United States Patent 8,541,208 (PROCESS FOR THE PRODUCTION OF FINE CHEMICALS) - sequence listing, part 7

SEQ ID NO: 27488 - protein, 296 aa, Desulfotalea psychrophila
MSSQLFVQYLLAGITYGSMYAIVAIGFNIIYNTTGIINFAQGEFVMLGGMLSISLLQFMPLPLAIGLAVVLTMAVGGLVEILFIRWLKNPGVLRMIVITVGLSILLREIALHIWGEGVYSLPYFYGNEISTVVILGARVSPQILWVIGVCLLLVVLLHLFFKTSPMGREMRACAVNKKAALLCGINARNMVTFSFMLSAGIGALAGAVMSPITYTQYDSGAALAIKGFTVAILGGLGNLFGAVAAGILLGVLEAFSVSVLPLAFQDAIAISLLLVILCVRPHGLFGSATAAGLKDF

SEQ ID NO: 27489 - DNA, 882 bp, Acinetobacter sp
  CDS (1)..(882)
atgaatttttttctagaagtgctgctcggtggaacactggcaggtgtgatgtattcacttgtggcgataggctttgttcttatttatagagcctcgggagtttttaactttgcgcaaggtgcattggtgctattttcagcattaacctttgtgaatttaactgaacacggtgtgccttttatcgttgcctttgcagtcaccttatttattatttttattgtggtgttactcattgatgcattggtgttaaagcatctagtgaatcgttcagtgattacgctttttatggcgacattaggcttaagttatgtgcttgaggggactgcacaagcagtatggggaacacaggtacatgggctcgacttgggaattagtgatgttcctatcgacttttatggaatccatctaagtaaatttgatcttgttgcaactttgattgcaggcagtcttgtcattattttatcgtttttatttaccaagactcgatttggtatatcgcttagagcagttgctgatgatcctttggcttcacaatctgtcggaattcgattgaattacatctggattttggtgtggagtgtcgctggattagttgcactggtcgctggattactctggggcgcacgtttaggtgtgcaattttcactgtcactcgtggttttaaaagcattacctgtattgatcattggtggatttacgtccattacgggtgccattgtaggtggtttgattattggtgcgagtgaaaagcttgccgagatttatctaggaagtttgatcgggagtggcatagaaaactggtttccatacctcatcgcaattttatttttactgatacgtccgacagggctatttggtgaacaacaagttgcgagggtataa

SEQ ID NO: 27490 - protein, 293 aa, Acinetobacter sp
MNFFLEVLLGGTLAGVMYSLVAIGFVLIYRASGVFNFAQGALVLFSALTFVNLTEHGVPFIVAFAVTLFIIFIVVLLIDALVLKHLVNRSVITLFMATLGLSYVLEGTAQAVWGTQVHGLDLGISDVPIDFYGIHLSKFDLVATLIAGSLVIILSFLFTKTRFGISLRAVADDPLASQSVGIRLNYIWILVWSVAGLVALVAGLLWGARLGVQFSLSLVVLKALPVLIIGGFTSITGAIVGGLIIGASEKLAEIYLGSLIGSGIENWFPYLIAILFLLIRPTGLFGEQQVARV

SEQ ID NO: 27491 - DNA, 1647 bp, Acinetobacter sp
  CDS (1)..(1647)
atgatgatcaaagattatcggatctgggtggtgttgtgtttagtactacaattagggtgcatttctgcgtgggcagcagaagaaacccatcctgtagctgataatacacctgccattcatagcctacagcaagaagatgcgattcaacagtttgtaaaatctgattttaatactcgtcgaatgatgctcaatcaatggcctgcaagtattgaaatacttgataaacttgtgacttatattgatgaaaatgagttatatacagatagcgcaggacatacctatctattaaaaaatgatgagactttactgagttatccagatgaaaaaattataaaagactggcccgcagatttatcacaagtcactttagtcaatacattgcgtaaagccttaacttttggtcaagcaaaagccaagctgaactctgaagatgcgacccaacgattacgtgcagtcgatattttagaaaataatatttctgagctagatactcaatttatccgacagctttacttaaaagaaaccaataacacagtaaaagcacgtcttgcacagcttaaagcacgactcgattttgatagttctgatattttagtcaaaatcgatgctgtaaaagtgttatcggaatcgaatcgtcctgatgtacttgcgttaatggaacaagaattacaacaaccacaattaaacccagagcttaaagcaaccttacttgatgcaaaaaataaaatcaaaacacgcatacaaatcagtgagtggtctggtcatgtcttttcagggttaagtacagccagtattttgctgctagcagcacttggacttgcaattacttatgggttattaggcgtaattaatatggcgcatggtgagctgattatgattggtgcctataccacatatgtcgtgcaaagcctgtttaaagctcatcttgctcactgggtagattggtatttgctgattgccattccagccgcatttatcgtgagtgcactcattggcatgctgatcgaacgcacgattatacggccgctgtatggtcgtcaattagaaacgttacttgcaacttttggtgtaagtctaattttgatgcaagccgtacgtatggtttttggtgctcaaaacgtggaagtatcaaatatcacatggttaagcggcggtatagcactgacgccaagccttatgctgccttataaccgtattgcgattatcgtgtttacagtcactattttgctgctattggtatttttactcaataaaacacgttttggtttattcattcgcgccgttacccaaaatcgtcaaatggcaagagcggttggaattcgttcggcacgtatcgatatgatggcttttggtctgggatcaggccttgctggactggcaggctgtgctttggcgcaagtgggtaatgttgggccagatctaggtcaaaactatattatcgatgcttttctggtggtggtcgtgggtggtgtaggtcaagtctggggtgctgtattggcagcattgggtttgggcgtaagtggaacaattctagaaattggtttaggtgcagtattggccaaaattattctgttggttcttgtgattttgtttattcaaaaacgtccacaaggtttatttgcaatcaaaggccgttttgtggagtaa

SEQ ID NO: 27492 - protein, 548 aa, Acinetobacter sp
MMIKDYRIWVVLCLVLQLGCISAWAAEETHPVADNTPAIHSLQQEDAIQQFVKSDFNTRRMMLNQWPASIEILDKLVTYIDENELYTDSAGHTYLLKNDETLLSYPDEKIIKDWPADLSQVTLVNTLRKALTFGQAKAKLNSEDATQRLRAVDILENNISELDTQFIRQLYLKETNNTVKARLAQLKARLDFDSSDILVKIDAVKVLSESNRPDVLALMEQELQQPQLNPELKATLLDAKNKIKTRIQISEWSGHVFSGLSTASILLLAALGLAITYGLLGVINMAHGELIMIGAYTTYVVQSLFKAHLAHWVDWYLLIAIPAAFIVSALIGMLIERTIIRPLYGRQLETLLATFGVSLILMQAVRMVFGAQNVEVSNITWLSGGIALTPSLMLPYNRIAIIVFTVTILLLLVFLLNKTRFGLFIRAVTQNRQMARAVGIRSARIDMMAFGLGSGLAGLAGCALAQVGNVGPDLGQNYIIDAFLVVVVGGVGQVWGAVLAALGLGVSGTILEIGLGAVLAKIILLVLVILFIQKRPQGLFAIKGRFVE

SEQ ID NO: 27493 - DNA, 1059 bp, Bartonella quintana
  CDS (1)..(1059)
atgacaaaatcagcttcaacttttctatcatgtatcagtattctcgttcttatcggttttttgttttatgctgataatcattttaatgactacacacttcgtgtcatcaatcttattgctatcaatgcgatattggcaatttcgcttaatttgatttatggtttcacgggtatgttttctcttggacatgctggcttcatggccattggtgcttatgtatgcgcaattttacttctctctcctgaacaaaaagaaatgatgtggattctcgaacctatagctgagccgttgcattatttgcagttacctttttttgtggctgttgttataagtggtctgtgtgctgcagttatagggttattagttgctcttcctatattacgtcttggtggcgattatcttggaattgcaacattgggttttgcagaaattattcgcattgttattacaaacgcaacatctctaacaaatggttctttgggaatcaaagggatacctcaaaatgctacattatggtggaactatggttggttagcatttacggttacctttattgttctcttactgcgaagcaatgctggtaatgtactgcgcgctattcgtgacgatgaaatcgctgcgaaaacaatgggtatcaacgcttttttctaccgtagcttttcctttactgttggtgcattttttgcagggatcggaggagcattaacggctgctcttatttcaactatcgatcccaaaatgttcaactttctcctaacctttaatattttgatgattgttgttgctggtggtcttggttcgattacaggcagtgttataagtagtgttattgttacagctatgcttgaatggcttcgtatcattgaaagtccatttgacttaggttttatatatattccagaaataccaggacttcgtatggttgttttttctcttttattgttagtaattatcttattttggcgaaaaggattgctgggacaacgtgaattctcatggaattggatttatggttttttgacacgaaagaagctccctaatactgagggaaagctatga

SEQ ID NO: 27494 - protein, 352 aa, Bartonella quintana
MTKSASTFLSCISILVLIGFLFYADNHFNDYTLRVINLIAINAILAISLNLIYGFTGMFSLGHAGFMAIGAYVCAILLLSPEQKEMMWILEPIAEPLHYLQLPFFVAVVISGLCAAVIGLLVALPILRLGGDYLGIATLGFAEIIRIVITNATSLTNGSLGIKGIPQNATLWWNYGWLAFTVTFIVLLLRSNAGNVLRAIRDDEIAAKTMGINAFFYRSFSFTVGAFFAGIGGALTAALISTIDPKMFNFLLTFNILMIVVAGGLGSITGSVISSVIVTAMLEWLRIIESPFDLGFIYIPEIPGLRMVVFSLLLLVIILFWRKGLLGQREFSWNWIYGFLTRKKLPNTEGKL

SEQ ID NO: 27495 - DNA, 1065 bp, Bartonella quintana
  CDS (1)..(1065)
atgttcatccagtatttttttaatgcactggcattgggatctctttacgggcttattgccattggttatactatgatctatggtattctaaggctcattaattttgttcacggcgatatctttatgctgggggcatattttgttttcttttctacaattagctttatacctgcttgggctgctgttcttcttgtatcattagctattcttatttattattcagtatttatagggtttaaaaaacgcctttcaatttattggggtgttgcttttttaattcttattttagcattcatttattattttaaaattgccccacaagattttacgccaacttggattttagccctctgtttttcaattttcatcacaagtgcagtgggtattactattgatcaatttgcctacaaacctctgcgccatgctccccgtatttcagcgcttattggtgcgataggagtttccttttttattgaaaatcttgctacaattctctttagtggtgttcccaaaggtgtgaaacagccagattttcttgtaacgccgttcttatggcatttagggcaaagttcagatggaatcattagaattgctcctatgtctttgatcgttcccactatttcgtttattcttattgtgttactgctatggattattcataaaacaaaacctggtcttgctatgcgtgcaatctcacatgatatcgaaacgactcgtttgatgggtgtttctgtcaataaagtcattgcattcacatttgggataggctcagcactcgctgctattgcgggtatcatgtgggctctacgctatcctcaaattcaacctcatatgggtgttcttcctggcctcaaagcatttgttgcagctgttatcggaggtattggctcaattccaggagcaatgttggggggactgttactaggatttattgaaattatgattatcgcattctttcccattctatccggataccgagatgccttcgcctttattttattgattctgattttattgatgatgcccactggtttaatgggcaaaaaaagtcaggagaaaatctaa

SEQ ID NO: 27496 - protein, 354 aa, Bartonella quintana
MFIQYFFNALALGSLYGLIAIGYTMIYGILRLINFVHGDIFMLGAYFVFFSTISFIPAWAAVLLVSLAILIYYSVFIGFKKRLSIYWGVAFLILILAFIYYFKIAPQDFTPTWILALCFSIFITSAVGITIDQFAYKPLRHAPRISALIGAIGVSFFIENLATILFSGVPKGVKQPDFLVTPFLWHLGQSSDGIIRIAPMSLIVPTISFILIVLLLWIIHKTKPGLAMRAISHDIETTRLMGVSVNKVIAFTFGIGSALAAIAGIMWALRYPQIQPHMGVLPGLKAFVAAVIGGIGSIPGAMLGGLLLGFIEIMIIAFFPILSGYRDAFAFILLILILLMMPTGLMGKKSQEKI

SEQ ID NO: 27497 - DNA, 1065 bp, Bartonella henselae
  CDS (1)..(1065)
atgttcatccagtatttttttaatgcacttgcattgggggctctttatgggcttatcgcaattggttacaccatggtctatggtattctaagactcattaatttcgctcatggtgatatctttatgctaggggcgtattttgttttcttttccacaatcagctttatgcctgcttgggctgctgttcttcttatattattggctcttttcatttattattcagtatttatagggtttaaaaaacgccctaaaatttattgggttgctgttttttttgcttttattttaacgttcatttattattttaaaattgctccacaagattttacaccgatttggattttagctctctgtttttcaatttttatcacaagtgcagtgggtattactattgaccagtttgcctataaaccactgcgtcatgctccacgtatttcagcgcttattggtgcaataggagtttccttttttattgaaaatcttgctactgtaatctttagtggtgtcccaaagggtgtaaaacagccagattttcttgtcacaccattcctatggcatttaggatcaggggaaaatggaattattagaattgctcccatgtctctgatcgttcccattgtttcatttattcttatcgtgttattgctatggattatccataagacaaaacctggtcttgctatgcgtgcaatttcccacgatattgaaacgactcgtttgatgggtgtttctgtcaataaagtcatcgcacttacctttgggataggctcagcacttgctgctattgcaggcatcatgtgggctttacgctatcctcaagttcaaccttatatgggtattcttcctggactcaaagcatttatagcagccgttatcggaggcattggttcaattccaggagcaatgttgggggggctgttactaggatttattgaaattatgattgtcgcattctttcctgctctatccggatatagagatgcttttgcctttattttattaattctgattttattagtaatgcccactggtttaatgggcaaaaaaaatcaggagaaaatctaa

SEQ ID NO: 27498 - protein, 354 aa, Bartonella henselae
MFIQYFFNALALGALYGLIAIGYTMVYGILRLINFAHGDIFMLGAYFVFFSTISFMPAWAAVLLILLALFIYYSVFIGFKKRPKIYWVAVFFAFILTFIYYFKIAPQDFTPIWILALCFSIFITSAVGITIDQFAYKPLRHAPRISALIGAIGVSFFIENLATVIFSGVPKGVKQPDFLVTPFLWHLGSGENGIIRIAPMSLIVPIVSFILIVLLLWIIHKTKPGLAMRAISHDIETTRLMGVSVNKVIALTFGIGSALAAIAGIMWALRYPQVQPYMGILPGLKAFIAAVIGGIGSIPGAMLGGLLLGFIEIMIVAFFPALSGYRDAFAFILLILILLVMPTGLMGKKNQEKI

SEQ ID NO: 27499 - DNA, 1059 bp, Bartonella henselae
  CDS (1)..(1059)
atggcaaaatcagcttcaacttttttatcatgtatcagtattcttttttttatcggttttttattttatgctgataaccattttaatgagtacacacttcgtgtcatcaaccttattgctatcaatgcgatattggcaatttcgcttaatttgatttacggtttcaccgggatgttttctcttggacatgctggattcatggctattggtgcttatgtatgcgcgattttacttctttctcctgaacaaaaagaaatgatgtggattcttgaacctatagctgagccattgcatgatctacagttacctttttttgtaactgttgttgtaagtggtctgtgtgctgcagttgtaggtttattaattgctcttcctatcttacgtcttggcggagattatcttggaattgcaacgttgggttttgcagaaattattcgcattgttattacaaacgcgacatccgtaacaaatggttctttaggaatcaaaggaatacctcaaaatgcgacattatggtggaactatagttggttagtatttacggttaccttcattattctcttactgcgaagcaatactggtaatgtactgcgcgctattcgtgatgatgaaatcgctgcgaaaacaatggggattaacgcttttttctaccgtagcttttcctttactgcaggtgcattctttgcaggtgtcggaggagcattaatggccgctcttatttcaacaatcgatccaaaaatgttcaacttccttctaacttttaatattttgatgattgttgttgctggtggtcttggttcgattacaggtagcattattggcagcattattattacggtcatgcttgaatggcttcgcattatcgagagtccatttgacttaggttttatacatattccagagacaccagggcttaggatggttattttttctcttttattgctcgtcattatcttattttggagaagaggtttattgggacaacgtgaattctcatggagcgggatttatagcttttttacacgcaaaaagttctctaatactgaggaaaagctatga

SEQ ID NO: 27500 - protein, 352 aa, Bartonella henselae
MAKSASTFLSCISILFFIGFLFYADNHFNEYTLRVINLIAINAILAISLNLIYGFTGMFSLGHAGFMAIGAYVCAILLLSPEQKEMMWILEPIAEPLHDLQLPFFVTVVVSGLCAAVVGLLIALPILRLGGDYLGIATLGFAEIIRIVITNATSVTNGSLGIKGIPQNATLWWNYSWLVFTVTFIILLLRSNTGNVLRAIRDDEIAAKTMGINAFFYRSFSFTAGAFFAGVGGALMAALISTIDPKMFNFLLTFNILMIVVAGGLGSITGSIIGSIIITVMLEWLRIIESPFDLGFIHIPETPGLRMVIFSLLLLVIILFWRRGLLGQREFSWSGIYSFFTRKKFSNTEEKL

SEQ ID NO: 27501 - DNA, 861 bp, Bacillus thuringiensis
  CDS (1)..(861)
atggatgtgttaatcaatttatttgtaaatgggatttcaacagggatgctcatttttttattagcatcaggtctttcccttattttcggtttaatgagtgttctaaactttgcacatggtggtttatttgcatggggagcgtttacaggtgtttggttatttaatatgacaggtagttacgtattagcattaattggagcagtagctatgggaatgttccttggattcattttagaaagattccttattagaccggtatatggaaatcatgttcgccagcttcttgttacgcttggaggaatgcttgtacttagtgaatgtattaaagtattttggggaccaaatccaattggggcaaagttaccgttatggctacaaggaagttttacattcggaggcgttatattaattaaatatcgtctatttgttattttaattgggattatcatttacgttgccttactattattgctcaaaaaaacaaagataggtcttatgatacgcgcaggtgtaatggataaagagatggttcaagcgctcggtattaacgtaaaagcgatattttctttcgtctttttattaggagcagggatggcagcgttgggaggtttcttattagcaccgtattcaggtgttattttcgccgaaatgggtatgcagtatgcgattttagctttcatagtagtaatcattggaggattaggaagcgtacaaggttcagcaattgcttctttaattgtcggattagctggtgcttttacagcgtattttataccggatttatcacttgcaatcaatatgttaatgctactgtttttcttaatcgtgaagccaaatgggcttgttggtgaaaaggggtga

SEQ ID NO: 27502 - protein, 286 aa, Bacillus thuringiensis
MDVLINLFVNGISTGMLIFLLASGLSLIFGLMSVLNFAHGGLFAWGAFTGVWLFNMTGSYVLALIGAVAMGMFLGFILERFLIRPVYGNHVRQLLVTLGGMLVLSECIKVFWGPNPIGAKLPLWLQGSFTFGGVILIKYRLFVILIGIIIYVALLLLLKKTKIGLMIRAGVMDKEMVQALGINVKAIFSFVFLLGAGMAALGGFLLAPYSGVIFAEMGMQYAILAFIVVIIGGLGSVQGSAIASLIVGLAGAFTAYFIPDLSLAINMLMLLFFLIVKPNGLVGEKG

SEQ ID NO: 27503 - DNA, 972 bp, Bdellovibrio bacteriovorus
  CDS (1)..(972)
atgaaagccttaaaaaacccggcactgacactgctttgtctggcggtcctgggacttggactggattttggcgtcaatgcctacatcaaactgatcctgctttttgccactgtgaactgcctgctgtcgatgagtctgaatctggtcaatggttacaccggacagttttctttggggcacgcaggttttatggcgatcggggcttacttttccgcttacgcttccaccaagtggggctttctgcctgaatccctgcaactgcttcaatcctttgtctttgtcatcggtgcgggtcttgccgctgcggtggctggctttctggtgggtctgccttcattgcgtttgaagggtgactatctggccattgtcactctgggttttggcgaaatcatccgcgtggcgctgctgaatatggatttcctggggggaccgcgcggtctttccggcattcccagctttggttcattcccgtttgcctttatgtttgcatccgtgtggctggtgatttgtttcttcaccatctggcgggtcatgcattccagtcacgggcgcgggttcttgagtgtgcgtgaagacgagatcgctgcggaagccatgggtatcaacaccacccgcatgaaagtaaaagcttttgtgctttccagcttctttgccggtgtggcgggggctttgtttgcgcactttactaatttcatcaatccatcctctttcaccttcctgcaaagtgtgaatgccgtgatcatggtggttctgggtggcatgggttccatgaccggctccatcgtggcggcggtcatcatcaccgttttgccagaagccctgcgcccgctgcaagaactgaccggtgtggatctgcgcatggtgatctattccctggctttgattctgatgatgattcttcgaccaaaaggtttgttcggggatatggaattcagcgatgtttggagaaaatatgtccgacgttctgcttga

SEQ ID NO: 27504 - protein, 323 aa, Bdellovibrio bacteriovorus
MKALKNPALTLLCLAVLGLGLDFGVNAYIKLILLFATVNCLLSMSLNLVNGYTGQFSLGHAGFMAIGAYFSAYASTKWGFLPESLQLLQSFVFVIGAGLAAAVAGFLVGLPSLRLKGDYLAIVTLGFGEIIRVALLNMDFLGGPRGLSGIPSFGSFPFAFMFASVWLVICFFTIWRVMHSSHGRGFLSVREDEIAAEAMGINTTRMKVKAFVLSSFFAGVAGALFAHFTNFINPSSFTFLQSVNAVIMVVLGGMGSMTGSIVAAVIITVLPEALRPLQELTGVDLRMVIYSLALILMMILRPKGLFGDMEFSDVWRKYVRRSA

SEQ ID NO: 27505 - DNA, 903 bp, Bdellovibrio bacteriovorus
  CDS (1)..(903)
atgcaggatttcgtacagcatttgatcaacggagtgagccttggatccatctacgcattgatcgccctgggctacacgatggtgtacggaatcctgaaaatgatcaacttcgcccactcggatgtttacatggtgggcgcctttgccgcctactatttcgcccgctggctgggaattgaaaacaaccccggcttcagcactcttctgaccctgattgtaatcacgatgatctgctgcagccttctggggctggtgattgaacgcctggcgtaccgcccgcttagaaactcaccaaaactgaacgtcctgatcaccgccattggtgtcagcttgtttttgcagtattccggtcaggtggtttttggagccgatcccaaagtctttcctgaagtcatgaaagactttgtgatcttctctatcggcatcgttgaagtccgctcttttgatgtgacggttctgggtgtgggcattgttgccatgctgggactgcagttcctgctgttcaaaacaaaaatgggccgtgccatgcgggcggtgagcgccaacccgatggtggccagcctgatgggtgtgaacccggaccgcattattgccttcacgtttgttgtcggatcctctctggccggaattggcagtgttctggtcggcatgaagtatcccaagattgacccgctgatgggcatgatgatcggcatgaaggcgtttgtcgccgcagttctgggtggcatcggcaacgtcggtggtgcggtcctgggtgcgatgatcatgggcctttccgaagaaatggtcgtggcttatctttccagcacctaccgtgatgctttggcctttggaattctgattgtgattctgatctttaagccggcaggtctgctgggtaaatactctgtggagaaggtctga

SEQ ID NO: 27506 - protein, 300 aa, Bdellovibrio bacteriovorus
MQDFVQHLINGVSLGSIYALIALGYTMVYGILKMINFAHSDVYMVGAFAAYYFARWLGIENNPGFSTLLTLIVITMICCSLLGLVIERLAYRPLRNSPKLNVLITAIGVSLFLQYSGQVVFGADPKVFPEVMKDFVIFSIGIVEVRSFDVTVLGVGIVAMLGLQFLLFKTKMGRAMRAVSANPMVASLMGVNPDRIIAFTFVVGSSLAGIGSVLVGMKYPKIDPLMGMMIGMKAFVAAVLGGIGNVGGAVLGAMIMGLSEEMVVAYLSSTYRDALAFGILIVILIFKPAGLLGKYSVEKV

SEQ ID NO: 27507 - DNA, 1068 bp, Rhodopseudomonas palustris
  CDS (1)..(1068)
atgatgatcctgtccggcgacccgccgcgcagccgggtgctgtcgctgctcctgatcacgatcgtggtggtgctggcgatcacgccgttcgtgtttcccggcgccaagccgctcaacgtcgccgccaagatctgcatcttcgcggccctggtggcgtcctatgatctgttgctcggctacaccggcacggtgtcgttcgcccacaccatgttctacggcatcggctcgtatgctgtggcgatcgcgctgtacggcatggggccgagctgggccgcggtcggcgccggcgtgctgatcggcctgccgctcgccgcgctcttggcgctcgtcatcgggttgttctcgctgcgggtcgaggcgatcttctttgcgatgatcacgctggcggtcgcctccgccttcctggtgctggcgtcgcagctgtcgtggctgaccggcggcgaggacggccgcagcttcagcctgccggagctgctgcggcccggcacggtgttcgtcaaagacttcttcggggtgcggatcaacggccgtatcctgacctactacatcatcctggtcggctgcgccggcatgatcctggcgctgctgcgggtggtgaactcgccgttcggccgggtgctgcaggcggtccgcgagaaccgcttccgtgccgaggcgctcggctatcgcaccgtgtttcatctgacttacgccaacgtgctggcggcgctggttgccgccgccgccggcgtgctgaatgcgatgtggctgcgctatgccgggccggacacctcgctgagcttctcgatcatgctcgacattctcttgatggtggtgatcggcggcatgggcacgatctacggcgccatcatcggcgccaccatcttcatcctggcgcagaactatctgcaggcgctgatgggcgcagcctcaggcgccgccgctgacgcggggctaccgttgctgccgaacctattacatccggaccgctggctgctgtggctcgggctgctgttcgtcgccagcgtctacttcttcccgaccggaatcgtcggccgattgcgcggggcaccgaaggtcgccgactag

SEQ ID NO: 27508 - protein, 355 aa, Rhodopseudomonas palustris
MMILSGDPPRSRVLSLLLITIVVVLAITPFVFPGAKPLNVAAKICIFAALVASYDLLLGYTGTVSFAHTMFYGIGSYAVAIALYGMGPSWAAVGAGVLIGLPLAALLALVIGLFSLRVEAIFFAMITLAVASAFLVLASQLSWLTGGEDGRSFSLPELLRPGTVFVKDFFGVRINGRILTYYIILVGCAGMILALLRVVNSPFGRVLQAVRENRFRAEALGYRTVFHLTYANVLAALVAAAAGVLNAMWLRYAGPDTSLSFSIMLDILLMVVIGGMGTIYGAIIGATIFILAQNYLQALMGAASGAAADAGLPLLPNLLHPDRWLLWLGLLFVASVYFFPTGIVGRLRGAPKVAD

SEQ ID NO: 27509 - DNA, 939 bp, Rhodopseudomonas palustris
  CDS (1)..(939)
atggattgccgggtcaagcccggcaatgacgaagtgggaatcaagatgaactcgcacctcctgatccagcttctcgtcaacggcctcgtggtcggcacgctatacggcgtggtcgcgatgagtttcgtgctgatctacaaggcgacgcaggtcgtcaacttcgcccaaggcgagctgctgctgatcggtgcctgggtgtgctggacgctgctggcgaaatatcagctgccgttctgggtcggcatgccgatcacgctggtgttcatgttcatcttcggcatcgcggttcagatcatcgtgctgcggccgatgatcggcgagccgatcatctcggtgatcatggtgacgatcgcgctgtcgaccgtgttccaggcggcgctgaagtggatcttcggcgtcaatccgcagccgttcccccagatcttcaccacccgatcgatctcgatcggcggcctgcagatccagaccgtctatgtgatgagcctggtcgtctcggtcgcgatgatgatcggcatggcgtggttcttcagggtgtcgaaatacggcctcgcgatgcgcgccaccgcgttcaaccagcaggtggcgcagtcgctcggcatctcggtgaagagcgtattcgcgatggcctgggcgatctcggccaccgtttcggcggtcgccggcgtcgtcgtcgccgtggtcaacggcgtgtcgtcggggctgtcggcctacggcatcaaggtgtttccggccgcgatcctcggcggcctcgactcgatcggcggcgcggtgctcggcggcatcatcatcggccttttggagaacatcgcccagtacgtcgacagcgaatatctgcactggggcaatctctacgaaatagcgccgttctacgtgctgatcatcatcctgatgatcaagccctacggcctgttcggcaccaaggacatcgagcggatctag

SEQ ID NO: 27510 - protein, 312 aa, Rhodopseudomonas palustris
MDCRVKPGNDEVGIKMNSHLLIQLLVNGLVVGTLYGVVAMSFVLIYKATQVVNFAQGELLLIGAWVCWTLLAKYQLPFWVGMPITLVFMFIFGIAVQIIVLRPMIGEPIISVIMVTIALSTVFQAALKWIFGVNPQPFPQIFTTRSISIGGLQIQTVYVMSLVVSVAMMIGMAWFFRVSKYGLAMRATAFNQQVAQSLGISVKSVFAMAWAISATVSAVAGVVVAVVNGVSSGLSAYGIKVFPAAILGGLDSIGGAVLGGIIIGLLENIAQYVDSEYLHWGNLYEIAPFYVLIIILMIKPYGLFGTKDIERI

SEQ ID NO: 27511 - DNA, 948 bp, Rhodopseudomonas palustris
  CDS (1)..(948)
atgctcgagctgatcgtcatttccaccctcaatggcgttctgtacggaatgctgctgttcttgatggcgagcgggctcaccgtcatcttcagcatgctcggcgtgctgaacttcgctcatgccagcttctatatgctcggcgccttcttcggctatcagatcagccgctggacaggattctggccggcgctgctgatcgcgccgctgctcgccggcgcgatcggcgccgcggtcgaacggttcggcctgcgccgcgtccaccgcaacggccatgtcgccgaactgctgttcaccttcgggctcgccttcgcgatcgaagaagtggtgtcgatcatctggggcaaggttccggtcgattaccgcaccccggccctgctcgacttcccggcattcacgatcttctccaccaactaccccgcctacaagatgttcatgctggcagtgtcggtggtgatcttcgtcggcctcctggtggtgctgaagaagacccggatcggcctgatcgttcaggcggcgctgacccacccacacatggtcgcgcatctcggccacaacgtcgaacggatcttcatgctggtgttcggcgtcggcactgcgctggccgccgttgccggcgtgatcgcgggcccgtcgctggtgacgcagtccaacatggcttcgctgctcgggccgatcctgttcgtcgtcgtcgtggtcggcggcctcggctcgttgcccggcgcattcatcgcctcgctgctgatcgggctgctgcagaccttcgcggtgtctatcaacgcttcgcccgcaacgctgttcggtccgctcggtcccgatctcgccgcctcctggctcaacgacatctggaacgtgaccatcgctcagatcgcaccgatcatgccgtatctgctgctcgtgctcatcctgatcttccggccgatggggctgttgggaacccgcgaaacatga

SEQ ID NO: 27512 - protein, 315 aa, Rhodopseudomonas palustris
MLELIVISTLNGVLYGMLLFLMASGLTVIFSMLGVLNFAHASFYMLGAFFGYQISRWTGFWPALLIAPLLAGAIGAAVERFGLRRVHRNGHVAELLFTFGLAFAIEEVVSIIWGKVPVDYRTPALLDFPAFTIFSTNYPAYKMFMLAVSVVIFVGLLVVLKKTRIGLIVQAALTHPHMVAHLGHNVERIFMLVFGVGTALAAVAGVIAGPSLVTQSNMASLLGPILFVVVVVGGLGSLPGAFIASLLIGLLQTFAVSINASPATLFGPLGPDLAASWLNDIWNVTIAQIAPIMPYLLLVLILIFRPMGLLGTRET

SEQ ID NO: 27513 - DNA, 948 bp, Rhodopseudomonas palustris
  CDS (1)..(948)
atgatgccgaacctgttcggacgccgatccgtcatcctgatcgcgctcgctgtggtgatggcggtgctgccgctgctgtttccatcgagctattacttccgcgtcgcctcgctggtctgggtctcggcactggcggcgatcggtctcaacattctgatgggtaaggccggccaggtcagcctcggccatgccggcttcttcggcatcggcgcttatgctgtggcgatcgggccggcgcatttgggcctcaacgcgctgcttgcagtgctggttggcgccctgctctccgccctgctggcatttctggtcggccggccgatcctgcggctgaaggggcattatctcgccatcgccacgctcgggctcggcgtgctggtggcgatggtcatcaccaccgaaagcggctggaccggaggccctgacggcatgccggtgccgaagctgtcgttgttcggctggcgcatttccggatcgaacacctggtattggatcacggccgggctgctgctgatcggcacctggttcgcactcaacctcgacgacacgccgaccgggcgcgccttccgcgccctgcacgacagcgagatcgccgcgcgcaccgcaggcgtgcatgtcgagcgcttcaagctacaggccttcgtcattgcggcggtgtacgcctcgattgccggctcggcgctggcgatgatgaatggcttcgtcaatccggatcaggccggcttcctgcattcggtcgagctggtgacgatggtggtgctcggcggcctcggctccatcgtcggcagtatcgttggcgccgcggtgctggtggtgctgccgcaactgctgacggtatttcaggactacgagcatttcctgctcggtctgatcatcatcgtgtcgatgatcttcatgcgtgacggcatggtgccgatgctggcgaagctgaccatgagggcgcggcgatga

SEQ ID NO: 27514 - protein, 315 aa, Rhodopseudomonas palustris
MMPNLFGRRSVILIALAVVMAVLPLLFPSSYYFRVASLVWVSALAAIGLNILMGKAGQVSLGHAGFFGIGAYAVAIGPAHLGLNALLAVLVGALLSALLAFLVGRPILRLKGHYLAIATLGLGVLVAMVITTESGWTGGPDGMPVPKLSLFGWRISGSNTWYWITAGLLLIGTWFALNLDDTPTGRAFRALHDSEIAARTAGVHVERFKLQAFVIAAVYASIAGSALAMMNGFVNPDQAGFLHSVELVTMVVLGGLGSIVGSIVGAAVLVVLPQLLTVFQDYEHFLLGLIIIVSMIFMRDGMVPMLAKLTMRARR

SEQ ID NO: 27515 - DNA, 873 bp, Rhodopseudomonas palustris
  CDS (1)..(873)
atgtccgaactgctgcaatttctgatctcggggctgacggtcggagcggtgtatgcgctggtcgcactcggcttcacgctggtctatcacgcctccgacgtcgtcaatttcgcccagggcgaattcgtcatgctcggcggcatggtcaccgtgtttgcgtatgcggccggcttgccgctgccgctggcggccttgctggcggtgatcgtcgcggtggtcgtcggcctgttactgtattggctggcgattgcgccggcccgcggcgcctcggcggtatcgctgatcatcatcaccatcggcgcctcgatcctgctgcgcggtgcggcgcagatcgtgttcgacaagcagttccacaagctgccggccttctccggcgatgcgccgatccacctgctcggcgcggtgatccagccgcagagcctgtgggtgctcggcggcgcggcgctcgtggtgctgacgctttactacgtgatggagcgaacgctgatcggcaaagccgtggtcgcgaccgccgccaaccggctcgcggcgcggctggtcggcgtcaacgtcgccaccgtgatggcgctggcgttcggcggctcggccgcgatcggcgccatcgccggcattctgatcaccccgatcacgctgaccagctacgacgtcggcacgctgctggcgctgaagggctttgcggcagcgatgctcggcggcatgggcaatccgctcggtgccgtgatcggcggcctgttgctgggcctgttggagtcgttcggcgccggctacgtgtcgtcgacctacaaggacgccatcgccttcatcgtcatcctcgccgtgctgttcgtcgcgccgcaggggctggtcggccgtcgcactgtcgagcgggtctga

SEQ ID NO: 27516 - protein, 290 aa, Rhodopseudomonas palustris
MSELLQFLISGLTVGAVYALVALGFTLVYHASDVVNFAQGEFVMLGGMVTVFAYAAGLPLPLAALLAVIVAVVVGLLLYWLAIAPARGASAVSLIIITIGASILLRGAAQIVFDKQFHKLPAFSGDAPIHLLGAVIQPQSLWVLGGAALVVLTLYYVMERTLIGKAVVATAANRLAARLVGVNVATVMALAFGGSAAIGAIAGILITPITLTSYDVGTLLALKGFAAAMLGGMGNPLGAVIGGLLLGLLESFGAGYVSSTYKDAIAFIVILAVLFVAPQGLVGRRTVERV

SEQ ID NO: 27517 - DNA, 918 bp, Rhodopseudomonas palustris
  CDS (1)..(918)
atggactatttcgcccagcagctcatcaacggtctcgtgctcggctcgatctatggcctgatcgcgatcggctacacgatggtgtacggcatcgtcggcatgatcaatttcgcccatggcgacatcttcatgatcggcggcttcatcgcgctgatcagcttcctgatcctggtgtcgttcggcctcaccttcgtcccgctcatcctcctggtggtgctgctggtgtcgatggcgatcaccgcgctgtacggctggacggtcgagcgcatagcgtaccgcccgttgcggcattcgttccgcctcgccccgatgctgtcggcgatcggcatgtcgttcgtgctgatgaactacgcccaggtgtcgcagggcgcccgcgtcaagccggtgccgccgatcatcaccggcggctatacgctgcacgagagcgccgacggcttcaacgtgcagctctccaacgtccagatccttgtggtggtcaccaccgtggtgctgctcggcatcttcacctggctggtggccaagacccggctcggccgcgacatgcgcgcctgcgagcaggatcagaccatggctgcgctgctcggcgtcgacgtcgaccgcaccatctcgatgaccttcgtgatcggcgccgcgctcgcctcggtcgcgggcatgatgtacctgctgtattacgggctgatcgacttcttcatgggcttcatcgccggcatcaaggctttcaccgcggctgtgctcggcggcatcggctcgctgcccggcgcgatgctcggcggcctgttgatcggcctgatcgagaccttctggtcggcctatttctcggtcgagtacaaggacgttgcggcgttctcgatcctgatcatcgtgctgatcttcatgccgaccggcctgctgggccggccggaagtcgaaaaagtctga

SEQ ID NO: 27518 - protein, 305 aa, Rhodopseudomonas palustris
MDYFAQQLINGLVLGSIYGLIAIGYTMVYGIVGMINFAHGDIFMIGGFIALISFLILVSFGLTFVPLILLVVLLVSMAITALYGWTVERIAYRPLRHSFRLAPMLSAIGMSFVLMNYAQVSQGARVKPVPPIITGGYTLHESADGFNVQLSNVQILVVVTTVVLLGIFTWLVAKTRLGRDMRACEQDQTMAALLGVDVDRTISMTFVIGAALASVAGMMYLLYYGLIDFFMGFIAGIKAFTAAVLGGIGSLPGAMLGGLLIGLIETFWSAYFSVEYKDVAAFSILIIVLIFMPTGLLGRPEVEKV

SEQ ID NO: 27519 - DNA, 1614 bp, Rhodopseudomonas palustris
  CDS (1)..(1614)
atgcctctcatccatctgacgcgcattctatttgccgcagtcgcgatcgcgttcgtcactctggggagcctgccggcggtggccggtccctatgaggacgccatcgcgcaattcgcccaagattccttcaccgacagcgaggacgcgatcggcaagctggtcgccagcggcaatccgcgcgccgcggtgatcatcaccgcgctgcaggacggcaagctctacgccgacccggacagcaaagcggccttcatcaagaccgacgacggcaagatcgccaatgcggcgaccggcgaggcggtcggtgcgctgccggccaaggccagcgcggttcggctcaacaacaagctgcgccgcgtcgtcgccggcgcgatggccggcctgacgctgctgtcgccggatctcgacaagcggctgcaggctgcgcaatcggtattcaagtcgcacgacgagaccatgctgccgaccgtcgaggcggcgctgaaggcggaaaagaacgccgccgccaagcgcgccttcaccgaagcgcgggcgtcgatcctgctgttcaagcagggcgcctccgatgccgacaagctggacgcgatcgccaccatcaaggcgcgcggcgatcaggaggcgatggcgctgctcaccggcgcgccgtcgaaccagagcgccgccgtcgccagcggcatcgccggcgccaaggcggcgatcgagcgcaatctggcgatctggtcgatggtgcagaacgcctggtatggactgtcgctcggctcggttctactgcttgccgcgatcggcctcgccatcaccttcggtgtgatgggcgtcatcaacatggcgcatggcgagatggtgatgctcggggcctacaccaccttcgtggtgcaggaggcgatccgcacgcgttatccggcgctgttcgactattctttgttgattgcggtcccgctcgcgttcctcgttgccggcgcagtcggcgttctgatcgaacgcaccgtgatccgcttcctctacggccgtccgctggagaccttgctcgccacctggggactgtcgctgatcctgcagcaggcggtgcgcacgctgttcggccccaccaatcgcgaggtcggcaatccgagctggatgagcggtgcgttcgaactcggcgagatgaccatcacttacaaccggctgtggatcctgtgcttcacgctggcggtgttcgccctgctgctggcgatgctgcgctacacctcgctcggcctggagatgcgcgcggtgacgcagaaccgccgtatggccgcgtcgatgggcattgccacgtcgcgggtcgacgcgctgacgttcggactcggctccggcatcgccggcattgccggtgtggcgctgtcgcagatcgacaacgtctcgccgaacctcggccagagctacatcatcgacagcttcatggtggtggtgttcggcggcgtcggaaacctgtggggcacgctggtcggcgccttctcgctcggcatcgccaacaagttcctggagccggtcgccggcgccgtgctaggcaagatcgccatcctggtgctgatcatcctgttcatccaaaagcgcccccgcggcctgttcgcgctcaagggccgggcggtggaggcatga

SEQ ID NO: 27520 - protein, 537 aa, Rhodopseudomonas palustris
MPLIHLTRILFAAVAIAFVTLGSLPAVAGPYEDAIAQFAQDSFTDSEDAIGKLVASGNPRAAVIITALQDGKLYADPDSKAAFIKTDDGKIANAATGEAVGALPAKASAVRLNNKLRRVVAGAMAGLTLLSPDLDKRLQAAQSVFKSHDETMLPTVEAALKAEKNAAAKRAFTEARASILLFKQGASDADKLDAIATIKARGDQEAMALLTGAPSNQSAAVASGIAGAKAAIERNLAIWSMVQNAWYGLSLGSVLLLAAIGLAITFGVMGVINMAHGEMVMLGAYTTFVVQEAIRTRYPALFDYSLLIAVPLAFLVAGAVGVLIERTVIRFLYGRPLETLLATWGLSLILQQAVRTLFGPTNREVGNPSWMSGAFELGEMTITYNRLWILCFTLAVFALLLAMLRYTSLGLEMRAVTQNRRMAASMGIATSRVDALTFGLGSGIAGIAGVALSQIDNVSPNLGQSYIIDSFMVVVFGGVGNLWGTLVGAFSLGIANKFLEPVAGAVLGKIAILVLIILFIQKRPRGLFALKGRAVEA

SEQ ID NO: 27521 - DNA, 1008 bp, Rhodopseudomonas palustris
  CDS (1)..(1008)
atggacgcgatcgttctgcagatcctgaacggcctcgacaaaggaggggcctatgcgctgatcgcgctcgggctgaccttggccttcggcacgctcggcgtggtgaacttcgcccacggcgcgctgttcatgctcggcgcgttctgcgccgtggtgttcaacaagtttctgacgctggagatcgtcaagatcgatccgacgcggacgacgccctggggctcgccgctggaggtcaagacgccgtatgtccaggcgatgctgggcgattggggtaaggtgctgatcgattactcggtgccggtctcgattctgctcgccattccggtgatgctgctgatcggcatcctgatcgagcgcggcctgatccggttcttctacaagcgcccacacgccgaccagatcctggtcactttcggccttgccatcgtgctgcaggagatcgtcaagcacttcttcggcgccaatccgatcgcgcagtcggcgccagcgttgttctccggctcgctgcagatcaccgaggcgatcgtctatccatactggcgcatcgtctatctatgcttctcgctggtggtgatcggctcggtctttgccttcctccagctcaccaccttcggcatggtggtgcgcgccggcatgcaggaccgggaaaccgtcggcctgctcggcatcaatatcgagcggcgcttcaccatcgtgttcggccttgcggcgatcgtcgcgggtctggccggtgtgatgtacacgccgatcgtgccacccgactatcacatgggcatggacttcctggtgctgtcgttcgtcgtcgtcgtggtgggcggcatggggtcgctgccgggcgcggtgctggccggcttcctgctcggcatcctgcagtcgttcgcctcgatgaacgagatcaaaggcctgctgccgggcatcgatcagatcatcatctatctggtcgccgtggtggtgttgttggtgcgtccgcgcggtttgctgggacgcaagggcgtgatggagagctga

SEQ ID NO: 27522 - protein, 335 aa, Rhodopseudomonas palustris
MDAIVLQILNGLDKGGAYALIALGLTLAFGTLGVVNFAHGALFMLGAFCAVVFNKFLTLEIVKIDPTRTTPWGSPLEVKTPYVQAMLGDWGKVLIDYSVPVSILLAIPVMLLIGILIERGLIRFFYKRPHADQILVTFGLAIVLQEIVKHFFGANPIAQSAPALFSGSLQITEAIVYPYWRIVYLCFSLVVIGSVFAFLQLTTFGMVVRAGMQDRETVGLLGINIERRFTIVFGLAAIVAGLAGVMYTPIVPPDYHMGMDFLVLSFVVVVVGGMGSLPGAVLAGFLLGILQSFASMNEIKGLLPGIDQIIIYLVAVVVLLVRPRGLLGRKGVMES

SEQ ID NO: 27523 - DNA, 873 bp, Rhodopseudomonas palustris
  CDS (1)..(873)
atggacatcgccaccttcgccttcgcggcgctgtatcaattcgccgacgcctttgccttcctggtgctgtcggcctgcgggctcgccgtcatcttcggcatgatgggcgtcatcaatctcgcccacggcgagttcatcatgtgtggcgcctacgtcaccgccaccgcggctcacgccggactgccgctgccgctcgccattctgaccggtgcgctggtttcggcgatggtcggcatgctggtcgagttcgtggtggtgcggcatctctatgaacgcccgctcgacaccatcgtcgccacctggggcctcagcctgatcgcgacgcaaggcacactgatcgtgatcggctcgaccatggctggtgtcggtacgccgttcggcagttttcaggtcggcgcctattcctattcgatctaccggatcgtgctgtttctggccgcgctcggcgtgctcggcgggctgtacgcggtgttcaactggacatccttcggcgtcaaagcacgcgccaccatccaggtgccgcacatggcggatgcgctcggcgtcgacacccgctggatctacagcctgaccttcgcctgcggcgccgggctcgccggactggccggcgggctgtacgcgccgaccatgacattggtgccgacgatgggcgcgaccttcctgatggaggcgttcgtcacggtggtgatcggcggcgcggacgtgttcctcggcacggcgccggctgctgcagtcctggctgtggtgaagtcggcgatgacgtcatggcagggccagttgttcggtcaaatcggcctgttggtcgcggtgatcatcgtggttcgggtgctgccgaaaggcatctccggcttcctgctgcgtgaacggacctga

SEQ ID NO: 27524 - protein, 290 aa, Rhodopseudomonas palustris
MDIATFAFAALYQFADAFAFLVLSACGLAVIFGMMGVINLAHGEFIMCGAYVTATAAHAGLPLPLAILTGALVSAMVGMLVEFVVVRHLYERPLDTIVATWGLSLIATQGTLIVIGSTMAGVGTPFGSFQVGAYSYSIYRIVLFLAALGVLGGLYAVFNWTSFGVKARATIQVPHMADALGVDTRWIYSLTFACGAGLAGLAGGLYAPTMTLVPTMGATFLMEAFVTVVIGGADVFLGTAPAAAVLAVVKSAMTSWQGQLFGQIGLLVAVIIVVRVLPKGISGFLLRERT

SEQ ID NO: 27525 - DNA, 876 bp, Rhodopseudomonas palustris
  CDS (1)..(876)
atggatatcaatgtccccgctctgttggcgcagcttctggtcggcctgatcaacggttcgttctacgcgctgctcagcctcggcctcgccgtgatcttcggcatgctcaacatcatcaacttcgcgcacggcgcgttgtacatgatgggcgcgttctgcgcctatttcctgctcaatctgctcggcctgaactattggtgggcgctgattctgtcgccgatcatcgtcggcctgttcggcatggtgatggagcgcacgctgctacaatggctgtcggggctcgatcacctctacggcctgctgctcaccttcggcgtggcgctgatcatccagggcgtgttccagaactatttcggttcatccggcctgccttatgcgatccccgaacagctccgcggcgcgatcaatctcggcttcatgtatctgccggtgtatcgcggctgggtggtggtgttctcgctggtggtgtgcctgctcacttggttcctgatcgagcgtacccggctcggcgcctatttgcgcgccgccaccgagaacccgacgctggtgcgcgcgttcggcatcaacgtgccgcggatgatcacgctgacctacggcctcggcgtgggcctggccgcgcttgccggcgtgctgtctgcgccgatcaaccaagtccgcccgctgatgggcgccgacctgatcatcgtggtgttcgccgtggtggtgatcggcggcatgggctcgatcatgggctcgatcatcaccggcttcgctctcggcgtcgtcgagggcttgaccaagtatttctaccccgaggcctccaacaccgtggtgttcgtgctgatggtgctggtgctgcttgtgaaaccctcgggcctgaccggacgggcaacctga

SEQ ID NO: 27526 - protein, 291 aa, Rhodopseudomonas palustris
MDINVPALLAQLLVGLINGSFYALLSLGLAVIFGMLNIINFAHGALYMMGAFCAYFLLNLLGLNYWWALILSPIIVGLFGMVMERTLLQWLSGLDHLYGLLLTFGVALIIQGVFQNYFGSSGLPYAIPEQLRGAINLGFMYLPVYRGWVVVFSLVVCLLTWFLIERTRLGAYLRAATENPTLVRAFGINVPRMITLTYGLGVGLAALAGVLSAPINQVRPLMGADLIIVVFAVVVIGGMGSIMGSIITGFALGVVEGLTKYFYPEASNTVVFVLMVLVLLVKPSGLTGRAT

SEQ ID NO: 27527 - DNA, 1041 bp, Rhodopseudomonas palustris
  CDS (1)..(1041)
atgaacaccacgattctgctgttccttgttcaggacggtatcaccaacggcgcgatctacgcactgctcgggctggcgctggtgctggtctttgcggtcacccgggtgatcctgatcccccagggtgaattcatcacattcggcgctctcacctacgcgacgctgtcggccggcggcgtgccgggcaccgcgcagcttgcgctgatgatgggcctggtggcgttcggcttcgagctgttcagcgcccgtaaatcgctgcatgtcgccaaagtgatgcgcgcggcgctgatctacatcgccttcccggcgatcgtgctggcgctggcgacctggctgccggcgcataaaccgggcgtcgccgtcaacatcgcgctgtcgctgctgatcgtcgccgcgatcgggctgtttctgtatcgcatcgccttccagccgctggcgcacacttcggtgctggtgctgctgatcgcctcggtcggctgccacttggcgctgcagggcttcggcctggtcttcttcggcgccgaaggcctgcgcggcccaccgctgtcggacgtggcgctcagcgtcggaccgttgctattcaccggccagagcctcgcggtgtacggcatcacgctggcgctgatggcggcgctgtggctgttcttcggctacacccgctacggcaaggcgctgcgcgccaccgcggtcaaccggctcggcgcgcgactggtcggcatccgtacctcgctctccggccagatcgcgttcctgctcgcctcggtaatcggcgcgatctccggcatcctgatcgtaccgatcaccacactctattacgataccggcttcctgatcggcctcaagggcttcgtcgccgcgatcatcggcggactggtcagctatccgctcaccgccatcgccgcgatcgtggtcggtatcgtcgagtcgttctcctcgttctatgcctcgaactacaaggaggtcatcgtcttcacgctgatcctgccggtgctggtgctgcgctcgctcgccacccccgcggtcgaagaagagaaggactaa

SEQ ID NO: 27528 - protein, 346 aa, Rhodopseudomonas palustris
MNTTILLFLVQDGITNGAIYALLGLALVLVFAVTRVILIPQGEFITFGALTYATLSAGGVPGTAQLALMMGLVAFGFELFSARKSLHVAKVMRAALIYIAFPAIVLALATWLPAHKPGVAVNIALSLLIVAAIGLFLYRIAFQPLAHTSVLVLLIASVGCHLALQGFGLVFFGAEGLRGPPLSDVALSVGPLLFTGQSLAVYGITLALMAALWLFFGYTRYGKALRATAVNRLGARLVGIRTSLSGQIAFLLASVIGAISGILIVPITTLYYDTGFLIGLKGFVAAIIGGLVSYPLTAIAAIVVGIVESFSSFYASNYKEVIVFTLILPVLVLRSLATPAVEEEKD

SEQ ID NO: 27529 - DNA, 1773 bp, Rhodopseudomonas palustris
  CDS (1)..(1773)
atgccgcgttggttgccaattctcctgttcgccgccgtgatgacggcgctgccgctgattccgggcattccgccgttctggatcgtgctgctcgacaatatcggcctcgccgcgctggtggcgatgggcctggtgctgctcaccggcgtcggcgggctcacctcgttcggtcaggccgcgttctgcggcttcggcgcctacaccaccgcctacatcaccaccgtctacggcatctcgccgtggctggcgctgccggcctcgctggtggtcgccggcatcgccgcagtgctgctcgggctgatgacggtccggctctcaggccattatctgccgctcggcaccatcgcctggggcatcgcgctttactacctgttcagcaagctcgacttcctcggccgcaacgacggcatctcgcgggtgccgccgctgtcgatcggcccgatcgacatgtacgatccgcatacgatctatttcgtgatctgggcgatggtactgatcagcgcggtgctgacgatgaacctgctcgacagccgcaccggccgcgcgatccgcgcgctacgccgtggccatgtcgctgccgaagcattcggggtgcagaccgcgcgcgccaagcttctggtgttcatctacgccgcggtgctcgccggcctttccggctggctgtacgcgcatttccagcgcaacgtgaacccgacgccgttcgggccccaggccggcatcgagtatctgttcatcgccgtggtcggcggcgccggctatgtctggggcggcgtgcttggcgccgcgatcgtcatcatcctgaaggaagtgctgcagggctatctgccgctgctgttcggcggccagggccagctcgagatcatcgtgttcggcatcctcttggtggtgctgctgcagctcgcgcccggcggcgtctggccctggctcgccaatctggtgccgctgaaattccggcgtgccgtcaccggcaatgccgacggcctgcccgcgcgcgagcgcgtcggcggctccaccaccgccccgctgctgaaggtcgaacgcgcgcgaaagcagttcggcggcgtggttgcggtcaacgacgtgtcgttcgaggtcaacgccgcggagatcgtcgcgctgatcggcccgaacggcgccggcaaatcgaccaccttcaacctgatcaccggcatcctcaccactaccggcgggcggatcgaagtgcacggcaagccggtcgacaacacgccgccgcaggaggtggtgaagctcggcatcgcccgcaccttccagcacgtcaagctggtgccggacatgaccgtcctggagaatgtcgcgatcggagcgcacttgcgcggccgctccggggcgatcaccagtatgctgcggttcgatcgcggcgacgaggccaagctgctcgccgaagccgcacgccagatcgagcgcgtcgggctcggcgccgagatcgatcagctcgcggggtcgctctcgctcggccagcagcgcatcgtcgaaattgcgcgggcgctgtgtgccgatcccgaactgcttctgctcgacgagccagccgccggcctgcgccacatggaaaagcagcggctcgctgcgctgctgcggcagctcaaggacagcggcatgtcggttctactggtcgaacacgacatgggctttgtgatggacctcgccgaccgcatcgtcgtgctcgacttcggcaccaggatcgccgaaggcacccccgacgctatcaagaccaatccggacgtgatcaaggcctatctcggagcgctggcatga

SEQ ID NO: 27530 - protein, 590 aa, Rhodopseudomonas palustris
MPRWLPILLFAAVMTALPLIPGIPPFWIVLLDNIGLAALVAMGLVLLTGVGGLTSFGQAAFCGFGAYTTAYITTVYGISPWLALPASLVVAGIAAVLLGLMTVRLSGHYLPLGTIAWGIALYYLFSKLDFLGRNDGISRVPPLSIGPIDMYDPHTIYFVIWAMVLISAVLTMNLLDSRTGRAIRALRRGHVAAEAFGVQTARAKLLVFIYAAVLAGLSGWLYAHFQRNVNPTPFGPQAGIEYLFIAVVGGAGYVWGGVLGAAIVIILKEVLQGYLPLLFGGQGQLEIIVFGILLVVLLQLAPGGVWPWLANLVPLKFRRAVTGNADGLPARERVGGSTTAPLLKVERARKQFGGVVAVNDVSFEVNAAEIVALIGPNGAGKSTTFNLITGILTTTGGRIEVHGKPVDNTPPQEVVKLGIARTFQHVKLVPDMTVLENVAIGAHLRGRSGAITSMLRFDRGDEAKLLAEAARQIERVGLGAEIDQLAGSLSLGQQRIVEIARALCADPELLLLDEPAAGLRHMEKQRLAALLRQLKDSGMSVLLVEHDMGFVMDLADRIVVLDFGTRIAEGTPDAIKTNPDVIKAYLGALA

SEQ ID NO: 27531 - DNA, 834 bp, Rhodopseudomonas palustris
  CDS (1)..(834)
atgggacttctgtacggcttggtcgcggtcggcctggctctgatctttggcctgatggatgtcaccaacttcgcccacggcgaattcctgatgttggcgatgtacatcaccttcttcctgttcgcgttcttcgcgatcgatccgatcctcgccgctccgctcgtcggggcggcgatgttcgtgttcggcgcggtgatttacctattggtcgtccgatttgcgatgagagccagagccaatatcggcatggtgcagatcttcacgaccttcggcctcgcaatcctgatgcgcggcttggcgcagtacttcttcacccccgactatcgcagcatcaacgtctcctggctgggcggcaagacgctggagatcggcggcgtgttcctgcccgtgccgcaactggttggcgcgctggtgtcgatcgccgcgttcggcgcgttgtacttcttcatgaagaagaccgatttcggccgtgcgctcgaagcgacccgcgaggacgcaggcgcggtggccctggtcggcatcgacaagaacaaggtgttcgcgctgggttggggccttggctcggcattgatcggtctggcgggggccgtgatggcgatcttcttctatatctatcccgatgtcggcgcctcgttcgcgctgatcgcctacgtcaccgtggcgctcggcggctttggcagcgtgttcggcgccttcgccggtggcatcatcgtcggcctggtcgaggcgaccaccgcgatgatcctgccgccgtcgctgaagtcgatcggcatctacgccgtttatctgctggttgtgttcattcggccgcgtggcctgttcggatcgatctga

SEQ ID NO: 27532 - protein, 277 aa, Rhodopseudomonas palustris
MGLLYGLVAVGLALIFGLMDVTNFAHGEFLMLAMYITFFLFAFFAIDPILAAPLVGAAMFVFGAVIYLLVVRFAMRARANIGMVQIFTTFGLAILMRGLAQYFFTPDYRSINVSWLGGKTLEIGGVFLPVPQLVGALVSIAAFGALYFFMKKTDFGRALEATREDAGAVALVGIDKNKVFALGWGLGSALIGLAGAVMAIFFYIYPDVGASFALIAYVTVALGGFGSVFGAFAGGIIVGLVEATTAMILPPSLKSIGIYAVYLLVVFIRPRGLFGSI

SEQ ID NO: 27533 - DNA, 876 bp, Rhodopseudomonas palustris
  CDS (1)..(876)
atgctcgccctgcaaatcctgatcgacggtttcgccatcagcgcgttgtatgcgctgggcgcgaccgggttcacgttgatcttcggcgtctccggcgtgctcaacctgtcacacggcgccatcatggtcgccgccgcggtcgcggcctgggcggcatcgagcacgttcggcatcggcagctacgccggcgcgctgatcggcatcgccaccgccctggtgatcgcattgctgacctattttgcggtggtgcagccgatccagcggtcacggcggatcgccaatgaggagaaggagatcttcgtcctcaccggcaccctgctctggggcatcatgatccaggaggcgatcgcttactttttcaccaacaacgccaagacggtgttgccgatcgtcaccggcgtggtcgaaattctcggcgtccgcaccccgcgcaacgagatcttcaccgcgctggtgtgctgcctggtgatcgcgctgctgtggctgctggtcaaccgcaccaagatcggcaaggcggtgctggcggcctcgatgaacccgcgcggcgtcaccctgctggggctcgaactcaccaacatctacgtcgtcgtctggatcatctacggcgtgctcgccggtatcgccggggtgctgctcggcatgttcctgggcgtgtcgtcctacagcgtcggtccgctgaccgcgagcgcattctcgatcgtggtgctcggcgggctcggcagcgtctccggctcgctgatcgccgccttcgtggtcggctatctggagaccttcaccgcttacatgatctcgccggcctatcgatcgatcccggcgctgctgctgttggtcacggtgatgtatctgcggcctcagggcctgctcgggaggcgctga

SEQ ID NO: 27534 - protein, 291 aa, Rhodopseudomonas palustris
MLALQILIDGFAISALYALGATGFTLIFGVSGVLNLSHGAIMVAAAVAAWAASSTFGIGSYAGALIGIATALVIALLTYFAVVQPIQRSRRIANEEKEIFVLTGTLLWGIMIQEAIAYFFTNNAKTVLPIVTGVVEILGVRTPRNEIFTALVCCLVIALLWLLVNRTKIGKAVLAASMNPRGVTLLGLELTNIYVVVWIIYGVLAGIAGVLLGMFLGVSSYSVGPLTASAFSIVVLGGLGSVSGSLIAAFVVGYLETFTAYMISPAYRSIPALLLLVTVMYLRPQGLLGRR

SEQ ID NO: 27535 - DNA, 876 bp, Rhodopseudomonas palustris
  CDS (1)..(876)
atgccgagcttgcccgttctgatttcgcaggcctttaacggcttggcactcggctcactgctggcacttgtcagcagcgggttgacgatcattctcggcacgctcggcgtgctcaattttgcccacggcgcgctgttcgccgtgggcgcctacaccgtcttcgtgatgctgcagtacacctcgtccttcgtgctggcggtcgtcgtcggctgcggcttcatgctggtgctcggcttcgtgctcgagcgcgtcattatccgttacttttacgaccgaccgcacgaagaccagatcctcgtgacgtacggcatcggcatcgtgctcgtcgagtgcatccgagccggattcggaggcaacgcccagcgggtgcccgtgccgtcctgggggcagggcgccacgcagctcggcttcctgatctatccaacctatcggttgcaactgatcgcgatcatcgccgggttgctgctcgccctctatctggtgttgtaccgtacctcaatgggcctggtggtgcgcgccgggatcgaaaatccgggtatggtcggaattctaggcatcaatgtccgccgtgccttccttctggtgttcgcgatcggcatcgtcgccgtcggcctcgcaggaatgctgtatgcccccgtggtcgcggtttcgccggacatgggtgcaaacttcatggcccaatccttcgtggttatcgtgctcggtggtctcggctcgttccccggcgccatcgtcggcggcctgatcgcgggcgagatcatcagtctcacgagtgcgttcaactcgtcgtattcggaagtcatgctctacgcacttatggcgctgttgctcgtgatgcgtccgcaggggctgttcggtacggaaggccgggcatga

SEQ ID NO: 27536 - protein, 291 aa, Rhodopseudomonas palustris
MPSLPVLISQAFNGLALGSLLALVSSGLTIILGTLGVLNFAHGALFAVGAYTVFVMLQYTSSFVLAVVVGCGFMLVLGFVLERVIIRYFYDRPHEDQILVTYGIGIVLVECIRAGFGGNAQRVPVPSWGQGATQLGFLIYPTYRLQLIAIIAGLLLALYLVLYRTSMGLVVRAGIENPGMVGILGINVRRAFLLVFAIGIVAVGLAGMLYAPVVAVSPDMGANFMAQSFVVIVLGGLGSFPGAIVGGLIAGEIISLTSAFNSSYSEVMLYALMALLLVMRPQGLFGTEGRA

SEQ ID NO: 27537 - DNA, 864 bp, Rhodopseudomonas palustris
  CDS (1)..(864)
atgagcgaattctggcaggccttggcgcaaggcgtcctgatcggaagcacctacgggctgctcgcgctgggcatgggcctggtgtacggcgtgtccggcatcgtcaacttcgcccatggcgatttcatctcactggcgatgttcatggcgctggcgctgttctcggcattcgcgctggatccttacgtctcggcgctgattaccatcccggtgatggcgctcatcggcggactggtctatcgctatctgttacggccgatggccgggcaccagttcttgatgatcgtacagctcaccctcggtctcagcctcgtgctgcagaacggcatcctgatggttttcggcggccagccggcgcgcacgccgtcgatcgtggaatcgaagttgatcattctcggcgacgtcgtgctgcggttgccgcatctgatcgcgtttgcggtcgcgttcgcgatggcgatcgggctgtacgtgatgctgcgctcgaccgatttcggccgctcgatccgcgcggtgcatcagaacgcgcgcgccgcagcgttgatgggggtcgacgtgggccgtgttcaggtcgtcacctttgcgatcggtgtcgccatcctcgccgttgctgcggcgctgctgctgccgggcacgccgatcactccgacccagggcctgcagtacactgttatcacgctgctggtcgtggtgctcggcggcatgaccaatttcgtcagcatcatgctcagcggcctggtgatcggtatctccgaggcgttcggccagatctatgtatcggatacgctcggccgtctcgtgccgtacgcgatcttcgtgctgatcatgctgttccggccgcagggcctgacctggaggacgtcatga

SEQ ID NO: 27538 - protein, 287 aa, Rhodopseudomonas palustris
MSEFWQALAQGVLIGSTYGLLALGMGLVYGVSGIVNFAHGDFISLAMFMALALFSAFALDPYVSALITIPVMALIGGLVYRYLLRPMAGHQFLMIVQLTLGLSLVLQNGILMVFGGQPARTPSIVESKLIILGDVVLRLPHLIAFAVAFAMAIGLYVMLRSTDFGRSIRAVHQNARAAALMGVDVGRVQVVTFAIGVAILAVAAALLLPGTPITPTQGLQYTVITLLVVVLGGMTNFVSIMLSGLVIGISEAFGQIYVSDTLGRLVPYAIFVLIMLFRPQGLTWRTS

SEQ ID NO: 27539 - DNA, 927 bp, Rhodopseudomonas palustris
  CDS (1)..(927)
atgttcggcgaatattcgattggtgatctcggggcgatcttcgcgatgcagggcttcgcggggctcattctgttttccgtctacgtgctgatggcgcttggcctggcgatcatcttcggccagatgggcgtcatcaacatggcccacggcgagttcatgatcctcggcgcctacgtcacctggatgacgtcgaacttcttccaatcctatctgccgtcgctgttcgccggctacttcttcatcgcgatgatcctggcgttcatcgcctccggggcactcggcatgctggtggagtgggggctgatccgccacctctataagcgtccgctcgacaccctgctggcgacctgggggttgtcgctgatccttcagcaggcctaccggtcgatcttcggtgcgcgcgaggtcggcgtcgagttgccgcagtggatgctcggctccaagcaggtcaccgacaccatcgagattccgatcaacggcatgttcgtgatggcgctcaccgtgctgatcaccgcggccgtgtcctacgtcctgttctggtcgcgctggggccgccaggtccgcgccgtggtacagaatcgggtgatggccggcgccgtcggcatcaacactgaaaaggtcgaccgctacaccttcggcctcggctgcggcatcgcaggcatcgcaggctcggccttcaccatgatcggttcgaccggtccgacctccggccagctctatatcgtcgacaccttcctggtcgtggtgttcggcggcgccgccagcctgttcggcaccattgcatcggccttcagcatctcacaggcgcagtcgaccatggagttcttcatgtccggctcgatggccaaggtgctgacgctgctcgccatcgtcgcgatcctgatggtgcggccgcaaggtctgttcgctctcaaggtccgtaagtaa

SEQ ID NO: 27540 - protein, 308 aa, Rhodopseudomonas palustris
MFGEYSIGDLGAIFAMQGFAGLILFSVYVLMALGLAIIFGQMGVINMAHGEFMILGAYVTWMTSNFFQSYLPSLFAGYFFIAMILAFIASGALGMLVEWGLIRHLYKRPLDTLLATWGLSLILQQAYRSIFGAREVGVELPQWMLGSKQVTDTIEIPINGMFVMALTVLITAAVSYVLFWSRWGRQVRAVVQNRVMAGAVGINTEKVDRYTFGLGCGIAGIAGSAFTMIGSTGPTSGQLYIVDTFLVVVFGGAASLFGTIASAFSISQAQSTMEFFMSGSMAKVLTLLAIVAILMVRPQGLFALKVRK

SEQ ID NO: 27541 - DNA, 873 bp, Rhodopseudomonas palustris
  CDS (1)..(873)
atgctcgatttcgtccagcaggtgatcggcgggattgccctcggctgcgtctacggcttgatcgccctcggcttcgtgctgatctacaaggcgaccgaagtcgtcaattttgcgcagggcgaaatcatgatgctcggcgcgtttctgtcgttcaccttcatcgccacgctcgggctgaactactggttcggcttcctgctttgtgtggtcagcatggcggtgctcggcgccgcgatggaacggctggtggtgcggccgatcctcgggtacccgcagttctcgatcgtgatggcgacgatcgggctcggtctcgtcatccgctcgttggttggcatcatctggggcaccgacgatttgcggatcgagacgccgttcaccggcggtgtgatccagcttggcggcttggtgctgtcgcaggacagcctgtcgatcattgttgccaccgcgctgctgtgcgccgtgctgtacgctttcttccgcttcaccaagatcggtatcgccatgcaggcgacgtcccagaacatgctggcggcctactacatgggcattccggtgaagcggatgttctcgctgatctggagcctgagtgcgatcgtagcctgctgcgccggcgtgctgctggcgccgatcaccttcatccacgccaatctgggtttcctcggcatcaaggcgttcccggccgccgtgctcggcggcttcggcagcatccccggcgcgctcgccggcggcatcaccatcggcatcgtggaatcgctgtcgggcttctatctgccggaagggttcaaggacgtcgcggcctacatcgtgctgctcgcggtgctgctgtggcggccgcagggcctgttcggcagcaacgcgctgaagaaggtctga

SEQ ID NO: 27542 - protein, 290 aa, Rhodopseudomonas palustris
MLDFVQQVIGGIALGCVYGLIALGFVLIYKATEVVNFAQGEIMMLGAFLSFTFIATLGLNYWFGFLLCVVSMAVLGAAMERLVVRPILGYPQFSIVMATIGLGLVIRSLVGIIWGTDDLRIETPFTGGVIQLGGLVLSQDSLSIIVATALLCAVLYAFFRFTKIGIAMQATSQNMLAAYYMGIPVKRMFSLIWSLSAIVACCAGVLLAPITFIHANLGFLGIKAFPAAVLGGFGSIPGALAGGITIGIVESLSGFYLPEGFKDVAAYIVLLAVLLWRPQGLFGSNALKKV

SEQ ID NO: 27543 - DNA, 867 bp, Rhodopseudomonas palustris
  CDS (1)..(867)
atgcggacgattctcggaatcctgccggacgcgctggcctacggcatggtgctgttcacgatctcgatcggcctgtcgatcatgatgggcttgatgcgcgtggtcaatctcgcacacggcgcattcgcgatgatcggcggttatctcgcctcgttcgcgctggtttcgctcggcgtttcctatccgatagcgatcctgatcgcggtgatcggcgcggtcatcatctcggtcccgttcgagttcctgctgtatcggcggatctatcgccgctccgacgaactgacccagatcctgctgacgatcggcatcaccttcttcatcgtcggcatcgccaactacatcttcgggccgacttcgaagccgatcccgctgccggagatgctgaaggggccgttcgatctcggcttccgcatgatcccggcgcaccggctgttcgtgatcggctgtggcgtggtcaccgcggtggcgctgtggctactgatagagaagaccgagttcggcgtgcggctgcgcgcggcggtcgacaatggcgacatggccgaggcgctgggcattcgcacccaaattgtctattcggtcaccttcgcgctggcggtggggctcgcggcgttcggcggcgtggtcggcgccgagctgctgccggtcgagccgttctacgcgctgcgctacatggtgacgttcctggtcgtggtctcggtcggcggcgccggctcggtcaccggtgcgatggcggcgtcgctgttgctcggccttgccgacactaccggcaaatatctggcgccggagtttggcgagttcttcttctatgtcgcggtgatcgtcatcgtttacgtattcccgcacggcctgttcggaaaggcgcactaa

SEQ ID NO: 27544 - protein, 288 aa, Rhodopseudomonas palustris
MRTILGILPDALAYGMVLFTISIGLSIMMGLMRVVNLAHGAFAMIGGYLASFALVSLGVSYPIAILIAVIGAVIISVPFEFLLYRRIYRRSDELTQILLTIGITFFIVGIANYIFGPTSKPIPLPEMLKGPFDLGFRMIPAHRLFVIGCGVVTAVALWLLIEKTEFGVRLRAAVDNGDMAEALGIRTQIVYSVTFALAVGLAAFGGVVGAELLPVEPFYALRYMVTFLVVVSVGGAGSVTGAMAASLLLGLADTTGKYLAPEFGEFFFYVAVIVIVYVFPHGLFGKAH

SEQ ID NO: 27545 - DNA, 870 bp, uncultured bacterium 582
  CDS (1)..(870)
atgctaatgctttttgagcaaatcttaaatggtttgctagtggggtcttattatacccttctcgcgctcggcctctcgattatttttagtcttgggggcgtcgtcaatcttgcccatggcgcgttttatgcggttggggcgtatctgacagtgttgtttactgatattcttgggtttggccttgcctttttgatcacccccgctgtggttggtctcatcggcattgcaattgaggcgctgtttttgcgcagactttacaacaaagatccaattctgaccttgctgtttacttttggtttagcgatgtccggtgaacaagctttgcgcttaatttttggggcctccggcattccattctcgattccagaatttttgtcgggtcagctacacgtcggtgattttctatattcatactaccgcctgtcaattctggcggtcaccagcttatcaattgcagggttgtggatattattcaataagacctcctttggtctgatcgttcgagccggcgttgcagatgctgaaatggtccgcgcgatgggaatatctgtcaaacccattttgtctatggtttttgcaattggcgtgggtttggctgcagtagcaggttccatgtcggcaagcttaacgggtgttcaacctgccatgggaaatgacatcgtgacagccgcttttgtcatctgtgtcttaggcggattaggcagtttttggggcgtcgtttttgcgggtctcttagtgggtattttgaagggcgttacagctttgtattttccacctgcggctgagggatcgatctatgcattgatggttctggttctgatctttcgtccacgcgggatgtttggtgttaaatttgaaaggctcgaatag

SEQ ID NO: 27546 - protein, 289 aa, uncultured bacterium 582
MLMLFEQILNGLLVGSYYTLLALGLSIIFSLGGVVNLAHGAFYAVGAYLTVLFTDILGFGLAFLITPAVVGLIGIAIEALFLRRLYNKDPILTLLFTFGLAMSGEQALRLIFGASGIPFSIPEFLSGQLHVGDFLYSYYRLSILAVTSLSIAGLWILFNKTSFGLIVRAGVADAEMVRAMGISVKPILSMVFAIGVGLAAVAGSMSASLTGVQPAMGNDIVTAAFVICVLGGLGSFWGVVFAGLLVGILKGVTALYFPPAAEGSIYALMVLVLIFRPRGMFGVKFERLE

SEQ ID NO: 27547 - DNA, 1254 bp, symbiont bacterium of Paederus fuscipes
  CDS (1)..(1254)
atgagccagtctctgaaacgcgcgctgttcagcgccctgctggtgttgttggtgtcttatccgatccttggtctgaggttgcgtaccgttggcatcaagctacaagttatcggtgccgatgcacagaccctctggagtattgccgtagccactatggctatgttcgtctggcaactgtttcgtgaccgtgtcctactcaagtttgggagtgggatcaagtacaaggtggacaaccgtggtctgaagatctttctcagcctgccgtcgacccagcgctggatcgttctggctttggtgttagtggcattcatttggccgttcttcgcctcacgtggcgcagtggatatcgccactctgatcttgatctacgtgatgctgagtattggcttgaatatcgtggtcggtctggccggtctgctcgacctgggttatgtcggcttctacgcagtgggtgcatatacctacgcgctgcttgccgagtacgccggtttcggtttctggagcgctctgcccatcgctggaataatggcggcgctgttcggttttctgcttggtttcccggtgctgcgcctgcgcggcgactacttggcgatcgtgacgttgggcttcggcgaaatcatccgcatcttgctgcgcaacctgaccgatatcaccggcggccccaacggcattggctcgatccccaagccgactctgttcggtcttagcttcgaacgccgcgcaccagggggcttacagacttttcatgagtttttcgatatcgactacaacagtaactacaaggtgatcctgctctatatgatcgctttgctgctggtactgctagccctgttcgtgatcaaccggctgatacgcatgccgatcggccgcgcctgggaagcgctgcgtgaagatgaagtagcctgccgtgctctgggccttaacccgactcttgtcaagctctctgcattcactatcggtgccggtttcgctggtttcgccggttgcttcttcgcagctcgccagggcctagttacgccggagtccttcaccttcattgagtccgtgatgatcctcgcgatcgttgtactcggtggtatgggctcacagcttggcgtaatccttggcgcggtagtgatggtactgctcttagagcggcgagagttcgccgaataccggatgctgatcttcggtctggccatgatcgtgatgatgatctggcgcccgcaaggactactgccgatgcaacgcccgcacttggagctgaaaccatga

SEQ ID NO: 27548 - protein, 417 aa, symbiont bacterium of Paederus fuscipes
MSQSLKRALFSALLVLLVSYPILGLRLRTVGIKLQVIGADAQTLWSIAVATMAMFVWQLFRDRVLLKFGSGIKYKVDNRGLKIFLSLPSTQRWIVLALVLVAFIWPFFASRGAVDIATLILIYVMLSIGLNIVVGLAGLLDLGYVGFYAVGAYTYALLAEYAGFGFWSALPIAGIMAALFGFLLGFPVLRLRGDYLAIVTLGFGEIIRILLRNLTDITGGPNGIGSIPKPTLFGLSFERRAPGGLQTFHEFFDIDYNSNYKVILLYMIALLLVLLALFVINRLIRMPIGRAWEALREDEVACRALGLNPTLVKLSAFTIGAGFAGFAGCFFAARQGLVTPESFTFIESVMILAIVVLGGMGSQLGVILGAVVMVLLLERREFAEYRMLIFGLAMIVMMIWRPQGLLPMQRPHLELKP

SEQ ID NO: 27549 - DNA, 879 bp, Alcaligenes eutrophus
  CDS (1)..(879)
atgttccagagcatcctggtccaggccctgagcggcgtcagcagcggcatggtgctgttcctggtcgcttcgggcatgacgctgatcttcggcacgctgcgcgtcgccaatttcgcgcacggctccttctacatgatcgcggcctacctgagcttcacgctcacgcgctgggtcggccacggaacctggggcttcgtcgtctcgctggtcgtggcgccgctcatcgtcgcactgctcgggctggtggtcgagcgcttcctgctgcgccgcatcgccacgcgcgcccaccagtaccagctgatcctgacctatgcgctgacgctgatcctggcggatgccgtgaagatgatctggggccgcgacaacttcacggtgccgcgccccggcgcgctcgacggcgccttcgacatcttcggcacgcccttcccgagctactacgcgctcttgatcgtggtcggcgccgtcatcgccgtcgcgctgcacctgctgctgacgcgcacgcgcttcggcaaggtgctgcgcgcctcggtcgccgacggccagatggtgggcgcgctcggcatcgacgtgccgcgcctgtacaccggcgtgttcgcgctcggcgcctggctggccggcctgggcggtgccctggcggcgccggtgggctcgatctcgctgggcatcgacagctcgatcatcatcgaatgcttcgcggtcgtgatcatcggcggcgtcggcagcgtcggcggcgccctgctcggcgcgctgatcatcggcgtgaccaagtcggtcggcatcctgttcgcgcccaagctggcgatcgccttcatcttcattgcgctgtgcgcggtgctggtgctgcggccgcagggcctgctgggccgcagcacggcctga

SEQ ID NO: 27550 - protein, 292 aa, Alcaligenes eutrophus
MFQSILVQALSGVSSGMVLFLVASGMTLIFGTLRVANFAHGSFYMIAAYLSFTLTRWVGHGTWGFVVSLVVAPLIVALLGLVVERFLLRRIATRAHQYQLILTYALTLILADAVKMIWGRDNFTVPRPGALDGAFDIFGTPFPSYYALLIVVGAVIAVALHLLLTRTRFGKVLRASVADGQMVGALGIDVPRLYTGVFALGAWLAGLGGALAAPVGSISLGIDSSIIIECFAVVIIGGVGSVGGALLGALIIGVTKSVGILFAPKLAIAFIFIALCAVLVLRPQGLLGRSTA

SEQ ID NO: 27551 - DNA, 882 bp, Rhizobium sp
  CDS (1)..(882)
atggaactgttcttccaacttgtcgtcgatggccttgcatccggagccatctacgcgtccctggcgctggccttggtcctgatcttccgtgcgacgcgcatcgtcaatttcgggcaaggcgaaatggccaccttctcggcttattgtgcctggcagctctatgaatggggcatgccgatgatgctttccttcctcgtcgtcggcgtcttcgcgttcgtgctcgggatcggcattttccgcttcgtcatcaggccggtttctaaggccccggtcgaggccgtcgtcgtcgtgacgctcgggctcttcgtcgtcttccaggcgctatccctgtggctctggggttccgaccagcgtgcttttccctcgctgttcccgaacatcggctgggatttccttggcgtgcgcatgacggcaagtgcggccggcatgatcgcccttctgctctgtctcgccgtggccacgggggcggtctttcgcttcacacggcttggcctcgccatgcgagcctccgcctttgatggcgagaagagcctgcttgttgggatccccgtcgaacggatgctgatgctcggctggggctttgccgcggtgattggcttcgtcgcggcgcttctggtcgggccgcggctgttcctgagcccgacgatgatgatgccgatcctgctctacgccctggcgtcggcgacccttggcggctgggacagcccgctcggggcgatgatcggcggtctgattgtcggtgtggcggaaagcctcggcgcgacctttctccccttcatcggtgcggatctgcgcgtggtgatcccgatactcgtcactctcgtcgtcctgctcgttcggccggtcggtctcttcggtactcgcacggtggtcaagctatga

SEQ ID NO: 27552 - protein, 293 aa, Rhizobium sp
MELFFQLVVDGLASGAIYASLALALVLIFRATRIVNFGQGEMATFSAYCAWQLYEWGMPMMLSFLVVGVFAFVLGIGIFRFVIRPVSKAPVEAVVVVTLGLFVVFQALSLWLWGSDQRAFPSLFPNIGWDFLGVRMTASAAGMIALLLCLAVATGAVFRFTRLGLAMRASAFDGEKSLLVGIPVERMLMLGWGFAAVIGFVAALLVGPRLFLSPTMMMPILLYALASATLGGWDSPLGAMIGGLIVGVAESLGATFLPFIGADLRVVIPILVTLVVLLVRPVGLFGTRTVVKL

SEQ ID NO: 27553 - DNA, 921 bp, Desulfovibrio vulgaris
  CDS (1)..(921)
atggaaacgttcatccagaacatattcaacgcgttgcaatgggggagtttctacgccctcatcgcgctcggttatacgctggtgtacggcgtacttctgctcatcaacttcgcccacggcgacatcttcatggtgggcgcgtacatctcgttcttcgttgcctccatcctgctcgggcagatagggggattcttcgaactttcggggcccatggcccttgccctcaccgtgccgctgaccatggtcctgaccgcaggcgtcggggtcaccctcgaacgggtggcctacagacccctgcgccgcaagggggcccaccgcctgtatgtggtcatcaccgcactcatgtgcggcatcatgctcgagaacggcaacctcgccctgctgggcgccagccgcaaggctctgccggagatgatcgacaaggtggtgtacaccatcggcaccgtttcggtgaccaacctgaagctcatggtcatcgtcaccgcctttctcgtcttcgcgcttctgcagttcatcgtcacgcgtacccgcatcggcatggccatgcgcgcggtggcgtgggacaagttcgcgctgccgctcatgggtatcccgctcgacagtatcatcgtcttcaccttcgtgctcggctccggttttgccggtcttgcggggctgctcttcgccatgtcgtaccccatcctcgatccctacatgggagccatggtggggtggaaggccttcatcgccgccgtcgtgggcggcataggcgatatccgcggggcgttcatcggaggcttcctgctggcgttcatcgagatcatggtggcggcggtcttcccctccacgttccgcgacctgttcgccttctcgattctgctcttcatcatgtggcagcggcccaccggactgttcggcgtggcgaagaccaccaagatctaa

SEQ ID NO: 27554 - protein, 306 aa, Desulfovibrio vulgaris
METFIQNIFNALQWGSFYALIALGYTLVYGVLLLINFAHGDIFMVGAYISFFVASILLGQIGGFFELSGPMALALTVPLTMVLTAGVGVTLERVAYRPLRRKGAHRLYVVITALMCGIMLENGNLALLGASRKALPEMIDKVVYTIGTVSVTNLKLMVIVTAFLVFALLQFIVTRTRIGMAMRAVAWDKFALPLMGIPLDSIIVFTFVLGSGFAGLAGLLFAMSYPILDPYMGAMVGWKAFIAAVVGGIGDIRGAFIGGFLLAFIEIMVAAVFPSTFRDLFAFSILLFIMWQRPTGLFGVAKTTKI

SEQ ID NO: 27555 - DNA, 906 bp, Desulfovibrio vulgaris
  CDS (1)..(906)
atggaagaattcctgcaacagttgaccaacggcctcgcggtggggggcatctacgccctcatcgccctcgggtacaccatggtgtacggcgtgctcaaactcatcaacttcgcgcatggcgacctgttcaccatcggagcctatctcgggttcacggtgttcgccgcgctggggctttcggggcatgtctccggggcggtggccgtattgctggtcacgaccatggtcatggggcttgtggcactcatcggctatctgcttgaacgtgtggcctaccggccattgcgctcgtcaagccgcctctctgccgtggtctctgcgcttggtgcctccatcttcttccagaacgccgtgatgctcatctacggtgccaagttccaagtctaccccaacgacatcaggcccaccatggccgtgagcttcttcggcatggacatccctctggtgcgcatcatgatgttcggtgcttctgtggcgctcatgctgcttctgcatttcttcatccaccgcacccgcacgggcactgccatccgcgccgtggccatcgaccagggcgcggccaagctcatgggcatcgacgtgaaccgggtcatcgcgctggtgttcatgatcggccctgcactgggtggcgccgcaggcgtcatggtaggcctctactatgggcagatagacttcaccatggggtgggtgtacggcctcaaggccttcaccgccgccatcctcggtggcatcggcaacatccccggtgccatggtgggcggtcttctgctgggcgtcatcgaggccctcggtgcggcatacatctccatcgcgtggaaagacgccatcgccttcctcgtcctcatcctcatcctgatcatcaggcccacgggccttctcggcgaaagggtggccgacaagatatga

SEQ ID NO: 27556 - protein, 301 aa, Desulfovibrio vulgaris
MEEFLQQLTNGLAVGGIYALIALGYTMVYGVLKLINFAHGDLFTIGAYLGFTVFAALGLSGHVSGAVAVLLVTTMVMGLVALIGYLLERVAYRPLRSSSRLSAVVSALGASIFFQNAVMLIYGAKFQVYPNDIRPTMAVSFFGMDIPLVRIMMFGASVALMLLLHFFIHRTRTGTAIRAVAIDQGAAKLMGIDVNRVIALVFMIGPALGGAAGVMVGLYYGQIDFTMGWVYGLKAFTAAILGGIGNIPGAMVGGLLLGVIEALGAAYISIAWKDAIAFLVLILILIIRPTGLLGERVADKI

SEQ ID NO: 27557 - DNA, 1224 bp, Desulfovibrio vulgaris
  CDS (1)..(1224)
atgcaaggcatcataaaatctcttcaggtcggcctctggttcatgttcctgacctttccgctgatggtcatacgggtcgacacgctgaacggtacggtggactggcggtggcagaacatggtcatgatggggcttggaaccttcgccctgtcgttcctgtggcgctatatgctcgcccgcaaggaagcggggggcgcatctgcccggcagggcaacgccgccgcgggcgggctgatggcccgcgtgcgcagtgacgcccgactccggaccccggcgctgcttgcggtgcttgtggtgttcgccgtgctgcccatgctggtctccacctatcagaccaacatcatgatttcggccctgctctacgtgatgctcggcctcgggctgaacatcgtcgtgggcctttccggtcagcttgtgctcggctacgtggccttctacgccgtgggcgcctacgcctacgccctgctcaacgcggacttcggtctcggcttctggacggtgctgcccatcgggggagctctggctgccgtcttcggcatcctgctcggttttccggtgctgcggctgaagggcgactatcttgccatcgtcacgctgggcttcggtgaaatcgtccgcctcgtgctggaaaactggggcagtgtcacgcgcggtcccagcggcatctccaagatcgcccgccccggtcttttcggcatggaactgtcggtgagcgaagccaccacctacatctattacctcatccttgcggcggtgattttcaccatcttcgccgtgggacgcctcaaggactcgcgcataggacgcgcctggcaggccctgcgcgaagacgaaatcgcctgcgaggccatgggcatcgacctcaccaccaccaagctcacggctttcgcgctgggagcgtgctgggccggcttcgccggggtcatcttcgcggccaagaccaccttcatcaaccccgccagcttcaccttcctcgaatcggcgatgattctcgccatggtggtgcttggcggcatggggtcgacactgggggtggtgctgggagcgctggtgctcatccttctgcccgaatacctgcgtgccttctcggagtaccgcatgctcatcttcggtgcggcgatggtgctcatgatggtgttcaggccgcaggggctggtgtcgtgccgctccagagagtatgatgtgaacgaccccgaagcgggtaagagcggggagaaggcgtaa

SEQ ID NO: 27558 - protein, 407 aa, Desulfovibrio vulgaris
MQGIIKSLQVGLWFMFLTFPLMVIRVDTLNGTVDWRWQNMVMMGLGTFALSFLWRYMLARKEAGGASARQGNAAAGGLMARVRSDARLRTPALLAVLVVFAVLPMLVSTYQTNIMISALLYVMLGLGLNIVVGLSGQLVLGYVAFYAVGAYAYALLNADFGLGFWTVLPIGGALAAVFGILLGFPVLRLKGDYLAIVTLGFGEIVRLVLENWGSVTRGPSGISKIARPGLFGMELSVSEATTYIYYLILAAVIFTIFAVGRLKDSRIGRAWQALREDEIACEAMGIDLTTTKLTAFALGACWAGFAGVIFAAKTTFINPASFTFLESAMILAMVVLGGMGSTLGVVLGALVLILLPEYLRAFSEYRMLIFGAAMVLMMVFRPQGLVSCRSREYDVNDPEAGKSGEKA

SEQ ID NO: 27559 - DNA, 909 bp, Desulfovibrio vulgaris
  CDS (1)..(909)
atggattggcagtatttctgtgaactcttgttcggtgggctcacgcgcggcagcatctatgcacttatcgcgctcggctacaccatggtgtacgggatcatcgagctcatcaacttcgcccatggcgaggtctacatgatcggcgcgttcacggcgctcatcgtggcgggtgtgctcggcatctatggctttcccgaggcgggcatcctcatcatcgccgccatcgtcgcggtcatctactgcgccgcctacgggttcacgctggagaaggtggcgtacaagcccctgcgtgacgcgccacgcctttctccgctgatctcggccatcggcatgtccatctttctccagaactatgtcatcctcgcgcagacctcggacttcgtgccgtttccgcgcctcgtgcccgacctcgccatccttgagcccatcgcccacatcaccgggacgagtgatgttctgatcatcgtcacgagcgccatcaccatggtgggcctcaccctgttcatcaagtacacccgcatgggcaaggccatgcgcgccacggcgcagaaccgcaagatggccatgctgctcggcatcgacgccgacagggtcatctccctcaccttcatcatcggttcctcgctggcggccatcggcggcgtgctcatcgcctcgcatatcggtcaggtgaacttcgccatcggcttcatcgcaggcatcaaggcgttcaccgccgctgtgcttggcggcatcggctccattcctggcgccatggcgggcgggcttgtgctcggcctttgcgagagtttcgcaaccggctacgtgtccagcgactatgaagacgccctcgccttcgcgctgctcgtgctcattctcatcttcagaccctccggtatcctgggcaagcccaagacccagaaggtctag

SEQ ID NO: 27560 - protein, 302 aa, Desulfovibrio vulgaris
MDWQYFCELLFGGLTRGSIYALIALGYTMVYGIIELINFAHGEVYMIGAFTALIVAGVLGIYGFPEAGILIIAAIVAVIYCAAYGFTLEKVAYKPLRDAPRLSPLISAIGMSIFLQNYVILAQTSDFVPFPRLVPDLAILEPIAHITGTSDVLIIVTSAITMVGLTLFIKYTRMGKAMRATAQNRKMAMLLGIDADRVISLTFIIGSSLAAIGGVLIASHIGQVNFAIGFIAGIKAFTAAVLGGIGSIPGAMAGGLVLGLCESFATGYVSSDYEDALAFALLVLILIFRPSGILGKPKTQKV

SEQ ID NO: 27561 - DNA, 969 bp, Thermus thermophilus
  CDS (1)..(969)
atgctagagcagatcctggtcctgctgccccaggtgctctttgacggcttcatcctgggcttcatctacgccatgatcgccctggggtacaccatggtctacggcgtcttggagctcatcaacttcgcccactccgagatcttcatgatcggggccgtggccggggtggaggtcttccgctacctcgcccccctgatccccaacggctacctcctcctcctggtggccgtggtggtgggggcggcggtggcgggcctcaccgccatcctggtggagcgcatggcctaccggcccctccgccgccggggcaccaccaaccgcctcgtgcccctggtgacggccatcggggtgagcttcttcctccaggacctggtgcggctcattgagggcctctggcacaacgagttcttcctgcgcatgcgcaccataccggacctcgagggctccttcaccctcttcgggggcgccatcttcatccagaccaagtcggtgatcgtcatcgtggtctccgtgctcatgctctgggggctcacctacctggtgaaccgcaccaagctggggatggccatccgggccgtggcccaggacctcaccacggcgagcctcatgggcatcaaccccgaccagatcatctcccgcaccttcctcatcggcggcgccttgggcggggtggccggggtcctcttcgccctcatctacaccaccatcaacccctacgtgggcttcctccccggcatcaaggccttcaccgcggcggtcctgggcgggatcggcaacatccccggggccatgctcgggggcctcgtcctggggcagctggagaacttcttcggcacctacctgcccatcctcaccgccggcaacttcgggacggagtacaaagacgtggtggccttcctcatcctcatcttcatcctcctcttccggccccaaggcctcctgggccagatggttaaggagaaggtatga

SEQ ID NO: 27562 - protein, 322 aa, Thermus thermophilus
MLEQILVLLPQVLFDGFILGFIYAMIALGYTMVYGVLELINFAHSEIFMIGAVAGVEVFRYLAPLIPNGYLLLLVAVVVGAAVAGLTAILVERMAYRPLRRRGTTNRLVPLVTAIGVSFFLQDLVRLIEGLWHNEFFLRMRTIPDLEGSFTLFGGAIFIQTKSVIVIVVSVLMLWGLTYLVNRTKLGMAIRAVAQDLTTASLMGINPDQIISRTFLIGGALGGVAGVLFALIYTTINPYVGFLPGIKAFTAAVLGGIGNIPGAMLGGLVLGQLENFFGTYLPILTAGNFGTEYKDVVAFLILIFILLFRPQGLLGQMVKEKV

SEQ ID NO: 27563 - DNA, 978 bp, Thermus thermophilus
  CDS (1)..(978)
atggacgccaccatcctcggcctcctccttctggacggcgtgcagaacggggtcatctacgggcttctcgccctggccatggtcctcgtcttcgccgtgacccgggtgatcctggtgcccatcggggagctcatgatgttcgcccccctctccttcgtctggctccaagaggggaagctccccggcaccctgtggctcgccctcgccttgggggtcctttgggccctgttggagcggggaaggggccgggggctccccctcctgggagggatggggcttctcctcctcttcctcctcgcccagggaagcccggccctcgcctatttggcggccctcctcctcgtggtctacctgggggtggccacctaccgggtcttcttccagcccatgcgggaggccacggtcctcgccctcctcatcatggccgtggggcttcacgtggcctaccagggcctgggcctcgtcttcttcggcccggagcagttccgccccgacccccttctccagggggaggtggtggtgggcctcacctggcagggcgtcttggtcctggccttcgccctcttgagcgccgccgccctctacctcttcttccgccgttccctcttcgggaaggcccttctggcggcggcggagaaccggcttggggcgaggctttgcgggatccgcccggaggaggcggggatggtggccttcgccatcgcgggcctcatggcggccctttcggggcttcttttggcgcccctcatcaacgccgcctacttcatgggctttatgctggggctcaaggccttcgtggcggccatcctgggtgggctcgtgagctacccggtggcctttttgggcgcggtcctggtggggctttttgaaagcttcaccagcttctacgcgagcgcctacaaggaagctttggtgttcctcctcctggtgccggccctcttctaccagagcctccgggcgaagggggtggaggagtga

SEQ ID NO: 27564 - protein, 325 aa, Thermus thermophilus
MDATILGLLLLDGVQNGVIYGLLALAMVLVFAVTRVILVPIGELMMFAPLSFVWLQEGKLPGTLWLALALGVLWALLERGRGRGLPLLGGMGLLLLFLLAQGSPALAYLAALLLVVYLGVATYRVFFQPMREATVLALLIMAVGLHVAYQGLGLVFFGPEQFRPDPLLQGEVVVGLTWQGVLVLAFALLSAAALYLFFRRSLFGKALLAAAENRLGARLCGIRPEEAGMVAFAIAGLMAALSGLLLAPLINAAYFMGFMLGLKAFVAAILGGLVSYPVAFLGAVLVGLFESFTSFYASAYKEALVFLLLVPALFYQSLRAKGVEE

SEQ ID NO: 27565 - DNA, 858 bp, Thermus thermophilus
  CDS (1)..(858)
atggagcttttcgcccagacccttctcaacggcgtgctgatggccggggtctacgccctggtggccacgggcctcgccctctccctgggggtggtgggcatcgtcaacttcgcccacggggagttcctcatgctcggggcctacctctcctacctcctcttcgccttccgcggcgtggaccccctcctttccctgggcctcgccttcctggccgccttcctggtgggcgcgctgacctaccacggcctgatccgcccggtgctcaaagctccggagctcaaccagatgctcctcaccttcggcctctccgtgttcctgcagaacctggccctcctcctcttcggggcggacacccgggtggtggccccgccctaccaggcggccaccctcgctttgggccccttcttcctgggggcggtgcccctcggggccttcctcctctccctggccctgcttctccttctccaggccttcctcacccgaagccgcctggggcttgcggtgcgggccgtggcccaaaaccgggtggcccccgggcttttagggatagaggcggaggcggtctacctcctcgccttcggcctctcggccgccctggccggggtcgccggggtgatgctctcggtgatgctctacgccagccccacggtgggcttcctcttcaccctaaagtccttcgccatcgtggccttggcggggctcgggaacctcaagggggtgatcccggcggctttggtcctggccctggccgaggccctggtgagcacctacgtccccgggggcggggggctggtggaggccgtcttcttcctggtgctcttcctggccctggtgggccgggcctggagggcggcatga

SEQ ID NO: 27566 - protein, 285 aa, Thermus thermophilus
MELFAQTLLNGVLMAGVYALVATGLALSLGVVGIVNFAHGEFLMLGAYLSYLLFAFRGVDPLLSLGLAFLAAFLVGALTYHGLIRPVLKAPELNQMLLTFGLSVFLQNLALLLFGADTRVVAPPYQAATLALGPFFLGAVPLGAFLLSLALLLLLQAFLTRSRLGLAVRAVAQNRVAPGLLGIEAEAVYLLAFGLSAALAGVAGVMLSVMLYASPTVGFLFTLKSFAIVALAGLGNLKGVIPAALVLALAEALVSTYVPGGGGLVEAVFFLVLFLALVGRAWRAA

SEQ ID NO: 27567 - DNA, 876 bp, Thermus thermophilus
  CDS (1)..(876)
atggcggacctccttccctacctcatcggcggcttggccaacggggccctctacagcctcctcgccttgggcttcgtcctcgtctaccgggcgaccagcgtggtgaacttcgccatcggggagttcctcctcgtgggggcctacctcacctacaccttcgccctcctccttcccctccccttggccctcctcgccgccctgcccctcgccttcctcttcggggtcctggtggaacggggcttcgtgcggccccttctcggccggaacgtggtggcggtgatcatggcgaccatcggcctcgccgccgccctggatgggggggtgcagctcctctggggcccggacctcaagtacctgccgggaagcctccccgacctcggctttgaagcgggaggggtctacgtctcctcccgggcggtctggaacctcctcctggccctgcccttggggctcggcctcctctggctcctccggaaaagccgctacggcgtcctggtccgggccatctccgagcgggaggtggccgccttggccctgggcatccccacggcccggatcctggccggggtctggggggtctccgccctcctcgccaccttggcgggggccctcctcgccgcggcgagcggggtggggcacaacctcgtcttcttcgggctcaaggtcttccccgtggccatcctgggggggcttgacgccgtgggcggggctctggcggcggggtttttgctcggggtcctcgaggccctctcccagcgctacctggaggcctacctccccggcttcaccgaggccctgcccttcgtggtggtcctcctcgtcctcctcgtgaggccctacggcctcttcggggagcggcagattgagagggtgtag

SEQ ID NO: 27568 - protein, 291 aa, Thermus thermophilus
MADLLPYLIGGLANGALYSLLALGFVLVYRATSVVNFAIGEFLLVGAYLTYTFALLLPLPLALLAALPLAFLFGVLVERGFVRPLLGRNVVAVIMATIGLAAALDGGVQLLWGPDLKYLPGSLPDLGFEAGGVYVSSRAVWNLLLALPLGLGLLWLLRKSRYGVLVRAISEREVAALALGIPTARILAGVWGVSALLATLAGALLAAASGVGHNLVFFGLKVFPVAILGGLDAVGGALAAGFLLGVLEALSQRYLEAYLPGFTEALPFVVVLLVLLVRPYGLFGERQIERV

SEQ ID NO: 27569 - DNA, 1068 bp, Thermus thermophilus
  CDS (1)..(1068)
atgttcgccctctccaaacgcctcaccgacgcctttagcctccgcttcgcccgggcggtgcgggagacctaccgggaggacgaggcctacgccagcacccccttgggccgcctcgccctctacgcctttctcctcctgctcctcctcctccccctcctcctcggcccctaccccatgtacgtggccaccctggtggccatcggggccctctccgccctgggcctccacctcctggtggggggcgcggggcagatctccttaggccacgccgccttcatgggggtgggggcctacgcggcaagccacctcacgggccccctcgcccccttggggatcctcctcgggggcgggatcgccgcctttttggggcttctcctcggcctcccctccctcaggatcaagggggtgtacctggccatcgccaccctggccttccagttcctggcggactacgtcttcaagacctgggaggcggtcacgggggggatccggggccggacccttcctccccccgaggtcttgggcctcgtcctggacaccccggagaagctctggtacctggtcctcctcttcgccctccccctcttcttctacggcaagcgcctcctcatgacccgcgccgggcgggccttccgggcggtgcgggacaacgacctctccgcccgggtggccggggtggacctcacccggaccaagctcctcgccttcgccctctccgccttctacgccggggtggcgggggggcttctcgccgggctctacaaggcggtgaccccggagtactttcccctctccgtgagcatccagtacctggccatggtcatcgtgggcggggcggggacggtcttgggagcggtcttgggggccttcttcgtcctcctcatccccgaggtgctcaatagcttcgtgggggccctgggcccggagtacgccgcccagctcgccgcctggcgcaacgtggtcttcggcggcctcatcctcctcttcctggtcctcgagcccctgggcctggtggggctttgggggcgggtgcgggactacttccgcacctggcccctgccctactag

SEQ ID NO: 27570 - protein, 355 aa, Thermus thermophilus
MFALSKRLTDAFSLRFARAVRETYREDEAYASTPLGRLALYAFLLLLLLLPLLLGPYPMYVATLVAIGALSALGLHLLVGGAGQISLGHAAFMGVGAYAASHLTGPLAPLGILLGGGIAAFLGLLLGLPSLRIKGVYLAIATLAFQFLADYVFKTWEAVTGGIRGRTLPPPEVLGLVLDTPEKLWYLVLLFALPLFFYGKRLLMTRAGRAFRAVRDNDLSARVAGVDLTRTKLLAFALSAFYAGVAGGLLAGLYKAVTPEYFPLSVSIQYLAMVIVGGAGTVLGAVLGAFFVLLIPEVLNSFVGALGPEYAAQLAAWRNVVFGGLILLFLVLEPLGLVGLWGRVRDYFRTWPLPY

SEQ ID NO: 27571 - DNA, 894 bp, Thermus thermophilus
  CDS (1)..(894)
atgagcttcttcctccagctcctcttctcgggggtggtcctggggctcgtctacgccctcgccgccttgggcttcgtcctcatctacaaggcgagccgggtggtgaacttcgcccaggggcagttcatcgccatcggggcctttttggcctactgggccatggtcgccttgggggcgccctttcttttggccgcggccttggccctggccttaaccgccctcttgggctttggggtggagcgggtcttcctgaagcgcatggtggggcagcccatcatctccgtcatcatggccaccatcggcctcgcctccctccttgacggcctgatccaccttacccccttcggggcgggcaacttcagctaccccgccttcctgccctcgggcggcgtcgccctcctgggggcgcaggtctcctacccccagctcctcgccctgggcttcaccctggccttcctcgccctcttcacctggtttttccagcgctccaccctggggatcgccatgcggagcgtggccgacgaccagatggcggccatgagcctcggggtctcggtggagaaggtcttcgccctggcctgggcggcggcggggctcacggcggcggcggccgggatcgtggtgggcaccatcgccggcctcaacctggacgggctggtgcacatcggccttagggtcttccccgtggtgatcctgggggggctggactccatccccggggcggtggtggcggggatcctcatcggcgtcttggaaaacctggcggcgggctacctggacccctttgtccccggcggggggacccgggacgtcttccccttcctggtcctccttttggttctctggttcaagccccatggcctcttcggcacggaggagattgagcgcgtatga

SEQ ID NO: 27572 - protein, 297 aa, Thermus thermophilus
MSFFLQLLFSGVVLGLVYALAALGFVLIYKASRVVNFAQGQFIAIGAFLAYWAMVALGAPFLLAAALALALTALLGFGVERVFLKRMVGQPIISVIMATIGLASLLDGLIHLTPFGAGNFSYPAFLPSGGVALLGAQVSYPQLLALGFTLAFLALFTWFFQRSTLGIAMRSVADDQMAAMSLGVSVEKVFALAWAAAGLTAAAAGIVVGTIAGLNLDGLVHIGLRVFPVVILGGLDSIPGAVVAGILIGVLENLAAGYLDPFVPGGGTRDVFPFLVLLLVLWFKPHGLFGTEEIERV

SEQ ID NO: 27573 - DNA, 861 bp, Bacillus cereus
  CDS (1)..(861)
atggatgtgttaatcaatttatttgtaaatgggatttcaacagggatgctcatttttttattagcatcaggtctttcacttattttcggtttaatgagtgttctaaacttcgcacatggtggtttatttgcatggggagcatttacaggtgtttggctatttaatatgacagggagttatgtgttagctttaattggagcaatagctatgggaatgttccttggatttattttagaaagattccttattagaccggtatacggaaatcatgttcgacagcttcttgttacacttggaggaatgcttgtacttagtgaatgtattaaagtattttggggaccaaatccaattggggcaaagttaccgttatggctacaaggaagttttacgttcggaggcgttatattaattaaatatcgtctattcgttatcataattggggttatcatatacattgccttattattattgctcaaaaaaacaaagataggtcttatgatacgcgcaggtgtaatggataaagagatggttcaagcgctcggtattaacgtaaaagctatattttctttcgtctttttattaggagcagggatggctgccttaggtggcttcttattagcaccatactcaggcgttattttcgctgagatgggtatgcagtatgcgattttagctttcatagtagtaatcattggagggctaggaagcgtacaaggttcagccatcgcttctttaattgtcggattagctggtgcttttacagcgtattttataccggatttatcacttgcaatcaatatgttaatgttactatttttcttaatagtgaagccaaatggacttgttggtgaaaaggggtga

SEQ ID NO: 27574 - protein, 286 aa, Bacillus cereus
MDVLINLFVNGISTGMLIFLLASGLSLIFGLMSVLNFAHGGLFAWGAFTGVWLFNMTGSYVLALIGAIAMGMFLGFILERFLIRPVYGNHVRQLLVTLGGMLVLSECIKVFWGPNPIGAKLPLWLQGSFTFGGVILIKYRLFVIIIGVIIYIALLLLLKKTKIGLMIRAGVMDKEMVQALGINVKAIFSFVFLLGAGMAALGGFLLAPYSGVIFAEMGMQYAILAFIVVIIGGLGSVQGSAIASLIVGLAGAFTAYFIPDLSLAINMLMLLFFLIVKPNGLVGEKG

SEQ ID NO: 27575 - DNA, 900 bp, Treponema denticola
  CDS (1)..(900)
atgttattgcagcaattaattaatggtctggtcataggaagtacatatgcattggttacaataggttttaatatggtgtacggtgtgttggagctgactaattttgcccatagttctttttatatgctggctgcgtatataggtcaattcattttgttaaaattctttatgactgtatcggtccctattgctctgattataacatttttaacttccataattataacagcctttttgggtgctcttatggataaaattgctttggagcctataagaataaaaaaaggtgctcctatttcatctttaataagtactgtcggtgttcagactataatcaacaactccgttcttttaattttcggcacagttccattatactttcctgatttattaaagctgggtaaatttactatttatggcggaactgtggttcaatggattcaggttctcatattgattatgactttaattataatgcttgtattaacttttattgttacgcgtacacgcttaggaaagtcaatgcgggcaatttctcaaaatcaagttgctgcaagacttatgggaataaatataaatagagttataacccttacattctttataggaactacagttgccggtatttcaggtttaatggttgcaatgtattatcaaagagtagataccttaatgggggcatctgtaggattaaagtcatttgctgcagcagttcttggcggaatgggctctctccccggagcggctataggaggattattgataggcttacttgaaactctttttgccgcttatataagttcaggatatagggatattgttgcatttgtgatattgatattggttcttcttattcggccctcaggcttaatgggtaaaaaaagtgtagataaggtatag

SEQ ID NO: 27576 - protein, 299 aa, Treponema denticola
MLLQQLINGLVIGSTYALVTIGFNMVYGVLELTNFAHSSFYMLAAYIGQFILLKFFMTVSVPIALIITFLTSIIITAFLGALMDKIALEPIRIKKGAPISSLISTVGVQTIINNSVLLIFGTVPLYFPDLLKLGKFTIYGGTVVQWIQVLILIMTLIIMLVLTFIVTRTRLGKSMRAISQNQVAARLMGININRVITLTFFIGTTVAGISGLMVAMYYQRVDTLMGASVGLKSFAAAVLGGMGSLPGAAIGGLLIGLLETLFAAYISSGYRDIVAFVILILVLLIRPSGLMGKKSVDKV

SEQ ID NO: 27577 - DNA, 1020 bp, Treponema denticola
  CDS (1)..(1020)
atgagaaaaaaatcgattatcttagataaaatgattaaaaaaatcgctaaaaatcagatatttgttttaattatacttgctgttctggcaatatctttcccgatttttgttgacaataattactatcttggcatagcaataatgttctttatatattcaatattgaccttatctcttaatttagttacgggttatgttggatttacacttttgggacaagcggcttttttcggtttgggggcttatgttgctgcaatacttggaacgcgttttcaagttgattttattatcggatgtatagcagcctctttatttgctggtatttttggagcaatgctggctctcccgactttgcgcatacgcggccgatattttgcaattgtaactctaggtttttctgaaatcatgcgaatgatagagcttaactggatggagatgacgcgaggccctcagggaatttcaaggataccgggtatagtaatttttgggaaagagtttgactcatacagatttaagtactatgttgggctggttcttttaatatttgccttatatataattaattcaattttaaattcaaaacatgggcgtgccgtacgcgcaataaaagatgacgatttagctgccggagctattggagtaaatgtttataaatataccgttattatattttctatttcagcgggtattgcaggaatggccggagcctattacgctcattatatgagttttattgatcctaatgcttttaattttgaacaatcaattttaattttatcgatggccatatttggcggattgggaagtttgcccggaagtattttaggagctctggcattgactattttacctgaagccctcagatttttatccgattatcggcaaattatatatggtcttatattggttttgatagttatatttaaaccctcaggtgttatgggtaagataaattttgaacggatacgatctatagcaaatatggaaaaggaggacttaaatgtcgaatccaattcttaa

SEQ ID NO: 27578 - protein, 339 aa, Treponema denticola
MRKKSIILDKMIKKIAKNQIFVLIILAVLAISFPIFVDNNYYLGIAIMFFIYSILTLSLNLVTGYVGFTLLGQAAFFGLGAYVAAILGTRFQVDFIIGCIAASLFAGIFGAMLALPTLRIRGRYFAIVTLGFSEIMRMIELNWMEMTRGPQGISRIPGIVIFGKEFDSYRFKYYVGLVLLIFALYIINSILNSKHGRAVRAIKDDDLAAGAIGVNVYKYTVIIFSISAGIAGMAGAYYAHYMSFIDPNAFNFEQSILILSMAIFGGLGSLPGSILGALALTILPEALRFLSDYRQIIYGLILVLIVIFKPSGVMGKINFERIRSIANMEKEDLNVESNS

SEQ ID NO: 27579 - DNA, 885 bp, Geobacter sulfurreducens
  CDS (1)..(885)
atgaatttaggccagcagatagcgcaatatcttctctccggactttcgacgggagccatctattccctgatcggggtcgggtttgccatcattcacaatgccacaggcattatcaatttcgcccaaggcgaactcgtgatgcttggcggcatgttcacgctcttttttctgacagccctgaatctgccgctgctggtagccataatcctggcaatcggcgccaccaccctcgtgggcgtagtgttcgaacgtctcgccatccgtcccatgaagaatgcctcgcctatcagcctcgtcatcatcacgatcggcggcagcattctcatccgcggcattgccatgatcgtctggggcaaggacactcacgccattcccacattctcgggcaatgagccgatccatctgggcgaggcaaccatccttccacagcacctctggatatttgcggtgaccattgtggtcatgatctgcagcaaactctacttcaactacaccatcagcggcaaggccatgcgtgcctgcgcctacaaccgtcgggccgccggtctcgtggggatcgacgtgcggcgcatggtgcttttttcctttgccatcagctctgccatgggttccctggccggtatcatcatcgctccgctcaccatgacctcctatgatgttggcatcatgctcggcctcaaaggattctgcgccgccatcatcggcggcatgagcagcggcctcggcaccatcctgggcggcattctcctcggcatcctggaatcgcttggcgctggacttttctcatccggctataaggacgccattgcctttatcatcctgttgctgattctctttgtacgtccccagggattgttccgcaagggcgagaccgagcgtgtctaa

SEQ ID NO: 27580 - protein, 294 aa, Geobacter sulfurreducens
MNLGQQIAQYLLSGLSTGAIYSLIGVGFAIIHNATGIINFAQGELVMLGGMFTLFFLTALNLPLLVAIILAIGATTLVGVVFERLAIRPMKNASPISLVIITIGGSILIRGIAMIVWGKDTHAIPTFSGNEPIHLGEATILPQHLWIFAVTIVVMICSKLYFNYTISGKAMRACAYNRRAAGLVGIDVRRMVLFSFAISSAMGSLAGIIIAPLTMTSYDVGIMLGLKGFCAAIIGGMSSGLGTILGGILLGILESLGAGLFSSGYKDAIAFIILLLILFVRPQGLFRKGETERV

SEQ ID NO: 27581 - DNA, 1158 bp, Agrobacterium tumefaciens
  CDS (1)..(1158)
atgcctatccggcgccgatcaaaccgctgccctattcggcctatggggagacggaaagcaatctgttctgcaccaccaacggtctcgacgcagcaaagctcaaaggctgacccctccccgcgtggtcccgccgaaccatgtttggcgggacaaagtctcggcaaggcggatctgcgttttttgtctgctcggcaccaacccgatttcggcaatggtaagaagcagaacaaagtctggtccgcccttctcacgaacggtggcgttatgctcgacattctctttatcggtctcagtctcggctcgatccttcttctggtggcactcggtctcgccatcacctacggcgccatgggcgtcatcaatatggcccatggcgaaatggtcatgatcggcgcttatgtcgccgtcctctcaggtatctggctgaaaactagccttctgcttgcaatacccctggcttttgtcgtgacggcgttgctcggcctgataatcgagcgggtggttgtgcggcgactctacggccgcctgctggacacgcttctcgccacctggggcattgccatccttctgcagcaagccgtaaggctcgaactgggcctcacctttttaggcattcatatagaagggctgggagctggactgcaaaatgtggccgtgccttcatatctgcagggcactttcaggttcgccggcgccgacatcaacgcgtatcgcaccttcatcatcgcggtgaccgccgcgctgacgctggcgacatggttcatcctctaccggacgacagccggcatgcaggtgcgcgccatcattcgcaacccgaagatggctgcggcctgcggcatcgatgtaaaacgcattaacgcgctcactttcgccttcggttccggtctcgccggtgttgcgggggtcatgatgtccggcttcaagaccgtgttcccggatatgggcacaacgatggtcgtggacggtttcatggtcgtggtaacgggcggcgtcggcagtctcttcggtacggccctgtcttccgggcttctcggcgaaatcaacgcgctggtggccatcggcacgaacgacattctggcgcgcgccgtcgttttcggggtcgtcatcctcgtcattctcgtaaagcccagcgggctgttctccttcaaggggcgctga

SEQ ID NO: 27582 - protein, 385 aa, Agrobacterium tumefaciens
MPIRRRSNRCPIRPMGRRKAICSAPPTVSTQQSSKADPSPRGPAEPCLAGQSLGKADLRFLSARHQPDFGNGKKQNKVWSALLTNGGVMLDILFIGLSLGSILLLVALGLAITYGAMGVINMAHGEMVMIGAYVAVLSGIWLKTSLLLAIPLAFVVTALLGLIIERVVVRRLYGRLLDTLLATWGIAILLQQAVRLELGLTFLGIHIEGLGAGLQNVAVPSYLQGTFRFAGADINAYRTFIIAVTAALTLATWFILYRTTAGMQVRAIIRNPKMAAACGIDVKRINALTFAFGSGLAGVAGVMMSGFKTVFPDMGTTMVVDGFMVVVTGGVGSLFGTALSSGLLGEINALVAIGTNDILARAVVFGVVILVILVKPSGLFSFKGR

SEQ ID NO: 27583 - DNA, 903 bp, Wolinella succinogenes
  CDS (1)..(903)
atgatggatattttaaccttttttcaacagttaattaatggcgtaagccttgggagcatgtacgctctcattgcgattggctatacgatggtttatggggtcttgcgcctcataaacttcgcgcacgcggatgtgatgatggtgggcgcttttttagtgttttttggggtctctagctttgctctccctttttgggcggctgcattgctttcgattcttttttcagcgcttcttggagtggtgatcgacaagattgcctacaaacccttaagaaacgccccccgaatctccatgctcatcacggctattggtgtgagctttttcttggagaacatcttcaacgtcttttttggaagcactcccaaatcctttgaggctcccgcttttttcaatgagaccctctcgctttcgcatctcgttttgacccatatcgctctgattgttcctttggtgacgctccttcttttggggatcttgctctatgtgctctatcgcaccaagcaagggatggccattagagcggtggcgtttgatgtgaacaccgtgaggctcatgggggtggatgccaatcaaattatctctatcgtctttatcatgggaagtgctctagcggccgtgggagggattttttatgcgattagctaccccaccattgatccgctaatgggggttcttattggccttaaggcgtttgcagccgcggttttgggcgggattggaagcgtgacgggcgcagtgcttggaggatttatccttggattcactgaggtggttgtggtggcgctatttcctgaattaagcggctataaggatgcctttgccttcctctttttaattctagtgcttctctttagacctgtgggaatcatgggggatgagcgcttggagaggagtcgattctaa

SEQ ID NO: 27584 - protein, 300 aa, Wolinella succinogenes
MMDILTFFQQLINGVSLGSMYALIAIGYTMVYGVLRLINFAHADVMMVGAFLVFFGVSSFALPFWAAALLSILFSALLGVVIDKIAYKPLRNAPRISMLITAIGVSFFLENIFNVFFGSTPKSFEAPAFFNETLSLSHLVLTHIALIVPLVTLLLLGILLYVLYRTKQGMAIRAVAFDVNTVRLMGVDANQIISIVFIMGSALAAVGGIFYAISYPTIDPLMGVLIGLKAFAAAVLGGIGSVTGAVLGGFILGFTEVVVVALFPELSGYKDAFAFLFLILVLLFRPVGIMGDERLERSRF

SEQ ID NO: 27585 - DNA, 1110 bp, Gloeobacter violaceus
  CDS (1)..(1110)
atgctaaaatccagccaatttcgatggggtccaattggttcggtggcacagcttcccattcggcaaacgatttttcagtggagcgaacgcctgccggcaccgctcaggcgctacgggcttttgggtgtgggcctgctcatcccggcattgatgctgctcacttcccagccgagctacctggccaatgtcgcggtgaccgtggcggtttacatggtgctggccatggggctcaacatcgtggtcggcctggcgggcctgttggatctgggctacatcgcctttttcgcggtgggcgcctatacctacgccatcggggcgccccatggcctcagcttctggctcgccctgccggtggctgcactgcttgccgccggtttcggggtgcttctgggggcaccgactttgcccttgcgcggcgactacctggccatcgtcaccctcggtttcggcgaaatcatccgcatctcgctcaacaacctcgactggctcacccgcggtccggcgggcatcagcggtgtacccgcacccgtgatcccctggataggcgccaaaggcttcacctggctcacgctctatcagccgctgcaactctatttcatcgcgcttgccttcgtcgcctttgtctactggatgaccagccgcctgaagcagtcgcgcgtcggccgcgcctgggtagccatccgcgaggatgagattgccgccgccgccatgggcgtcgacaccgtcaagctcaagctcctggccttcgccaccggggcggccctggccggcatggtcggggtgctctttgccgtgcagctcacctatgtctcccccgacagcttcaccctgatcgaatcggtgatggtcgtctcgatggtggtcctgggagggatgggatcggtgcccggggtggcccttggggctttgatcctaattgtcctgccggaggcgctccggggcttttccgagtaccggctgctgttatttggcgcggcgatgatcctggtgatgctcatccgtccccagggattattgggcgagcggcagggcgtgccgccccggcctacaggagccggtcttgaagacgaaacgccgctcgaagtcgaaaagcgcgacctgccggtgtaa

SEQ ID NO: 27586 - protein, 369 aa, Gloeobacter violaceus
MLKSSQFRWGPIGSVAQLPIRQTIFQWSERLPAPLRRYGLLGVGLLIPALMLLTSQPSYLANVAVTVAVYMVLAMGLNIVVGLAGLLDLGYIAFFAVGAYTYAIGAPHGLSFWLALPVAALLAAGFGVLLGAPTLPLRGDYLAIVTLGFGEIIRISLNNLDWLTRGPAGISGVPAPVIPWIGAKGFTWLTLYQPLQLYFIALAFVAFVYWMTSRLKQSRVGRAWVAIREDEIAAAAMGVDTVKLKLLAFATGAALAGMVGVLFAVQLTYVSPDSFTLIESVMVVSMVVLGGMGSVPGVALGALILIVLPEALRGFSEYRLLLFGAAMILVMLIRPQGLLGERQGVPPRPTGAGLEDETPLEVEKRDLPV

SEQ ID NO: 27587 - DNA, 1170 bp, Gloeobacter violaceus
  CDS (1)..(1170)
atgatagagcatccatcccactttgggacgggcggtggtacgctttggtgtgttcgccgcgctttgaggtttgctttgcaagaactggttcagcagctggtcaacggcatcacccttggcagtgtgtacgccctcatcgccctgggctacacgatggtttacggcatcctggaactgatcaattttgcccacggcgaagtgttcatggttggagctttcgtcgccctgggggtgttcgtggtgctgggcggcgcagggttgccctggtggttgctgctgcttgcggctctgctgtgtgcgatggccgtctgctcgctgctgggtatggggcttgaacgcctcgcctaccggccgctcctgagcgaagcgaaaccgctcggggcggtggaactgggcgtgatcgcggcaagcggcagcggcatctggtggctgtaccatcagctcaaaggcggcctatcccaggcggagtggtggttggggccggcggtgggtctgggggccgccgccgcgttttgggggctttttgcttaccttggccgcagcggtccggcgcgcaagacgccgcgcctgtcgctgctgatcacggcgctgggggcctcgattttgctgcagaacgccatgcgcctcatcgtcggcagccgcgatcggatcctgcccgaggtgctgccggcgtggagctttacgctggcgggggtgcagattaccgcgccgcaaatactgacggtgggggtgagcgttacggcgatggtcttgctcacctggctggtgcagagcacgcgcttgggcaaggcgatgcgcgccacggcccaggacatcgaggcggcccagttgatgggcatcaacacccgcctgatcatcgtcatcgtctttgtcctcggctccagcctggcggcggtagcaggggttctgttcggcatattctttaaatcgatcaattttttcatcggcttccaggccggtctcaaggcgttcaccgccgcggtcttgggaggaatcggcaacattcctggggcggtgttgggagggctgttgctcgggttgctcgaatcactggggtcgggctatatttcgagtgaatggaaagacgtatttgcgtttatagtgctggtcggtgtgcttttgcttcgcccctcggggcttctgggcgagaatgtgcccgaaaaagtttga

SEQ ID NO: 27588 - protein, 389 aa, Gloeobacter violaceus
MIEHPSHFGTGGGTLWCVRRALRFALQELVQQLVNGITLGSVYALIALGYTMVYGILELINFAHGEVFMVGAFVALGVFVVLGGAGLPWWLLLLAALLCAMAVCSLLGMGLERLAYRPLLSEAKPLGAVELGVIAASGSGIWWLYHQLKGGLSQAEWWLGPAVGLGAAAAFWGLFAYLGRSGPARKTPRLSLLITALGASILLQNAMRLIVGSRDRILPEVLPAWSFTLAGVQITAPQILTVGVSVTAMVLLTWLVQSTRLGKAMRATAQDIEAAQLMGINTRLIIVIVFVLGSSLAAVAGVLFGIFFKSINFFIGFQAGLKAFTAAVLGGIGNIPGAVLGGLLLGLLESLGSGYISSEWKDVFAFIVLVGVLLLRPSGLLGENVPEKV

SEQ ID NO: 27589 - DNA, 1092 bp, Chromobacterium violaceum
  CDS (1)..(1092)
atggatctgaatcatctgagcaccggcaagaaaatggcggtcttcgccgcctgcgcggtccttctggccgtgctgcccttcctggtcggcggcgcgctgggcaattcctgggtgcgcatcatcgacttcgcgctgctgtacgtgatgctggcgctgggcctgaacatcgtggtgggcttcgccggcctgctggacctgggcttcatcgccttctacgcgatcggcgcctatacctacgcgctgctgagctcgccgcacttcgacatccactggctattcttcctcaccattccgctgggcgcggccttcgcctcgctgggcggggtgctgctgggcacgccggtgctgaagctgaagggcgactacctggccatcgtgaccctgggtttcggcgagatcgtgcgcatcttcatgaacaacctgaaccagccggtcaacatcaccaacggtccccagggcatcaacctgatcgacccgatccacatcggcggcgcgtcgctgggccagaccatcgagctgttcgggctgagcttccacaacgtctacctgtactactacctgttcctggcgctgaccgtgctggtggtgatcatggcctggcgtctgcagcactcccgcatcggccgcgcctgggtggcgctgcgcgaggacgacatcgccgccgcggcgatgggcatcaacatccgcaacatcaagctcttggccttcggcctgggcgccttgtccggcggcgtggccggcggcctgttcgcctcgttccagggcttcgtgtcgccggaatcgttcagcctgctggagtccatcatgatcctggccatgatcgtgctgggcggcatgggccacatcccgggcgtgatcctgggcgccgtggtgctgaccatcgcgccggaaatcctgcgcgacgtgatcggcccgctgcagatgaagaccgtcggccgcatgctgatcgacccggaaaacgcccgcatgctgctgttcggcctggcgatggtggtgatgatgctggtccgtccggaagggatgtggccgtccaagcggcgcaaggctgagttccagcacgccaaagaagacgccgcggtgcagaaaggttaa

SEQ ID NO: 27590 - protein, 363 aa, Chromobacterium violaceum
MDLNHLSTGKKMAVFAACAVLLAVLPFLVGGALGNSWVRIIDFALLYVMLALGLNIVVGFAGLLDLGFIAFYAIGAYTYALLSSPHFDIHWLFFLTIPLGAAFASLGGVLLGTPVLKLKGDYLAIVTLGFGEIVRIFMNNLNQPVNITNGPQGINLIDPIHIGGASLGQTIELFGLSFHNVYLYYYLFLALTVLVVIMAWRLQHSRIGRAWVALREDDIAAAAMGINIRNIKLLAFGLGALSGGVAGGLFASFQGFVSPESFSLLESIMILAMIVLGGMGHIPGVILGAVVLTIAPEILRDVIGPLQMKTVGRMLIDPENARMLLFGLAMVVMMLVRPEGMWPSKRRKAEFQHAKEDAAVQKG

SEQ ID NO: 27591 - DNA, 930 bp, Chromobacterium violaceum
  CDS (1)..(930)
atggacatttttctgcagcaaatcctgaacggtctcgttctgggtagcatctacgcgctgatcgcgctgggctacaccatggtgtacgggatcatgggcctgatcaacttcgcccacggcgaagtggtgatgttcggcgccatggtcaccatcaccgtcatcaccaccctgatggggatgggcatcaacctgccggggccggcgctggtgctgatcggccttctggtggccattcccgcctgcatgctgctcggcttcaccatcgagcgcgtcgcctaccgcccgttgcggggcaagcagcgcctggcgccgctgatcaccgcgatcggcgtgtccatcgtgctgcaacaggtcgccatcctgatctggggccgcaactacatccccttcccgcagattctggaccatgatgtggtgagcattttcggcgccagcatcaccaagctgcagatcgtgatcatcgcgctgtgcctggccatcatggccggcctgctgctgatggtggaaaagaccaagctcggccgcgccatgcgcgccaccagccagaacccggccgtggccggcctgatgggcgtcaacgtcaacaccatcatctccgccaccttcgtcatcggttccggcctgggcgctatcgccggcgtgatggtggccaccaactacgaacaggcccactactacatgggcttcatgatcggtctgaaggccttcaccgccgcggtgctgggcggcatcggcaacctgggcggcgcggtggccggcggcattctgctgggcatcatcgaaagcctgggcgccggctacatcggctcgctgaccggcggcttcctggggtccaactaccaggacatcatcgccttcatggtgctgatcctggtgctgatcttccgtccgtccggcctgctgggcgaaaaaatggccgaccgcgcctga

SEQ ID NO: 27592 - protein, 309 aa, Chromobacterium violaceum
MDIFLQQILNGLVLGSIYALIALGYTMVYGIMGLINFAHGEVVMFGAMVTITVITTLMGMGINLPGPALVLIGLLVAIPACMLLGFTIERVAYRPLRGKQRLAPLITAIGVSIVLQQVAILIWGRNYIPFPQILDHDVVSIFGASITKLQIVIIALCLAIMAGLLLMVEKTKLGRAMRATSQNPAVAGLMGVNVNTIISATFVIGSGLGAIAGVMVATNYEQAHYYMGFMIGLKAFTAAVLGGIGNLGGAVAGGILLGIIESLGAGYIGSLTGGFLGSNYQDIIAFMVLILVLIFRPSGLLGEKMADRA

SEQ ID NO: 27593 - DNA, 1155 bp, Synechococcus sp
  CDS (1)..(1155)
atgcaactgctttttgaaagcctgttcaacggtgtggccattggctctgtcttgctgatggccgcgctcggactggccattgttttcggcctcatgggggtgatcaacctcgcccatggcgagctgatcatgcttggggcctacaccacctacgtggtgcagctgatcttcaaactgcctgtgctgcagccggtttacaacgcctacgtgctggtagcgcttcccctggccttcatcgtcagcggtgtggtcggcatcctgcttgaacgcaccgtgattcgccggctctatggcaacccgctggagacgttgctggcgacctggggtgtcagcttgattcttcagcagtttgtgcggagcgtgcccctggcccacgccgccggcctgatcctggcgctggtgctgggctttggcctgccggtgatcttgccgcagcgactgtttgacggtgccaaggcgcgctttgtacgcgctggcagctgggcggtttcggccctcgcaggtgtgttgctggctggtggcctggcctcacaaatcagtcgtatcgcccgagctacctcccgcaacgtggatgtcaccgcaccgaagtggatgcggggaggcatggagtggatggacatcacctttcctgtaccgcgcctggtgatcatcgtgatcacgatcgttgcggtggttggggtgacgtggttcctcaacaaaagcgtgtggggcatgcgcattcgtgccgtcacccagaaccgtgcgatgagtgattgcctgggcatccccacgcagacggtggacgtgctcaccttcggtatcggatccggtcttgccggtgtggctggtgttgcagtctccctactcggctccgttggtccgaacgtcggcggctcttacatcgtcggttgtttcatggtggtggtgctcgggggtgtcggcaatctgctcggcaccgtgctcgcctcctttgccattggatggctcaccgatctgatcggagctggtcgtctgctcacgatgtggcctgacatgccatctcctctggccgctgctgtggagttctttgccaccacgagcatggcccaggtgatggtgttcgctctgatcgtggtgttcctgcaattccgtcccgcgggtttgttcccgcagaagggacgcatggtggaggcctga

SEQ ID NO: 27594 - protein, 384 aa, Synechococcus sp
MQLLFESLFNGVAIGSVLLMAALGLAIVFGLMGVINLAHGELIMLGAYTTYVVQLIFKLPVLQPVYNAYVLVALPLAFIVSGVVGILLERTVIRRLYGNPLETLLATWGVSLILQQFVRSVPLAHAAGLILALVLGFGLPVILPQRLFDGAKARFVRAGSWAVSALAGVLLAGGLASQISRIARATSRNVDVTAPKWMRGGMEWMDITFPVPRLVIIVITIVAVVGVTWFLNKSVWGMRIRAVTQNRAMSDCLGIPTQTVDVLTFGIGSGLAGVAGVAVSLLGSVGPNVGGSYIVGCFMVVVLGGVGNLLGTVLASFAIGWLTDLIGAGRLLTMWPDMPSPLAAAVEFFATTSMAQVMVFALIVVFLQFRPAGLFPQKGRMVEA

SEQ ID NO: 27595 - DNA, 1155 bp, Prochlorococcus marinus subsp
  CDS (1)..(1155)
atggaattgcttcttgatagtttattcaacggtatagcgatcggatcagttttactagtagcagctttgggcttagctattgtatttggtttgatgggtgtaatcaatcttgcacatggtgaactaatgatgctaggtgcttacacaacatatgtaactcaattaattttcaaactcccactattaaaaccctattacaacgcttacgttatagtttctatattttttgcatttattgtcagtggagtagtaggaatacttttagaaaaaactgtaattagaaagttatacggaagtccattagaaactttacttgcaacatggggagtaagccttattcttcaacagtttgtccgcagtgttcctttagcttatgggacaggactagtaataagtctcataataggtttatttctaccatcagtattttcatcaaaagtaaaagagtctataaattttaaatatgtaaaatttagttcatggatatttgcagctttagcgggagttctctccggtaatttaatttcatcttcagttagcaaattaagtcgagctagtgcaagaaatgtggatgtcacggctccagcttggatgaggggtcaggttgaaatccttggaacagctttcccaaaaacaagattaatgataataataattactttaatatctgtgattgcaataactttatttttgaatcaaagtgcttggggtatgaggataagagcagtaactcaaaatagagaaatgagtgactgtcttggaatttcaacagaaaaagttgatgttcttacttttggaattggttctggattggcaggtgtagcaggagttgctgtatctcttttgggatcggttgggcctaatgttggaggaaattatatagttgggtgttttatggttgtagttttaggaggtgtagggaacctattgggtacaatttttgcctcttttggaataggaataatgactgatttaattggagctggtcgccttttatcaatatggcctgatatgcctctaccactatcaaatacaattaatttctttgcaactaccagtatggctagagttatgatttttgcgttaatagtaatattcctgcaattcaaacctactggtttattcccccagaaaggaaggatggttgagagttaa

SEQ ID NO: 27596 - protein, 384 aa, Prochlorococcus marinus subsp
MELLLDSLFNGIAIGSVLLVAALGLAIVFGLMGVINLAHGELMMLGAYTTYVTQLIFKLPLLKPYYNAYVIVSIFFAFIVSGVVGILLEKTVIRKLYGSPLETLLATWGVSLILQQFVRSVPLAYGTGLVISLIIGLFLPSVFSSKVKESINFKYVKFSSWIFAALAGVLSGNLISSSVSKLSRASARNVDVTAPAWMRGQVEILGTAFPKTRLMIIIITLISVIAITLFLNQSAWGMRIRAVTQNREMSDCLGISTEKVDVLTFGIGSGLAGVAGVAVSLLGSVGPNVGGNYIVGCFMVVVLGGVGNLLGTIFASFGIGIMTDLIGAGRLLSIWPDMPLPLSNTINFFATTSMARVMIFALIVIFLQFKPTGLFPQKGRMVES

SEQ ID NO: 27597 - DNA, 1155 bp, Prochlorococcus marinus
  CDS (1)..(1155)
atgcaactgcttcttgaaagtcttttcaatggtgtggccatcggctcggtgctgctggttgctgccctcggactggcgatagtcttcggcctgatgggtgtcattaacctcgcccatggcgagttgatcatgctcggggcctacaccacttatgtggtacagctgatcttcaagctgcctgctctgcagcctttctacaacgcttatgtgttggtggcgattcctctggccttcatcgttagtggtgtggttggtatcttgctagaacgcaccgtgattcgtcgtctctacggcaacccgttggagacattgttggcgacatggggcgttagcctgattctgcagcagtttgtgcgcagttttccattggcttatgcggctggcttggtgctggcgttagtgcttggtttcagtctgccgatcattcttcctgacaagcttttgcaggggcctcgggcccgcttggtgcgtgctggaagctggcttgtgtcggctctggctggggtgttactggcgggtggtttggcctctcagatcagtcgtatcgctcgtgcgacctctcgcaatgtcgatgtcacggcacctaagtggatgcgtggggggattgaactgtcgggcatgaccttccctgtaccacgcttggtgatcattgtgatcacgatcctcgctgtactcggtatcacctggtttttgaatcgcagtgtgtgggggatgcgcatcagggcagtgactcagaatcgttccatgagtgattgccttggaatctcaaccgatactgtggatgtgcttacctttggtatcggctccggtttggctggcatcgctggggtcgcggtgtctttgttgggctccgtgggacccaacgtcggcacttcttatatcgttggttgcttcatggtggtggtgcttggaggtgtgggaaatctgttcggtaccgtgttggcctcctttgctattggggtgctaacagacctgatcggtgctggccgtttgctcagtatctggccttcgatgcctgcgcctttggcgagtgtggttgatttttttgctaccacgagcatggcccaggtaatggtgtttgcgctgattgtggtgttcctgcagttccgacctgctggtctgtttccccagaggggacgcatggtggaggcttaa

SEQ ID NO: 27598 - protein, 384 aa, Prochlorococcus marinus
MQLLLESLFNGVAIGSVLLVAALGLAIVFGLMGVINLAHGELIMLGAYTTYVVQLIFKLPALQPFYNAYVLVAIPLAFIVSGVVGILLERTVIRRLYGNPLETLLATWGVSLILQQFVRSFPLAYAAGLVLALVLGFSLPIILPDKLLQGPRARLVRAGSWLVSALAGVLLAGGLASQISRIARATSRNVDVTAPKWMRGGIELSGMTFPVPRLVIIVITILAVLGITWFLNRSVWGMRIRAVTQNRSMSDCLGISTDTVDVLTFGIGSGLAGIAGVAVSLLGSVGPNVGTSYIVGCFMVVVLGGVGNLFGTVLASFAIGVLTDLIGAGRLLSIWPSMPAPLASVVDFFATTSMAQVMVFALIVVFLQFRPAGLFPQRGRMVEA

SEQ ID NO: 27599 - DNA, 885 bp, Bordetella pertussis
  CDS (1)..(885)
atggatttctttatccagatgatagtttcgggactgagcgtcggcgcggtctatgccctgatcgggctgggcctgaacctgacgttctggacgacccgcgtgctcaatttcgggcaggggtccgtcctcatggcaggcgccatgctgaccgcggtcatggtcggcgccggcgtcaatgtgtttctcgcggtgggcgtttcattgctcgtcaccgccttcatcctgtggatcgtcgagctggtcggcgtgcggcccatgcggcgcatgtccggcagcatgggctgggtggtctccacgctgggcatcggcatcttcctgcaggggatggccagctggctgttcggcacccaggcggtcgctttccccgacgtgctgttcagcagcgccgataccgtcgagttcatgggcgcctatatctcgctgcagtacatcgccgtgttcgtcatcagcgtgatgatcgtctgcctgatggagctgttcctgcggcattccatctggggctacggggtgcgcgcggtggcgcacgatcgcgacctggcggccctgatgggcataccggtgtaccgcgtggtcgtgttctcgttcctggtcagcggcgtgctggcgggcatcgccggcatcctggtgtcgcaggtctccggcaccgtggatccgaacttcggcctgcatctcctgattctcgccttcgtcgcggccgtggtcggcggcatgggcagcgcgttcggctcgctggtcggcggcctgatcctggggatcatggagaagctggtgggcggctacgtctcgcccgccgccgccgaggtggtggcgttcgtgctcttgattggcgtgctgacgattcgcccgcagggcttgttcggcaagcgtgaaaccgtgaaggtgtga

SEQ ID NO: 27600 - protein, 294 aa, Bordetella pertussis
MDFFIQMIVSGLSVGAVYALIGLGLNLTFWTTRVLNFGQGSVLMAGAMLTAVMVGAGVNVFLAVGVSLLVTAFILWIVELVGVRPMRRMSGSMGWVVSTLGIGIFLQGMASWLFGTQAVAFPDVLFSSADTVEFMGAYISLQYIAVFVISVMIVCLMELFLRHSIWGYGVRAVAHDRDLAALMGIPVYRVVVFSFLVSGVLAGIAGILVSQVSGTVDPNFGLHLLILAFVAAVVGGMGSAFGSLVGGLILGIMEKLVGGYVSPAAAEVVAFVLLIGVLTIRPQGLFGKRETVKV

SEQ ID NO: 27601 - DNA, 1797 bp, Bordetella pertussis
  CDS (1)..(1797)
atgaaccgcttcctgcttatcgcattcatcgtcgtgctggccggcctgccgctgctgtcggccacgcccgaattctggatcacgcaactcaactacatcggcctggccgccatggtggcgctggggctggtgctgctgaccggcgtgggcggcctgacctcgttcggccaggcggccttcgtgggcctgggcgcctacaccacggcactgctcaccacgcaatacgacatctcgccgtggctggcgctgccggtgggcctgctggtgacggccgtggtggcgttcctgctggggctgatcacgctgcggctgtcggggcattatctgccgctgggcaccatcgcctgggggctctcgctgtattacctgttcggcaacctggactggctcggcaagcatgacggcatcgccggcatcgagcccatcagcctgttcggctggtcgctggccagcggacgccatatttactacctgatctgggtgttcgtgctgctggcgctgtgggcgacgcgcaacctgctcgattcgcgtccgggccgcgccatccgcgccctgaagagcggcgccggcatggccgagtcgatgggggtcaataccggcatctacaaaatcgtcatcttcgtgtgggcggcgctgctggcctgcctgtcgggctggctgtatgcccatatgcagcgcgcggtcagccccagtccgttcggcctgaactacggcatcgaatacctcttcatggccgtggtcggcggcgccggccatgtctggggggcgctgctgggctcggcggtcatcctgggaatcaaggaccagctgcagaacatcctgcccaagctgatcgataccaacgccaacttcgaactgatcttcttcggcgtgctgatgatcctggtgctgcagtacgccagcaatggcctgtggcccattctgtcgggctggtgggagcgcgtcaccggcgcggccggctcgcggcgcaacatggcgccgccgccgcaagcgccggcgctgccgcaccgcgcccggccgcaggccggcgagctggtgctggaagtcgacagcatccgcaaggagttcggcggcctggtggcggtcaacgacattacgttcaaggtgcgcgccggcgaaatcatgggcctgatcggccccaacggcgccggcaagagcacgaccttcaacctgatcagcggcgtgctgccggccacgcgcggccaggtgcgcttcctgggcgatcgcatcgacggccgctcggcgcgcgagatcgccaagcgcggcgtgggccgcaccttccagcacgtgcagctgctgccgaccatgttggtgctggaaaacgtggccctgggggcgcacatgcgttcggacgtgggcgtgctgtcgggcgccttgcacagcgagcgcgcccgcgaggcccagctgctgcacgaagccgcgcagcagctgcagcgcgtcgggctgggcgactatctgtacgagcaggcgggcaacctggcgctgggccagcaacgcatcctggaaatcgcccgcgcgctggcgtgcgatccggtgctgctgatgctcgacgagcccagcctcgggctggcgccgcgcatcgtgcgcgagattttccatatcatcgcccggctgcgcgaaaccggcgtggcgatcctgctggtcgagcagaacgcccgcgccgccttgcaggttgccgattacggctacgtgctggaaaccggtgaaatcgtgctgcacggcccggcgcgcgaactggccggcaatccgcgcgtcatcgagagctacctgggcctgggcaagggcgcccaggactga

SEQ ID NO: 27602 - protein, 598 aa, Bordetella pertussis
MNRFLLIAFIVVLAGLPLLSATPEFWITQLNYIGLAAMVALGLVLLTGVGGLTSFGQAAFVGLGAYTTALLTTQYDISPWLALPVGLLVTAVVAFLLGLITLRLSGHYLPLGTIAWGLSLYYLFGNLDWLGKHDGIAGIEPISLFGWSLASGRHIYYLIWVFVLLALWATRNLLDSRPGRAIRALKSGAGMAESMGVNTGIYKIVIFVWAALLACLSGWLYAHMQRAVSPSPFGLNYGIEYLFMAVVGGAGHVWGALLGSAVILGIKDQLQNILPKLIDTNANFELIFFGVLMILVLQYASNGLWPILSGWWERVTGAAGSRRNMAPPPQAPALPHRARPQAGELVLEVDSIRKEFGGLVAVNDITFKVRAGEIMGLIGPNGAGKSTTFNLISGVLPATRGQVRFLGDRIDGRSAREIAKRGVGRTFQHVQLLPTMLVLENVALGAHMRSDVGVLSGALHSERAREAQLLHEAAQQLQRVGLGDYLYEQAGNLALGQQRILEIARALACDPVLLMLDEPSLGLAPRIVREIFHIIARLRETGVAILLVEQNARAALQVADYGYVLETGEIVLHGPARELAGNPRVIESYLGLGKGAQD

SEQ ID NO: 27603 - DNA, 882 bp, Bordetella pertussis
  CDS (1)..(882)
atgagcggactgattatccagggcctggtcaacggcctgatcctgggcgccatctacggcctgatcggcgtgggcctgaacgtgatcttcggcgtgctgcgcgtggtgaacttcgcgcacggcgagttcctggtgctgggcgcctactttgcctactacctgctcgaatacgccggcatcgacccgctgctggcattgccgctggccttcggcgccttcttcctggccggctacgtgctgtatttcgtgctgatcccgcgcctgtccaaggccgacgaccccgaaatcagctcgctgctgctcatgttcggcgtgtccatcatgctgggagccatcatgctgctggccttcgaggccgacgcacgttcgctgccctacgagatcgaaccggtgttcttcaagatcgggccggtgctgatcccgaccgtgcgcctgatcgccctggccatcgcgctggccgtggtcgccgtgctggcctggttcctgtaccgcacccagttgggcaaggcgctgcgcaccatcatcatgaaccgcgacgccgtgcgtatcgtcggcatcaacgtcgagcggctgtcggccgtggcgttcggcctgggcatcggcctggccgccgtcacgggcgtgctggtggccatggtgttcccggcattttcccccttcatgggcaacgactacaccctgatcggcttcatcgtcatcgtgctgggcgggctgggccatcccgtgggtgcgctggtcggcgccatgctgttcggcgtcaccgaacaggtttcggtggtgttcttcaacccctccatcgccacgatctgcggcttcgtgctgatggtggccatgatcttcgtgcggcccaccgggctgttcggccaccgcgccctgcgctga

SEQ ID NO: 27604 - protein, 293 aa, Bordetella pertussis
MSGLIIQGLVNGLILGAIYGLIGVGLNVIFGVLRVVNFAHGEFLVLGAYFAYYLLEYAGIDPLLALPLAFGAFFLAGYVLYFVLIPRLSKADDPEISSLLLMFGVSIMLGAIMLLAFEADARSLPYEIEPVFFKIGPVLIPTVRLIALAIALAVVAVLAWFLYRTQLGKALRTIIMNRDAVRIVGINVERLSAVAFGLGIGLAAVTGVLVAMVFPAFSPFMGNDYTLIGFIVIVLGGLGHPVGALVGAMLFGVTEQVSVVFFNPSIATICGFVLMVAMIFVRPTGLFGHRALR

SEQ ID NO: 27605 - DNA, 1950 bp, Bordetella pertussis
  CDS (1)..(1950)
atggatctgacaggttttctggcccagctgctcaacgggctggccgaggcatcgtcgctgttcctggtggcggcggggctttcgctgattttcggcgtgacgcgcatcgtcaatttcgcgcacggctcgctctacatgctgggcgtgtacgtggcgtattcgatcgtcgagcgcgtgggcggcaccgcgctgggcttctggttcggcctggtggccgcgtcgctggccgtcggcgtggtgggcgcggcgatcgaggtcgtgctgttgcgccgcatctatcgcgcgccggagctgttccagttgctggcgaccttcgccctggtgctggtcatcaacgacgccgcgctgtggatctggggcgccgaggatctgctggggcggcgcgcgccgggcctgaccggcgcgatcgacctgctgggccgccggtatccggtctacaacctggtgctgatcgtggtcgggccggtggtgctggggctgctctggctgctgctgacgcgcacgcgctggggcaccctggtgcgcgcggccacgcaggaccgcgagatgctcggcgcgctgggcgtgaaccaggcctggctgttcaccggcgtgttcgcgctgggcgccatgctggccgggctgggcggcgcgctgcagctgccgcgcgagccggccagcctgagcctggacctgcgcaccatcggcgatgcgttcgtcatcgtggtggtgggcggcatgggatcgattccgggggcctatgtggccgcgctcatcatcgccgagatcaaggcgctgtgcatcggcctgggcaccgtgaccctgctgggcttgagcatttcgttttccaagctgacgctggtggtggagttcgccttcatggcgctggtgctggtgttccgcccctggggcctgttcggacgcccgcagggcgccagccgcaactcggcgcccatcgaggcgccgctgcggccggccgcgccgcgcctgcgcatcctgtggggcgtcctgctggcctccctggcggtgctgccgctgctggcgcagtggcttccgtacgcggtggtgctgacgcaggacatcctgatcgccgtgctgttcgccgttagcctgcatttcatgatggggccgggcggcatgcattcgttcggccacgcggcgtacttcgggctgggcgcgtacggcgcggccttgctgctgaaggccgcctcgctgcccatggaggccgcgctggccttcgcgccgctggtgggcgcgctgggcgcgctggtcttcggctggttctgcgtgcgcctgtcgggcgtctatctggccatgctgaccctggcgttctcgcagatcgtctggtcggtggtgttccagtgggacgacttcaccggcggctccaacggcatgatcggcgtctggccggccgagtggctgtccggcaccgcctactactatctggcgctggcggtggtcgcggccgccgtgctgggcctgcggcgcgtgctgttctcgccattcggctacgcaatgcgcgccgggcgcgattccagcctgcgcgccgacgccatcggcatcgacgtcaagcgggtgcagtgggcggctttcgtggtggccggcgcgttcggcgggctggccggagcgctgtatgcgttttccaagggcagcatttcgcccgacaccatggcggtcagcaaatcggtggacggcctggtgatggtgctgctgggcggcatccagaccctgatcggcccggtggtgggcgcgacggcgttcaacgtgctgcaggattacatcatgcgcgccaccgagtactggcgcgcgctgttcggcggcgtcatcctcctgctggtgctggtgttcccgcaagggatcgcgggattctgccggcaggcggggcaatggtggagcgcgcgcgccggcaaggaccggccgccgcgcaagggcggcgccttcatcggcggaccgcgggagaagcaggcatga

SEQ ID NO: 27606 - protein, 649 aa, Bordetella pertussis
MDLTGFLAQLLNGLAEASSLFLVAAGLSLIFGVTRIVNFAHGSLYMLGVYVAYSIVERVGGTALGFWFGLVAASLAVGVVGAAIEVVLLRRIYRAPELFQLLATFALVLVINDAALWIWGAEDLLGRRAPGLTGAIDLLGRRYPVYNLVLIVVGPVVLGLLWLLLTRTRWGTLVRAATQDREMLGALGVNQAWLFTGVFALGAMLAGLGGALQLPREPASLSLDLRTIGDAFVIVVVGGMGSIPGAYVAALIIAEIKALCIGLGTVTLLGLSISFSKLTLVVEFAFMALVLVFRPWGLFGRPQGASRNSAPIEAPLRPAAPRLRILWGVLLASLAVLPLLAQWLPYAVVLTQDILIAVLFAVSLHFMMGPGGMHSFGHAAYFGLGAYGAALLLKAASLPMEAALAFAPLVGALGALVFGWFCVRLSGVYLAMLTLAFSQIVWSVVFQWDDFTGGSNGMIGVWPAEWLSGTAYYYLALAVVAAAVLGLRRVLFSPFGYAMRAGRDSSLRADAIGIDVKRVQWAAFVVAGAFGGLAGALYAFSKGSISPDTMAVSKSVDGLVMVLLGGIQTLIGPVVGATAFNVLQDYIMRATEYWRALFGGVILLLVLVFPQGIAGFCRQAGQWWSARAGKDRPPRKGGAFIGGPREKQA

SEQ ID NO: 27607 - DNA, 927 bp, Bordetella pertussis
  CDS (1)..(927)
atgtcagacctcatcccacaacttacccagcagttcttcaacggactgtccctgggggcgatctacgcgttgattgccattggctacacaatggtctacggcatcatcggtatgatcaacttcgcccacggcgagatctacatgatcggcgcctacgtcggcctggtcacgctgacggccatcggcaccaacagcggcctgccgctgcctttcatcatcgccgccatgctggtggtcgccatcttcgtgaccggcgtctacggctatagcgtcgaacgcgtggcgtaccggcccgtgcgcggcagcccccgcctggtggcgctgatctcggccatcggcatgtcgatcttcctgcagaactgggtcgccctcgggcagggcgcgcgcgacatggccgtgccggcgctggtctcgggcgcggtgcagttccacatgggttccagcttcgacgtcaccgtaccgtattcgcgcatcatgatcatcgtggtgactgtggtgctgatggtggcgctcacgctgttcatcaagtattcgcgcatggggcgcgcctcgcgcgcctgctcgcaggacatgcacatggccaacctgctgggcatcgacaccaaccgggtgatttccttcaccttcgtgctgggcgccatgctggccgcggtgggaggcgtgctgatcgccatcaccatcggcaagctgaatccgttcatcggcttcctggcgggcatcaaggcgttcaccgccgcggtgctgggcggcatcggcagcattcccggcgcgatgctgggcggcgtgctgctgggcctggccgaaaccttcgcggccgcctacatctcatcgcaatacaaggacatcgtggcttttgcgctgctggtgctgatcctgctgttccgtcccaccgggctgctcggcaaacctgaggtggaaaaagtctag

SEQ ID NO: 27608 - protein, 308 aa, Bordetella pertussis
MSDLIPQLTQQFFNGLSLGAIYALIAIGYTMVYGIIGMINFAHGEIYMIGAYVGLVTLTAIGTNSGLPLPFIIAAMLVVAIFVTGVYGYSVERVAYRPVRGSPRLVALISAIGMSIFLQNWVALGQGARDMAVPALVSGAVQFHMGSSFDVTVPYSRIMIIVVTVVLMVALTLFIKYSRMGRASRACSQDMHMANLLGIDTNRVISFTFVLGAMLAAVGGVLIAITIGKLNPFIGFLAGIKAFTAAVLGGIGSIPGAMLGGVLLGLAETFAAAYISSQYKDIVAFALLVLILLFRPTGLLGKPEVEKV

SEQ ID NO: 27609 - DNA, 1239 bp, Bordetella pertussis
  CDS (1)..(1239)
atgacccaacaaagtcctctcaagaatgccacgatcgccgcggtcatgaccgccgtcatcgtgacgccgatcttcggcctgcagctggtgcgccagggcgcgcgcaccctgatggagccgcgctgggacctggtcgcgctggcctgcgcgctggtttttgcgttccaactgttgcgcccgtggatttccaagcccttcaaggcgctgaaaacaggcctgccgacgctgccgtcggcgctggcgcgcggccacaaatggctggtcgtgctgctgatcgccgtctcggtgatctggccgttcttcagcgggcgcagctcggtggacatcgccacgctggtgctgatctacgtcatgctgggcctggggctgaacatcgtggtcggcttcgccggcctgctcgacctgggcttcgtgggcttttacgcggtcggggcctatacctacgccttgctttaccactggggcggctggagcttctgggaagcgctgccgttctcgggcgcggtcgcggcgctgttcggcttcgtgctgggctttccggtgctgcgcctgcgcggcgactacctggccatcgtcacgctgggctttggcgaaatcatccgcctgctgctcatcaacctgaacatgctgaccggcggcccggacggcatatccggcctgcccaagcccagcgtgctgggcatggaaatggcgcgccgcgccagcacggaaggcggccagaccttccatgagatcatgggctggactttccagaaccagcacatggtgatctacctgtacctgatggcgctggcgttggcgctggcgacgctgttcgtctccacgcggctgatccgcatgccggtggggcgcgcctgggaggcgctgcgcgaagacgagatcgcctgccgctcgctgggcctgaaccccacgcgcatcaagctgtcggccttcacgctgggcgccatgttcgccggtttcggcggcgccttcttcgcggcccgccagggcatggtcaaccccgagtcgttcaccttcatcgaatcggcgctgatcctggccatcgtggtgctgggcgggatgggctcgcagatcggggtgatcctggcggcgatcctgctgacggtgctgccggagctggcgcgcgagttcgccgaataccgcatgctgatgttcggcctggtgatggtattgatgatgatgtggcgtccgcagggattgctgcccatgaagcgtccgcatgtggagctgcgcaaatag

SEQ ID NO: 27610 - protein, 412 aa, Bordetella pertussis
MTQQSPLKNATIAAVMTAVIVTPIFGLQLVRQGARTLMEPRWDLVALACALVFAFQLLRPWISKPFKALKTGLPTLPSALARGHKWLVVLLIAVSVIWPFFSGRSSVDIATLVLIYVMLGLGLNIVVGFAGLLDLGFVGFYAVGAYTYALLYHWGGWSFWEALPFSGAVAALFGFVLGFPVLRLRGDYLAIVTLGFGEIIRLLLINLNMLTGGPDGISGLPKPSVLGMEMARRASTEGGQTFHEIMGWTFQNQHMVIYLYLMALALALATLFVSTRLIRMPVGRAWEALREDEIACRSLGLNPTRIKLSAFTLGAMFAGFGGAFFAARQGMVNPESFTFIESALILAIVVLGGMGSQIGVILAAILLTVLPELAREFAEYRMLMFGLVMVLMMMWRPQGLLPMKRPHVELRK

SEQ ID NO: 27611 - DNA, 921 bp, Bordetella pertussis
  CDS (1)..(921)
atgacgtttacgttgatcgtcgagcagttgctgaacggtctgcagttcgggttgatgctgtttctgattgccgccggcctgaccctggtgttcggcatcatggacatcatgaatctggcgcacggctcgctttacatggccggcgcctatgtcgcggccgaaaccatgcagcgcaccgggtccttcacggcggcggtgctggtggccgcgctggccaccggcctggtgggcgcggtgctcgagctcacgctgatccgcaagctggcggtgcgcgaccacctggcccaggtgctgggcacctacgccgtcatcctgatcgccaatgacctggtcaagatgatctgggggccggcgcccgtcatgctcaacatgccagccgccctgtccggcccggtgcgcctgctgcccgatctgctgtatccggcctaccggctgatgatcatcgtgttcgggctggcggccgccgccggcctgtactggttcgtgacgcgcacgcgcgccggcgtgctggtgcgcgccggcgcctccaatcgccagatggcgaccctgatgggcgtgcgcgtgcccttgctgttcctgggcgtgttcgtgctgggcgcgatgctggccgcggtggccggcgcgttgctggggccggtgaccgccgtgcagatcggcatgggcgagggaatcctgatcctggtgctggtgtgcatcgtcatcggcggcatcggctcgattcgcggggccttcgtgggcgcgctgctggtcggcatggtcgacaccgccggccgggccttcctgcccatgctgctgcgccaggtgtttccgcccgccgtggcttccagcgtcgggccgacgctggcggccatcgcgatctatgtcctgatggcgggggtgctggtgttccggccggccggcctgtttccggcgcgcgggtga

SEQ ID NO: 27612 - protein, 306 aa, Bordetella pertussis
MTFTLIVEQLLNGLQFGLMLFLIAAGLTLVFGIMDIMNLAHGSLYMAGAYVAAETMQRTGSFTAAVLVAALATGLVGAVLELTLIRKLAVRDHLAQVLGTYAVILIANDLVKMIWGPAPVMLNMPAALSGPVRLLPDLLYPAYRLMIIVFGLAAAAGLYWFVTRTRAGVLVRAGASNRQMATLMGVRVPLLFLGVFVLGAMLAAVAGALLGPVTAVQIGMGEGILILVLVCIVIGGIGSIRGAFVGALLVGMVDTAGRAFLPMLLRQVFPPAVASSVGPTLAAIAIYVLMAGVLVFRPAGLFPARG

SEQ ID NO: 27613 - DNA, 1038 bp, Bordetella parapertussis
  CDS (1)..(1038)
atggactcttcaattgcgctgatcctgctgcaagacggtgtggtcaacggcgccatttatgccctgctgggcatggcgctggtactggttttcgccgtcacgcgggtcattttcattccgcagggcgagttcgtcgccttcggcgccctgacactggccatgctggtcgacggccgcgtgccgggcaccgcctacctgctgcccctgctgggcggcgtgtgcctgctgctggagctggtgcgcgcgctgcgcaccggcgcgtggggcgccatgcccaaggtgctggccggctgcgtggcgctgcccctggcgctgctgtggctgaccgacagctatgcggcgcagggcacctcgctgtggctgaacatgctgctgaccctggccctggtgatcccgatggggccgatggtctaccgcatcgtctaccagccgctggccgaggccacggtgctggtgctgctgatcgtgtcggtcgccgtgcacttcgcgttgatggggctggcgctggtgttcttcggcgccgagggctggcgtacgccggcattcgtcagcgggcaggtcgatctcgggttctcgacctggtcggcgcaaagcctgttcgtggtggccacctgcgcgctgctgatcgtggcgctgtggctgttcttcggcaagacgctgtacggccgcgcgctgcgggccaccgccgtgaaccggcgcggcgcgcgcctggtgggcatcagcaccaccatgtcgggcagcctgacattcaccctggcggtgtccatcggcgccatgtcgggcatgctgatcgcgcccatcaccaccgtgtattacgacaccggcttcctgatcggcctgaagggcttcgtgggcgccatcatcggcggcctggtgagctacccggtggccgcggccggcgcactgctggtcggcatcctggaggccttctcgtcgttctgggccagttcgtacaaagaagtcatcgtgttcaccctgattatcccggttctggtctggcgttcgttcagcagccgtcatgtggacgaagaggaataa

SEQ ID NO: 27614 - protein, 345 aa, Bordetella parapertussis
MDSSIALILLQDGVVNGAIYALLGMALVLVFAVTRVIFIPQGEFVAFGALTLAMLVDGRVPGTAYLLPLLGGVCLLLELVRALRTGAWGAMPKVLAGCVALPLALLWLTDSYAAQGTSLWLNMLLTLALVIPMGPMVYRIVYQPLAEATVLVLLIVSVAVHFALMGLALVFFGAEGWRTPAFVSGQVDLGFSTWSAQSLFVVATCALLIVALWLFFGKTLYGRALRATAVNRRGARLVGISTTMSGSLTFTLAVSIGAMSGMLIAPITTVYYDTGFLIGLKGFVGAIIGGLVSYPVAAAGALLVGILEAFSSFWASSYKEVIVFTLIIPVLVWRSFSSRHVDEEE

SEQ ID NO: 27615 - DNA, 1839 bp, Bordetella parapertussis
  CDS (1)..(1839)
atgaaccgcttcctgcttatcgcattcatcgtcgtactggccggcctgccgctgctgtcggccacgcccgaattctggatcacgcagctcaactacatcggcctggccgccatggtggcgctggggctggtgctgctgaccggcgtgggcggcctgacctcgttcggccaggcggccttcgtgggcctgggcgcctacaccacggcgctgctcaccacgcaatacgacatctcgccgtggctggcgctgccggtgggcctgctggtgacggccgtggtggcgttcctgctggggctgatcacgctgcggctgtcggggcattatctgccgctgggcaccattgcctggggactctcgctgtattacctgttcggcaacctggattggctcggcaagcatgacggcatcgccggcatcgagcccatcagcctgttcggctggtcgctggccagcggacgccatatttactacctgatctgggtgttcgtgctgctggcgctgtgggccacgcgcaacctgctcgattcgcgtccgggccgcgccatccgcgccctgaagagcggcgccggcatggccgagtcgatgggggtcaataccggcatctacaaaatcgtcatcttcgtgtgggcggcgctgctggcctgcctgtcgggctggctgtacgcccacatgcagcgtgcggtcagccccagtccgttcggcctgaactacggcatcgaatacctcttcatggccgtggtcggcggcgccggccatgtctggggggcgctgctgggctcggcggtcatcctgggaatcaaggaccagctgcagaacatcctgcccaagctgatcgataccaacgccaacttcgaactgatcttcttcggcgtgctgatgatcctggtgctgcagtacgccagcaatggcctgtggcccattctgtcgggctggtgggagcgcgtcaccggcgcggccggctcgcggcgcaacatggcgccgccgccgcaagcgccggcgctgccgcaccgcgcccggccgcaggccggcgagctggtgctggaagtcgacagcatccgcaaggagttcggcggcctggtggcggtcaacgacattacgttcaaggtgcgcgccggcgaaatcatgggcctgatcggccccaacggcgccggcaagagcacgaccttcaacctgatcagcggcgtgctgccggccacgcgcggccaggtgcgcttcctgggcgatcgcatcgacggccgctcggcgcgcgagatcgccaagcgcggcgtgggccgcaccttccagcacgtgcagctgctgccgaccatgtcggtgctggaaaacgtggccctgggggcgcacatgcgttcggacgtgggcgtgctgtcgggcgccttgcacagcgagcgcgcccgcgaggcccagctgctgcacgaagccgcgcagcagctgcagcgcgtcgggctgggcgactatctgtacgagcaggcgggcaacctggcgctgggccagcagcgcatcctggaaatcgcccgcgcgctggcgtgcgatccggtgctgctgctgctcgacgagccggccgccggcttgcgctacaaggaaaagcaggaactggccaaggtgctggaacagctgcgcgccgaggggctgagcatcctgctggtggaacacgacatggactttgtgatgcgactgaccaatcacctggtggtcatggatttcggcaccaagctggccgagggcgtgcccgccgatgtgcagaagaacccggcggtgctggaggcctatctgggcggtatcgacgacgatcttcccgacgccggccagggcgcgccggcagccgccggaggtgcgcaatga

SEQ ID NO: 27616 - protein, 612 aa, Bordetella parapertussis
MNRFLLIAFIVVLAGLPLLSATPEFWITQLNYIGLAAMVALGLVLLTGVGGLTSFGQAAFVGLGAYTTALLTTQYDISPWLALPVGLLVTAVVAFLLGLITLRLSGHYLPLGTIAWGLSLYYLFGNLDWLGKHDGIAGIEPISLFGWSLASGRHIYYLIWVFVLLALWATRNLLDSRPGRAIRALKSGAGMAESMGVNTGIYKIVIFVWAALLACLSGWLYAHMQRAVSPSPFGLNYGIEYLFMAVVGGAGHVWGALLGSAVILGIKDQLQNILPKLIDTNANFELIFFGVLMILVLQYASNGLWPILSGWWERVTGAAGSRRNMAPPPQAPALPHRARPQAGELVLEVDSIRKEFGGLVAVNDITFKVRAGEIMGLIGPNGAGKSTTFNLISGVLPATRGQVRFLGDRIDGRSAREIAKRGVGRTFQHVQLLPTMSVLENVALGAHMRSDVGVLSGALHSERAREAQLLHEAAQQLQRVGLGDYLYEQAGNLALGQQRILEIARALACDPVLLLLDEPAAGLRYKEKQELAKVLEQLRAEGLSILLVEHDMDFVMRLTNHLVVMDFGTKLAEGVPADVQKNPAVLEAYLGGIDDDLPDAGQGAPAAAGGAQ

SEQ ID NO: 27617 - DNA, 873 bp, Bordetella parapertussis
  CDS (1)..(873)
atgtcggaattcatgcagttcattttctcgggagtgacagtgggcgcggtctacgcgctcgtcgccctcgggttcgcgatcatcttcaacgcgaccggcgtggtgaactttgcccagggcgagttcgtcatgctgggcggcatgatcactgtcttcgcgcacggcgcgggcctggcgctgccgctggccgcgctgctcgccatcgccgtgaccgccgcgacaggcgtggcgctgaaccgcctggcgatcgagccggcgcgcggcgcccccgtcgtctcgctcatcatcatcaccatcggcgcctcgatcttcatccggggcgcggtgcaaagcctgttcggcaagcagatccacagcctgcccgcgttctcgggcgacgacccgatacacgtgctgggcgccaccatcctgtcgcaaagcctgtggatgatcggcggcgcggtggcggtattcatcgtcctgtggctgttcttcaccaggacactgataggccgcgcggtgctggccacctcgaacaaccgcctggcggcccgcctggtcgggatcaacacccgattcatcatgaccctgtcgttcgcgctgtcggcggccatcggcgccctggccggcgtgctgatcacgccgatcacgctgacttcgtacgacgtgggcctgaccctggcgctcaagggctttgccgccgccatgctgggcggcatgggcagccccaagggcgcgctggccggcggcattctgctcggcctgctggaatccctgaccgccggctacctgtcgtcgcagtacaaggacgcggcggccttcctcaccattctcgcggtgctgttcttcatgccgcagggactgttcggacacaagtccacggatcgcgtataa

SEQ ID NO: 27618 - protein, 290 aa, Bordetella parapertussis
MSEFMQFIFSGVTVGAVYALVALGFAIIFNATGVVNFAQGEFVMLGGMITVFAHGAGLALPLAALLAIAVTAATGVALNRLAIEPARGAPVVSLIIITIGASIFIRGAVQSLFGKQIHSLPAFSGDDPIHVLGATILSQSLWMIGGAVAVFIVLWLFFTRTLIGRAVLATSNNRLAARLVGINTRFIMTLSFALSAAIGALAGVLITPITLTSYDVGLTLALKGFAAAMLGGMGSPKGALAGGILLGLLESLTAGYLSSQYKDAAAFLTILAVLFFMPQGLFGHKSTDRV

SEQ ID NO: 27619 - DNA, 930 bp, Bordetella parapertussis
  CDS (1)..(930)
atggatattttcactcaacagataatcaatggcctgacgctgggcagcgtgtatgcgctggtcgcgctgggctatacgatggtgtacggcatcatcggcctgatcaacttcgcgcatggcgacgtggtcatgatcggcgcgatggcggcgaccatggtcgccgccgccctggtgggcggcgatccgtccacgtcggccttcgccgtcctcggcgccggcctgctggtctcggtgcccctgtgcatggccgtgggctggaccgccgaacgcgtggcgtaccggcccttgcgccgcgcgccgcggctggccgcgctgatcaccgccatcggcgtatccatcatcctgcagaacgtggcgatgatggtgtggggccgcaattacctcaactttccccaggtgctcacgcccgccgtgttcgagatcggcggggcgcgcatgagcatgctgcagatcgccatcgtggtcatcgccgcgctgatcatgggcgcgctgctgctggtcgtgcacaagacgcggctgggtaccgccatgcgggccaccgcgcagaaccgcgaagtggccggcctgatgggcgtgaacatcaacaccgtgatctcggcggccttcctgatcggttcggcgctggcggccatcgccggcatgatggtcaccacctattacggcgtgtcgcagtacaccatgggcttcatgctgggcctgaaggcgttcaccgcggcggtgctgggcggcatcggcaacctggtcggggccatggccggcggcctgctgctgggcatcattgaatcgctgggctcgggctatatcggcgacctgaccggcggcttcctcggcagccactaccaggatgtcttcgccttcgtggtgctggtgatggtgctgatcttccggccttcgggcttgctgggcgagcgcgtgggagaccgggcatga

SEQ ID NO: 27620 - protein, 309 aa, Bordetella parapertussis
MDIFTQQIINGLTLGSVYALVALGYTMVYGIIGLINFAHGDVVMIGAMAATMVAAALVGGDPSTSAFAVLGAGLLVSVPLCMAVGWTAERVAYRPLRRAPRLAALITAIGVSIILQNVAMMVWGRNYLNFPQVLTPAVFEIGGARMSMLQIAIVVIAALIMGALLLVVHKTRLGTAMRATAQNREVAGLMGVNINTVISAAFLIGSALAAIAGMMVTTYYGVSQYTMGFMLGLKAFTAAVLGGIGNLVGAMAGGLLLGIIESLGSGYIGDLTGGFLGSHYQDVFAFVVLVMVLIFRPSGLLGERVGDRA

SEQ ID NO: 27621 - DNA, 888 bp, Bordetella parapertussis
  CDS (1)..(888)
atgaacatcgaatccattctcggcattccgatcaatgcgttcatgggccagttgctgatggggctgatgaacggcgccttctacgccatgctgagcctgggcctggcgatcattttcgggctgctcaacgtgatcaatttcctgcacggcgcccagttcatggtgggggcgttcatcgcctggatgctgctggcgtgggcgggcctgagctactgggtcgccctgctggtggcgccgctggtcgtcgcgatcggcgccgtgttcgtcgagcgcctgttcctgcggcatctctaccgtctcgaccatctctacggcatgctgctgaccttcggcctgatgttgatggtcgaggggctgtttcgcaagagcttcggctcgtccgggcttgcctatcccaatgtcatccccggcggcatgaacctgggtttcatgttcctgccgtattaccgggcctgggtcgtggcggcctcgctgctcgtctgccaggccatctggctgctgatcgagaagacgcggctgggaagctatctgcgcgcggcgaccgagaacccggacatggtgcgcgccttcggcatcaaggttcccgtgctgctgacgctgacctacgcgttcggcgcggggctggccggcctggcgggcgtcatggcggcgccgatctaccaggtcagtccgctgatgggctccaacctggtcatcctggtcttcgccgtggtggtgatcggcggcatgggctcgatcctgggctcgatcctgaccggcttctcgctgggcgccatcgaaggcctgaccaaactcttctacccgcaggcctcggcgaccgtgatcttcctcgtgatgatcatcgtgctgctcatcaagccgacgggcctgttcggcaaggcgaagtga

SEQ ID NO: 27622 - protein, 295 aa, Bordetella parapertussis
MNIESILGIPINAFMGQLLMGLMNGAFYAMLSLGLAIIFGLLNVINFLHGAQFMVGAFIAWMLLAWAGLSYWVALLVAPLVVAIGAVFVERLFLRHLYRLDHLYGMLLTFGLMLMVEGLFRKSFGSSGLAYPNVIPGGMNLGFMFLPYYRAWVVAASLLVCQAIWLLIEKTRLGSYLRAATENPDMVRAFGIKVPVLLTLTYAFGAGLAGLAGVMAAPIYQVSPLMGSNLVILVFAVVVIGGMGSILGSILTGFSLGAIEGLTKLFYPQASATVIFLVMIIVLLIKPTGLFGKAK

SEQ ID NO: 27623 - DNA, 876 bp, Bordetella parapertussis
  CDS (1)..(876)
atgatgttcctgactctgttattggtgggtatcgtcagcggcgtgctgggagggctgatactggccctcctgtccaccggcttcaaccttgccctcggggtgtcccgcgtcgtgaacttccagcacggcgccgtagtgctttggtcgatgtacgcggcctacgtgctgtgggaggctaccggcatcaatccctatctcggcctgctgctgatcgtgccggtggctttcgccatcggctacttcctgcatcgctggctgatcatccgctcgctccagacccctgaagacagccagatcctgttctccatcggactgctgatcgccttccagtacctggcccagttcgtctattccacggacgcccgctcgctgaccgaggaaagcctgcagcattccctgatcatcggtccggtcatcctgcaatacacccggctcgccgccgccgccgtctcgctgctggtgctggtgttgctgcatctgatgctgacccgcaccgatctgggacgcaagctgcatgcgtgcgcccagaaccccgtcggcgcgcgggtggccggcctgaacgtcgagcacctttcggcggtagcgctgggcatcgcggccgcctgcgcggcggtcagcggcaccgccctggccaccatggcgcccatcttcccggaacgggccttcgagtactcgctggccgcggtggtggtgtcggtgctcggcgggatgggcagcatgagcggcagcatcctgggcggattgatcgtgggcgtcatcatcgccgtctcgcaggtcaccggccatggcgatctcgcgctcgccatcgtctatgcgctggttttcctcatcttcctggtccacccgacggggctgatcagtgcggtcaaacgttga

SEQ ID NO: 27624 - protein, 291 aa, Bordetella parapertussis
MMFLTLLLVGIVSGVLGGLILALLSTGFNLALGVSRVVNFQHGAVVLWSMYAAYVLWEATGINPYLGLLLIVPVAFAIGYFLHRWLIIRSLQTPEDSQILFSIGLLIAFQYLAQFVYSTDARSLTEESLQHSLIIGPVILQYTRLAAAAVSLLVLVLLHLMLTRTDLGRKLHACAQNPVGARVAGLNVEHLSAVALGIAAACAAVSGTALATMAPIFPERAFEYSLAAVVVSVLGGMGSMSGSILGGLIVGVIIAVSQVTGHGDLALAIVYALVFLIFLVHPTGLISAVKR

SEQ ID NO: 27625 - DNA, 882 bp, Bordetella parapertussis
  CDS (1)..(882)
atgagcggactgattatccagggcctggtcaacggcctgatcctgggcgccatctacggcctgatcggcgtgggcctgaacgtgatcttcggcgtgctgcgcgtggtgaacttcgcgcacggcgagttcctggtgctgggcgcctattttgcgtactacctgctcgaatacgccggcatcggcccgctgctggcattgccgctggctttcggcgccttcttcctggccggctacgtcctgtatttcgtgctgatcccgcgcctgtccaaggccgacgaccccgagatcagctcgctgctgctgatgttcggcgtgtccatcatgctgggggccatcatgctgctggccttcgaggccgacgcacgctcgctgccctacgaaatcgaaccggtgttcttcaagatcggaccggtgctgatcccgaccgtgcgcctgatcgccctggccatcgcgctggccgtggtcgccgtactggcctggttcctgtaccgcacccagatgggcaaggccctgcgcgccatcatcatgaaccgcgacgccgtgcgcatcgtcggcatcaacgccgagcggctgtcggccgtggcgttcggcctgggcatcggcctggccgccgtcaccggcgtgctggtggccatggtgttcccggcgttctctcccttcatgggcaacgactacaccctgatcggcttcatcgtcatcgtgctgggcggattgggccaccccgtgggcgcgctggtcggcgccatgctgttcggcgtcaccgaacaggtgtcggtggtgttcttcaacccctccatcgccacgatctgcggcttcgtgctgatggtggccatgatcttcgtgcggcccaccgggctgttcggccaccgcgccctgcgctga

SEQ ID NO: 27626 - protein, 293 aa, Bordetella parapertussis
MSGLIIQGLVNGLILGAIYGLIGVGLNVIFGVLRVVNFAHGEFLVLGAYFAYYLLEYAGIGPLLALPLAFGAFFLAGYVLYFVLIPRLSKADDPEISSLLLMFGVSIMLGAIMLLAFEADARSLPYEIEPVFFKIGPVLIPTVRLIALAIALAVVAVLAWFLYRTQMGKALRAIIMNRDAVRIVGINAERLSAVAFGLGIGLAAVTGVLVAMVFPAFSPFMGNDYTLIGFIVIVLGGLGHPVGALVGAMLFGVTEQVSVVFFNPSIATICGFVLMVAMIFVRPTGLFGHRALR

SEQ ID NO: 27627 - DNA, 876 bp, Bordetella parapertussis
  CDS (1)..(876)
atggacgtctacatgcaattgaccatgaacagtctgcagatcgccgcggcgtacatactgttctcgttgggcctgacgctgatcttcggcgtcatgcggatcgtgaacttcgcgcacggcgagttcttcaccctgcctctgctggtcatgggcgtgctggtgccgctgctggtcggcgcgcagctgccgctcatcgtgtcctatgcgctgagcggcgtgctgggcatcgcggccacgctgctgctgggcgggcttatctacaagttcgccctcaagcgcttcctgcgcgacatgaccggctctttcgtggtgtcggtcggcctctcgctgctgctgcaaggggtcttcctggagactttcggcggcgtgccgaccaagctgcccacgctggtggagggcacggtgaacatcctgggcgcgttcgttaccgtccagcgcctcatcatcaccggctgcgcgctgctggtggccgtgttcatgtgctggacgatcgtttccagccgcctgggcaaggccttgcgtgcggtggccgaggaccatgaggccgccatgctccagggcattccctaccgccgcatcgccctggccggcttcctcatcgcgaccgtgctcgcggcgatcgccgcggtcctgctttcgccggtcacggtatcgagcccgatcatcggcaacgactacctcatccgcggcttcatcgccatcgtgatcggcggcctgggcagcattcccggcgccatcctgggcagcgtcctgatcgcggtcatagagagcctgggcgggtattacttcgaccccacctgggccaccatcacgatgttcgccctgaccatgtttgtactgctcgttcgtccgaaggggatcctgggaaatggctaa

SEQ ID NO: 27628 - protein, 291 aa, Bordetella parapertussis
MDVYMQLTMNSLQIAAAYILFSLGLTLIFGVMRIVNFAHGEFFTLPLLVMGVLVPLLVGAQLPLIVSYALSGVLGIAATLLLGGLIYKFALKRFLRDMTGSFVVSVGLSLLLQGVFLETFGGVPTKLPTLVEGTVNILGAFVTVQRLIITGCALLVAVFMCWTIVSSRLGKALRAVAEDHEAAMLQGIPYRRIALAGFLIATVLAAIAAVLLSPVTVSSPIIGNDYLIRGFIAIVIGGLGSIPGAILGSVLIAVIESLGGYYFDPTWATITMFALTMFVLLVRPKGILGNG

SEQ ID NO: 27629 - DNA, 930 bp, Bordetella bronchiseptica
  CDS (1)..(930)
atgtttcgtcgcaaatatggaaccgcgctttgcgcgctggtcctcatcgcattgccggccctgctcaacgacccgttcatcacccacctgggcgtgcgggcggccacctacgccatcgtagtcatgggcctgacgctgttcgccggctacaccggccagatctcgctggggcacgccgccttcttcgggctggccgcctatctgtcgggcatgatggccaaggccggcgtgccctacctggtatcggtgccggtcgccacggccgcagtcggcgtgctgggctgcctggtcggcatgctggtgctgcgcaccagcggccactacctggcgctggccagcatcgccgtcgcggtcatcgtgcaggtcatcatcaagaacagcacgatcaccggcggcccttccgggttgacggccgtgcccgcgccggatttcttcggctggtcgctcaccagcgacctgggctactactactacgtgctgctgtgcatgttcgccggcttcgtcatcctgcgccgggtcatcgactcgcgcaccggcgacgccctgcaggccatcgccaacaacgaactggccgcccagtcgctgggcatcccggtgttccgctacaaggtgctgtcattcaccatcagcaccctgttcgcggcgttcgccggcaccctgttcgtgcactacgacggcttcatcgacccggacaggctgggcatccacgtctccgtgctgttcctgatcatgaccttcgtgggcggcatcggcaacatctacggctcggtgatcggcgccttcgcgctgaccatcatcgaggagtacgcccaggaattcggccaatacaacatcctggtctacggcctgctgctggcgctggtgatcctgttcctgcccaaaggactggtggatctgcccaacaagctcaaatccctgcgcgcgaggtaa

SEQ ID NO: 27630 - protein, 309 aa, Bordetella bronchiseptica
MFRRKYGTALCALVLIALPALLNDPFITHLGVRAATYAIVVMGLTLFAGYTGQISLGHAAFFGLAAYLSGMMAKAGVPYLVSVPVATAAVGVLGCLVGMLVLRTSGHYLALASIAVAVIVQVIIKNSTITGGPSGLTAVPAPDFFGWSLTSDLGYYYYVLLCMFAGFVILRRVIDSRTGDALQAIANNELAAQSLGIPVFRYKVLSFTISTLFAAFAGTLFVHYDGFIDPDRLGIHVSVLFLIMTFVGGIGNIYGSVIGAFALTIIEEYAQEFGQYNILVYGLLLALVILFLPKGLVDLPNKLKSLRAR

SEQ ID NO: 27631 - DNA, 873 bp, Bordetella bronchiseptica
  CDS (1)..(873)
atggaccattttctgcagcaactgatctacggcctgtccgtgggcagcacctatgccatgatcgccctggcgatcacgctggtgttccggggaatggacatcatcaacttcgcgcaaggcgaaatcttcatggtgggggcattcctgggctacgtcttccacgtggacctgggactgtcgatgtggctggcctttccgctggccatcgcctcggcgctggtgttcggctcgttcctcgaacggatgttcatgcggcggctggaaaacagcaaccagctctcgctgttcatgatgaccgtggcgctgttcatcctgctgcgcagcgccgcgcaactggtcttcggctcgtccgcgtaccgctttccgccgctgagcgaacatgcggcctcgatcggctcggtgcgcatcagcgaccagtacctgatcgtcatcggcatgacgctgctcatcatgctgctgctgtacctgctgttcacccgcacgccgctgggcctgtcggtgcgggcggtcgcgcaggacaagaccaccgcgcgcatgatgggcatcaacgtttcacgcatcaacaacttcaccgtggcgctgtgctcggcgctgggcgctgcggccggcatcgtctacgcgccgatagcggtgctgtcgttcgacatgggcaacctgatcatgctcaagggcttcaccgccgcgctgctgggcgggctgggcctgctctcgggcgcggtgctgggcggaatcatgctgggcgtcatcgagcagttcggcacgctgttgatcaactccgcctacaaggatctggtctcgttctcgatcctgctgctcatcatcctggtcaagcccaacggcatcctgggcaagaagcagatcaagaaagtctaa

SEQ ID NO: 27632 - protein, 290 aa, Bordetella bronchiseptica
MDHFLQQLIYGLSVGSTYAMIALAITLVFRGMDIINFAQGEIFMVGAFLGYVFHVDLGLSMWLAFPLAIASALVFGSFLERMFMRRLENSNQLSLFMMTVALFILLRSAAQLVFGSSAYRFPPLSEHAASIGSVRISDQYLIVIGMTLLIMLLLYLLFTRTPLGLSVRAVAQDKTTARMMGINVSRINNFTVALCSALGAAAGIVYAPIAVLSFDMGNLIMLKGFTAALLGGLGLLSGAVLGGIMLGVIEQFGTLLINSAYKDLVSFSILLLIILVKPNGILGKKQIKKV

SEQ ID NO: 27633 - DNA, 957 bp, Bordetella bronchiseptica
  CDS (1)..(957)
atgcggatatcatcgaaacactggacgctgatcgtcctggccgcgctgatcgccatcgccccgctgttcttcccctccggctattacttccgcgtgggctcgacaattttcgtcaacgcgctggcggtcaccggcatcgtcatcctgaccggctacgccggccagatcagcctgggacacgcgggattcgccggcatcggcggctatgcctgcgcgctggcgcccgtgcacctcgggctgccctcggcgctgtcggtcgtgctgggcgcggccgtctcgggcgcgctggcgtggctggtcggccgccccatcctgcgcctgaagggctactacctgggcgtggcctcgctgggcttcggcatcctggtggccatggtgctgaacaatgaacgccagctcaccaaagggccggacggcatcgccgtgcccgaccccggtctgcgcagcctgttgaagggctggggcctggacctgtccaatggccagttctggtacgccatgacgggcatcgcgctggtgatcggcgcctggctcgcgctcaacctctaccacagcccgacagggcgggcgctgcgcgcgctgcacggttcggagatcgccgccggcaccgtcggcatcgacgtggcgggcgccaagctcaaggcgtttgtcgtctcggccgtgtacgcctcggtctcgggctcgctgctggcgctgcagaaccgcttcatcacgccggacatcgcgggcttcatgcactcgatcgaaatggtgaccatggcggtgctgggcggcgtcggctcggtcgccggcgcaatcttcggcgcgagcctgctgaccctgcttccgcaggtgctgacggtgttcgccgactacgaacccctcatcctgggcctgaccatgatgctggtcatgatcttcctgcccgaaggcctggttccgtccatcatgcgcacgatacgaggaaggaaaaaatga

SEQ ID NO: 27634 - protein, 318 aa, Bordetella bronchiseptica
MRISSKHWTLIVLAALIAIAPLFFPSGYYFRVGSTIFVNALAVTGIVILTGYAGQISLGHAGFAGIGGYACALAPVHLGLPSALSVVLGAAVSGALAWLVGRPILRLKGYYLGVASLGFGILVAMVLNNERQLTKGPDGIAVPDPGLRSLLKGWGLDLSNGQFWYAMTGIALVIGAWLALNLYHSPTGRALRALHGSEIAAGTVGIDVAGAKLKAFVVSAVYASVSGSLLALQNRFITPDIAGFMHSIEMVTMAVLGGVGSVAGAIFGASLLTLLPQVLTVFADYEPLILGLTMMLVMIFLPEGLVPSIMRTIRGRKK

SEQ ID NO: 27635 - DNA, 1950 bp, Bordetella bronchiseptica
  CDS (1)..(1950)
atggatctgacaggttttctggcccagctgctcaacgggctggccgaggcatcgtcgctgttcctggtggcggcggggctttcgctgattttcggcgtgacgcgcatcgtcaatttcgcgcacggctcgctctacatgctgggcgtgtacgtggcgtattcgatcgtcgagcgcgtgggcggcaccgcgctgggcttctggttcggcctggtggccgcgtcgctggccgtcggcgtggtgggcgcggctatcgaggtcgtgctgttgcgccgcatctatcgcgcgccggagctgttccagctgctggcgaccttcgccctggtgctggtcatcaacgatgccgcgctgtggatctggggcgccgaagacctgctggggcggcgcgcgccggggctgaccggcgcggtcgacctgctgggccgccagtacccggtctacaacctggtgctgatcgtgatcgggccggtggtgctggggctgctctggctgctgctgacgcgcacgcgctggggcaccctggtgcgcgcggccacgcaggaccgcgagatgctcggcgcgctgggcgtgaaccaggcctggctgttcaccggcgtgttcgcgctgggcgccatgctggccgggctgggcggcgcgctgcaattgccgcgcgagccagccagcctgagcctggacctgcgcaccatcggcgacgcgttcgtcatcgtggtggtgggcggcatggggtcgatcccgggcgcctatgtggccgcgctcatcatcgccgaaatcaaggcgctgtgcatcggcctgggcaccgtgaccctgctgggcttcagcgtgtcgttctccaagctgacgctggtggtggagttcgccttcatggcgctggtgctggtgttccgcccctggggcctgttcggacgcccgcagggcgccagccgcaactcggcgcccatcgaggcgccgctgcggccggccgcgccgcgcctgcgcatcctgtggggcgtcctgctggccgccctggcgacgctgccgctgctggcgcagtggctgccgtacgcggtggtgctgacgcaggacatcctgatcgccgcgctgttcgccgtcagcctgcatttcatgatggggccgggcggcatgcattcgttcggccacgcggcgtacttcgggctgggcgcgtacggcgcggccttgctgctgaaggccgcctcgctgcccatggaggccgcgctggccttcgcgccgctggtggccgccctgggcgcgctgatcttcggctggttctgcgtgcgcctgtcgggcgtctatctggccatgctgaccctggcgttctcgcagatcgtctggtcggtggtgttccagtgggacgacttcaccggcggctccaacggcatgatcggcgtctggccggccgagtggctgtccggcaccgcctactactatctggcgctggcggtggtcgcggccgccgtgctgggcctgcggcgcgtgctgttctcgccattcggctacgcaatgcgcgccgggcgcgattccagcctgcgcgccgacgccatcggcatcgacgtcaagcgggtgcagtgggcggctttcgtggtggccggcgcgttcggcgggctggccggagcgctgtatgcgttttccaagggcagcatttcgcccgacaccatggcggtgagcaagtcggtcgacggcctggtgatggtgctgctgggcggcatccagaccctgatcggcccggtggtgggcgcgacggcgttcaacgtgctgcaggattacatcatgcgcgccaccgagtactggcgcgcgctgttcggcggcgtcatcctcctgctggtgctggtgttcccgcaagggatcgcgggattctgccggcaggcggggcaatggtggagcgcgcgcgccggcaaggaccggccgccgcgcaagggcggcgccttcatcggcggaccgcgggagaagcaggcatga

SEQ ID NO: 27636 - protein, 649 aa, Bordetella bronchiseptica
MDLTGFLAQLLNGLAEASSLFLVAAGLSLIFGVTRIVNFAHGSLYMLGVYVAYSIVERVGGTALGFWFGLVAASLAVGVVGAAIEVVLLRRIYRAPELFQLLATFALVLVINDAALWIWGAEDLLGRRAPGLTGAVDLLGRQYPVYNLVLIVIGPVVLGLLWLLLTRTRWGTLVRAATQDREMLGALGVNQAWLFTGVFALGAMLAGLGGALQLPREPASLSLDLRTIGDAFVIVVVGGMGSIPGAYVAALIIAEIKALCIGLGTVTLLGFSVSFSKLTLVVEFAFMALVLVFRPWGLFGRPQGASRNSAPIEAPLRPAAPRLRILWGVLLAALATLPLLAQWLPYAVVLTQDILIAALFAVSLHFMMGPGGMHSFGHAAYFGLGAYGAALLLKAASLPMEAALAFAPLVAALGALIFGWFCVRLSGVYLAMLTLAFSQIVWSVVFQWDDFTGGSNGMIGVWPAEWLSGTAYYYLALAVVAAAVLGLRRVLFSPFGYAMRAGRDSSLRADAIGIDVKRVQWAAFVVAGAFGGLAGALYAFSKGSISPDTMAVSKSVDGLVMVLLGGIQTLIGPVVGATAFNVLQDYIMRATEYWRALFGGVILLLVLVFPQGIAGFCRQAGQWWSARAGKDRPPRKGGAFIGGPREKQA

SEQ ID NO: 27637 - DNA, 876 bp, Bordetella bronchiseptica
  CDS (1)..(876)
atggatacagtgctgttcgccaatgccatcatcaatggcgtcattgtcgggttgctgctggcgttaccggccttggccattacgttggtattcggcatagcccggtttcccaacgccgccgccggcgactacatgaccttcggcgcctacgcgaccgtggccgcgcaggcgttcatgggcgcgtcgctggtcggcagcgcgatcgtggcgacgctggccaccgggctgctttccctgttcttctatttctgggtcttcaggaaactggcgcagcgctcgctggtggcgcgcctgatcgcctcgatcggcatcgccttcgccgtcagggccgccattaccttcttcgccgggcacgggcaatacaccatccaggcgccgctgcagcgggcctggaacttcggcgggatacgcatcctgccgctggatgtgtacatcctcctggccgcgctgcttgccctggccttcatgttcggcctgctttacctgtcgccgacgggccggcgcatgcgggccgtatcggacaacccgcaactggcggccgtcggcggcatcggcgtgcgcaaggtaatggtgatcctctgggggatcgtcggggtgttctcggggctgggcggcgtattgctgggcatcaaggcgacggtgctgccggaactgggctgggaactgctgctgcccatgttcgccgcggtgatcctgggcggggtcggcagtccggtcggcgccgtgctggggatgatcgtgttcggcatcgcccaggaggccgcgacgctctatatcgggtccgcctacaagattgtgatcgctttcctggtgttgctggttgtcctgctgttcaggccccagggcatcatgggccgcgtccaggcagtgaggtaa

SEQ ID NO: 27638 - protein, 291 aa, Bordetella bronchiseptica
MDTVLFANAIINGVIVGLLLALPALAITLVFGIARFPNAAAGDYMTFGAYATVAAQAFMGASLVGSAIVATLATGLLSLFFYFWVFRKLAQRSLVARLIASIGIAFAVRAAITFFAGHGQYTIQAPLQRAWNFGGIRILPLDVYILLAALLALAFMFGLLYLSPTGRRMRAVSDNPQLAAVGGIGVRKVMVILWGIVGVFSGLGGVLLGIKATVLPELGWELLLPMFAAVILGGVGSPVGAVLGMIVFGIAQEAATLYIGSAYKIVIAFLVLLVVLLFRPQGIMGRVQAVR

SEQ ID NO: 27639 - DNA, 888 bp, Bordetella bronchiseptica
  CDS (1)..(888)
atgaacatcgaatccattctcggcattccgatcaacgcgttcatgggccagttgctgatggggctgatgaacggcgccttctacgccatgctgagcctgggcctggcgatcattttcgggctgctcaacgtgatcaatttcctgcacggcgcccagttcatggtgggggcgttcatcgcctggatgctgctggcgtgggcgggcctgagctactgggtcgccctgctggtggcgccgctggtcgtcgcgatcggcgccgtgttcgtcgagcgcctgttcctgcggcatctctaccgtctcgaccatctctacggcatgctgctgaccttcggcctgatgctgatggtcgaggggctgtttcgcaagagcttcggctcgtccgggcttccctatcccaatgtcatccccggcggcatgaacctgggtttcatgttcctgccgtattaccgggcctgggtcgtggcggcctcgctgctcgtctgcctggccatctggctgctgatcgagaagacgcggctgggcagctatctgcgcgcggcgaccgagaacccggacatggtgcgcgccttcggcatcaaggttcccgtgctgctgacgctgacctacgcgttcggcgcggggctggccggcctggcgggcgtcatggcggcgccgatctaccaggtcagtccgctgatgggctccaacctggtcatcctggtcttcgccgtggtggtgatcggcggcatgggctcgatcctgggctcgatcctgaccggcttctcgctgggcgccatcgaaggcctgaccaaactcttctacccgcaggcctcggcgaccgtgatcttcctcgtgatgatcatcgtgctgctcatcaagccgacgggcctgttcggcaaggcgaagtga

SEQ ID NO: 27640 - protein, 295 aa, Bordetella bronchiseptica
MNIESILGIPINAFMGQLLMGLMNGAFYAMLSLGLAIIFGLLNVINFLHGAQFMVGAFIAWMLLAWAGLSYWVALLVAPLVVAIGAVFVERLFLRHLYRLDHLYGMLLTFGLMLMVEGLFRKSFGSSGLPYPNVIPGGMNLGFMFLPYYRAWVVAASLLVCLAIWLLIEKTRLGSYLRAATENPDMVRAFGIKVPVLLTLTYAFGAGLAGLAGVMAAPIYQVSPLMGSNLVILVFAVVVIGGMGSILGSILTGFSLGAIEGLTKLFYPQASATVIFLVMIIVLLIKPTGLFGKAK

SEQ ID NO: 27641 - DNA, 867 bp, Bordetella bronchiseptica
  CDS (1)..(867)
atgttgatgcaaatcctgatcggctcgctcacggccggcgcggtctacgcgctggtcgcgctcgggttcgtgctgatctacaagggcaccggcgtggtgcacttcggctacggcgagcagctgaccttcggcgcctacatggcgctgatcggccagtcgctgctggggctgccgttcggcctggcgctgctgttcgcgctggcggcctcggcgctgctgggctggctgatcttcggcctgttcgccgggccgctgcgccacgccacgctgtggacccgcatcatcgccaccctggccatcggcatcgcgctgcgcgaggggctgcgggcctacatggggccgacggcctggccgttcccgttcctgctgtcgcagcaggccttcgaggtgggcggcatttacctggtgcccgccaacctcgcgatcgccggcatcgcggtgctcatcctggcggccctgttcctgttcctggagcgcaccctgcgcggcaaggcgatcctgtcggcgtgcgagaaccgcaccggcgccagcctggtcggcatccgcgtctcgcgcgtgtacctgaccatctggatcctggcctcgctgctggcggcggtggccggcatcctgatcgcgccgcagctcacgctctcgcccgacatgggcatcatcgccatcaagggcttcacggcggcggtcatcggcggctttgccagcctgcccggcgcggtgctgggcgggctgctgctgggcgtgctcgaaggcctggccggcgcgtacgtgtccagcgccatgaaggacgtcatcagctacgccgtgctcatcctggtgatgctgctgatgccgcacgggctgtttggaaaactcatcgtcaaaaaggtgtag

SEQ ID NO: 27642 - protein, 288 aa, Bordetella bronchiseptica
MLMQILIGSLTAGAVYALVALGFVLIYKGTGVVHFGYGEQLTFGAYMALIGQSLLGLPFGLALLFALAASALLGWLIFGLFAGPLRHATLWTRIIATLAIGIALREGLRAYMGPTAWPFPFLLSQQAFEVGGIYLVPANLAIAGIAVLILAALFLFLERTLRGKAILSACENRTGASLVGIRVSRVYLTIWILASLLAAVAGILIAPQLTLSPDMGIIAIKGFTAAVIGGFASLPGAVLGGLLLGVLEGLAGAYVSSAMKDVISYAVLILVMLLMPHGLFGKLIVKKV

SEQ ID NO: 27643 - DNA, 873 bp, Bordetella bronchiseptica
  CDS (1)..(873)
atgaatctactgcaacagctcatcaacggcatcgtgctgggccatgcctacgcgctgatcgccatcggctggaccctgctgctgggcgtggcccggctggtgaacttcggccatggccagatgtacatggtgggcgccttcgtcacctggtgggccaccacctcggccggcatgccctacctgctggcgctgcccaccgccatggcgctgggcgcgctgatcggcctggccatgcagcgcatcatgctgcgcgccaccttcgagcagaacctggtgtccatcatgatcatgacgctgggcttcggctacgtcatccagggcgcggcctcgctgatcttcggctcgaccgggcagatcctggacaccgcctggtcgcagcgcgatatcgaggtcggcgaactgtgggtcacctggcaggacgccgccatcgtggtcgccgcgatcgccgtgttcgccggcctgaagtggctgctggaaggctcgcgcgccggacgcctggtgcgcatggtggccgaagacccgaagctggcgcagctggccggcgtcgacgtgcgccgcatctactatggcgtattcgccttcgagggcgccgcggtggcgtttgccgccggcatggtggcgccgcgcacgcccatcctcacctcgatgggcttcgaggaagtcatcatcaccttcgtcgtggtggtgctgggcggcatcggcagcgtcaccggcagctatgccgccggcgtggcgctgggcgtgttcaccgccctgttcagcgccctggtctcgccggcctacgccacggcggccgccttcctggtgctgatcggcgtgctggtcttgcgcccgggcggcctgagcgccggcgcggcgcggggggtgcactga

SEQ ID NO: 27644 - protein, 290 aa, Bordetella bronchiseptica
MNLLQQLINGIVLGHAYALIAIGWTLLLGVARLVNFGHGQMYMVGAFVTWWATTSAGMPYLLALPTAMALGALIGLAMQRIMLRATFEQNLVSIMIMTLGFGYVIQGAASLIFGSTGQILDTAWSQRDIEVGELWVTWQDAAIVVAAIAVFAGLKWLLEGSRAGRLVRMVAEDPKLAQLAGVDVRRIYYGVFAFEGAAVAFAAGMVAPRTPILTSMGFEEVIITFVVVVLGGIGSVTGSYAAGVALGVFTALFSALVSPAYATAAAFLVLIGVLVLRPGGLSAGAARGVH

SEQ ID NO: 27645 - DNA, 930 bp, Bordetella bronchiseptica
  CDS (1)..(930)
atgggattcttcctcgaaacattgttcggcggcctgatgagcggcatgctgtacgcgctgatcggcctgggcttcgtgctgatcttcaaggcctcgggcgtgttcaacttcgcccagggcgccatggtgctggtggccgcgctgtcgatggcgcggttctccgaatggattccgcagtggctgggcttcgagaacatgctgctggccaacgtgctggccttcatcgtcagcgcgctggtcatgttcgtgctggcggtcgcggtcgagcgcttcgtgctgcgccacctggtcaaccaggaagccaccacgctgctgatggccacgctgggcatcagctactttctcgacggcctggggcagatcgccttcggcagctcggtctactcgatcaacgtcggcatgcccaaggatccggccatcatcctcgaaacgatgttcgagggcggcctgctgatcaacctggaagacctgaccgccgccgtggtggcggccctgctggtggccgcgctggcgctgttcttccagtacacctcgaccggccgcgccctgcgcgcggtggccgacgaccaccaggcggcccagtccatcggcatcccgctcaaccgcatctgggtcattgtctggagcgtggcgggcctggtcgcgctggtggccggcatcatctggggttcgaagttcggcgtgcagttcaccctgtcgaccgccgcgctgcgcgcgctgccggtggtgatcctgggcgggctgacctcggtgcccggcgccatcctgggcggcctgatcatcggggtgggcgagaagatgtcggaggtgtacctggggtcgctcgtgggcggcggcatcgaaatctggttcgcctatgtgttggcgctggtgttcctgctgttccgtccgcaagggctgttcggcgagaagatcatcgaccgggtctga

SEQ ID NO: 27646 - protein, 309 aa, Bordetella bronchiseptica
MGFFLETLFGGLMSGMLYALIGLGFVLIFKASGVFNFAQGAMVLVAALSMARFSEWIPQWLGFENMLLANVLAFIVSALVMFVLAVAVERFVLRHLVNQEATTLLMATLGISYFLDGLGQIAFGSSVYSINVGMPKDPAIILETMFEGGLLINLEDLTAAVVAALLVAALALFFQYTSTGRALRAVADDHQAAQSIGIPLNRIWVIVWSVAGLVALVAGIIWGSKFGVQFTLSTAALRALPVVILGGLTSVPGAILGGLIIGVGEKMSEVYLGSLVGGGIEIWFAYVLALVFLLFRPQGLFGEKIIDRV

SEQ ID NO: 27647 - DNA, 942 bp, Rhizobium leguminosarum
  CDS (1)..(942)
atgcagcgtgtttcgctcgcatccaggggaaaacgacatatggagtatttcgtccagcagctcttaaatgggctgacgctcggatccatctatggccttgtggctattggctatacgatggtttacggcattatcggcatgatcaatttcgcccatggcgacatcttcatgctcggtggtttcgccgctcttatcgtcttcttcgtcctcacatccatcttcgcaggtctcccggtggcagttctgctgctggcgatgcttgtcgtcgcgatgttgatgacgagcttgtggaactggacgattgagcgcgtcgcataccgtcccctgcgcggttccttccgcctggcgccgctgatcaccgcgatcggcatgtcgatcacgctgtccaatttcatccaggtgacgcagggtccacgcaacaagccgattccgccgatggtgagctcggtctaccagttcggcaacatttcggtgtcgctgaaacagatcatcatcatcgtgatcacggcagtgctgctcacgatcttctggtacatcgtcaatcgtaccgcactcggccgtgcccagcgcgccactgagcaggatcgcaagatggcagcgctgctcggcgtcaacgtcgaccagacgatctcgatcactttcgttatgggtgcggcactcgcagccgtcgccggcacgatgtacctgatgtattatggcgtcgcctcgtttaacgacggcttcacgcccggtgtgaaggccttcacggcagccgttctcggcggtatcggttcgttacccggcgccgtcttcggcggcctccttatcggccttatcgagtcgctgtggtcggcatacttcaccatcgcctataaggacgtcgcgacctttgcgatcctggctttcgtgttgatcttcaagccgaccggcatcctcgggcggccggaagtcgagaaggtataa

SEQ ID NO: 27648 - protein, 313 aa, Rhizobium leguminosarum
MQRVSLASRGKRHMEYFVQQLLNGLTLGSIYGLVAIGYTMVYGIIGMINFAHGDIFMLGGFAALIVFFVLTSIFAGLPVAVLLLAMLVVAMLMTSLWNWTIERVAYRPLRGSFRLAPLITAIGMSITLSNFIQVTQGPRNKPIPPMVSSVYQFGNISVSLKQIIIIVITAVLLTIFWYIVNRTALGRAQRATEQDRKMAALLGVNVDQTISITFVMGAALAAVAGTMYLMYYGVASFNDGFTPGVKAFTAAVLGGIGSLPGAVFGGLLIGLIESLWSAYFTIAYKDVATFAILAFVLIFKPTGILGRPEVEKV

SEQ ID NO: 27649 - DNA, 861 bp, Bacillus cereus
  CDS (1)..(861)
atggatgtgttaatcaatttatttgtaaatgggatttcaacagggatgctcatttttttgttagcatcaggtctttcacttatttttggtttaatgagcgttttaaactttgcacacggtggtttgtttgcatggggagcatttacaggtgtttggttatttaatatgacaggaagttatatattagctttagttggagcagtagccatgggaatgttcctaggatttattttagaaaggtttcttattaggccggtatatggaaatcatgttcgacagctgctcgttacgcttggaggaatgctcgttcttagtgagtgtattaaaatattttgggggccaaaccctattagtgcaaaattaccgttatggttacaaggaagttttacattcggaggtattatattaattaaatatcgtctatttgttattttgattgggataattatttacattgcactactactattactcaaaaagacgaagataggtcttatgatccgtgcaggtgtaatggataaagaaatggttcaagcgcttggtattaatgtaaaagcgatattttctttcgtctttttattaggggcagggatggcagctttgggaggattcttattagcgccgtattcgggcgttattttcgccgagatgggcatgcagtatgcaattttagcttttatagtagtaattatcggtggattaggaagcgttcaaggttcagctattgcttctttaattgtcggattagctggtgcttttacagcgtattttataccagatttatcacttgcaattaatatgttaatgttactatttttcttaatagtgaagccaactggacttgttggtgaaaaggggtga

SEQ ID NO: 27650 - protein, 286 aa, Bacillus cereus
MDVLINLFVNGISTGMLIFLLASGLSLIFGLMSVLNFAHGGLFAWGAFTGVWLFNMTGSYILALVGAVAMGMFLGFILERFLIRPVYGNHVRQLLVTLGGMLVLSECIKIFWGPNPISAKLPLWLQGSFTFGGIILIKYRLFVILIGIIIYIALLLLLKKTKIGLMIRAGVMDKEMVQALGINVKAIFSFVFLLGAGMAALGGFLLAPYSGVIFAEMGMQYAILAFIVVIIGGLGSVQGSAIASLIVGLAGAFTAYFIPDLSLAINMLMLLFFLIVKPTGLVGEKG

SEQ ID NO: 27651 - DNA, 933 bp, Streptomyces avermitilis
  CDS (1)..(933)
atgcacaccctgccgcagcagctggccaacgggctgttcctcggctcgatgtacgggctgatcgccatcggttacacgatggtgtacggcatcgtccagctcatcaacttcgcccacggcgagatcttcatgaccggaggcttcggcgcactcacggtctacttctacgtcctgccagacggcacatccatgtggatagccctcccggcgatgctcatcggaggcggcctcatcgccgtactcatcgccgtcggggcggaacgcttcgcctaccggcccctgcgcggcgcaccacgcctcgcccccctcatcaccgccatcggcctctccctcggcctccagcaggtggtcttcaacttctacccggacgccaagaccgacaggaccttcccccagctgggcaccgagtccttcaacatcggctccgtccacatccagagcggccagctcttcatcatcatcgccgcccccatctgtatggccgctctcggcttcttcgtccgcctctcccgcaccggccgcgccatgcaggccaccgcccaggacccggacaccgcccagctcatgggcatcgacaccaaccgcatcatcgtcatcgccttcgccatcggcggactcttcgccgcggtcgccgccgtcgcctacggcctgcgctacggccagatcaagtacgacatgggcttccagatgggcctcaaggccttcaccgcggccgtcctcggcggcatcggcaacatctacggcgccatgctcggcggagtcgtcctcggcgtcgccgaaaccctcgccaccgcctacatcgacggcatccccggcatgcagcagctcggcggcggcagctgggcccccgtctgggccttcgtcctcctcatcctcgtactgctgctgcggccacaaggcctcctcggcgaacgcgtcgcggacagggcgtga

SEQ ID NO: 27652 - protein, 310 aa, Streptomyces avermitilis
MHTLPQQLANGLFLGSMYGLIAIGYTMVYGIVQLINFAHGEIFMTGGFGALTVYFYVLPDGTSMWIALPAMLIGGGLIAVLIAVGAERFAYRPLRGAPRLAPLITAIGLSLGLQQVVFNFYPDAKTDRTFPQLGTESFNIGSVHIQSGQLFIIIAAPICMAALGFFVRLSRTGRAMQATAQDPDTAQLMGIDTNRIIVIAFAIGGLFAAVAAVAYGLRYGQIKYDMGFQMGLKAFTAAVLGGIGNIYGAMLGGVVLGVAETLATAYIDGIPGMQQLGGGSWAPVWAFVLLILVLLLRPQGLLGERVADRA

SEQ ID NO: 27653 - DNA, 891 bp, Streptomyces avermitilis
  CDS (1)..(891)
atgagcaccgccctggacaccgtactgaacgggctcgccctcggttcggtctacgccctggtcgccctcggcttcgtcatcatcttcaaggcctcggcagtgatgaacttcgcgcacggctccctgctgctcctcggcggctatctgaccgcggtgctgcacgaccggctcggcttcgcgggcgccctcgccctcgcggtcctcgccaccgcggccgccgccgggctgatcgactggctgctgctgcgccgcctcgacccgcacgccgcgcacgtactgaccatcctcaccatcggcgtcgacatcctgctgatgacggacctcacccgccgcatcggcggggacctcctcaccctgggcgacccctggggctccgacgtgaccgagctcggcccgatcaccgtcgccgacagccggatcgcctcgatcctggtgtcactggtcgtcatcgccgccgtcttcgccgtcttccggttcacttcgtggggcctgtccctgcgagccgccgccgaggaccacgaggccgccgcgctgatgggcatcaggctcgcccggatccggaccctcgcctggtgcctggccggcgcgctcgccgcgctcgccgccgtcttcctggccgccttcccggcccccggcctggagcgcaccaccggacagatcgcgctgaaggccttccccgccgcgatcctcggcggcatggcctcgccgccgggcgcgctcgccggaagcctgctgatcggcgtcaccgaggcgctggcggccggctaccagtccgaactctccgcgctcggcgagggcttcggcgacgtggtgccgtacgccgtgatggtgctggtgctcctcgtccggcccgccggtctcttcgggacgagggaggcggcccgtgtctag

SEQ ID NO: 27654 - protein, 296 aa, Streptomyces avermitilis
MSTALDTVLNGLALGSVYALVALGFVIIFKASAVMNFAHGSLLLLGGYLTAVLHDRLGFAGALALAVLATAAAAGLIDWLLLRRLDPHAAHVLTILTIGVDILLMTDLTRRIGGDLLTLGDPWGSDVTELGPITVADSRIASILVSLVVIAAVFAVFRFTSWGLSLRAAAEDHEAAALMGIRLARIRTLAWCLAGALAALAAVFLAAFPAPGLERTTGQIALKAFPAAILGGMASPPGALAGSLLIGVTEALAAGYQSELSALGEGFGDVVPYAVMVLVLLVRPAGLFGTREAARV

SEQ ID NO: 27655 - DNA, 897 bp, Streptomyces avermitilis
  CDS (1)..(897)
atgaccgtcatcttcggtcagaccttcaccggcatcagcatcggtgccgttctgctgctcatcgcgctcggcctctcgctcaccttcggtcagatgaacgtcatcaacatggcccacggcgagttcatcatggccggcgcctacaccacatacgtcctgcagaagtccatttccagcgccggattgtcgcttctggtcgcgctgcccgtcgcatttctcgtctcgggcgcactcggggcgttgctggaatggctgctgatccgccggctgtatctgcggccgctcgacacacttctcgtcacctggggcgtctccctgatgctccagcaactcgcccgggacatcttcggcgcaccgaatgtgcagacacgggcgcccgagctcctcaccgggaacatcacggtcatcggcggtgacgacccgctcaccttcgccaacagccggctgttcatcctcgggctggccatcgccgcggtggtcgcgctgtcgctgacgctgcggctgaccccgctcggccggcgcatccgggccgtggtgcagaaccgggatctggccgaggtgtccggcatctccaccggccgggtcgatcgcacggccttcttcatcggctccgggctcgccggggtcgccggggtcgcgctgacgctggtcggtccgatcgggcccaccatgggcaccaacgtgatcatcgacgccttcctggtgatcgtggtcggcggcatcgggcagctcaagggcagtgtgatcgtcgccttcgtgctcggcgtgctccagtcggtcctcgagtactcgaccacggtcagcgtcgcgaaggtgctggtgctggtcgccatcgtcgctttcctccagtggcggccccaggggctgtacaccctgcgcacgaggagtctcgtatga

SEQ ID NO: 27656 - protein, 298 aa, Streptomyces avermitilis
MTVIFGQTFTGISIGAVLLLIALGLSLTFGQMNVINMAHGEFIMAGAYTTYVLQKSISSAGLSLLVALPVAFLVSGALGALLEWLLIRRLYLRPLDTLLVTWGVSLMLQQLARDIFGAPNVQTRAPELLTGNITVIGGDDPLTFANSRLFILGLAIAAVVALSLTLRLTPLGRRIRAVVQNRDLAEVSGISTGRVDRTAFFIGSGLAGVAGVALTLVGPIGPTMGTNVIIDAFLVIVVGGIGQLKGSVIVAFVLGVLQSVLEYSTTVSVAKVLVLVAIVAFLQWRPQGLYTLRTRSLV

SEQ ID NO: 27657 - DNA, 1005 bp, Tropheryma whipplei
  CDS (1)..(1005)
atgttgcttagtttggattatcttttgagtcagtcgtggatcacgtttgatgtggcttccttcatcaagggctttggctttgctacggttgaaggcctgactttcggtgccatctatgcactgattgccgttggctataccgtggtgtacggtgttttggggcttatcaatttcgctcatgctggggtttttgttaccggctgctacgcccttgtatttacgctctctgcgcttggttttagctcttttccttctaagaagcccatttttattgttcttatttacgtcctcatcgcggtgtttgtttccattcttgctgctgccgctgttgcctttcttgttgagcgcgttgcctataagcctcttaggaagagaaatgcccctaatctggcatttctaattactgcaataggtgcttccctgaccataagtaatttattttttcttcgttccccaaatccagagcctgcactttctatttttaccccagtccctctttttaaattttttggtgcaactgttacaagctttaatgtggtgacaattctggctgcggtaatcctgatgtttttggttgactggttcataaggcggaccagatttggcaggggcattagagctgtggcgcaggatcctaacactgcttcacttgttggagtgaaccccgagcgggttatagcgctgacttttgttcttggtggtgttatagctggcgctgcaagtctgttctatgttctaaaggttccttcgggtgttgtgtacaatgcggatattgttctcggtttaaaggcttttgctgctgccgttctgggtggcattggcagcattcggggcgctctactcggagggcttctgctcggtctgttctctaactggggtgctctgcttttgggtaatagccagtggggtgatgtttctgtctttgttcttctgttactagttttacttttcaggccatctggtatcctcggcagatctggcctttcggctaaaagcaggatgtga

SEQ ID NO: 27658 - protein, 334 aa, Tropheryma whipplei
MLLSLDYLLSQSWITFDVASFIKGFGFATVEGLTFGAIYALIAVGYTVVYGVLGLINFAHAGVFVTGCYALVFTLSALGFSSFPSKKPIFIVLIYVLIAVFVSILAAAAVAFLVERVAYKPLRKRNAPNLAFLITAIGASLTISNLFFLRSPNPEPALSIFTPVPLFKFFGATVTSFNVVTILAAVILMFLVDWFIRRTRFGRGIRAVAQDPNTASLVGVNPERVIALTFVLGGVIAGAASLFYVLKVPSGVVYNADIVLGLKAFAAAVLGGIGSIRGALLGGLLLGLFSNWGALLLGNSQWGDVSVFVLLLLVLLFRPSGILGRSGLSAKSRM

SEQ ID NO: 27659 - DNA, 918 bp, Pseudomonas fluorescens
  CDS (1)..(918)
atgagtaccttagtgattgaggaggccctgaacggattgcagttcgggctcatgcttttcttgctcgcggcgggattaactctggtgtttgggatcatggatatgatcaacctggcccatggctcgctgtacatgattggtgcatacctgaccgccaccgtcgctgaggccagtggctcttacttcattggcattcccgttgcgctggtaggaacagcgatcattggcatggtgctggagataagcctgtttcgaaggttgtatagaagggatcacttatctcaagtgctggcgacctttgcactgatcctcatctgtaacgaggcggtgcgaatgatctggggtgtacaacccattccgctcagcacaccggccgtgttctcgcgcccgattgagctgatccctggtctgcactattccgcacagcggttgatgattatcggtgtggggctggtggtcgcgatctcaatgtacttcctggtagcgaaaacccgattgggtatgtgggttcgggcaggagcatccaatcgggaaatggccaccacgatgggcgtgaacatcaaatggttgttcaccgtggtgttcggtgtaggggcagcgctgtgcgccttggctggtgcaatgcttggtccattgctggcagtacaagttggcatgggcgaaagcattctgattctggcgtttgtggtagtcgtcatcggtggcatcggctccatcaggggggcgtttgtcggtgcgcttctgatcggcgccgtcgacaccttgagccgttcactgcttcctctgttgctcggcaagttcctatcgccatcagtgacctcctcgattggcgcagccgtggcatcaatcatcatttacgttcttatggctgccgtgctgttttggaagccacaaggcctgtttcctgctcgtgggtga

SEQ ID NO: 27660 - protein, 305 aa, Pseudomonas fluorescens
MSTLVIEEALNGLQFGLMLFLLAAGLTLVFGIMDMINLAHGSLYMIGAYLTATVAEASGSYFIGIPVALVGTAIIGMVLEISLFRRLYRRDHLSQVLATFALILICNEAVRMIWGVQPIPLSTPAVFSRPIELIPGLHYSAQRLMIIGVGLVVAISMYFLVAKTRLGMWVRAGASNREMATTMGVNIKWLFTVVFGVGAALCALAGAMLGPLLAVQVGMGESILILAFVVVVIGGIGSIRGAFVGALLIGAVDTLSRSLLPLLLGKFLSPSVTSSIGAAVASIIIYVLMAAVLFWKPQGLFPARG

SEQ ID NO: 27661 - DNA, 867 bp, Azoarcus evansii
  CDS (1)..(867)
atggatttcgtatccttcctgatccaggtgctgaactcgctgcagtacggcctgctgctgttcctcgtggccagcgggctgacgctggtgttcggcatcatgggcatcatcaacctcgcgcacggcagcttctacatggtcggcgcctacctcgcgttcgcgctcacgagcctgaccggcaacctgatgctggcgatcgcgctggggttgccgctggccttcgtgttcggcgcgatcctcgaatgggcgctgttctcgcacctgtacaagcgcgaccacctcgaacaggtgctgctgacctacggcctgatcctgatcttcgaggagctgcgcagcctcgccgtcggcgacgacgtgcatggcgtgacgatccccgagctgttctcggcatcgatcccgctctcggataacctcagctacccgctgtatcggctggtgatctcggtcgtgtgcctcgcgctcgcgggcgggctgtactggctgatccagaagacgcgcctcggcatgatgatccgcgccggcagccacgaccgcgacatggtcaaggcgctcggcatcgacatcaacctgctgtaccgcaccgtgtttgccctcggtgtcgcgctcgcggcgctggccggcatgctcgccgcgccgatctcctccgtctatccgggcatgggcagcagcgtgctgatcatctccttcgtgatcgtcgtgatcggcggcgtcggctcggtgtggggcgcgctcgtcgcggcgctcgtgatcggcttcgcggacaccttcggcaaggtgctgctgcccgatctcgcgggcctgatggtctatctcgtgatggccgtggtgctgctgtggcgccccgaaggcatcttcaagaaggcttga

SEQ ID NO: 27662 - protein, 288 aa, Azoarcus evansii
MDFVSFLIQVLNSLQYGLLLFLVASGLTLVFGIMGIINLAHGSFYMVGAYLAFALTSLTGNLMLAIALGLPLAFVFGAILEWALFSHLYKRDHLEQVLLTYGLILIFEELRSLAVGDDVHGVTIPELFSASIPLSDNLSYPLYRLVISVVCLALAGGLYWLIQKTRLGMMIRAGSHDRDMVKALGIDINLLYRTVFALGVALAALAGMLAAPISSVYPGMGSSVLIISFVIVVIGGVGSVWGALVAALVIGFADTFGKVLLPDLAGLMVYLVMAVVLLWRPEGIFKKA

SEQ ID NO: 27663 - DNA, 894 bp, Vibrio parahaemolyticus
  CDS (1)..(894)
atgaatacggatttattactgcaactcgtcattaatggcgtgatcgtcggcatgttgtatggcgtggtcgccatgtgctttgtactgatttacaaatcaactcaggtggtgaactttgctcagggtgagtttctactgatcggcgcgtgggtgtgttgggctgcattggttcatctacaactgccatttttcgtcggcttcttactcacgctcgcctttatgatggtgtttggtatcgccgtgcaaaccattgtgctcaggcctttaattggtgagccgatcatctcggtgatcatggtgacgattggtttgtcgatgttcttccaagcactgatgaagtggatgtttggtgtgtcagcggtgtcgtacccgcaggtattcgaaaccaacgtcgtcaatattggtggtttgaacgtagaatttgcttacatactgagcttgatcttctcgatgatcatcatgggcgcgttctactggttctttaaattcagcaaaatgggcttggcgatgcgtgcgaccgcatttaaccagcaggtcgcccagagtcttggcatttccatcaagaaagtgtttgcgatcagttgggctatttcggcgatggtatccgcgacagcagggattgttatcgggatcgtcaacggcgtatcggacgcgctatctatcatcggcatcaaagtgttcccagcggttattttaggtggcttggattcagtggtcggcgcaatcgtcggtggcatcaccatcggggtgctggaaaacttagctgagttctttgatagccaatacctgcaagtgggtaacctttacaacatcgcaccgttctatgtgctgttaatcattcttgccttcaagccatacggcctgtttggtaccaaagatattgagcgtatttaa

SEQ ID NO: 27664 - protein, 297 aa, Vibrio parahaemolyticus
MNTDLLLQLVINGVIVGMLYGVVAMCFVLIYKSTQVVNFAQGEFLLIGAWVCWAALVHLQLPFFVGFLLTLAFMMVFGIAVQTIVLRPLIGEPIISVIMVTIGLSMFFQALMKWMFGVSAVSYPQVFETNVVNIGGLNVEFAYILSLIFSMIIMGAFYWFFKFSKMGLAMRATAFNQQVAQSLGISIKKVFAISWAISAMVSATAGIVIGIVNGVSDALSIIGIKVFPAVILGGLDSVVGAIVGGITIGVLENLAEFFDSQYLQVGNLYNIAPFYVLLIILAFKPYGLFGTKDIERI

SEQ ID NO: 27665 - DNA, 1314 bp, Pseudomonas syringae
  CDS (1)..(1314)
atgtccgttactgctgctggtcctgtcaccaaacctgttgaaatcaaaaaaagcctgatcgatgccgtcgtcgccgggctgctggcgctgatcgtatttggcccgattgtcggcatcgtgctcgacggctacagcttcaacctgcaaccgacccgtgtcgcgtggctggtggctgtggtcatggtcgggcgctttctgattagtctgttcctgcagacgcccaggggcatacgcatgtcccagagctttgaaagctcggattctggcgtgcatgtgctcaagccagatcacaaatccagcctgtactggatcattccgctgctgatcgtggttgccatcgtgttcccgatcttcgccaacaagtacatcctgaccgtggtcattctcgggctgatctacgtactgctggggctgggcctgaacatcgtggtcggtctggccggtctgctcgatctgggctacgtcgcgttctacgccatcggtgcttatggcctggcgctcggctatcagtatctgggcctgggtttttggtcggcgttgccgctggcagcgatcgcggcggcgcttgccgggtgcattctcggctttccggtgttgcgcatgcatggcgattacctggccatcgtgacgctggggttcggcgaaatcatccgtctggtgctgaacaactggctatcgttcacgggcggcccgaatggtgtgccggtgccgtcgccgacctttttcggcctggaattcggacgtcgcgccaaagacggcggtgtccccattcatgaatatttcggcttcgattacaacccggacctgaaattcatcttcatctataccgtgctgtttctggtggtgctggcagtgctgttcatcaagcatcgcctgacccgcatgccgatcggtcgtgcctgggaagccttgcgtgaagacgagattgcctgccgttcgatgggcctcaatcacgtactggtcaagctctcggcgttcaccataggtgcttcgacagcggggcttgcgggcgtgtttttcgccagctaccaaggcttcgtcaacccgacgtcgttcaccttcttcgagtcggcgctgattctggccatcgtcgtgctgggcggtatgggttcgaccatcggtgtggtgattgctgcgttcgtgctcaccgttgcgcctgaactgctgcgcagcttctctgagtaccgcgtgttgctgttcggcattctgatggtgctgatgatgatctggcggccgcgcggcctgatccgcatcagccgcaccggggtgaaaccacgcaagggtgcgctggtgacagaaggaggtgcgcgatga

SEQ ID NO: 27666 - protein, 437 aa, Pseudomonas syringae
MSVTAAGPVTKPVEIKKSLIDAVVAGLLALIVFGPIVGIVLDGYSFNLQPTRVAWLVAVVMVGRFLISLFLQTPRGIRMSQSFESSDSGVHVLKPDHKSSLYWIIPLLIVVAIVFPIFANKYILTVVILGLIYVLLGLGLNIVVGLAGLLDLGYVAFYAIGAYGLALGYQYLGLGFWSALPLAAIAAALAGCILGFPVLRMHGDYLAIVTLGFGEIIRLVLNNWLSFTGGPNGVPVPSPTFFGLEFGRRAKDGGVPIHEYFGFDYNPDLKFIFIYTVLFLVVLAVLFIKHRLTRMPIGRAWEALREDEIACRSMGLNHVLVKLSAFTIGASTAGLAGVFFASYQGFVNPTSFTFFESALILAIVVLGGMGSTIGVVIAAFVLTVAPELLRSFSEYRVLLFGILMVLMMIWRPRGLIRISRTGVKPRKGALVTEGGAR

SEQ ID NO: 27667 - DNA, 1590 bp, Pseudomonas syringae
  CDS (1)..(1590)
atgccttcttatttttaccgtttgatcctcgccatcagcctgctgctgcccttcgcagcgcaggccagcgatgccggtgattttgccgcagccagttcttcccgacaggccgagctgttggaggcctgggcagccagcccggtccctgaacgcatcgaactgctggaagcgctgcgcgatggccgtgttgccgccgacagtagcaaacgcgcgtggatcgaaaacaacgacaaatacggggcagtggatgcgaatgcgcctgcggctgccgacgctccaacccctgacgaaccgcgcaaattgcgcctgaacaaccggctgcgcggcctggtcgataccgcgctggccagccaccaattgctggcagccgacaccaggctgcgtcttgcggcagctttgcaattgcaaaaaagcgcccgccccgcgcaactggatctgctgacccagcgcgtggccagcgaaaccgattccagcgttaaaagcgcgctgacactggcgctggccaacctgcaactggtcgattccagcccctcggtgcgtctggcggcagtgcgcctgctcggcgaaaccggcgacccgctggcgcgtacccgtcttgagtcgctgctggcgccgggcgtcgaaaccgatgcgtcagtgcgcattgccgctgaaaccagcctggcgcaggtcaaccgcaagctgatgatcggcgaagtgctcggtcaggcgttcagcggcatgtcgctgggctcgattctgttgttggcggcgctggggctggcaatcaccttcggcctgctcggcgtgatcaacatggcccacggcgaaatgctgatgctgggtgcctactcgacctacgtggtgcaactgatgctgcagcgctacgcgccgggtgccatcgagtactacccgctgatcgcattgcccgtggcgttttttgtcaccgccatgatcggcatggtgctggagcgcacggtgattcgtcatttgtacggccgcccgctggaaaccctgctcgccacctggggcatcagcctgatgctgatccaggccgtgcgcctggccttcggtgcgcaaaacgtcgaagtggccaacccgcaatggttgtccggcgggattcaggtgctgcccaatctggtgctgccttacaaccgcatcgtgatcatcgccttcgcgctgttcgtggtgctgctgacctggctgctactgaacaagacccgcctggggctgaacgtgcgcgccgtgacccagaaccgcaacatggccgcctgctgcggcgtgccgaccgggcgcatcgacatgatggcgttcgggctgggctcaggcattgcaggcctgggcggcgtcgccctgagccagatcggcaacgtcggccctgatctcggccagagctacatcatcgactcgttcctggtggtggtgctcggtggcgtcggacaactggccggcagcgtgacggcggctttcgggctgggtatcgccaacaagattctcgaaccgcaaatcggcgccgtattgggcaagatcctgatcctggcgctgatcattctgtttatccagaaacgtccgcaaggcctcttcgcactgaaaggacgggtgattgactga

SEQ ID NO: 27668 - protein, 529 aa, Pseudomonas syringae
MPSYFYRLILAISLLLPFAAQASDAGDFAAASSSRQAELLEAWAASPVPERIELLEALRDGRVAADSSKRAWIENNDKYGAVDANAPAAADAPTPDEPRKLRLNNRLRGLVDTALASHQLLAADTRLRLAAALQLQKSARPAQLDLLTQRVASETDSSVKSALTLALANLQLVDSSPSVRLAAVRLLGETGDPLARTRLESLLAPGVETDASVRIAAETSLAQVNRKLMIGEVLGQAFSGMSLGSILLLAALGLAITFGLLGVINMAHGEMLMLGAYSTYVVQLMLQRYAPGAIEYYPLIALPVAFFVTAMIGMVLERTVIRHLYGRPLETLLATWGISLMLIQAVRLAFGAQNVEVANPQWLSGGIQVLPNLVLPYNRIVIIAFALFVVLLTWLLLNKTRLGLNVRAVTQNRNMAACCGVPTGRIDMMAFGLGSGIAGLGGVALSQIGNVGPDLGQSYIIDSFLVVVLGGVGQLAGSVTAAFGLGIANKILEPQIGAVLGKILILALIILFIQKRPQGLFALKGRVID

SEQ ID NO: 27669 - DNA, 1266 bp, Pseudomonas syringae
  CDS (1)..(1266)
atgagcaagtctttcaaacaggcgctgttcagcgccgcactggtctgggccgtggcctacccggtgttcggcctgaaactggcgttctccggcgtgaccctgcaagtgcagaatgccagcccgctgaccctgaccattattgccgtgtgctcggtgctgctgtttctgcgcgtgctgttcgccgagcaaatcagcagcctgcgtcgcggctcggaaaagccgctgatcccgcagaagaccagcgacttcctgactcagccgaaaacccagcgctggggcctggcggccctgatcgtgctggccttcatctggccgttcttcggctcgcgcggtgcggtggacatcgccacgctgatcctgatctacgtcatgctcggcctgggcctgaacatcgtcgtcggcctggccggcctgctcgatctcggctacgtgggtttctatgcggtcggtgcctacagctacgccctgctgtcccattactacgggctcggcttctggatctgcctgccgattgcggggatgatggcggcagtgttcggcttcttgctgggcttcccggtattgcgtttgcgcggcgactatctggccatcgtgacgctggggttcggcgagatcatccgtattttcctgcgtaacctcaccgagttgacgggtggcccgaatggcatcagcaacatcgacaagccgacctttttcggcctgacgttcgagcgcaaagcggccgaaggtatgcagacctttcacgagtatttcggcctgccgtacaactcgatcaacaaggttgtctttctctacctgatcgccctgctgctggcactggcggcgctgttcgtcatcaaccgtctgctgcgcatgccgatcggccgggcctgggaggcgctgcgtgaagacgaaatcgcctgccgcgcgctgggcctgaatccgaccgtcatcaagctgtcggccttcaccctgggcgctgcattcgccggtttcgccggcagcttcttcgcggcccgccaaggcctggtgacacccgaatccttcaccttcatcgagtcggcaatcatcctcgccatcgttgtgctcggtggcatgggctcgcaactgggcgtgattctggcggccattgtgatgatcctgctgccggaactgatgcgtgagttcagcgactaccgcatgttgatgttcggcgccctgatggtgctgatgatgatctggcgtcctcaaggcttcctgccgatgcaacggcctgaaatgaaattgaaagcggagctgcccaaatag

SEQ ID NO: 27670 - protein, 421 aa, Pseudomonas syringae
MSKSFKQALFSAALVWAVAYPVFGLKLAFSGVTLQVQNASPLTLTIIAVCSVLLFLRVLFAEQISSLRRGSEKPLIPQKTSDFLTQPKTQRWGLAALIVLAFIWPFFGSRGAVDIATLILIYVMLGLGLNIVVGLAGLLDLGYVGFYAVGAYSYALLSHYYGLGFWICLPIAGMMAAVFGFLLGFPVLRLRGDYLAIVTLGFGEIIRIFLRNLTELTGGPNGISNIDKPTFFGLTFERKAAEGMQTFHEYFGLPYNSINKVVFLYLIALLLALAALFVINRLLRMPIGRAWEALREDEIACRALGLNPTVIKLSAFTLGAAFAGFAGSFFAARQGLVTPESFTFIESAIILAIVVLGGMGSQLGVILAAIVMILLPELMREFSDYRMLMFGALMVLMMIWRPQGFLPMQRPEMKLKAELPK

SEQ ID NO: 27671 - DNA, 924 bp, Pseudomonas syringae
  CDS (1)..(924)
atgcccgagtttttccactacatgcagcagctggtcaatggtctgaccattggcagtacgtatgcattgatcgccatcggctacacgatggtgtacggcatcattggaatgatcaacttcgcccatggcgaggtgtacatgatcggttcttatgtggccttcatggcactcgccggtctggcgatgctggggattcatagcctgccgttgctgatgattgccggctttgccgcagcgatcgtcgtaaccagcgcctacggatacagcatcgagcgtgtggcctatcggccattgcgcaacagcaaccgtctgattccactgatttctgcgatcggcatgtcgatctttctgcagaactcggttcagctttctcagggttccggcaactttgccatccccaacctgctgcccggcagcctgtcgttcgggcccggtggttcgcaggaagtgcttatttcctacatgcagatcgtggtgttcgtcgtcaccctgctggccatgaccggcctgaccctgttcatctcccgctcgcgaatgggccgcgcctgccgcgcctgcgccgaagacatgaaaatggccaacctgctgggcatcaacaccaacaacatcattgccctgaccttcgtggtcggcgcggcactggccgccgtcgccgcgatgctgctgagcatgcaatacggcgtgatcaacccgagtgccgggtttctggtcggcctgaaagcgttcacagcggcggtgctgggcggtataggatcgatccctggcgcggtgctcggcggtctggtattgggcgtcgccgaggcgttcggtgccgacattttcggtgatcagtacaaggacgtcgtggccttcggcctgctggttctggtgctgctgttccgaccgaccggtattctgggtcgtccggaggttgaaaaagtatga

SEQ ID NO: 27672 - protein, 307 aa, Pseudomonas syringae
MPEFFHYMQQLVNGLTIGSTYALIAIGYTMVYGIIGMINFAHGEVYMIGSYVAFMALAGLAMLGIHSLPLLMIAGFAAAIVVTSAYGYSIERVAYRPLRNSNRLIPLISAIGMSIFLQNSVQLSQGSGNFAIPNLLPGSLSFGPGGSQEVLISYMQIVVFVVTLLAMTGLTLFISRSRMGRACRACAEDMKMANLLGINTNNIIALTFVVGAALAAVAAMLLSMQYGVINPSAGFLVGLKAFTAAVLGGIGSIPGAVLGGLVLGVAEAFGADIFGDQYKDVVAFGLLVLVLLFRPTGILGRPEVEKV

SEQ ID NO: 27673 - DNA, 882 bp, Pseudomonas syringae
  CDS (1)..(882)
atgcaagggttcaacgggctttcggtgttctgcgtgctgctgctcatggcgctcgggctggcaatcattttcggccagatgggcgtgatcaacatggcccacggcgagtttctgaccgtcggcgcgtacaccacctatgtgctgtcgacgctggtgcagacctatatgccgtctatgcagccttactactttttcttcgccattgcgctgtcgttcgtagtggcgggctcgattggctggctggtcgagcgggtgatgatcagccgtctctatcaccggccgctggacacattgttggcgacctggggtttgtcgctggtaatgcaacaagcgctgcgttcgatcttcggtgcccgggaagtcagcgccaacccgcccgagtggctgatgggcgcggtcagcctgagcgacaccatcgagattccgcgcaatggcctgttcgtgatggcgctgaccgtgctgctgaccggttgcatcttcctcatgctgtaccgcacacgctggggcctgcatgtgcgggcaacggtgcagaaccgggtgatgagccgcgccgtggggatcaacacccgcgaagtggaccgcatgacctttgcgctgggttgcggcgtggcgggggtggcgggcgcggcgtttaccaccatcggctccaccgggccgacggccgggtcgctgtatatcgtcgacacgtttctggtggtggtcttcggcggtgcgcaaagcctgctgggcacgattgcttcggcgttcaccattgcccagacgcagtcgattgccgagtttttcatgagtggatcgatggccaaggtgctgaccctgtctgccgtgattctgattctgctgatgcgcccgcaagggttgttctcaagcaaagttcgcaagtag

SEQ ID NO: 27674 - protein, 293 aa, Pseudomonas syringae
MQGFNGLSVFCVLLLMALGLAIIFGQMGVINMAHGEFLTVGAYTTYVLSTLVQTYMPSMQPYYFFFAIALSFVVAGSIGWLVERVMISRLYHRPLDTLLATWGLSLVMQQALRSIFGAREVSANPPEWLMGAVSLSDTIEIPRNGLFVMALTVLLTGCIFLMLYRTRWGLHVRATVQNRVMSRAVGINTREVDRMTFALGCGVAGVAGAAFTTIGSTGPTAGSLYIVDTFLVVVFGGAQSLLGTIASAFTIAQTQSIAEFFMSGSMAKVLTLSAVILILLMRPQGLFSSKVRK

SEQ ID NO: 27675 - DNA, 882 bp, Pseudomonas syringae
  CDS (1)..(882)
atggaattcttctttgaagtgctgatcggcgggttgctggccggtgtcatgtactcgctggtggcgattggctttgtgctgatctacaaggcctcgggcgtgttcaatttcgctcaaggcgcgatggtgctgttcgcggcactgacgtttgtcagcctgctggagcgtggcgtgccgttcttctgggcgtttctggcgacgttggcgagcatggccgtgctggcactgctgatcgaaagactggtcctgcgcccgctggtcaaccggccgccgatcatcttgttcatggccacccttggcctttcgtacatgatcgaaggcttggcgcaagcgttgtggggcgcgcaggtgcacggcctggaactgggcattcccgacgagccactggaaattcgcggcatgctgctctcgcagttcgacctgttcgcagcgggcacggctgcggcgctggtgattgccctgtcggtgctgttcaaccgcacgcggatcggcctgtcattgcgggcggtggcggatgacccgctggcgtcgttggcggtgggtatccggctgccacgcatctgggcggtggtctgggccgtggccgggtttgtcgggctggtggccgggctgctttggggcgcgcggctgggggtgcagttttccctgtcgctggtggtgctcaaggcactgccggtgctgatcatcggtgggttttcctcgattggcggcgccattgtcggcggcctgatcatcggcgcgtccgagaagctggccgagatttacctggggccgatcatcggcagcggtatcgaaaactgggtgccgtatgtgctggcgctgttgtttctgctggttcgtcctgctggcctgttcggcgagcgggcgatagagcgcgtctga

SEQ ID NO: 27676 - protein, 293 aa, Pseudomonas syringae
MEFFFEVLIGGLLAGVMYSLVAIGFVLIYKASGVFNFAQGAMVLFAALTFVSLLERGVPFFWAFLATLASMAVLALLIERLVLRPLVNRPPIILFMATLGLSYMIEGLAQALWGAQVHGLELGIPDEPLEIRGMLLSQFDLFAAGTAAALVIALSVLFNRTRIGLSLRAVADDPLASLAVGIRLPRIWAVVWAVAGFVGLVAGLLWGARLGVQFSLSLVVLKALPVLIIGGFSSIGGAIVGGLIIGASEKLAEIYLGPIIGSGIENWVPYVLALLFLLVRPAGLFGERAIERV

SEQ ID NO: 27677 - DNA, 882 bp, Pseudomonas syringae
  CDS (1)..(882)
atgcaagtcttcagcgggttttcgctgttttcggtgctggtgctgatggcactcgggctgaccatcgtgttcggcctgatgggcgtgatcaacatggcccacggtgaactgatggcgatgggctcatacgcgacctacgtcacttcagtggtgtttcagcgctactttcccgagcttatgggttggtacttcatcatcggcatcggggtggccttcgtggtgacgtttgcctttggttttctgctggagcgctgtttcattcgcttcatgtacaaccgcccgctggacacgctgctggccacctggggcctgtcgctggtgttgcaacaactgtttcgtcaggtgttcggccccaaggaagtcagcgtgcccactgtgcagtggctgcagggcgcttggaaagtcagcgagggcctggagctgccgctcaaccggattttcatcatcggcctgacctttgtcatcgccgctgccgtgtttgtgtttctgtaccgcagccgctggggcctgcgcattcgtgccgtgacccagaaccgggcgatggccggtgccgccgggatcaataccgcgcgggtcgattcggtgacgttcgcgctgggctgcggcctggcgggtattgccggcagctcgttcaccatgctcgcctccaccggtccggtgagcggccagcagtatctggtggacaccttcatcgtcgtcgtgttcggcggtgttgaaagcttacttggcacgttcctgtcggccttcgccatcggccagacgcagatctcgctggaatacctgaccaccggttccatggccaaagcgatcaccttgctggtggtcatcgtgctgctgttcttccgccccaacggcctgttcgccacgaaagtgagacgttga

SEQ ID NO: 27678 - protein, 293 aa, Pseudomonas syringae
MQVFSGFSLFSVLVLMALGLTIVFGLMGVINMAHGELMAMGSYATYVTSVVFQRYFPELMGWYFIIGIGVAFVVTFAFGFLLERCFIRFMYNRPLDTLLATWGLSLVLQQLFRQVFGPKEVSVPTVQWLQGAWKVSEGLELPLNRIFIIGLTFVIAAAVFVFLYRSRWGLRIRAVTQNRAMAGAAGINTARVDSVTFALGCGLAGIAGSSFTMLASTGPVSGQQYLVDTFIVVVFGGVESLLGTFLSAFAIGQTQISLEYLTTGSMAKAITLLVVIVLLFFRPNGLFATKVRR

SEQ ID NO: 27679 - DNA, 915 bp, Pseudomonas putida
  CDS (1)..(915)
atggatggtattttcctgcagcaactggtcaacggcctgaccctcgggtcggtctatggcctgatcgccatcggctacacaatggtctatggcattatcggcatgatcaacttcgcgcacggcgaggtgtacatgatctccgcttacctcgcggcgatcagcctggcattgctggcttacttcggtgtcgaatcgttccccctgctgatgctgggcaccttgttgttcaccatcgtcgtcaccggcgtttatggtttcaccatcgagcgcatcgcctacaaaccgctgcgtaactccacccgcctggcaccgctgatcagtgccatcggcatttcgctgatcctgcagaactacgcacagatcagccagggcgcccgccagcaaggcgtgccaaccctgctggaaggcgccatgcgtgtcgaagtcgggtccggcttcgtgcaactgacttataccaagatcttcatcctggtggcggcctttgtcggcatgggcctgctgacctacgtgatcaagtacaccaagctcggccgcatgtgccgtgctacccagcaagaccgcaagatggcctcgatcctgggtatcaacaccgaccgggtaatctcctacgtgttcgtcatcggtgcagtgatggccgccctggccggcgtgctcatcaccatgaactacggcaccttcgacttctacgccggcttcatcatcggtatcaaggcgttcactgccgcagtgctcgggggtatcggctcgctgccgggtgccatgctcggcgggatcatcctgggaatttccgagtcgctgttctcaggcctgatcaactccgactacaaggatgtgttcagcttctcgctgctggtgatgatccttatcttccgcccacaaggcctgctgggtcgcccgctcgtggctaaggtgtga

SEQ ID NO: 27680 - protein, 304 aa, Pseudomonas putida
MDGIFLQQLVNGLTLGSVYGLIAIGYTMVYGIIGMINFAHGEVYMISAYLAAISLALLAYFGVESFPLLMLGTLLFTIVVTGVYGFTIERIAYKPLRNSTRLAPLISAIGISLILQNYAQISQGARQQGVPTLLEGAMRVEVGSGFVQLTYTKIFILVAAFVGMGLLTYVIKYTKLGRMCRATQQDRKMASILGINTDRVISYVFVIGAVMAALAGVLITMNYGTFDFYAGFIIGIKAFTAAVLGGIGSLPGAMLGGIILGISESLFSGLINSDYKDVFSFSLLVMILIFRPQGLLGRPLVAKV

SEQ ID NO: 27681 - DNA, 1308 bp, Pseudomonas putida
  CDS (1)..(1308)
atgaacatgtccgttgccaaaactgcctctattagcgaaaccaagggtttcgaccttaaacgcagcctgctggagaccattgtcgctggcctgctggcacttatcgtgtttggtccggtcgttggtgtggtgctcgacggctacaccttcaatgccgagccgcgccgcgtggcctggctggtcggcggtgtgatggtggggcgcttcctgctcagcctgttcctgcagactgcccccgggcagcgcatgctcctgggcttcgacagcggtggctcgggcgtgcatgtgaccgcaccggactacaagtcgcgcctgcgttacatcatccccgcgctgatcgtgattgccatcgttttcccgatcttcgccaacaagtacctgctgaccgtggtcatcctcggcctgatctacgtattgctgggccttggcctgaacatcgtggtcggcctggccggcctgctcgacctgggttacgtggcgttctatgccatcggtgcctacggcctggcgctgggttaccagtacctggggctgggcttctggagcgtgctgccgctggcggccatcgctgcggcgctggcggggtgcatcctcggcttcccggtgttgcgcatgcacggtgactacctggcgatcgtgacgctgggctttggcgagatcattcgcctggtgctgaacaactggctatcgttcaccggtggccccaacggcatgccggcaccttcacccaccttcttcggccttgagttcggccgccgggccaaggatggcggggtgccgatccacgagttcttcggcttcgagtacaacgccagcctcaagttcgtgttcatctacgcggtgctgttcatggtcgtgctggcagtgctgtacatcaagcatcgcctgactcgcatgccggtcggccgggcctgggaagcgctgcgcgaagacgagattgcctgccgttcgatgggcctgaaccacgtgctggtcaagctgtcggcctttaccctgggcgcctcgactgccggtctggccggggtgttcttcgccacctaccagggcttcgtcaacccgtcgtcgttcacatttttcgagtcggcgctgatcctcgccatcgtcgtgctgggtggcatgggctcgaccgtgggtgtggtcatcgcggcgttcgtgctgaccgtggcgccggaactgctgcgcagcttctccgagtaccgggtgctgctgttcggcgtgctgatggtgctgatgatgatctggcgaccgcgtgggctgatccgtatcagccgtaccggtgtgaccccacgtaaaggagtggcgccatga

SEQ ID NO: 27682 - protein, 435 aa, Pseudomonas putida
MNMSVAKTASISETKGFDLKRSLLETIVAGLLALIVFGPVVGVVLDGYTFNAEPRRVAWLVGGVMVGRFLLSLFLQTAPGQRMLLGFDSGGSGVHVTAPDYKSRLRYIIPALIVIAIVFPIFANKYLLTVVILGLIYVLLGLGLNIVVGLAGLLDLGYVAFYAIGAYGLALGYQYLGLGFWSVLPLAAIAAALAGCILGFPVLRMHGDYLAIVTLGFGEIIRLVLNNWLSFTGGPNGMPAPSPTFFGLEFGRRAKDGGVPIHEFFGFEYNASLKFVFIYAVLFMVVLAVLYIKHRLTRMPVGRAWEALREDEIACRSMGLNHVLVKLSAFTLGASTAGLAGVFFATYQGFVNPSSFTFFESALILAIVVLGGMGSTVGVVIAAFVLTVAPELLRSFSEYRVLLFGVLMVLMMIWRPRGLIRISRTGVTPRKGVAP

SEQ ID NO: 27683 - DNA, 1041 bp, Pseudomonas putida
  CDS (1)..(1041)
atgcgcctgctgggtgaaaccggcgacccgctggcccgcacccgcctcgaagccctgctgcagcccgatgcagaactagacccgggcgtgcgcacagccgccgaaacgagcctggcccaggtcaagcgcaaactgctgctaggcgaactgctcggccaggccttcagcggcctgtcgctgggttcggtcctgctgctggcagcgctgggccttgcgatcaccttcggcctgctcggggtgatcaacatggcccatggcgagatgttgatgctcggcgcctacagcacctacatggtccaggtactgctgcagcgcttcgccccaggcgccatcgagttctacccgctgattgccctgccggtggccttcgccgtcagtgccggggtaggcatggcgctggagcgcacggtgatccgccacctgtacggccgcccactggaaaccctgctggccacctggggcatcagcctgatcctgatccaggccatccgcctgctgttcggcgcgcagaacgtcgaggtgagcaacccggcctggctgtctggcggcatccagctgctacccaacctggtgctgccgtacaaccgcctggtcatcatcggcttcgccctggccgtggtgctgcttacctggctgctgctcaaccgtacccggttgggtctgaacgtgcgcgcagtcacccagaaccgcaacatggccgcctgctgcggcgtgtccaccgggcgcgtcgacatgctcgcctttggccttggctcgggcatcgcagggctcggtggcgtggctttaagccaggtgggcaacgtcggcccggacctgggccagagctacatcatcgattcgttcctggtggtggtgctcggcggcgtcgggcagctggccggtagcctctgggccgcgttcggcctgggcatcgccaacaagctgctggagccgcagatcggtgccgtactcggcaagatcctcatccttgcgttgatcattctgttcatccagaaacgcccgcaaggcctgttcgccctcaagggacgggtaatcgactga

SEQ ID NO: 27684 - protein, 346 aa, Pseudomonas putida
MRLLGETGDPLARTRLEALLQPDAELDPGVRTAAETSLAQVKRKLLLGELLGQAFSGLSLGSVLLLAALGLAITFGLLGVINMAHGEMLMLGAYSTYMVQVLLQRFAPGAIEFYPLIALPVAFAVSAGVGMALERTVIRHLYGRPLETLLATWGISLILIQAIRLLFGAQNVEVSNPAWLSGGIQLLPNLVLPYNRLVIIGFALAVVLLTWLLLNRTRLGLNVRAVTQNRNMAACCGVSTGRVDMLAFGLGSGIAGLGGVALSQVGNVGPDLGQSYIIDSFLVVVLGGVGQLAGSLWAAFGLGIANKLLEPQIGAVLGKILILALIILFIQKRPQGLFALKGRVID

SEQ ID NO: 27685 - DNA, 882 bp, Pseudomonas putida
  CDS (1)..(882)
atgaacttcttcctggagaccttgatcggcggcttgctcgccgggaccctgtattcgctggtggccatcggcttcgtgctgatctacaaggccagcggcgtgttcaactttgcccagggcgcgatgctgctgtttgctgcgctgacattcgttagcttgcacgagcagggcctgccgttcgccctggcgttggccctgaccgtactggtgatgatcgtcggcgcgctgctgatcgagcgcctggtgctgcggcccctggtcaatcgctcgcagatcaccctgttcatggccacccttggcctgtcgttcatcatcgagggcctggcccagggcttgatgggcgcccaggtacgtgcgctggatctgggcatcgaggacgtcccgctgttcgtcggcgagctgatgatcagccagttcgacctagtcgcctctggcgtttccgccttgttggtggcagtgctggcgctgctgttcaacaagacccgcatcggtgtggccttgcgtgcggtggccgacgatacccgcgcggcgctgtcgctgggcatcaacctcaaccgcatctggcagatcgtctgggccgtggccggcatggtcgggctggtggccgggctgctctggggggcgcgccagggggtgcagttctcgctctcgctggtagtgctcaaggcgctgccggtgctgatcatcggcggcttcacctcaattggcggagccatcgtcggcgggctgatcgtcggcgccgccgagaacctcgccgaagcctacatcggcccactgatcggcggcggcatcacgccctggttcgcttatttcctcgccctgatattcctttacatccgtccggccggcctgttcggcgaccgggccatcgaacgggtatga

SEQ ID NO: 27686 - protein, 293 aa, Pseudomonas putida
MNFFLETLIGGLLAGTLYSLVAIGFVLIYKASGVFNFAQGAMLLFAALTFVSLHEQGLPFALALALTVLVMIVGALLIERLVLRPLVNRSQITLFMATLGLSFIIEGLAQGLMGAQVRALDLGIEDVPLFVGELMISQFDLVASGVSALLVAVLALLFNKTRIGVALRAVADDTRAALSLGINLNRIWQIVWAVAGMVGLVAGLLWGARQGVQFSLSLVVLKALPVLIIGGFTSIGGAIVGGLIVGAAENLAEAYIGPLIGGGITPWFAYFLALIFLYIRPAGLFGDRAIERV

SEQ ID NO: 27687 - DNA, 924 bp, Pseudomonas putida
  CDS (1)..(924)
atgcctgagatctaccatttcttccaacaactggttaatggattgaccatcggcagcacctatgccttgatcgccatcggctacacgatggtgtacggcatcattggcatgatcaacttcgcccacggcgaggtgtacatgatcggttcctacgtggccttcatcgccctggcgggcctggccatgatgggtatccattcgctgccgatcctgatgaccgtcgccttcgtcgcgacgatcttcgtcaccagtgcctatggctacagtatcgaacgggttgcctaccgccccctgcgcaacagcaaccgtctgatcccgctgatttctgccatcggcatgtcgatcttcctgcagaacacggtcttgctttcgcaggactccaaggacaagtccatccccaacctgatccccgggagtttctccttcgggccaggcggtgctgaagaagtactgatcagctacatgcaaatcctggtgttcgtcgtcaccctggtggccatgaccctgctcaccctgttcatctctcgttcccgcctaggccgcgcctgccgcgcctgcgccgaggacatcaagatggccaacctgctgggcatcaacaccaacaacatcatcgccctcaccttcgtcatcggtgccgccctggctgccgtggcggccgtgctgctgagcatgcagtacggggtgatcaaccccaacgccggtttcctggtgggcctgaaggctttcaccgcggcggtactgggtggcatcggcagcatcccgggcgccatgctcggcgggctggtgctgggcgtggccgaagcgttcggtgccgatatcttcggcgaccagtacaaggacgtggtggcattcggcttgttggttcttgtcctgctattccggccgaccggcattctgggccgcccggaggttgaaaaagtatga

SEQ ID NO: 27688 - protein, 307 aa, Pseudomonas putida
MPEIYHFFQQLVNGLTIGSTYALIAIGYTMVYGIIGMINFAHGEVYMIGSYVAFIALAGLAMMGIHSLPILMTVAFVATIFVTSAYGYSIERVAYRPLRNSNRLIPLISAIGMSIFLQNTVLLSQDSKDKSIPNLIPGSFSFGPGGAEEVLISYMQILVFVVTLVAMTLLTLFISRSRLGRACRACAEDIKMANLLGINTNNIIALTFVIGAALAAVAAVLLSMQYGVINPNAGFLVGLKAFTAAVLGGIGSIPGAMLGGLVLGVAEAFGADIFGDQYKDVVAFGLLVLVLLFRPTGILGRPEVEKV

SEQ ID NO: 27689 - DNA, 1257 bp, Pseudomonas putida
  CDS (1)..(1257)
atgaacagaaatctcaaacaggcgttcttcagcgccttgctggtctgggccgtggccttcccggtactgggcctgaaactgagcatcgacggcatcagcctggtcgtgcacagtcagggctcgttcaccatcagcatcatcgccgtgtgttccgtgctgatgttcctgcgcgtgctgttcgacaagcagtggagttcggtgatgggccgccgatcggatcgcaagctgatccccccggcagtcagcaactacctcaccctgcccaagacccagcgctatgtcatcatcgggttgatcgtggtggcactggtatggccgttcttcggctctcgtggtgcggtcgacattgccacgctgatcctgatctacgtgttgctgggcctgggcctgaatatcgtggtcggtctggcgggcctgctcgacctcggctacgtgggcttctatgccgtcggtgcctacagctacgccatgctctcgcattacctgggctggagcttctgggtgtgcctgccgattgccggcctgatggctgccacgttcggcttcctgctcggcttcccggtgctgcgcctgcgtggtgactacctggcgatcgtgaccctcggtttcggtgagatcatccgcctgttcctgcgtaacctcaccgactggaccggcggccccaacggcatcagcaacatccccaagccggagttcttcggcctgaccttcgaacgccgtgcggccgagggcatgcagaccttccacgagttcttcgggctgcaatacaactcgatcaacaaggtcatcttcctgtatctggtggccctgctgctggccctgctggcgttgttcgtgatcaaccgcctgctgcgcatgccgatcggccgtgcctgggaagccctgcgtgaagacgagatcgcctgccgtgctctgggcctgaacccgaccgtgatcaagctctcggcattcaccctgggtgcctgcttcgccggcttcgccggcagcttcttcgccgcgcgccaaggcctggtgacgccggagtcgttcaccttcatcgagtcggcgatcatcctcgccatcgtcgtgctgggtggcatgggttcacaactgggcgtgattctcgcggccatcgtgatgatcctgctgcctgagctgatgcgtgagttcagcgaataccgcatgctgatgttcggtgcgctgatggtgttgatgatgatctggcgtccgcaaggcctgctgcctatgcaacgtccacacatggagctgcgtcgatag

SEQ ID NO: 27690 - protein, 418 aa, Pseudomonas putida
MNRNLKQAFFSALLVWAVAFPVLGLKLSIDGISLVVHSQGSFTISIIAVCSVLMFLRVLFDKQWSSVMGRRSDRKLIPPAVSNYLTLPKTQRYVIIGLIVVALVWPFFGSRGAVDIATLILIYVLLGLGLNIVVGLAGLLDLGYVGFYAVGAYSYAMLSHYLGWSFWVCLPIAGLMAATFGFLLGFPVLRLRGDYLAIVTLGFGEIIRLFLRNLTDWTGGPNGISNIPKPEFFGLTFERRAAEGMQTFHEFFGLQYNSINKVIFLYLVALLLALLALFVINRLLRMPIGRAWEALREDEIACRALGLNPTVIKLSAFTLGACFAGFAGSFFAARQGLVTPESFTFIESAIILAIVVLGGMGSQLGVILAAIVMILLPELMREFSEYRMLMFGALMVLMMIWRPQGLLPMQRPHMELRR

SEQ ID NO: 27691 - DNA, 861 bp, Pseudomonas putida
  CDS (1)..(861)
atgctcgatttgtacctgttccaactgctcaacggcctgggcctggggatgatctacttcctcatcgccgtaggcctgacgatcattttcggcctgctcaacttcgtcaacttcgcccacggcgcgtttttcttgctgggcgcctacctgtgctacaccgccgtggccgtcaccggcaacttctggctggcgctgctgattgcgccactggtggtggccgcgctggcctgggcggtcgagcgcctgttgatcaaacgcatctaccacctgccgcacaccttccagatcctcgtcaccctcggcatcgcgctgatcatccaggaagcgtcggtgctgatctggggcccggtgggcaaaaacattgccgtgccacccgaactgcgcggggtgctgatactcggcgacttcatctacccctactaccgcttgttcctgatcggcttcgcagcgctgatcggtattggcctgtggctgctgctggaacgcacccgtttcggcgcactggtgcgggccggtagcgaaagcaccgagaccgtgtcgctgttgggcaccaacattttccgcctgttctccctgacattcgccctgggcgtgggcctggcaggtgtggcgggtgtgctatttgcgccgctacggggcgcccagcccttcgtcggcccggaaatcctcggcattgccttcgtggtggtggtgattggcggcatggggtcgttcggcggggcgctggttggcggcctgctggtgggtgtggtgcaaagcatgatgaccagtctctggccgcaaggcgccagcctgatgatctacggcgccatggcagcagtgattctggtccgtccctacggcctgttcgggagagcctga

SEQ ID NO: 27692 - protein, 286 aa, Pseudomonas putida
MLDLYLFQLLNGLGLGMIYFLIAVGLTIIFGLLNFVNFAHGAFFLLGAYLCYTAVAVTGNFWLALLIAPLVVAALAWAVERLLIKRIYHLPHTFQILVTLGIALIIQEASVLIWGPVGKNIAVPPELRGVLILGDFIYPYYRLFLIGFAALIGIGLWLLLERTRFGALVRAGSESTETVSLLGTNIFRLFSLTFALGVGLAGVAGVLFAPLRGAQPFVGPEILGIAFVVVVIGGMGSFGGALVGGLLVGVVQSMMTSLWPQGASLMIYGAMAAVILVRPYGLFGRA

SEQ ID NO: 27693 - DNA, 879 bp, Lactobacillus plantarum
  CDS (1)..(879)
atgcagacatttggacaacaattgatcaacggactatcgctaggaagtatctacgcgttattggcgctaggctacacgatggtttatggcattatcaaattaattaattttgcacatggcgatatttatatgttgggggccttttggggctattacagtttgaagtcactacactttaactttgttgcggcgctcctgtccgcaatggtgatctgcgcagttagtggtgtgattattgaatatttcgcgtaccgcccattacgccattcaccgcgaattaccgcgctaatcacggcaatcggtgtttcattcttgcttgagaatggaatgtcatactttgttggtgcgagtgcccgttcatttccccaagcaatcaaagtggtgacttatcactggggcggattgcgggtatcgaatgtgcagctactgatcttaggaacggcgtgcctattaatgattctattggaattaattatcaaacgtaccaaaatgggtaaagcaatgcgggccgtttctgttgatcccgaagctgcacagttggtgggcatcaatcttaaccatacgatttcgttcacgttcgcattagggtctgcaatggccggcgctgccggagtcttgattggcctatactataattcgattgatccgttgatgggcatgacgcccggtatcaaggcctttgtcgcagccgtgattggtgggattggttctgtgcctggggcttcattggggggctttattatcggcatcctggagactggtgttcaggcgattggcctatccgcatacaaggacgcggtggtttactttgtcttaattgttattttgctcgtgttgccggctggaatattcggtaaacgaaccaaggaaaaagtctga

SEQ ID NO: 27694 - protein, 292 aa, Lactobacillus plantarum
MQTFGQQLINGLSLGSIYALLALGYTMVYGIIKLINFAHGDIYMLGAFWGYYSLKSLHFNFVAALLSAMVICAVSGVIIEYFAYRPLRHSPRITALITAIGVSFLLENGMSYFVGASARSFPQAIKVVTYHWGGLRVSNVQLLILGTACLLMILLELIIKRTKMGKAMRAVSVDPEAAQLVGINLNHTISFTFALGSAMAGAAGVLIGLYYNSIDPLMGMTPGIKAFVAAVIGGIGSVPGASLGGFIIGILETGVQAIGLSAYKDAVVYFVLIVILLVLPAGIFGKRTKEKV

SEQ ID NO: 27695 - DNA, 963 bp, Lactobacillus plantarum
  CDS (1)..(963)
atgaaagcaaatttgaaaactaacatggcgtggctcggtgtgatggttatcggctttgttgtgattgacggtttagagctgatgggcgtcattaactcgtttattgaaaatatgctggtgacgattggtatcaacgttatattggcggtgggactcaatctgattattgggtttgcaggccagttctcgcttggtcacgtcggctttatggcaattggcgcctacgcgactggtattatgacccaaacaatggcgacgcccgcgggattttatctgtcgatgatcgtcggcatggtgattgccatggtagcggcggtcattgttggcatcccaacattacgattgcgcggtgattacttagccattgcgacgatgggggcggccgaaatcattcggattctaatcaataatctgaaaattacgaacggtgcagcggggttattcaatatcccggcacttgcttcgtgggcaacggtgtacgtcttaatgtgtctgacaacgattatcacggtcaactttattcacagtcgcggtggtcgggccgtgatggctgtgcgggatgatgaactggcggctggtgccatgggaatcaatacgacgcgctggaagttggccgctttcgtctttggcgcggcgactgcggcgattggtgggtcgttgcacgcggcctacattcagacgattgcgccgggtgattttaatatcatggcttccattgcgattctgattattgtcgtactcggtggggtcggcagtattaccgggactttcgtagccgcaatcgtattaggagcgctcgacacgatcttacaaaacttcggtacgatccgaatgattatttattcattggcactgattttgattatgatttttaagccagccggactgttaggaacgtgggagttctcattcacgcgtctattcagacggcgatcaactaaggaggcggttaaccatgagtag

SEQ ID NO: 27696 - protein, 320 aa, Lactobacillus plantarum
MKANLKTNMAWLGVMVIGFVVIDGLELMGVINSFIENMLVTIGINVILAVGLNLIIGFAGQFSLGHVGFMAIGAYATGIMTQTMATPAGFYLSMIVGMVIAMVAAVIVGIPTLRLRGDYLAIATMGAAEIIRILINNLKITNGAAGLFNIPALASWATVYVLMCLTTIITVNFIHSRGGRAVMAVRDDELAAGAMGINTTRWKLAAFVFGAATAAIGGSLHAAYIQTIAPGDFNIMASIAILIIVVLGGVGSITGTFVAAIVLGALDTILQNFGTIRMIIYSLALILIMIFKPAGLLGTWEFSFTRLFRRRSTKEAVNHE

SEQ ID NO: 27697 - DNA, 876 bp, Bradyrhizobium japonicum
  CDS (1)..(876)
atgctggatttcgttcagcagctggtcagcggtgttgcgctcggctgcgtctacggcctgatcgcgctcggcttcgtgctggtctacaaggcgaccgaggtcgtcaacttcgcccagggcgacctgatgatgctgggcggcttcttcgccttcaccttcatcggcatgatgggcctgaactactggatcggctttgccggtgcggtggccgcgatggcgctgttcggcatgctggccgaacgcgtggtggtgcggccgatcctcggctatccgcaattctccatcatcatggcgaccatcgggctcggctacttcctgcgctcgatcgccggcatgatctggggcaccgatgatctgaagatcgagacgccgttcagccagggcgtgctgcgcatcggctcgctggtgctcgcctacgacaagctctcggtgatcgcggcgacgatgatcctgtgcacgctgctctggctcttcttcaacaggaccacgctcggcaccgcgatgcgcgccagttccgagaacatgctggcggcctattacatgggcatcccggtcaagcgcgtggtgtcgatcgtctgggcgatcagcgcggcggtcgcgacctgcgccggcgtgctgctggcgccgatcaccttcattcactccaatgtcggcctcgtgctcggcctcaaggcattccccgccgcagtcctcggcggcttcggctcgatccccggcgcggtggtcggcggcgtcctgatcggcgtgatcgagagcatggccggcttctatctggccgagggctggaaggacgtcgcgccgtacgtcgtgctgctcgccgtgctgctgctcaagcccgaaggcctgttcggccttcacgtccgcaagaaggtctga

SEQ ID NO: 27698 - protein, 291 aa, Bradyrhizobium japonicum
MLDFVQQLVSGVALGCVYGLIALGFVLVYKATEVVNFAQGDLMMLGGFFAFTFIGMMGLNYWIGFAGAVAAMALFGMLAERVVVRPILGYPQFSIIMATIGLGYFLRSIAGMIWGTDDLKIETPFSQGVLRIGSLVLAYDKLSVIAATMILCTLLWLFFNRTTLGTAMRASSENMLAAYYMGIPVKRVVSIVWAISAAVATCAGVLLAPITFIHSNVGLVLGLKAFPAAVLGGFGSIPGAVVGGVLIGVIESMAGFYLAEGWKDVAPYVVLLAVLLLKPEGLFGLHVRKKV

SEQ ID NO: 27699 - DNA, 1770 bp, Bradyrhizobium japonicum
  CDS (1)..(1770)
atgcagagccggctccccatcctcgtcttcgcgcttgtcatggcggcgatcccgtttgtcccgggcatgccgccgttctggatcgtgctgctcgacaatatcggccttgccgccctcgtcgcgatgggcctcgtgctgctgacgggcgtcggcggcctgacctcgttcggacaagccgccttcgtcggcttcggcgcctacaccaccgcggtgctgtcgacgagctacggcctgtcgccctggctgacgctgccgttgtcgctcgtggtcagcggatcgctggcggtgctgcttggcctcgtcaccgtccgcctctccggccactatctgccgctcggcacgctcgcctgggggctcggcctgttctatctcttcagcaagctggagtttttgggccgcaacgacggcatctcggcgatcccgccgctgtcgatcggcgcgttcaagatgctctcgcccggctcgatctactacgcgatctgggtcgccgtgatcctctcggccctgctcacgatgaacctgctggactcccgcaccggccgcgccatccgcgcgctcaggcgcggccatgtcgccgccgaggcgttcggcgtgcacacgccgcgggcaaagctactggtgttcatccacgccgcggtgctagccggtctctccggctggctctatgcccaccttcagcgcgcggtgaacccgacgccgttcggcgcacaggccggcatcgaatatctcttcatcgcggtggtcggcggcgccggctatgtctggggcggcgtgctgggcgcggcgatcgtcgtggtcctgaaagaggtgctgcaaagctatctgccgctgctcctgccgggttccggccaggtcgagaccatcgtgttcggcatcatgctggtggcgctgttgcaactcgcgcccggcggcgtctggccctggctgatgtcgttcctgcccgagcctacccgcggcaggaagccggacacctcgctgaagctggagcagcgcacccgcgcgcccggcgaagccagcgtcctgctccaggtcgagaaggcacgcaagcaattcggcggcgtgatcgcggtcaacaacgtttccttcgaggtccaggcccgcgagatcgtcgcgctgatcgggccgaacggcgccggcaagagcacgacgttcaacctgatcaccggcgtgctgtcggcgacctcaggctcgatctcggtgcttggcaagaggctcgacaacgcgccgccgcaggagatcgtcaagctcggcatctcccgcaccttccagcacgtgaagctggtccccgacatgaccgtgctggagaacgtcgctatcggcgcgcatctgcgcggtcattcggggccgatctcctccatgctgcggctcgaccgcgccgacgaggcaaagctgctcgccgaggccgcacgccagatcgagcgcgtcgggcttgccgaccagatgcaccagctcgcaggttcgctctcgctcggccagcagcgcatcgtcgagatcgcgcgcgcgctgtgcgtcgatccgatgctgctgctgctcgacgagccggccgccggcctgcgccacatggagaagcagcagcttgccaggctgctgcgcgaattgcgcgacggcggcatgagcgtgctgctggtcgagcacgacatgggctttgtcatgaacctcgccgaccgcatcgtcgtgctcgatttcggcaccaagatcgcggagggcacgcccgccacgatcaagaccaatcccgaagtgatcaaggcctatctcggagtggcggcatga

SEQ ID NO: 27700 - protein, 589 aa, Bradyrhizobium japonicum
MQSRLPILVFALVMAAIPFVPGMPPFWIVLLDNIGLAALVAMGLVLLTGVGGLTSFGQAAFVGFGAYTTAVLSTSYGLSPWLTLPLSLVVSGSLAVLLGLVTVRLSGHYLPLGTLAWGLGLFYLFSKLEFLGRNDGISAIPPLSIGAFKMLSPGSIYYAIWVAVILSALLTMNLLDSRTGRAIRALRRGHVAAEAFGVHTPRAKLLVFIHAAVLAGLSGWLYAHLQRAVNPTPFGAQAGIEYLFIAVVGGAGYVWGGVLGAAIVVVLKEVLQSYLPLLLPGSGQVETIVFGIMLVALLQLAPGGVWPWLMSFLPEPTRGRKPDTSLKLEQRTRAPGEASVLLQVEKARKQFGGVIAVNNVSFEVQAREIVALIGPNGAGKSTTFNLITGVLSATSGSISVLGKRLDNAPPQEIVKLGISRTFQHVKLVPDMTVLENVAIGAHLRGHSGPISSMLRLDRADEAKLLAEAARQIERVGLADQMHQLAGSLSLGQQRIVEIARALCVDPMLLLLDEPAAGLRHMEKQQLARLLRELRDGGMSVLLVEHDMGFVMNLADRIVVLDFGTKIAEGTPATIKTNPEVIKAYLGVAA

SEQ ID NO: 27701 - DNA, 1026 bp, Bradyrhizobium japonicum
  CDS (1)..(1026)
atgctgttcctggtgcaggacggcatcaccaatggcgcgatctatgcgctgctcggcctcgcgctggtgctggtgttcgccgttacccgcgtgatcctcattccccagggcgagttcgttacctatggcgcgctgacctatgcctcgctggccgcgggccagatgccgggcacggcaaagctcgcgctcgccctcggcatcggcgccttcggcttcgacctgttcgtggcccgcaaggcgctgcatggccggctgatcctgcgcagcgtcctcaccaatatcgtgctgccggccatcgtgctggcgctgacaatctacttcgccgcccagaagccgccggtggcggtctgcatcgcgctgtcgctggtgatcgtggcgatgatcggcctgtatctctaccgcatcgcgttccagccgctggcgcacacctcggtgctggtgctgctgatcgcctccgtgggcgtccacctcgcgctgcagggactgggcctgctgttcttcggcgccgagggccagcgcggacctgccgtgctgtccggctctttcaccgccggcgcgctgcgtttcaccggccagagcatcaccgtctacgccatcaccatcgccttcatcgtcgggctctggctgttcttcggcctgacgctctacggcaaggcgctgcgcgcgaccgccgtgaaccggctaggggcgcggctcgctggcatccgcaccacgctgtcggggcagatcgccttcctgctggcgtccgtcatcggcgcgctgtcgggcatcatgatcgtgccgatcacgacgctctattacgacagcggcttcctgatcgggctgaagggtttcgttgccgcgatcatcggcggcctcgtcagctaccccctcaccgccgtcgccgcgctggtcgtcggcatcgtcgaggcgttctcgtccttctacgcctccaactacaaggaagtgatcgtcttcatgctgctgatccccgtgctgctgctgcgctcgctcgccgcgcccgcggtcgaggaagagaaggactga

SEQ ID NO: 27702 - protein, 341 aa, Bradyrhizobium japonicum
MLFLVQDGITNGAIYALLGLALVLVFAVTRVILIPQGEFVTYGALTYASLAAGQMPGTAKLALALGIGAFGFDLFVARKALHGRLILRSVLTNIVLPAIVLALTIYFAAQKPPVAVCIALSLVIVAMIGLYLYRIAFQPLAHTSVLVLLIASVGVHLALQGLGLLFFGAEGQRGPAVLSGSFTAGALRFTGQSITVYAITIAFIVGLWLFFGLTLYGKALRATAVNRLGARLAGIRTTLSGQIAFLLASVIGALSGIMIVPITTLYYDSGFLIGLKGFVAAIIGGLVSYPLTAVAALVVGIVEAFSSFYASNYKEVIVFMLLIPVLLLRSLAAPAVEEEKD

SEQ ID NO: 27703 - DNA, 879 bp, Bradyrhizobium japonicum
  CDS (1)..(879)
atggagcttttcaccaatcaagtgctggccggcatcgccacgggcgcgatctatgcctgcatggcgctcgccgtggtcatgatctaccaggccatcgaccatctcaacttcgcgcagggcgagatggcgatgttctcgaccttcatctcctggcagctgatgcagtggggcatcccctactgggccgctttcgtcatcacgctggcgctctccttcgtcggcggcatcgcgatcgagcgcatcctgttcaagccgctggcgaaggcgcccgtgctgaccaacgtcgccggcttcatcgcgctgttcgcgatcatcaactcctcggccggcctgatctgggacttcaccatcaagcaatatccgaccccgttcggctcttcgccgttcctcggcagccagctgatctcgacccaccaggccggcatgatcggcgtcaccgtgctgctgctgctcggcctgtatttcttcttccagtacacgcggatcggccttgccatgcgcgcggccgcctcggtgcctgaatcggcgcgcctcgtcggcatcaacacgagctggatgatcgcgctcggctggggcatggcgtccgcgatcggctcgatcgccggcatgctgatcgcgcccgtggtgttcctcgagcccaacatgatgggcggcgtgttgatctacggctttgccgccgcggtgctgggcggactgaccagcccgttcggcgccgtggtcggcggcttcctggtcggcatcttcgagaatctcgccggcacctacatccccggcgtcggcaacgagctgaaactcccgatcgcgctcgcgctgatcatctccgtcctggtcgtcaaacccgctggtctgttcggccggcacatcgtcaagcgagtttga

SEQ ID NO: 27704 - protein, 292 aa, Bradyrhizobium japonicum
MELFTNQVLAGIATGAIYACMALAVVMIYQAIDHLNFAQGEMAMFSTFISWQLMQWGIPYWAAFVITLALSFVGGIAIERILFKPLAKAPVLTNVAGFIALFAIINSSAGLIWDFTIKQYPTPFGSSPFLGSQLISTHQAGMIGVTVLLLLGLYFFFQYTRIGLAMRAAASVPESARLVGINTSWMIALGWGMASAIGSIAGMLIAPVVFLEPNMMGGVLIYGFAAAVLGGLTSPFGAVVGGFLVGIFENLAGTYIPGVGNELKLPIALALIISVLVVKPAGLFGRHIVKRV

SEQ ID NO: 27705 - DNA, 1665 bp, Bradyrhizobium japonicum
  CDS (1)..(1665)
atggtgcagctgcatacgccgctgccgctcaccatcatcgtggtcgcggtggccgcagcgctggtcgggctgatcatcgagcggttcggcctgcggccgctccagaactcggtgcgcatcgcgccgctgctcgcgaccatcggcatcagcttcgtgctcgaccagctggtgatgctgacgttctcgccgaacccgcgtgcgctgccgagccagttgccggacgtccgcttccagatcggcggcggcacgatcgggccgctcgatctgctcatcgccggcgtcggcatcaccagcgcgctgctgctgttcgtgttcctgcgctacagcaagctcggctgggcggtgcgcgccacggcgcaggaccgcgatgccgcgatgcagatgggcgtcgatgtcaaccgcgtcaatcaggcggtgttcggcatcgccgcggcgctcggcggcgtctccggcatgctggtcggcatgtactacaaccagatcgacaccgcgatgagccttcaggcgacactcaagggcgtcgtcgccgaagtcgtcggcggcgccggcaacgtgccgggcgcggtgatcgggagcctgttgctgggactggtcgaaagctacggcgtagccgtgttcggcaccagctaccgcaatctgttcgcgttcctgctgctggtcgtcgtgctggtgttgcggccgaacggcctgttcgccagcgcgcggcaggcgccgcccgagccgctcaccgggactttcatcgcgccgagccggccggtgcgcattccgcgctgggcgctgctggtggcggccgctgcctttgcgatcctgccgctgttcccggtgtccttctacgtgctccagaccctgatcaacgcctggctgctcggcatgctcgcgctcagcctcacgctcgttgcaggcacgatcgggcaggtctcgcttggacatgcggcgctgctcgcgatcggcgcctacacgtccgcgctgctgtcgctgagcttcgccgttcccgtcggcctcgccatcatcggcggcggcctgatgagcgctgcgctcggcaccgctctgatctcgccgtcgttccgcctgcgcgggcactacgtctcgatcgcgacgctcgccatcggcgagatcgtgtcgctggtgatcttgaactgggagagcgtcacgcgcgggccgatcggcatctccggcattccgccgctgtcgctgttcggctacgacctcgtcagcccgtcgtcggtctactggttcagccttgcggtcatggtcgttctggcgctgctccaggcgcgcctgctcggctcgcatctcggccgcagctttcgcgccatccgcgacgacgacatcgccgcgcgcgcctacggcctcagcctgaaccgctacaaatcgctggccttcatcttcggcgggtttgcggcgggtgtcagcggcggcatcgccgcgcatctctattcctacatcaaccacgagaccttcaacacgcagcagtccatcctggcgctgacggtcgtgatcctcggcggactcggcaatgtcgtcggcgccatcgtcggatcggtggcgctggtcggcctgcccgaattgttccggatcgcggcggagtaccgcatcctgatctacggcatcgtgctgctgctgctggtgcggttcaggccgcagggcctgttggggacgatgtga

SEQ ID NO: 27706 - protein, 554 aa, Bradyrhizobium japonicum
MVQLHTPLPLTIIVVAVAAALVGLIIERFGLRPLQNSVRIAPLLATIGISFVLDQLVMLTFSPNPRALPSQLPDVRFQIGGGTIGPLDLLIAGVGITSALLLFVFLRYSKLGWAVRATAQDRDAAMQMGVDVNRVNQAVFGIAAALGGVSGMLVGMYYNQIDTAMSLQATLKGVVAEVVGGAGNVPGAVIGSLLLGLVESYGVAVFGTSYRNLFAFLLLVVVLVLRPNGLFASARQAPPEPLTGTFIAPSRPVRIPRWALLVAAAAFAILPLFPVSFYVLQTLINAWLLGMLALSLTLVAGTIGQVSLGHAALLAIGAYTSALLSLSFAVPVGLAIIGGGLMSAALGTALISPSFRLRGHYVSIATLAIGEIVSLVILNWESVTRGPIGISGIPPLSLFGYDLVSPSSVYWFSLAVMVVLALLQARLLGSHLGRSFRAIRDDDIAARAYGLSLNRYKSLAFIFGGFAAGVSGGIAAHLYSYINHETFNTQQSILALTVVILGGLGNVVGAIVGSVALVGLPELFRIAAEYRILIYGIVLLLLVRFRPQGLLGTM

SEQ ID NO: 27707 - DNA, 882 bp, Bradyrhizobium japonicum
  CDS (1)..(882)
atgcaggcattcctggacattttcgacatctacctgctggaggccgtgatcaacggtatcctgctcggcggcgtgctggcgctgcttgcgctcgggctcaatctgatcttcggcgtcatcgacgtgacctggatctgctatgccgagctcgtgatgatcggcatgtacgccatgtatttcatggtgcagtattacggcgtcagctatttcgtcgcggcgccgttcaccattcttcttgtcgcgctgctcggcgccgcgctgcattacctcgtgatcgcgccgctgctcaccgcgccgccgatcaaccagttgctcgcaaccggtggcgtgctgttcgtgctccagagttttgcgaccgttgccttcggcatcgacttccgcaatctcggcatccgcctgccggtgctcgccttcggcgacatgaatttcagctacgcacgactcctgtcgtttctggctgcgctggtcggcatggtcgccgtctacctgttcatgacgcgcaccttcacgggaaccgcgatccgcgcgatctcgcaggaccggcagatcatggcgctgatgggcgtcgatacgaagaagctctacctcatcacctcggcgctcggcggcgcgctcgcaggcctcgccgcctgcctgctggtgctgcaatacgacgtgcaccccttcgtcggcctgtccttcgggccgatcaccttcctgatctgcgtgctcgggggcctcggcaatttcatcggcggcttcatcgccgccttcgtgttcgccgagatcatctcgctcggcgggctgttctccgacctcgaatggggctatgtgctcgccttcgccttcttcatcgtcatgatgttcatccggcccgcgggcctgcttgcgaggcgccgatga

SEQ ID NO: 27708 - protein, 293 aa, Bradyrhizobium japonicum
MQAFLDIFDIYLLEAVINGILLGGVLALLALGLNLIFGVIDVTWICYAELVMIGMYAMYFMVQYYGVSYFVAAPFTILLVALLGAALHYLVIAPLLTAPPINQLLATGGVLFVLQSFATVAFGIDFRNLGIRLPVLAFGDMNFSYARLLSFLAALVGMVAVYLFMTRTFTGTAIRAISQDRQIMALMGVDTKKLYLITSALGGALAGLAACLLVLQYDVHPFVGLSFGPITFLICVLGGLGNFIGGFIAAFVFAEIISLGGLFSDLEWGYVLAFAFFIVMMFIRPAGLLARRR

SEQ ID NO: 27709 - DNA, 855 bp, Bradyrhizobium japonicum
  CDS (1)..(855)
atggaagctttgctcttcacgcaaggactcaacgtcatctacgaagcactgatccttgcgatcttggtcctcggcctggccgtcgtgatgggcttgttgaacgtcctgaacatcgcgcatggcgagttcatcatgataggcgcgtatgccgcctacgtggtgcaaagggcaggccttccatatttgctcgcagtgccggccgcggcgctggtttgtggggccatcggctttgtcgtggagcgatgcctgataaggccattgcactacgaaccgttcgagacgctcctggcgacctgggggctgggactgctgcttcgcaagtgcgtcgagcttgcgtttggccgcggttatcgcagcgtcgagataccaatcggtggttcgttgagcctctttggtgaatcctatccagcgtaccgattggtgctgatggcggtcgccgccttggtacttgccggcctgttcatctggtaccgccgcgctccgaccggggctcggatccgtgccatggtcggcaatcccgtgcttgcggaggcggtcggtatccaaacgcgtgaactcgcgcgaaacaccttcgtcacgggcaccgcattggcaggtgtcgccggcgtcatggtcgcgccgctcacgccggtcgaaccattcatggggctcactttcatcgtgaactcattcttcgcgctggtggtcggcggaatgggaacggtatcgggcctgttcgctggcgcgactatcatcggtggtctgcaaagcgttctatcggccgccgtcagcccgacctcggcctatcttgcgatgctcctcatctccatcctcttcctctggcagcgaccccgtggcctatttcctcgtccgtaa

SEQ ID NO: 27710 - protein, 284 aa, Bradyrhizobium japonicum
MEALLFTQGLNVIYEALILAILVLGLAVVMGLLNVLNIAHGEFIMIGAYAAYVVQRAGLPYLLAVPAAALVCGAIGFVVERCLIRPLHYEPFETLLATWGLGLLLRKCVELAFGRGYRSVEIPIGGSLSLFGESYPAYRLVLMAVAALVLAGLFIWYRRAPTGARIRAMVGNPVLAEAVGIQTRELARNTFVTGTALAGVAGVMVAPLTPVEPFMGLTFIVNSFFALVVGGMGTVSGLFAGATIIGGLQSVLSAAVSPTSAYLAMLLISILFLWQRPRGLFPRP

SEQ ID NO: 27711 - DNA, 867 bp, Bradyrhizobium japonicum
  CDS (1)..(867)
atgcagatcgccgcggaaacgttgttgaacggattgatgctaggggcgctttacgcgctgttcggacttggtctgagcttgagcgtcggggtcatgcgcatgatcaacatcgcccatggcgatctgatcgtcgtcggggcctacctgaccagtgtcgtcatgagcggagcgggcgtcggtgcctttaccgcgttgctcgtggtcattccggtgatgttcgcgctcggttggatcctccagatcatcctgctcaaccgtgtcgtcggaaaagatgctttggctccgcttcttctgacgttcggcctctccatcgtcttgcagaacgttcttcaggagatcttcaccgcggatacgcgaagcttacaggccggtgatctcgcaggtctcgggttcaacgtttttggcgtttccattggagttcttcccctcgtctctgcgctcgcgagcatcgcgctgctcggcgcgacgcattggctcgtcggtcacacccatttcgggcgtcaggcacgcgccgtgtcggatgatccgggcaccgcgaggctggtcggtgtgaacgatagacgtttgtttggaattgtaaccggcgtcatcttttcgatgatcggtgtggcagcggtgctctacgctctccggacgcccttttcgccaacggctggacccgagcggcttctctattcgttcgaggcggtagtgctcggtgggctcggcaatgtctggggtacgttgttcggcggactcgtgatcggcgtcgcacagcttttcggcgccaagatcgcctctggtctcggtcccttcttcggccatctcgcatttctcgtggcactgctcgcccgtccccagggcttgttcggaaaggcgccgtcatga

SEQ ID NO: 27712 - protein, 288 aa, Bradyrhizobium japonicum
MQIAAETLLNGLMLGALYALFGLGLSLSVGVMRMINIAHGDLIVVGAYLTSVVMSGAGVGAFTALLVVIPVMFALGWILQIILLNRVVGKDALAPLLLTFGLSIVLQNVLQEIFTADTRSLQAGDLAGLGFNVFGVSIGVLPLVSALASIALLGATHWLVGHTHFGRQARAVSDDPGTARLVGVNDRRLFGIVTGVIFSMIGVAAVLYALRTPFSPTAGPERLLYSFEAVVLGGLGNVWGTLFGGLVIGVAQLFGAKIASGLGPFFGHLAFLVALLARPQGLFGKAPS

SEQ ID NO: 27713 - DNA, 867 bp, Bradyrhizobium japonicum
  CDS (1)..(867)
atggaaggcatcgtcgccacactcctcatcggtgtcagcctgggcgcgcagtacgcgctgctcgcccttggcttcaccctggtcttcggcatcctgggcgtggtcaacttcgctcacggcggcttctacgtcctcggcgggtatctcgcctactcgtcaatggcgttcctgggcgcgccgtacctgatcgcggtgatcgttgcggcgctgggtacagccgcgctcggatacctgttcgagcgcttcctgctcgatcgactggtcaatgaccacctttcaacgctcatgctgacgctcggattgtacctgatgatgtcgagcggcctccttgccgttttcgggccgcaatcgcccgcgttcacctttcccttgaccggtgtcctgcgctggcacgggttcttcattccgatcgaaaacctcgtggttctcgtcgtatgcctggtcggcatatcctcggtgtacgcgctgatgtatcgcagtgacttcggccgcgcgcttcgcgctctcgccgatgatcgggccgtggcgaccgctcagggcctgaggccgaaactcctgtttcccgcggcgtttgcgctggcgaccggacttgcgggactcacgggcgcgctggtcacgccgatcctttcgcttgcgccacacgttggcgatcccgtgctggcgacctcatttctcatcgtgatcctcggcggtctcgggagcatcggaggggcgaccgctgcggcgttcctcgtggggatggtggaggcgttttcggccgtctacctcggagggtcaaagggcgccttggtgctgtttgtactcgtgcttctcatgctcgtggtgaagcccgcgggtctgttcggtcagcgtgtgcgtggagcctga

SEQ ID NO: 27714 - protein, 288 aa, Bradyrhizobium japonicum
MEGIVATLLIGVSLGAQYALLALGFTLVFGILGVVNFAHGGFYVLGGYLAYSSMAFLGAPYLIAVIVAALGTAALGYLFERFLLDRLVNDHLSTLMLTLGLYLMMSSGLLAVFGPQSPAFTFPLTGVLRWHGFFIPIENLVVLVVCLVGISSVYALMYRSDFGRALRALADDRAVATAQGLRPKLLFPAAFALATGLAGLTGALVTPILSLAPHVGDPVLATSFLIVILGGLGSIGGATAAAFLVGMVEAFSAVYLGGSKGALVLFVLVLLMLVVKPAGLFGQRVRGA

SEQ ID NO: 27715 - DNA, 882 bp, Bradyrhizobium japonicum
  CDS (1)..(882)
atgacgatggacctgtcgctgactatcatgcagcttctctccgggatcgcccttggggcggtcctggtgatcactgcgcttggattgacgatcgtgttcggcatgctcggggtggtgaatttcgcccatggcgcgctgttcatgatcggggcctatgctgggctgtatctggcgtcgctcaccggaagcttctggtggggactgctgctcgctcccatcctgatcggcgccttcggcatgctgatcgagttcgtcctgatccgcaggctctatggacgctcggtcgacgatccgttgctgctcaccttcggcctcagctacatcctcgtcgaaggtgtgcgcatcgtgttcgggagcgacggcattccgtttccaaccccgccgcaactggtcggcgtgcttgatctcggcatcggcttcttcccgcgctaccgcctgttcgtcatcgcgctggtggccgtggtgctgctggtgctctggctgacgctggaaaagtcccgcataggcttgatcgtgcgcgccggcgcgcgcgatcccaccatcatgcaggtgctcggcgtcgatatcggccgggtctggcttgcgatcttcggcctcggcgtcgggctcgccgcgctcggcggcgtgctcgccggtcccatgcgcagcgtcaatccggagatgggctcgctcgtgcttgcggaggcgttcgtggtgaccgtgatcggtggccttggttcgatcgtcggggctgtcgttgccggcctcatggtcggcatatccatcagcatggtcgcgctgttcgcccctgagatggcgaccatcgtcatgttcgcgctgatggcggtggtgctgctgatccgcccgcagggcctgttcggcgtcagagggaggaccgcgtga

SEQ ID NO: 27716 - protein, 293 aa, Bradyrhizobium japonicum
MTMDLSLTIMQLLSGIALGAVLVITALGLTIVFGMLGVVNFAHGALFMIGAYAGLYLASLTGSFWWGLLLAPILIGAFGMLIEFVLIRRLYGRSVDDPLLLTFGLSYILVEGVRIVFGSDGIPFPTPPQLVGVLDLGIGFFPRYRLFVIALVAVVLLVLWLTLEKSRIGLIVRAGARDPTIMQVLGVDIGRVWLAIFGLGVGLAALGGVLAGPMRSVNPEMGSLVLAEAFVVTVIGGLGSIVGAVVAGLMVGISISMVALFAPEMATIVMFALMAVVLLIRPQGLFGVRGRTA

SEQ ID NO: 27717 - DNA, 918 bp, Bradyrhizobium japonicum
  CDS (1)..(918)
atggattatttcgcccagcagctcatcaacggcctcgtgctcggctccatctacggcctgatcgcgatcggctacacgatggtctacggcatcgtcggcatgatcaacttcgcccatggcgacgtcttcatgatcggcggcttcatcgccctgatcaccttcctgatcctgatctcgctcggcctgaccgcgatcccggtgatcctgctcgtcgtgctgctggtcgcgatggcgatcacggcgctctatggctggaccatcgagcgcatcgcctaccggccgctgcggcattccttccgtctcgctccgatgctgtcggcgatcggcatgtcgttcgtgctgaccaactattcgcaggtggcgcaaggcgcccgcgtcaagccgatcccgcccttcatcaccggcggctacacgctgcatgagagcgcggacggcttcgtcatccagctctccaacatccagatcatggtggtcatcaccaccatcgtgctgctggcgatcttcacctggctggtgtcgcacacgcggctcgggcgcgacatgcgcgcctgcgagcaggaccagaccatggcggccctgctgggcgtcgacgtcgaccgcaccatctccatgaccttcgtgatcggcgccgcgctcgccgcggtcgcgggtttcatgtacctgctctattacggtctggtcgatttcttcatgggcttcgtcgccggcatcaaggccttcacggcggccgtgctcggcggaatcggctcgctgccgggcgccatgctcggcggtcttgcgatcggcctgatcgagacgttctggtcggcctatttctcggtcgaatacaaggacgtcgcggcattctcgatcctgatcgtcgtgctgatcttcatgccgaccggcctgctcggccgtcccgaagtcgaaaaagtctga

SEQ ID NO: 27718 - protein, 305 aa, Bradyrhizobium japonicum
MDYFAQQLINGLVLGSIYGLIAIGYTMVYGIVGMINFAHGDVFMIGGFIALITFLILISLGLTAIPVILLVVLLVAMAITALYGWTIERIAYRPLRHSFRLAPMLSAIGMSFVLTNYSQVAQGARVKPIPPFITGGYTLHESADGFVIQLSNIQIMVVITTIVLLAIFTWLVSHTRLGRDMRACEQDQTMAALLGVDVDRTISMTFVIGAALAAVAGFMYLLYYGLVDFFMGFVAGIKAFTAAVLGGIGSLPGAMLGGLAIGLIETFWSAYFSVEYKDVAAFSILIVVLIFMPTGLLGRPEVEKV

SEQ ID NO: 27719 - DNA, 870 bp, Bradyrhizobium japonicum
  CDS (1)..(870)
atgcaggcactttacgctcagctactggtgggactgatcaacggctcgttctacgcgctgctcagtctcgggcttgccgtgatcttcggcatgctcaacatcatcaatttcgcccacggcgctctctacatgatgggcgccttcgtcgcctatttcctgctgaacaatgattatctcagtatcggctactggccggcattgatcgtcgctccgatcgtcgtcggcatcttcggcatgatcctggaacggaccatgctgcaatggctgaccgggcttgaccatctctacggcctgctgctgaccttcggcattgcgctgatcgtgcagggcgtgttccagaactattttggatcgtcgggcctgccttatgccattcctgaccagctcaagggcggcatgaatctcggcttcatgttccttccggtctatcgcggctgggtcgtcgtgttctcgcttatcgtgtgtctggcgacctggtacctgatcgagaagacgcggctcggcgcttacctccgcgccgcgaccgaaaacccgacgctggtccgcgccttcggcataaacgtgccgcgcatgatcacgctgacctacggtctcggcgtcggccttgccgcgctcgccggcgtgctctcggcgccgatcaaccaggtgcggccgctgatgggcgccgacctcatcatcgtcgtgtttgccgtggtggtgatcggcggcatgggatcgatcatgggctcgatcatcaccggtttcgctctcggcgtgatcgagggcctgaccaagtatttctaccccgaggcctccaacaccgtcgtgttcgtgctgatggtgctggtgctcttggtgaagccatcgggattgacgggaagggcggcctga

SEQ ID NO: 27720 - protein, 289 aa, Bradyrhizobium japonicum
MQALYAQLLVGLINGSFYALLSLGLAVIFGMLNIINFAHGALYMMGAFVAYFLLNNDYLSIGYWPALIVAPIVVGIFGMILERTMLQWLTGLDHLYGLLLTFGIALIVQGVFQNYFGSSGLPYAIPDQLKGGMNLGFMFLPVYRGWVVVFSLIVCLATWYLIEKTRLGAYLRAATENPTLVRAFGINVPRMITLTYGLGVGLAALAGVLSAPINQVRPLMGADLIIVVFAVVVIGGMGSIMGSIITGFALGVIEGLTKYFYPEASNTVVFVLMVLVLLVKPSGLTGRAA

SEQ ID NO: 27721 - DNA, 1890 bp, Bradyrhizobium japonicum
  CDS (1)..(1890)
atggccttttatgtcgtacagtttctgaccggtctcgccagcgcagcgtcgctgttcctggtggcctcgggcctgtcgatcatctttggcgtgacgcggatcgtgaatttcgcgcatggcgccttctacatgatcggcgcatacatcgccttcacgctgaccgagcggctttcgggcgcgttcggtttctggggcagtatcgtcgcggccgcgctggccgtggcgctgatcggcgtcatcgtcgagatggtgctgctccgccgcatctatcatgcgcccgaattgttccagctgctcgcgaccttcggtctgaccctgatggtcgaggacctcgtcgtgctgatctgggggcccgacgatctcgtcggccgccgcgcgccgggcttcaagggcgcgatcgatttcttcggccagaacatcccgagctatgacctgttcctgatcgggctcggcccggtcgtgctcggcattctctggctgctgttccagcgcacgcgctggggcgtgctggtgcgcgcggcaacgcaggaccgcgacatggtcgcggctctcggcgtcaatcagaaatggttgttcacgtcggtgttcgcggtcggcgtcttcctcgcagcgctcggcggcgcgctccagatcccgcgcgatgccgtgcatcacgcgatggatctgcgcatcatcgtcgaggtcttcgtcgtggtcgtgatcggcggtctcggcagcatcgtcggcgccttcgtcgcggcggtgctggtctccgagctcaacgccttcggcatcctgatcttcccgaagatctccatcatcctggtcttcctggtgatggcggtggtgctgatcgtccgcccctggggcctgttcggcaagccggaggcggccgcgcgcaagacgccgggtctcaccgtcaatccctggcgcccgctgtcgtcgaacgagcggctggccgcgctggcaacgctcgtcattgccgcaacgctgccgctgttcgccggcaactacgcgctgaccgtcggctcggagatcgcgatcttcgtgatcttcgccgtcagcctgcacttcctgatgtcggtcgggggactcgcgtctttcggccacgccgcctatttcggcctcggcgcctacggcatcgccttcctcgccaagatggccggactgccgatgatcgtctgcctgttgctcgggccgctgctcggctgcatgggcgccgcggtgttcggcttcttcgccgtgcagctctccggcgtctactttgcgatgctgacgctcgcctttgcccagatcgtctggtcgatcgcgttccaatgggtgagcgtcaccggcggcgacaacggcattctgggcgtctggccggaaaaatgggcggcgagcccgtcgcacttctattggctggcgctcggcgtcgcggcgctcgtcacggtcgcgctgcgggccatggtgttctcgccgttcggctacgcgctgcgggccacgcgcgactcgctcctgcgcagcgaagcgatcggtatcaacgccaagcgcatccagtggaccgccttcgtgatcgcgggcacgaccgccggcatcggcggcgcgctgttcgcctatctcaagggcagcgtcttcccggacaatctcggcatctcgctttcggtcgacgcgctggtcatggtgctgctcggcggcgtcgagacggtgtcgggcgcggtgatcggcgccatcgtctacaaggcgctcaacatctggctggtcagccagaccgacctgtcgaagctcgtgctcggcggcttcatcgtgctgatcgtcgtcgtctttcccaagggcatcgtcggcatgctggagatgctggcgcagcgtcgcaggaagacatcgccgccgggatctcccttgcttgccaagccgatcgagtccgccgaatga

SEQ ID NO: 27722 - protein, 629 aa, Bradyrhizobium japonicum
MAFYVVQFLTGLASAASLFLVASGLSIIFGVTRIVNFAHGAFYMIGAYIAFTLTERLSGAFGFWGSIVAAALAVALIGVIVEMVLLRRIYHAPELFQLLATFGLTLMVEDLVVLIWGPDDLVGRRAPGFKGAIDFFGQNIPSYDLFLIGLGPVVLGILWLLFQRTRWGVLVRAATQDRDMVAALGVNQKWLFTSVFAVGVFLAALGGALQIPRDAVHHAMDLRIIVEVFVVVVIGGLGSIVGAFVAAVLVSELNAFGILIFPKISIILVFLVMAVVLIVRPWGLFGKPEAAARKTPGLTVNPWRPLSSNERLAALATLVIAATLPLFAGNYALTVGSEIAIFVIFAVSLHFLMSVGGLASFGHAAYFGLGAYGIAFLAKMAGLPMIVCLLLGPLLGCMGAAVFGFFAVQLSGVYFAMLTLAFAQIVWSIAFQWVSVTGGDNGILGVWPEKWAASPSHFYWLALGVAALVTVALRAMVFSPFGYALRATRDSLLRSEAIGINAKRIQWTAFVIAGTTAGIGGALFAYLKGSVFPDNLGISLSVDALVMVLLGGVETVSGAVIGAIVYKALNIWLVSQTDLSKLVLGGFIVLIVVVFPKGIVGMLEMLAQRRRKTSPPGSPLLAKPIESAE

SEQ ID NO: 27723 - DNA, 930 bp, Bradyrhizobium japonicum
  CDS (1)..(930)
atgacgcgggcaaatccgcttgcgccatcgcgcggcccaaatccgaaaacggatgacgccatgctcgacatgatcctgtcgcaggccgtcaatggccttgtgctcggctttctctacgttctgatcgcgatcggcctgtcgatcatcttcggcatgctcggcatcgtcaatttcgcgcatggcgccttcttcgccgtcggcgcctatctcgcttatgccctggccaaggagttcggctggtggggggcgcttgccgcgccgctgttgaccggcgcgatcggcgtcgtcgtcgagatggtcctgatccggcacctctatggcaaggaaccgctgctcgggctgatcttgaccttcgcgctcgcactgctggcggaggcggtgttgcggctgatcttcggcggcgcgcccgtgcccttcgctgcgccgaaattcctggccggcttcgtcgaatacggcccgatcctgatcaccaaatacaggatgttcgtgctgctcacgaccgcgctgacgctggtcgcgttctgggcctttctcgcctacacgccttacggccggatcatccgcgccgggtcgcgtgatccggagatggtcggcctactcggcatcaacctgccgatcgtctttagcggcgtgttcggcatgggttgcctgctcgccggcctcggcgggctcttggcggcaccgctctggaccatcacgccgtcgatggcggcgggcgccatcatgccggctttcgtgatcgtcaccatcggcggcctcggctccttcctgggtgccgtcgtggccggcctcctggtcggcatcaccacggcgatgaccatccagttccagccggaatggtcgggcgcagccatgtacatcctgatggccgccattctcctcgtccgcccgcgcggactgttcggcgaacgctgggagagattcgagtga

SEQ ID NO: 27724 - protein, 309 aa, Bradyrhizobium japonicum
MTRANPLAPSRGPNPKTDDAMLDMILSQAVNGLVLGFLYVLIAIGLSIIFGMLGIVNFAHGAFFAVGAYLAYALAKEFGWWGALAAPLLTGAIGVVVEMVLIRHLYGKEPLLGLILTFALALLAEAVLRLIFGGAPVPFAAPKFLAGFVEYGPILITKYRMFVLLTTALTLVAFWAFLAYTPYGRIIRAGSRDPEMVGLLGINLPIVFSGVFGMGCLLAGLGGLLAAPLWTITPSMAAGAIMPAFVIVTIGGLGSFLGAVVAGLLVGITTAMTIQFQPEWSGAAMYILMAAILLVRPRGLFGERWERFE

SEQ ID NO: 27725 - DNA, 873 bp, Bradyrhizobium japonicum
  CDS (1)..(873)
atgttctacacgatcatagagcaggtcgttaacggcatcgtatcaggatcggtctatgcgatcgttgcggtcggcatgacgatgatttttggcgtgctgcgcgccatcaacttcgcgcatggcgaatactatatgctcggcaccttcggggcctggttcgccatcgaatatttcgacctgccttatccggtagcagtcgtgatcggtgtggttgccaccgccgtcatcgccgtcgtggtcggcaatttcgtgatgcagcggatcgtcggagcgccggccgaggccggcgtgctcgcgaccctcggcgtcgcgctgatcctgcagaacaccgtcatcctggtgttcggtggcagctacaagttcttctccggcggctatatcgagccggtgacgctgttcggtttcacactggccgagcagcgcatcctgatcatcatcgtcagcctcatcgtgttcgtcggcctcgagctgatggtcacctacagccggatgggcaaggcgatgcgcgcggtgtcgcagaacatcgaatgctgcgctgtggtcggtatcgacgtccgtcacatcgcgctctggaccttcatcctcggggctgggttggcggcgctctcgggcgtgttgactgcgcccgtgaacgtcagcgtctacggcggcatgggcgagctcatcaccttcaagacgctgcccatcatcatcatgggcggactcggcaacgtccggggcacgttcgtcgcggcgatgatcctcggtatcgcggagagcctggttgccacctatgtcgggctgcagttccgcgacaccgtgggatttgcgaccctcatgctggtgctgatgtggcgtccgcacgggctcttctccgcgcaggcccgcttctga

SEQ ID NO: 27726 - protein, 290 aa, Bradyrhizobium japonicum
MFYTIIEQVVNGIVSGSVYAIVAVGMTMIFGVLRAINFAHGEYYMLGTFGAWFAIEYFDLPYPVAVVIGVVATAVIAVVVGNFVMQRIVGAPAEAGVLATLGVALILQNTVILVFGGSYKFFSGGYIEPVTLFGFTLAEQRILIIIVSLIVFVGLELMVTYSRMGKAMRAVSQNIECCAVVGIDVRHIALWTFILGAGLAALSGVLTAPVNVSVYGGMGELITFKTLPIIIMGGLGNVRGTFVAAMILGIAESLVATYVGLQFRDTVGFATLMLVLMWRPHGLFSAQARF

SEQ ID NO: 27727 - DNA, 1044 bp, Bradyrhizobium japonicum
  CDS (1)..(1044)
atgacgagtgacatcgcagccattcttgcgatcgacgggatcgccaccggcgcagtctatgcgctggtggcgatcgggaccgtcctcatcttcacggtgaccagggtcatcttcattcccttcggcgacatcgccgcgttcaccgcgctgacgctggcggccctcgatgcgaagcgctttccgggcacgggggcgctggtggtcatcctggcctgccttgcgaccctgatcgagatcatctcgctggtacgcgccggcgaaacccggctgctgccgcgcgcgctcttgttctacctcgtgcttccggtggccgtggttggcctcgcctggctgacgatgcgcgccgatcctccgctcgccgtcaggctcgtgcttgccttgatgctgatcacgccgatcgctccgctgctggatcggatcgtcttccgccccatcgcggacggaacggtgttgttgctcctgacggtctcggtcgcgctgcatttcgcgctggtgggcctggggctgctgttcttcggacctgaaggcgtcagaaccgaaccgctgacgtcgttgtcggccgagttcgccggcgtgctggtctcgggccagaccatgctgatcgtgatcgcagccctcgtcttcagtggcctgctctttctcttcttcgacttcacgctggtcggaaaatcgctgcgtgccaccgccgtgaaccggaccggctcccgcctgatgggaatacggcccgcccgcgccggcacgatcgcctatctgctgggctcgctgatggccggcgtatcgggcatcctgatcgcaccggtcaacaccgtgttctacgattccggcttcctgatcggcctcaaggccttcgtcggcgccatcgtcggcggcatgaccagctatcccggcgcggcgatcggcgccgtcggcgtcggtattctcgaaagcttcgcatccttcgagagcagcgcgctgaaggacgtcatcgtgttctcgcttctgatcccgatcctgatctggcgatcgctcgcctcgctgcattccgaggaggagatcgaggaatga

SEQ ID NO: 27728 - protein, 347 aa, Bradyrhizobium japonicum
MTSDIAAILAIDGIATGAVYALVAIGTVLIFTVTRVIFIPFGDIAAFTALTLAALDAKRFPGTGALVVILACLATLIEIISLVRAGETRLLPRALLFYLVLPVAVVGLAWLTMRADPPLAVRLVLALMLITPIAPLLDRIVFRPIADGTVLLLLTVSVALHFALVGLGLLFFGPEGVRTEPLTSLSAEFAGVLVSGQTMLIVIAALVFSGLLFLFFDFTLVGKSLRATAVNRTGSRLMGIRPARAGTIAYLLGSLMAGVSGILIAPVNTVFYDSGFLIGLKAFVGAIVGGMTSYPGAAIGAVGVGILESFASFESSALKDVIVFSLLIPILIWRSLASLHSEEEIEE

SEQ ID NO: 27729 - DNA, 1011 bp, Bradyrhizobium japonicum
  CDS (1)..(1011)
atgagccgtttcatcgaacgccatcccgcctgggcgctgatctcgatcatcgcgatcgccatcgcgctgtggctgatcttcgcagtctggccgccgggcctcgaagaggcaatcgggcgcaagcgcgtcttcctcaacgccgtcttcaacggcatcacgctcggcgggctctacttcctcgtcgcgagcggcttcacgctgatcttcggcctgatgcgcaacgtcaacctggcgcacggctctctctatctgttcggcggctatgtcggctacgccatcagcacagccaccggctcctggctcctcagcttcatcgttgccttcgtcctgactgcactggtcggcgtgctgcttcaggtgatcgtgttccggcgcatggaaggccaggacctcaggcagaccatggtgacgatcgggctctcgatcgtgtttgccgacctgatgctctgggcctgcggcggcgacttctaccagatccagaccccgagctggctgatcgggcccgtggacctgccgctgatcacggcggtgaaatcctcgggcgagccggtctatctccgatatccggtggtgcggctggtgatcttcgcggcgtccgtcgtgatcggcgtcggcatgtggctcgcgctcaaccgcacccggatcggcatgatcatccgcgccggcgtcgacgatcgcgacatgctggccgccaccggcgtgcgcatccagctcgtcttcgtgctggtgttcgcgttcggcgccgggctcgccggcatcgctggcgtcgtcggcggcaccttccagtcgctgtcccccggcgaggacattcgtttcctgctggcctcgctggtggtggtgatcgtcggcggcatgggctcgatccccggtgcggcgctcggtgcgctcatcatcggcctcgccgagcagctcggctcggtctacatcccgacctacgccatcgtcgtgacctttctgatcatggtgctggtgctggcaatccggccgcagggcctcctggcgaggcgctga

SEQ ID NO: 27730 - protein, 336 aa, Bradyrhizobium japonicum
MSRFIERHPAWALISIIAIAIALWLIFAVWPPGLEEAIGRKRVFLNAVFNGITLGGLYFLVASGFTLIFGLMRNVNLAHGSLYLFGGYVGYAISTATGSWLLSFIVAFVLTALVGVLLQVIVFRRMEGQDLRQTMVTIGLSIVFADLMLWACGGDFYQIQTPSWLIGPVDLPLITAVKSSGEPVYLRYPVVRLVIFAASVVIGVGMWLALNRTRIGMIIRAGVDDRDMLAATGVRIQLVFVLVFAFGAGLAGIAGVVGGTFQSLSPGEDIRFLLASLVVVIVGGMGSIPGAALGALIIGLAEQLGSVYIPTYAIVVTFLIMVLVLAIRPQGLLARR

SEQ ID NO: 27731 - DNA, 1047 bp, Bradyrhizobium japonicum
  CDS (1)..(1047)
atgagaatagccctcaccattctcgccgtcgcggcccttgcctcggtgccgctctggctgcgcgatccctatctcctcaacgcgctgatcacgaccggaatcttcgtcatcggcgcgatgagcctcaatctcctgctcggcttcaccgggcagctcagcctcggccacatcgccttcttcggcatcggcgcctatgtcagcgcgctgacatcgctcggtttcgacatcgggctgcccggagacctgcgccttgttcacacgccgtggccgcccattgtgggcttcgtgctcgcgatcctcatcgccgggctgtgcggttatttcgtcgggctgctctcgttccgcgttcgcggcgcctatttcgtcattgtcacgatctccttcgccgaagtcgtgcggctcgtcgcgctgaactgggtcgagttgacgcaaggccctctggcgctgaccaacattccctccatcgcgctgccgttgcccggcctcagtgagctgacgctgcgcaccaagatgcagaactactatctcgtgctggtcgtggctctcatcgcctatctcctgatcgcgcgtctcgttcattcccatttcggccgcgcgatgcgcggattgatggagaatgagacgctcgcggtctccgtcggtatcgacgtgaccaagacgctgacgctggcggcggtgatttccgccgcgatcgctggcgccgccggcagcctctatgcgcactatatccggatcatcgatccggaagtgtttgccttcatcaacaccgtcaccatggtgatcatggtcatcagtggcggcaagggctcgctggcggggcccgtcgtcggcggcctgatcttcgggctgctgccagtcgcgctgcgtccgatcatggcgccggaggcgcaatggatcgcctatggcggcgtgctgatcgccatcctgttcgtgctgccgcgcggcatcgtgccctcgctcgcgcagcgatttcgcaggagacggagcggcacgacggcgctggcgccggtggccctcgccgagacagcggtcaaggagcgggcgtga

SEQ ID NO: 27732 - protein, 348 aa, Bradyrhizobium japonicum
MRIALTILAVAALASVPLWLRDPYLLNALITTGIFVIGAMSLNLLLGFTGQLSLGHIAFFGIGAYVSALTSLGFDIGLPGDLRLVHTPWPPIVGFVLAILIAGLCGYFVGLLSFRVRGAYFVIVTISFAEVVRLVALNWVELTQGPLALTNIPSIALPLPGLSELTLRTKMQNYYLVLVVALIAYLLIARLVHSHFGRAMRGLMENETLAVSVGIDVTKTLTLAAVISAAIAGAAGSLYAHYIRIIDPEVFAFINTVTMVIMVISGGKGSLAGPVVGGLIFGLLPVALRPIMAPEAQWIAYGGVLIAILFVLPRGIVPSLAQRFRRRRSGTTALAPVALAETAVKERA

SEQ ID NO: 27733 - DNA, 903 bp, Bradyrhizobium japonicum
  CDS (1)..(903)
atggatctcgacgcgctcgccggctgcctctccagctccgcctgcctggtgacgcaaaccaccagcggcctcatcatcggcatgctgctgtttctggtcgcggtcgggctgacgctgatcttcggtgtgctcaaggtcgtcaatttcagccacggcgccttctatatgttcggcgcctattttgcgatgacggcctatcatctcaccgacagctttgcgctggcgatgctggcgggtgcgggcggcaccgccatcctcggcctgatcttcgagcgcgtcttcatgagccgcgtctatggcgccgacgtcttgatgcagctcctcgtctgctacgccttcgtgctgatcttcgatgatgtcgtgcgcatcatctggggccccgagttcaagtcgatgggcatgcctgcggcgttccaggtgatgccgctgttcatcgccggcggcgtggtgccgccttattacctgctgctgatcggcgtcgcgctcgtcgcggccatcgtgctcggcattgggctgtcgcgcagccgcattggcaaggtgatccgcgccgccgcgcacaatcccggcatggtgtcggcgctcggcatcaacaccggcctgatctatggcggcgtgttcgcgctcggcggcatgctggcggggctggctggtgcacttgccgcgccggtgcgctcgctcacccccggcatgggattctcggtgctgatcgaatccttcatcgtcaccgtgatcggcggcatgggctcgatcctgggcgcactgatcggcgcgctgctgatcggcctgatccgctcgttcggctcgctcggctttcccctgttcacggaaggtctgatgtacctgttcatggtgatcgtgctggtctccaagcccaccggcctgttcggcaaggaggcggcatga

SEQ ID NO: 27734 - protein, 300 aa, Bradyrhizobium japonicum
MDLDALAGCLSSSACLVTQTTSGLIIGMLLFLVAVGLTLIFGVLKVVNFSHGAFYMFGAYFAMTAYHLTDSFALAMLAGAGGTAILGLIFERVFMSRVYGADVLMQLLVCYAFVLIFDDVVRIIWGPEFKSMGMPAAFQVMPLFIAGGVVPPYYLLLIGVALVAAIVLGIGLSRSRIGKVIRAAAHNPGMVSALGINTGLIYGGVFALGGMLAGLAGALAAPVRSLTPGMGFSVLIESFIVTVIGGMGSILGALIGALLIGLIRSFGSLGFPLFTEGLMYLFMVIVLVSKPTGLFGKEAA

SEQ ID NO: 27735 - DNA, 906 bp, Bradyrhizobium japonicum
  CDS (1)..(906)
atgagggcgtattgtgggggacgacttttgacagctcaagccattatccagagtctcgcgagcggcctgctcatgggcctgctctacggactgatcgccgtcggcctcgcgctgatcttcggcctgatggacgtcgtgaacttcgcccatggcgagttcctgatgatcgcgatgtatgtgagcttcttcctgttcgcgttcttcgccatcgaccccctgctgtcggcgccgctggtcgccgcggccctgttcgtgttcggggcggtcgtctacctcttgattgtacgcttcgcgatgcgcgccaaggcaaacgccggcatggtgcagatcttctcgaccttcggccttgccatcgtgatgcgcgggctcgcgcagttcttcttcacgccggactatcgcagcattccgcagtcctggctcggcggcaagacgatctcgatcggcggcatcttcctgccggagccgcagttgatcggcgcgctggtctcgatcgcggctttcgccggcctctatttcttcatcaaccgcactgacttcggccgcgcgctcgaagccacccgcgaagatcccggtgcagtcgcactcgtcggcatcgacaagaaccgcgtgttcgcgctgggctggggcctgggcgccgcactggtcggtctcgccggcgcgatcatggcggtgttcttctacatctatccggacgtcggcgcctccttcgcgctgatcgcctatgtcacggttgcgctcggtggtttcggcagtgtgttcggcgcgttcgccggcggcatcatcgtcggcctcgtcgaggcgaccaccgccctggtgctgccgccttcgctgaaatcggtcggcatctacgcggtctatctgctcgtcgtcttcatccggccgcgcggcctgttcggatcgatgtga

SEQ ID NO: 27736 - protein, 301 aa, Bradyrhizobium japonicum
MRAYCGGRLLTAQAIIQSLASGLLMGLLYGLIAVGLALIFGLMDVVNFAHGEFLMIAMYVSFFLFAFFAIDPLLSAPLVAAALFVFGAVVYLLIVRFAMRAKANAGMVQIFSTFGLAIVMRGLAQFFFTPDYRSIPQSWLGGKTISIGGIFLPEPQLIGALVSIAAFAGLYFFINRTDFGRALEATREDPGAVALVGIDKNRVFALGWGLGAALVGLAGAIMAVFFYIYPDVGASFALIAYVTVALGGFGSVFGAFAGGIIVGLVEATTALVLPPSLKSVGIYAVYLLVVFIRPRGLFGSM

SEQ ID NO: 27737 - DNA, 1170 bp, Bradyrhizobium japonicum
  CDS (1)..(1170)
atgacccctcacatgctgacgcgatcactggaccgcagcgcgacgatcttcctgctggttgtcgccgcgctgggcgtgctgatcccgttgtccaacctgctgctgcccgcgggctcgttcctgcaagtgccgacctatctggtcgcgctctggggcaagtatgtctgttacgccatcctggcgctcgcgatcgacctgatctggggctattgcggcatcctctcgctcggccacggcgctttcttcgcgctcggcggctacgcgatgggcatgtacctgatgcggcagatcggcacccgcggcgtctacggcaacccgatcctgcccgacttcatggtgttcctgaactattcgaagctgccctggtactggtacggcttcgacatgttctggttcgccgcgctgatggtgctggtcgtgccgggcctgctcgccttctgcttcggctggctcgccttccgctcccgcgtcaccggcgtgtatctgtcgatcatcacgcaggcgatgacctatgcgctgctgctcgccttcttccgcaacgatttcggcttcggcggcaacaacggcctgaccgacttcaaggacattttgggcttcaacgtgcaggcggaagggactcgcgccgcgctgttcgcgctgagctgcctggcgctgatcctgggcttcctggtctgccgcgccatcgtctcgtccaagctcggcaaggtgctgatcgcggtgcgtgatgcggaatcgcgcacccgcttcctcggctaccgggtcgaatcctacaagctgttcgtgttcacggtgtcggcctgcatggccggcgttgccggcgcgctctacgtgccgcaggtcggcatcatcaatccgagcgaattcgcgccgggcaattcgatcgaggcggtgatctgggtcgcggtcggcggccgcggcacgctggtcggcgcggcgctcggcgccgtcgtcgtcaactatgccaagacgttcttcacctctggcatgctggcgccgtactggctgttcatgctcggcgcgctgttcatcctggtgacgctgctgctgcccaagggcatcgtcggcaccttcaacacctggtgggacgcgtcgaaggaaaaacgtcccgcggcgaccacggcgagtgccgcggccgaggacggcgtcaccgaaccaaagatggcggagtag

SEQ ID NO: 27738 - protein, 389 aa, Bradyrhizobium japonicum
MTPHMLTRSLDRSATIFLLVVAALGVLIPLSNLLLPAGSFLQVPTYLVALWGKYVCYAILALAIDLIWGYCGILSLGHGAFFALGGYAMGMYLMRQIGTRGVYGNPILPDFMVFLNYSKLPWYWYGFDMFWFAALMVLVVPGLLAFCFGWLAFRSRVTGVYLSIITQAMTYALLLAFFRNDFGFGGNNGLTDFKDILGFNVQAEGTRAALFALSCLALILGFLVCRAIVSSKLGKVLIAVRDAESRTRFLGYRVESYKLFVFTVSACMAGVAGALYVPQVGIINPSEFAPGNSIEAVIWVAVGGRGTLVGAALGAVVVNYAKTFFTSGMLAPYWLFMLGALFILVTLLLPKGIVGTFNTWWDASKEKRPAATTASAAAEDGVTEPKMAE

SEQ ID NO: 27739 - DNA, 1608 bp, Bradyrhizobium japonicum
  CDS (1)..(1608)
atgccagctaatttgtccgcccgcctctgttcgctcctgctctcgttgttcctgatcgcgttcgcactgccggccttcgccggtccgttcgaggatgcggtcgccaaattcgccaacgatgattattccgacacggaagaggcgatcggcgtggtcgcgagcagcggcaatccgctggccttccccatcatcagcgcgctccaggacggccgcctcatggccgatccggacagcaagaaggtttacgtcaccggcaccgacggcaagtcgatcgatgtcgcgaccggccaggcggtggccagcgttcccgacagtgcgagcgcggtccgcctcaacaaccgtcttcgccgcagcgtcgatgccgcggtcggcagcctgacgcttcagtcgccggacgtcggaacgcgcctccaggccgcgcaatccgtcttcaagtcgcatgaggagaccgcgctcgaagccgtcgatgccgcgctcgccaaggaaaccaacaaatcagtcaaggctacgctcggcgaagcccgcgcggcgatcctgctgttcaagccggacgccaccgaggtcgagaagctcgaggccgtcgccaccctcagggcgcgcggcgaccaggaggcgatggcgctgctcaccggcatgggcgaccagccggcctcggtgaccaaggccgccgcgagtgcgatcggctcgatccagagttcgctcgcggtctggtccacggtgcagaatgcctggtacggcctctcgctcggctcagtgctgctgctcgcggcgatcgggcttgccatcaccttcggcgtgatgggcgtcatcaacatggcccacggcgaaatggtgatgttaggggcctacaccaccttcgtggtgcaggaggtgatccgcacccgctatcccggcctgttcgactattccttgctgatcgccgtgccgctggcctttctcgtcgccggcgcgatcggcgtgttgatcgagcgcagcatcattcgcttcctctacggccgtccgctggagacgctgctggcgacctggggcctgtcgctggtgctccagcaggcggtccgcaccatgttcggcccgaccaaccgcgaggtcggcaacccctcctggatgagcggcgccttcgagctcggccagatcaccattacctataaccggctctggatcctctgcttcacgctcgccgtgttcgcgatcctgctcgcgatgctgcgctacaccgcgctgggcctggagatgcgcgcggtgacgcagaaccggcgcatggcggcctcgatgggcatcgccacctcgcgcgtcgacgcgctcaccttcggcctgggttcgggcattgccggcatcgccggcgtggcgctgtcgcagatcgacaatgtcagtcccaatctcggccagagctacatcatcgacagcttcatggtcgtggtgttcggcggggtcggcaatctctggggcacgctggtcggcgccttcacgctcggcatcgccaacaagttcctggagccggtcgcaggcgccgtgctcggcaagatcgccatcctggttctcatcatccttttcattcaaaagcggccgcgcggtctgttcgcgctcaagggccgtgcggtggaagcatga

SEQ ID NO: 27740 - protein, 535 aa, Bradyrhizobium japonicum
MPANLSARLCSLLLSLFLIAFALPAFAGPFEDAVAKFANDDYSDTEEAIGVVASSGNPLAFPIISALQDGRLMADPDSKKVYVTGTDGKSIDVATGQAVASVPDSASAVRLNNRLRRSVDAAVGSLTLQSPDVGTRLQAAQSVFKSHEETALEAVDAALAKETNKSVKATLGEARAAILLFKPDATEVEKLEAVATLRARGDQEAMALLTGMGDQPASVTKAAASAIGSIQSSLAVWSTVQNAWYGLSLGSVLLLAAIGLAITFGVMGVINMAHGEMVMLGAYTTFVVQEVIRTRYPGLFDYSLLIAVPLAFLVAGAIGVLIERSIIRFLYGRPLETLLATWGLSLVLQQAVRTMFGPTNREVGNPSWMSGAFELGQITITYNRLWILCFTLAVFAILLAMLRYTALGLEMRAVTQNRRMAASMGIATSRVDALTFGLGSGIAGIAGVALSQIDNVSPNLGQSYIIDSFMVVVFGGVGNLWGTLVGAFTLGIANKFLEPVAGAVLGKIAILVLIILFIQKRPRGLFALKGRAVEA

SEQ ID NO: 27741 - DNA, 876 bp, Bradyrhizobium japonicum
  CDS (1)..(876)
atgtccaatctgttcgatcttctggtcgcaggacttgccaccggcgccatctatgcactggtcgcggtcggcttcacgctgctgtggcagacctcgcagaccatcaatttcgcgcagggcgagttcgtgatgctgccggcgttcctgatgctcgcgacgatgcatgttggcgcgccgttctggctcgcgatcatcctcggcatcctgctctcgatgatcctgctcggcctcgccttcaagatgctgctggtcgatccgatgatgcgccatggcgtgctgccgctggcgatcgcgaccatggcgctggcgatcggcatcaaggaatcggtgaagcagttcttcagcgcggaggcctcgcccttcccctcgatcgtgccgaccggcgatatctccatcctcggccacgccgtctcgctgcaaagcatcggcgtcctcgtcgtcgccattcttgcagtcttcggcctgacctcgctcctcaaccgcacctcgctcggccaccagatgcaggcggccgcccagaatccgacggtggcgcgcatcatcggcgtgcccgtggagcgcatgatcctgttgaccttcctgatcaacgccttcctggtcgcgctggcctcgctgctgatcacgccgatttacctcgcgaaattctcgtccggcgaggtgctgggccaggccgccttcatcgcggcgatcgtcggcggcttcaaccaggtgcgcggcgcgatcgcgggcggcctgttgatcggcgtgctcgacaatctcgcggcaagctacgtctcgacgcaataccgcgcggccgtgccgctgatcttcctgatcgtcgtcatcctgttccggccgcaaggactgctcggccgcgccgaggagcgcacggtatga

SEQ ID NO: 27742 - protein, 291 aa, Bradyrhizobium japonicum
MSNLFDLLVAGLATGAIYALVAVGFTLLWQTSQTINFAQGEFVMLPAFLMLATMHVGAPFWLAIILGILLSMILLGLAFKMLLVDPMMRHGVLPLAIATMALAIGIKESVKQFFSAEASPFPSIVPTGDISILGHAVSLQSIGVLVVAILAVFGLTSLLNRTSLGHQMQAAAQNPTVARIIGVPVERMILLTFLINAFLVALASLLITPIYLAKFSSGEVLGQAAFIAAIVGGFNQVRGAIAGGLLIGVLDNLAASYVSTQYRAAVPLIFLIVVILFRPQGLLGRAEERTV

SEQ ID NO: 27743 - DNA, 1011 bp, Bradyrhizobium japonicum
  CDS (1)..(1011)
atgacagaacttgccgcaaacgatccgctgccgaagccgaagcgcgacatcgcgccgatcctgctgccgatcgcgctcgccctcctggtgatcccgctggtcggctcgcccagcacctggctgacgctgaccgccgcgagcctcgccatgggcatgatgatcttcatcatggcctccgggctgacgctggtgttcggcctgatggacgtgctcaatttcggtcatggcgccttcatcgccgtcggcgcctatgtcgcaaccctggtgctggcaccgtttgcggcgtccattcaggccgattcgctctggatgaacctcgcggtgctggcgccggctgcgctgctgtcgatggcggtgtccggcgcgctcggcctggtcgtcgagcgcgtgctgatcctgccggtctacggccagcatctgaagcagatcctgatgacgaccggcggcctgatcgtcgccgagcagacgctctatgcgctgtgggggccgcagatcatcccgatgccgctgcccacctcgctgcgcggctccttcatcctcggcgacgtcgcgatcgccaagtaccgcgtgctggcgacgctgatcggccttgccgtcttcatcgcgatccagctcgtgctcaaccgcaccaagctcggcctgctgatccgcgccggggtcgagaaccgcgagatggtcgaggcgctcggctatcgcatccgccgcctgttcctcggcgtgttcatgacgggctccgcgctcgcaggcctcggcggagtgatgtgggcgctctatcgcgagcaggtccacgcctccatgagcgacgacctcaccgtgctgatcttcatcgtcgtcatcatcggcggcctcgggtcgatcggcggctgcttcatcggcgcgatcctggtggcgatggtcgccaattacggcggcttcctggtgccgaaactcgccctcgtctccaacatcctgctgatggtcgccattctgatgtggcggccgcgcggcctctatgcggtgaccagccgatga

SEQ ID NO: 27744 - protein, 336 aa, Bradyrhizobium japonicum
MTELAANDPLPKPKRDIAPILLPIALALLVIPLVGSPSTWLTLTAASLAMGMMIFIMASGLTLVFGLMDVLNFGHGAFIAVGAYVATLVLAPFAASIQADSLWMNLAVLAPAALLSMAVSGALGLVVERVLILPVYGQHLKQILMTTGGLIVAEQTLYALWGPQIIPMPLPTSLRGSFILGDVAIAKYRVLATLIGLAVFIAIQLVLNRTKLGLLIRAGVENREMVEALGYRIRRLFLGVFMTGSALAGLGGVMWALYREQVHASMSDDLTVLIFIVVIIGGLGSIGGCFIGAILVAMVANYGGFLVPKLALVSNILLMVAILMWRPRGLYAVTSR

SEQ ID NO: 27745 - DNA, 858 bp, Bradyrhizobium japonicum
  CDS (1)..(858)
atggctaacgcgttcgtcgcggcgttcgagatcctgagctttggcgcgatcatcgtcctgatcgtgctggggctcgggatcatcgccagcatgatgggcatcttcaacttcgcgcaaggagagttcgtcctgctcggggcctacatcacctatctcgcctacgccgggggcctgccgatctgggccggcatggtcgcggcgcccttcgtggtcggcgcgctcggctttgtgctggaggcgctgatcatccgccgcttctacgccgcgccgatcgtggcgatgctcggcacctatgcgctcggcctgatcatccgcgaatccgtgcgcggcctgatcggcggcttctatctcaccgtgcccgagccgatcggcggctcgatcgacatcggcgcgatgcacatctcggcatggcgcttcaccatcatcgtcatcacgctgctggtgatgggtggctgctatctcctgctctctcgcacgagcttcggcctgcgcgtccgcgccacgctggaaaatccctcgctggcgcgcgcctccggcatctccacgccgctgatctatggcgccacctttgccttcggcgcggcgctcgccggccttgccggcgcgctgatcgtgcctgtcttcagcctgttcgccgatctcggcctgcgcttcctgatccagggctttgtcgcggtcatggtcggcggcgtcggctccttcatcgggccggtggcgggtgccggcgtcatcggcacgctgagtgccgcgctgccctgggtgatggcgcccgtcgtcgccgacgtcctcgtctttgtgctcgccattatcttcatcaaattccggccgcagggcctcatcgctggcaaaggggtttag

SEQ ID NO: 27746 - protein, 285 aa, Bradyrhizobium japonicum
MANAFVAAFEILSFGAIIVLIVLGLGIIASMMGIFNFAQGEFVLLGAYITYLAYAGGLPIWAGMVAAPFVVGALGFVLEALIIRRFYAAPIVAMLGTYALGLIIRESVRGLIGGFYLTVPEPIGGSIDIGAMHISAWRFTIIVITLLVMGGCYLLLSRTSFGLRVRATLENPSLARASGISTPLIYGATFAFGAALAGLAGALIVPVFSLFADLGLRFLIQGFVAVMVGGVGSFIGPVAGAGVIGTLSAALPWVMAPVVADVLVFVLAIIFIKFRPQGLIAGKGV

SEQ ID NO: 27747 - DNA, 1617 bp, Yersinia pestis
  CDS (1)..(1617)
atgatgagtgggcctatgaaatcgttaattcctgtttggaatagggcaatcaattatgtgttcaggccgatgataggtctgttactgggcttatcgatgtcggcaatggcagggccagcacaggattttgttgcggcgaatcgtgcacagcaggccacattattacaacagtgggcaacggaacctgatgctagccgattacctcttttgcaggcgctaaaacaagaaacagtagtggtagacagtgccggccaagcgtttattaaaaataatcaaagtattaattcgctggaaggccaatcgcaaccgaccggtacgctgaaaaaaatctggctcaacaaccggttacgtatcttgatcgccaatgccctggcggcacaacgcttagtcagtgacgatgaaaccgtgcgtttacaggcggcagttgaattacaacggcaggcacagagcgatcaactaccgctgctgaatcaacgcctgaagttggaaacggacagtcaggtcaaagaggcattgagcattgcactcgccaatttacaactgacggacagtaatccgcaggtgcgtctgaatgccgtgcaattgttggggcaatcaggttcaccgcaaactcaatcacggctgcaaagtttaaccgatacgcaggttgaaccgaatgaacaggtccgagccgcagcagccaccagtttgaaacagatacaacatcggttgatgattggggaggttattgggcaggtatttagcggactatcattgggttcaatcttactgctggcggcattggggttagctatcacctatggcttactgggggtgatcaatatggcgcatggtgaaatgctgatgttgggagcctattccgcctatctggtgcaatcgctattccaacaatttgccccacactggctggcactttatccattaatcgctctaccggttgcgttctttattactgcgggcattggtatggcgttggaacgcacggtgattcggcatctgtatggccgcccgttggaaacactgctagcgacgtgggggatcagcctgatgttgattcaggggatccgcatgttgtttggcccacagaatttggaagttgctaaccctgcatggctgtccggtggggttcaggttttacctaatctggttttaccgtggaatcggatcgcggtgattgcatttgtcattattgttttgctactcacatggttgctgctgaataaaacccgccttggtctgcaagtccgtgcagtgacacaaaatcgggcaatggcggcctgctgcggagtggctacggggcgggttgatatgctggcattcggtttgggttctggtattgcagggcttggcggtgtagcactctcgcaattgggcaatgtcggcccggaattagggcagggttatatcatcgactccttcttggtggtggtcctaggtggcgtcgggcaattagctggcagtgtggttgccgcattaggtctggggatgttgaataaaattttggaaccacaaattggcgcagtattgggcaaaatcctgattttagtgctgatcattttatttattcaaaaacgaccgcagggtctgtttgcccttaagggcagggtgagtgactaa

SEQ ID NO: 27748 - protein, 538 aa, Yersinia pestis
MMSGPMKSLIPVWNRAINYVFRPMIGLLLGLSMSAMAGPAQDFVAANRAQQATLLQQWATEPDASRLPLLQALKQETVVVDSAGQAFIKNNQSINSLEGQSQPTGTLKKIWLNNRLRILIANALAAQRLVSDDETVRLQAAVELQRQAQSDQLPLLNQRLKLETDSQVKEALSIALANLQLTDSNPQVRLNAVQLLGQSGSPQTQSRLQSLTDTQVEPNEQVRAAAATSLKQIQHRLMIGEVIGQVFSGLSLGSILLLAALGLAITYGLLGVINMAHGEMLMLGAYSAYLVQSLFQQFAPHWLALYPLIALPVAFFITAGIGMALERTVIRHLYGRPLETLLATWGISLMLIQGIRMLFGPQNLEVANPAWLSGGVQVLPNLVLPWNRIAVIAFVIIVLLLTWLLLNKTRLGLQVRAVTQNRAMAACCGVATGRVDMLAFGLGSGIAGLGGVALSQLGNVGPELGQGYIIDSFLVVVLGGVGQLAGSVVAALGLGMLNKILEPQIGAVLGKILILVLIILFIQKRPQGLFALKGRVSD

SEQ ID NO: 27749 - DNA, 936 bp, Synechococcus elongatus
  CDS (1)..(936)
atggtaaccaacgccttgcaagtccttgtggatggactagccacagggagtgtttatgccatttttgccctcggctatacccttgtcttctcgattttgggcatcattaactttgctcacggcgctgtttttgcccttggggcttatctcacctatgccctcttgggaggacgctttggctttaatggcctgttggccaatgggcagcttcccgttgccttgccctttgccccggccttggccttgagtgcccttggctgtgggctgttgggggtgggcattgactggattgtctttcgaccgttgcggcagcagggcaccgataccctcttgacggtggtggccagtcttggcgctgccgttttcctcaccaacttgatccagtatttagtgggtgccgaagtctatacctatcccgatcaactctggggtggattgccccttaccctgcaatggggggacattaccctgcgcactagccaattgattatctttgccgtggccgtggttttgatgattgccctgacctattgggtgaaagggacgcgcatggggaaaggattgcaggccgtggctgaaaatccaactgccgccacattgctgggcattgatggcgatcgcattattcaagtgacattttttgttagcagtgctttggctgctgttgctggcaccctcatcgccttgagtgttgggattacaggaccacagtttggggtgatctttggcctcaaggggttagcggtgattgttctggggggcctcggcagtttaccagggacaatgttggccggctttttgctgggattggtggaggcaatggtgcctgcggctgcttcggggtttcgcgatgctgctgcctttgccatccttttcctagtgctgctggcgcgcccccaagggctcttgggtcagccccccgttgaaaaagtctag

SEQ ID NO: 27750 - protein, 311 aa, Synechococcus elongatus
MVTNALQVLVDGLATGSVYAIFALGYTLVFSILGIINFAHGAVFALGAYLTYALLGGRFGFNGLLANGQLPVALPFAPALALSALGCGLLGVGIDWIVFRPLRQQGTDTLLTVVASLGAAVFLTNLIQYLVGAEVYTYPDQLWGGLPLTLQWGDITLRTSQLIIFAVAVVLMIALTYWVKGTRMGKGLQAVAENPTAATLLGIDGDRIIQVTFFVSSALAAVAGTLIALSVGITGPQFGVIFGLKGLAVIVLGGLGSLPGTMLAGFLLGLVEAMVPAAASGFRDAAAFAILFLVLLARPQGLLGQPPVEKV

SEQ ID NO: 27751 - DNA, 870 bp, Synechococcus elongatus
  CDS (1)..(870)
atggatattcaactgattcaacttttcgttaatggcttggcggtggggagtattattgcccttgcagccgtgggtttaacgctcacctttggcattttgcgcctgcccaactttgcccatggtgatttcatgacggcgggagcctacctgacgttggtggccaatgcaacaggactgaatatttggctctcaatggcgattgggggcttggggacggccgggttgatgctcctaagtgagaagctcctgtggcagccgatgcgcgatcgccgcgcaacctcaacaactctgattattatttccatcggtctgtcattcctgctgcgcaatgctgtgatcctcatttggggcagtgaaaaccaaacctatcggctacccgtcatccctgcccttgatgttggcggggtgaaaattatttactcgaaggtgattgtaatgattttggcggtggtagcgatcgccactgtgcatttgatcctccaacgcaccaaggtaggcaaggccatgcgagccgtagctgatgatctcgacttggcgcgggtttccgggattgatgtcgagtgggtggtgctgtgcacttggcttttggcaggggtactcacaggggtggcggggggtctctatggcctgattaccgctgtgcggccaacgatgggttggtttttgatcttgcccctctttgccagtgtgattctgggtggcattggtaacccctacggggcgatcgccggcgccctgatcattggtgttgcccaagagatgagtacacggatgatccctgctgaatacaagctggctgttgccctagggatgatgatggcagtgcttttagtgcgcccccaagggctatttcgtggcaccctcagctag

SEQ ID NO: 27752 - protein, 289 aa, Synechococcus elongatus
MDIQLIQLFVNGLAVGSIIALAAVGLTLTFGILRLPNFAHGDFMTAGAYLTLVANATGLNIWLSMAIGGLGTAGLMLLSEKLLWQPMRDRRATSTTLIIISIGLSFLLRNAVILIWGSENQTYRLPVIPALDVGGVKIIYSKVIVMILAVVAIATVHLILQRTKVGKAMRAVADDLDLARVSGIDVEWVVLCTWLLAGVLTGVAGGLYGLITAVRPTMGWFLILPLFASVILGGIGNPYGAIAGALIIGVAQEMSTRMIPAEYKLAVALGMMMAVLLVRPQGLFRGTLS

SEQ ID NO: 27753 - DNA, 1170 bp, Synechococcus elongatus
  CDS (1)..(1170)
atgcctaagctatcgcagttttcttttcccaaagatcgcctcagtggccgcgagttaatggtggtggctgcccttgctctaatcctgattttcgtgatgccatctctgttgccggggtttcgcttggatttactgcaccgctatctggctctggcgattgtggctttgggaatagatctgatttggggttttacgggattgcttagccttggccatggcattttctttgccttgggggggtacgcgatcgccatgcatttaaaactacaggtacccgccactgcctctagctccctaccagattttatgtccctctatggtgtcacggagttgccgtggttttggtatcccttctattcctttacctttgctgttgcagcagtggtgctgatcccagccctattgggggcactcttggggtaccttgtctttcgcaaccggatccgtggggtctatttctctatccttactcaagcggccattatcgtcttttataacttctttaatggtcagcaaaagctctttaacggcaccaatggcctgacagattttcaaaccctgctggggttccctgtacgcaatgcccagacccagtattggttctatgtcctaacagtgattttcttggccttggcgtatcttctctgccgttggctgacaatgggacgctttggccgcctactggtcgccatccgcgatgatgaagcccgtgtccgtttctcgggatacaacccgaccagctataaggtactcgtttttgccatttccgctgccttagcaggaatcggtggcgccttctttactttgcgcaccggcatcatttcaccacgggcgatggacattgccttctcaattgagatggtgatctgggtggcggttggcggtcgtgccagcctcattggagctgtcctgggagcactcttggtcaactttgctcgcagtctgttgagtgagcagtttgccgatatttggctctttttccaaggggccctgtttttaattgtggtgttggcactccctacgggaattgttggctggctgcgcactgaagcccccaacctgattgcgaaactcttggggcgaccacaacccctggcaacatatccagagttggagtttgatcccgaggtgcaatatgagcgtgaagttctcgaacaggagggcaaataa

SEQ ID NO: 27754 - protein, 389 aa, Synechococcus elongatus
MPKLSQFSFPKDRLSGRELMVVAALALILIFVMPSLLPGFRLDLLHRYLALAIVALGIDLIWGFTGLLSLGHGIFFALGGYAIAMHLKLQVPATASSSLPDFMSLYGVTELPWFWYPFYSFTFAVAAVVLIPALLGALLGYLVFRNRIRGVYFSILTQAAIIVFYNFFNGQQKLFNGTNGLTDFQTLLGFPVRNAQTQYWFYVLTVIFLALAYLLCRWLTMGRFGRLLVAIRDDEARVRFSGYNPTSYKVLVFAISAALAGIGGAFFTLRTGIISPRAMDIAFSIEMVIWVAVGGRASLIGAVLGALLVNFARSLLSEQFADIWLFFQGALFLIVVLALPTGIVGWLRTEAPNLIAKLLGRPQPLATYPELEFDPEVQYEREVLEQEGK

SEQ ID NO: 27755 - DNA, 1158 bp, Synechococcus elongatus
  CDS (1)..(1158)
atgacttttttgctagaaagtgtcttcaatggcatgagtattggtgcggtgttgctgttaaccgcactagggctggcgattgtctttggtattatgggcgtgattaaccttgcccacggtgaactgatgatgctgggagcctacactaccttcgtggtacaaaatggcttccgtcaattgggagagggttggtttgatacttatctattaatagcagtgcccttagcctttgccgtggcagcggggatcggtctcgttcttgagcggggagtcattcgctatctctatggtcgccccctcgaaaccctcttggccacttggggcgtgagtttgatcctgcaacagttggtgcgcagtattagttggcagatgactctgcaaatcgccctcttttgcctgctcttctttggtggccgctggctcctctccaagcggacgatcgctcctcgttggcaggcttgggtaacgccactgttactgacgctctctgtcggaattgccctgacagcgggcctcgtggctgggagcgcggtgggtctggcaatgacaaagccctggtttggtgctcagggggtggatgtgactgctcctagttggctgcggggaggggtaagtgtctgggggatgcagtttcccttggtgcgcctctttattattgccctgacagcagtgtgtttggtggcaatttacctctttcttctgcgatctcaatggggtctacggattcgcgccgtgactcaaaaccgcagtatgagtgcctgcatggggattcccacccaaacggttgatgccctcacctttgcccttggctctggtttggcgggggtagcaggctgtgccattagcctcttgggttctgtaagtccgaatacgggtcagaactacattgttgaagccttcatggttgttgttgtggggggggtcggcaaaattgtcggttcaattgtggctgcccttggcattggctttgtcaactacgtcatcggttcggggttgatgacccgctttcttgaaccgcaaacagcagtgtttgacttctttgaattttttgccagtaccagcatggcacgggtgatggtcttcatcctcatcattgctttcctgcaactgcgtcccgctggtctttttccacaaaaaggacggacggtcgatgcctaa

SEQ ID NO: 27756 - protein, 385 aa, Synechococcus elongatus
MTFLLESVFNGMSIGAVLLLTALGLAIVFGIMGVINLAHGELMMLGAYTTFVVQNGFRQLGEGWFDTYLLIAVPLAFAVAAGIGLVLERGVIRYLYGRPLETLLATWGVSLILQQLVRSISWQMTLQIALFCLLFFGGRWLLSKRTIAPRWQAWVTPLLLTLSVGIALTAGLVAGSAVGLAMTKPWFGAQGVDVTAPSWLRGGVSVWGMQFPLVRLFIIALTAVCLVAIYLFLLRSQWGLRIRAVTQNRSMSACMGIPTQTVDALTFALGSGLAGVAGCAISLLGSVSPNTGQNYIVEAFMVVVVGGVGKIVGSIVAALGIGFVNYVIGSGLMTRFLEPQTAVFDFFEFFASTSMARVMVFILIIAFLQLRPAGLFPQKGRTVDA

SEQ ID NO: 27757 - DNA, 870 bp, Streptococcus mutans
  CDS (1)..(870)
atgctccaacaacttattaatggtcttatcctagggagtgtctatgctctgttagcccttggttataccatggtttatggaattattaagttaattaactttgcccatggagatatttatatgatgggagcctttattggttattttcttattacaaaatatcatatgaatttctttgtggctcttgtgctgacgatggtcttaacagctatcttaggggttgtgattgaatttctggcttatcgtcctttgcggaattcgacacgtatcgctgctttgattactgccattggtgtttctttttttctcgaatacagtatggttcgtttagttggtgccaataaacatgcttttccccaaacccttgctacagtgaaatataatttaggtcctgttagtgtaaccaatgtacaactcatcattttaggagtctctatcttcttgatgttggctttgcagtttattgtccaaaaaactaaaatgggtaaagccatgcgtgccgtttcagttgacagtgatgctgcgcagttaatgggaatcaatgttaatagtactattagttttacctttgctttaggttctgcacttgctggtgctggtggtgtcttgattggactttattataattctgttgatccactgatgggaatggttcccggtattaaagcctttgtcgccgctgttttaggcggtattggtattattccaggtgcagctgtcgggggctttatgattggtcttttagagacgttttctgtttctatcggtcttgcaagttacaaggatgcagttgtctatgcagtgcttatcattatccttttagtaagaccagctggtattttaggaaaaaatgtgaaagagaaggtgtaa

SEQ ID NO: 27758 - protein, 289 aa, Streptococcus mutans
MLQQLINGLILGSVYALLALGYTMVYGIIKLINFAHGDIYMMGAFIGYFLITKYHMNFFVALVLTMVLTAILGVVIEFLAYRPLRNSTRIAALITAIGVSFFLEYSMVRLVGANKHAFPQTLATVKYNLGPVSVTNVQLIILGVSIFLMLALQFIVQKTKMGKAMRAVSVDSDAAQLMGINVNSTISFTFALGSALAGAGGVLIGLYYNSVDPLMGMVPGIKAFVAAVLGGIGIIPGAAVGGFMIGLLETFSVSIGLASYKDAVVYAVLIIILLVRPAGILGKNVKEKV

SEQ ID NO: 27759 - DNA, 957 bp, Streptococcus mutans
  CDS (1)..(957)
atgaaaaaaaatttaaaagcaaatataacttggcttgccctagtccttatcatcttttttcttctttttggacttattagtgctggtatcatagatatttactatactcaaattctcatgggaattgggattagtattatcatggcactcggaaccaacttagttcttggcttttctggacagctctctcttggacaagctggctttatggccattggtgcttatgcaactgctattttaacaactcaaaatcctacttatgcaggtttctatttatccattattgtcggtatgatagtgactgcaacggttgccttggttgttgggattccaacacttcgtttgaagggtgattacttagctattgcaactcttggtgtagctgaaattatccgtaaactgattgaaaatggtggtgatttgactaatggttctaggggaattatgggaattctcaaatacaccacttggccagtcgtctttgttttcgttgttttgattaccatttttgtgttaaattatctgaggagtcctatgggaagagaagtacttgcggttcgtgaagatgaaattgcagcagaagctatgggggtgaatacgacaaaaattaaggtacttacttttatgattgctgcagtaatttccagcattgcaggttccctttatgtcggttatattggtacagtcgctcctaaagattttaccattatgaaatcaattgattttcttatcgtggctgttcttggtggacttggctcagtaacaggaactattgtggctgctgttgttttgggtatcctcaatatgttcttgcaaaatgtatcagatattcgtatgattatctattcgttagctttaattttggttatggtctttagaccaggcggtcttttaggaacatgggaattcagtttttcaagacttttcgctaaaaaagctaaggagggcgacaaatag

SEQ ID NO: 27760 - protein, 318 aa, Streptococcus mutans
MKKNLKANITWLALVLIIFFLLFGLISAGIIDIYYTQILMGIGISIIMALGTNLVLGFSGQLSLGQAGFMAIGAYATAILTTQNPTYAGFYLSIIVGMIVTATVALVVGIPTLRLKGDYLAIATLGVAEIIRKLIENGGDLTNGSRGIMGILKYTTWPVVFVFVVLITIFVLNYLRSPMGREVLAVREDEIAAEAMGVNTTKIKVLTFMIAAVISSIAGSLYVGYIGTVAPKDFTIMKSIDFLIVAVLGGLGSVTGTIVAAVVLGILNMFLQNVSDIRMIIYSLALILVMVFRPGGLLGTWEFSFSRLFAKKAKEGDK

SEQ ID NO: 27761 - DNA, 870 bp, Streptococcus agalactiae
  CDS (1)..(870)
atgcttcaacagctcgttaatggacttatcttaggatccatatatgctttacttgccttaggatatactatggtatatggcattattaagctgattaattttgctcatggggacatctatatgatgggcgctttcatgggctattatttgattaatcatcttcatcttaattttttcctagctttattaattgcaatgctggggtctgctttcctaggtgttgtaattgaatatttagcttatcgtccactgagaaaatcaactagaattgccgcgttaattacagctattggtgtttcttttcttttggagtacgggatggtataccttgttggagcggatactagggcatttccgcaagccattcatactgttaaatataatttaggaccgataactataaccaatgttcagctcatcattttaggtattgcgctattactaatgcttactttacagttcatcgttcaaaaaactaaaatggggaaagctatgagagctttatcagtggatagcgatgccgcacaattgatgggaattaatgttaaccgtaccattagttttacatttgcgctggggtctgctttagctggagcaggtggagtactgattgggctttattataattctgttcaacctcttatgggggtaactccagggttgaaagcatttgttgcagctgtcttaggtggtattggtatcattccgggagcggctatcggtggttttgttattggcattttagaaactttagcgactgcacttggtgtgtcagattttcgagatggtatcgtttatgctattttaattctcattttcttgatccgtccagcaggaattcttggaaaaaatattaaggagaaggtctag

SEQ ID NO: 27762 - protein, 289 aa, Streptococcus agalactiae
MLQQLVNGLILGSIYALLALGYTMVYGIIKLINFAHGDIYMMGAFMGYYLINHLHLNFFLALLIAMLGSAFLGVVIEYLAYRPLRKSTRIAALITAIGVSFLLEYGMVYLVGADTRAFPQAIHTVKYNLGPITITNVQLIILGIALLLMLTLQFIVQKTKMGKAMRALSVDSDAAQLMGINVNRTISFTFALGSALAGAGGVLIGLYYNSVQPLMGVTPGLKAFVAAVLGGIGIIPGAAIGGFVIGILETLATALGVSDFRDGIVYAILILIFLIRPAGILGKNIKEKV

SEQ ID NO: 27763 - DNA, 954 bp, Streptococcus agalactiae
  CDS (1)..(954)
atgaaagaaaatatgaaatcaattttatcttggttagctatagtagtgttaggttatctcttgattagcgtgctaatatctatgggtatatttaacctctatcatattcaaattattgaaacaattgggattaatgttattttagcagttggtttgaacctaattgtaggttgttcgggacagttttcactaggacatgcaggtttcatggctattggcgcttatgcagttgctattatcggcgttaaaatgccaacttatgtaggttttttgatagctatacttgttggaactcttgttgcaggaggtattgccttaggtgtaggaattcctactttgagactaaaaggtgattatttagctatagctactttaggtgttgctgagattatccgtattttgttggttaatggaggtgatattacgaatggtgctgcgggtatcatggggattccgccttttacaacctggtctttagtttatggggtggcagttgtgagtcttatccttgcaatgaattttttgcgtagtcccttagggcgtaatacaattgctatacgagaagatgaaattgcagcagagtctatgggtgtggatacaacaaaagtgaaagtaattgtttttgtttttggagctattttagcttctatcgctggtagtttacaggctggctacgttggaactgttatgccaaaagacttttcatttatgatgtctgtcaatgttttaattattgttgttttaggtggtttaggttcaatgacagggacagttttagcagcaattttattaggattattgaatatgttactacaagactacgcttctgttcgaatgattatctatgctttagctctgattttaattatgatttttagacctagcggtttattaggaacgaaggagttaactctatctcatctatttcgtaagacgagtaagggaggcaattag

SEQ ID NO: 27764 - protein, 317 aa, Streptococcus agalactiae
MKENMKSILSWLAIVVLGYLLISVLISMGIFNLYHIQIIETIGINVILAVGLNLIVGCSGQFSLGHAGFMAIGAYAVAIIGVKMPTYVGFLIAILVGTLVAGGIALGVGIPTLRLKGDYLAIATLGVAEIIRILLVNGGDITNGAAGIMGIPPFTTWSLVYGVAVVSLILAMNFLRSPLGRNTIAIREDEIAAESMGVDTTKVKVIVFVFGAILASIAGSLQAGYVGTVMPKDFSFMMSVNVLIIVVLGGLGSMTGTVLAAILLGLLNMLLQDYASVRMIIYALALILIMIFRPSGLLGTKELTLSHLFRKTSKGGN

SEQ ID NO: 27765 - DNA, 987 bp, Oceanobacillus iheyensis
  CDS (1)..(987)
atgattaaaaataatacacaaaaatatatcgttattggattactcatggttgctattctcttccctctattcacccaaaataattactatattcatgtcatgacgctatcgtttatatggatgatcgccgtatatggattaaatatactggcgggatataccggttatttatcattggctcatgctggattctttgcaattggagcatatgcattaggcttactaaccgtaaaggcagaagtgggtttttggctagctttaattttagcaccaattataacaacaatcattggatttggaattggtttaattgcattgcgcaccaaggaacatttttttgctatatacacactttgtgtagggtacgtcatctatttattaattgataagtgggatagtttaacagaaggagttcgcggactaatgggcataccgttaccatctgatattggtccaatctcttttgagagtaatatcgctcaatactatttcattttaatcgtattgcttttctctattttcgtgatttatagaattgtaaattccatagtcggaaaaaagctaatcgcaattcgtaatagtgaacaactcgctttatcattaggtatttcaacgaaaaaaaataaactacttgcttttgtattatctacgttttttgcaggattagcgggtgcgttatatgcaagttttatacggttcctaggtccagatatcggttctacaaatataacatttgatctactcatgtatttaattgtcggaggtattggtacattatctggtccgattataggtactctattagtcgtatggctttctcaaaatctacaattcttacaagattatcgaatgctaatatttggtccattattggcactgttaatcattttctcccctcgaggtattgtaggtatgttctctagcatgaagcaaaacatccaacaaaaaagagatttacggcaaaaacaactaaaaaaagaagcgtag

SEQ ID NO: 27766 - protein, 328 aa, Oceanobacillus iheyensis
MIKNNTQKYIVIGLLMVAILFPLFTQNNYYIHVMTLSFIWMIAVYGLNILAGYTGYLSLAHAGFFAIGAYALGLLTVKAEVGFWLALILAPIITTIIGFGIGLIALRTKEHFFAIYTLCVGYVIYLLIDKWDSLTEGVRGLMGIPLPSDIGPISFESNIAQYYFILIVLLFSIFVIYRIVNSIVGKKLIAIRNSEQLALSLGISTKKNKLLAFVLSTFFAGLAGALYASFIRFLGPDIGSTNITFDLLMYLIVGGIGTLSGPIIGTLLVVWLSQNLQFLQDYRMLIFGPLLALLIIFSPRGIVGMFSSMKQNIQQKRDLRQKQLKKEA

SEQ ID NO: 27767 - DNA, 864 bp, Oceanobacillus iheyensis
  CDS (1)..(864)
atggagatattaatacaacagttattcaatggtttaacgatcggtagtgtatatagtttagtagcattaggtctcacacttgtttatggaattttgcatgtacccaattttgctcatggagccatttatatgattggtggctacgtaacattaacgatgatggtctatttgggattatcttattggctatcgatgcttatttctgtattagtagttggaaccctagcattattaatggaacgtcttatattccatcctctaagaaattctatctccattaatagtatgattgctgcaattggaatgttgttatttttagaagcgtttgctcagctgttctggggtccagattttcgagagatgccaacaccatacaatgaagtagtcaatgtatttggattaacatttacggttcagagaatcttgattgttgtggcagcaattgttgttatgatattactttatgcttttcttaagaaaacgtttataggtcgaactatcattgcattgtcgcaaaatcgagaaggtgcgtttttggttggtattaatgcgaataaagtagcgatgttgactttctttatagctggcgctttagcggcaattgcagcatcacttacatcgccaatcaatcttgtatttcccggcatgggacacctcgttatcttaaaggcatttgttattattattatcggtggtatgggtagtatacctggtgctattgtaggtggttatattttaggatttagtgaaagtattggggcaacctatatctctagtgattataaagatattattgctttcgttcttctgatcattattctctctatcaagcctaatggcatatttgctaagggggaacactaa

SEQ ID NO: 27768 - protein, 287 aa, Oceanobacillus iheyensis
MEILIQQLFNGLTIGSVYSLVALGLTLVYGILHVPNFAHGAIYMIGGYVTLTMMVYLGLSYWLSMLISVLVVGTLALLMERLIFHPLRNSISINSMIAAIGMLLFLEAFAQLFWGPDFREMPTPYNEVVNVFGLTFTVQRILIVVAAIVVMILLYAFLKKTFIGRTIIALSQNREGAFLVGINANKVAMLTFFIAGALAAIAASLTSPINLVFPGMGHLVILKAFVIIIIGGMGSIPGAIVGGYILGFSESIGATYISSDYKDIIAFVLLIIILSIKPNGIFAKGEH

SEQ ID NO: 27769 - DNA, 885 bp, Corynebacterium efficiens
  CDS (1)..(885)
atggacattctactcaatcagctagtagcgggcctgtcagtggggtccgttctgctgctggtggcggttggtctttccctgaccttcggtcagatgggggtcatcaacatggcccacggcgagttcatcatggttggggcctacacggccttcgttgtgcagggggttatcaactctgcagggttctcgcttttgatcagtattccactggcatttgccatcggagggctcctcggggttctccttgaacagaccttgctacgccatctctaccaccggcctttggacacactgcttgcgacctttggcgttggtctgatcctgcagcagctggccagggatattttcggcgcaccagcagtagacgtacgtgcgcctgaatggttgcgtggtcataccgaaattctggggactctggtgccggtgtcccgactgttcattctctttctcgccttggcctcagtggccggattggcggtgtttctcaaccgttccatctggggtcggagaatcagggcagtcgtgatcaatcgcgatctcgccgagactaatggcatcaatacccgggccacggaccgtatgaccttttttatcgggtctggtctcgccggaattgcaggcgtcgccatcactctcattggagccaccgggccgaccatcggtcagaactacattgtcgacgctttccttgtcgtggccgcgggtggaatcggcaagatcaagggcgcggtgatcatggcgtttgttctgggcataatgcaagccttcattgagtactcaaccggtgcgagtattgcgaagttcattgtgctgattgcagtggtcgcctttcttcagttccgcccccaagggctgtttcaaacccgaacaaggagcctcgtatga

SEQ ID NO: 27770 - protein, 294 aa, Corynebacterium efficiens
MDILLNQLVAGLSVGSVLLLVAVGLSLTFGQMGVINMAHGEFIMVGAYTAFVVQGVINSAGFSLLISIPLAFAIGGLLGVLLEQTLLRHLYHRPLDTLLATFGVGLILQQLARDIFGAPAVDVRAPEWLRGHTEILGTLVPVSRLFILFLALASVAGLAVFLNRSIWGRRIRAVVINRDLAETNGINTRATDRMTFFIGSGLAGIAGVAITLIGATGPTIGQNYIVDAFLVVAAGGIGKIKGAVIMAFVLGIMQAFIEYSTGASIAKFIVLIAVVAFLQFRPQGLFQTRTRSLV

SEQ ID NO: 27771 - DNA, 870 bp, Brucella suis
  CDS (1)..(870)
atgagctctctcttttctgccgccgtcgccggattgtcggcaggcggtgcctacgcaatccttggcgtgtgcgccatcttcacctacaggctggtggccgtggtcaatttcaccggagccgccatcggagccatcggcacattcatcatggtggcgctgttcggggcgggcgtgccgctggtacttgccgtgcttctcggcattgcggccggcgcgcttgcgggcatcctcgtcggccttgtcatgaccacatggtttgccaatgccaacgcctcgaccaaggccgccgtcacagcagcacttctggtcggcatcattgccgtgggcctgcgccttaccggcgggcagcacccgcattatttccccgaagtcatttccggctcggccttccggctggcgggtgtggaagtgacctgggctgcggtgctgacgcttgtgctttccgtcgcctttaccattctcaccgagcaattccttgcgcgcacgcgcaccggcctgcaattgcgcgcactgtcgcaaaggcccatggcggcggaactgatcggcatttgcgtgcgtcttctggcgcttggcgtctgggccgtcaccggcgcggtcacagccttcgcgctgatggtgatcgcgccactgcgttcgccggatttcgcgtcactcagccttctcgtcgttccggcccttgctgcggcactgatcggcgccttctcaagctttcgcgcagcacttgctggcggcgtgctgatcggcattctggaaggcgccgtcagcaccatcgatatcgtcagccaatatcgcagcaccgtgcctttcttcgtcattcttgccgtccttctgtggtcgcaacggggagcccgctgggatgaagcacgctag

SEQ ID NO: 27772 - protein, 289 aa, Brucella suis
MSSLFSAAVAGLSAGGAYAILGVCAIFTYRLVAVVNFTGAAIGAIGTFIMVALFGAGVPLVLAVLLGIAAGALAGILVGLVMTTWFANANASTKAAVTAALLVGIIAVGLRLTGGQHPHYFPEVISGSAFRLAGVEVTWAAVLTLVLSVAFTILTEQFLARTRTGLQLRALSQRPMAAELIGICVRLLALGVWAVTGAVTAFALMVIAPLRSPDFASLSLLVVPALAAALIGAFSSFRAALAGGVLIGILEGAVSTIDIVSQYRSTVPFFVILAVLLWSQRGARWDEAR

SEQ ID NO: 27773 - DNA, 888 bp, Brucella suis
  CDS (1)..(888)
atggtaatgatttttggaatacctttgcaggcgcttctcaggcaattgctggtcggcctcatcaatggctccttctatgccatgctgagcctcggccttgccatcatcttcgggcttctgcgcatcatcaatttcgcccatggcgcgcaatatatgctgggtgctttcgtcggctatctcctgttgagctggctcggcatcagctactggccggcgctggtcctcgcgcccctcatcgtcgggctcggcggcgcgatcatcgagcgcgtggcgctgtcgcggctttacaatctcgatccgctctatggcctgctgttcaccttcggcctggcgctggtgatcgaaggcacgttccgctattattatggtgctgccggacagccctatgcggtgccgccgtcccttgcgggcgggcgtaatctcggcttcatgttcctgccgaactatcgcgcctgggtggtcgttgcctcgctcttcgtctgtcttggcacctggcttctgatcgaaaagaccaagcttggcgcttacttgcgggccgcaaccgaaaacccgacactggtgaaagcctttggcatcaacgtgccgctgcttttaaccttcacctatgcgctgggttcggcccttgccggtcttgcgggcatcatggccgcgccgatctatcaggtcagcccgctgatgggttccaacatcattatcgtggtctttgccgtggtggtggtcggcggcatggggtcaatcctcggcgccatcatcaccggctatgtgctgggaattgcggaagggcttaccaaggtcttctacccggaagcttccagcatcgtcgtcttcgttatcatggcaatcgtccttctggttcgacccgccggactgttcgggaaggaggcctga

SEQ ID NO: 27774 - protein, 295 aa, Brucella suis
MVMIFGIPLQALLRQLLVGLINGSFYAMLSLGLAIIFGLLRIINFAHGAQYMLGAFVGYLLLSWLGISYWPALVLAPLIVGLGGAIIERVALSRLYNLDPLYGLLFTFGLALVIEGTFRYYYGAAGQPYAVPPSLAGGRNLGFMFLPNYRAWVVVASLFVCLGTWLLIEKTKLGAYLRAATENPTLVKAFGINVPLLLTFTYALGSALAGLAGIMAAPIYQVSPLMGSNIIIVVFAVVVVGGMGSILGAIITGYVLGIAEGLTKVFYPEASSIVVFVIMAIVLLVRPAGLFGKEA

SEQ ID NO: 27775 - DNA, 870 bp, Brucella suis
  CDS (1)..(870)
atgcagactgtgctcagcattgctgtcgatgcccttgcctatggcatggtgcttttcgtcatctccatcggcctttccgtcaccatgggcctgatgcgcgtcgtcaatctggcacatggcgcctttgcgatgatcggtggctatttcgcatcctatgccgcacaacagcttggcctcaattatggctttgcgatcatcattgcggtcgtcggcacgatgattatcgccgtgccggtggaaaggctgctttaccgccgtatctatggtgcaccggaattgacacaggtattgatgaccattggcgtcacgttctgcatcatcggcatcaccaattatattttcggcccgacgctgaagaccattcccctgccggaaatgctgcgcggctcggtcgatctcggctttcacgctattgcaaagcaccgcattttcgctatcggctgcggcctcgcggtggcagtcggcctatggtacgccgtcgagcgcaccgctttcggcgtgaaactgcgcgctgccgtcgataatgccaatatggcggcagccctcggcgtgcgtaccgagatcgtctatgcggtgagctttgcgctcgccatcgggcttgcggccttcggcggcgtggtcggcgcggagcttttgcccgtcgaaccctattatgcgctgcgctacatggtgactttccttgtcgtggtttcggtcggcggggccggttctatccccggcgcactcgtcgcctgcctgttgctcggcgcaatcgacacgaccgggcgttacctcgcacccgaatatggcgaattcttcttttatctggcggtgatcgtgatcgttaccctgttcccgcgcggccttgcaggaaggctggcccgcaaatga

SEQ ID NO: 27776 - protein, 289 aa, Brucella suis
MQTVLSIAVDALAYGMVLFVISIGLSVTMGLMRVVNLAHGAFAMIGGYFASYAAQQLGLNYGFAIIIAVVGTMIIAVPVERLLYRRIYGAPELTQVLMTIGVTFCIIGITNYIFGPTLKTIPLPEMLRGSVDLGFHAIAKHRIFAIGCGLAVAVGLWYAVERTAFGVKLRAAVDNANMAAALGVRTEIVYAVSFALAIGLAAFGGVVGAELLPVEPYYALRYMVTFLVVVSVGGAGSIPGALVACLLLGAIDTTGRYLAPEYGEFFFYLAVIVIVTLFPRGLAGRLARK

SEQ ID NO: 27777 - DNA, 885 bp, Brucella suis
  CDS (1)..(885)
atgactacctttctgcaaattcttctgaacggcctgatgcttggcgggctattcgcgattgtcgccgtcggcctgacgctcatcttcggcatcgtcaaggtcgtgaatttcgctcatggcgaattcctgatggcgggcatgttcgtgacgtggctgataaccacaaagctggggcttcatccttatgcggcggttatcattgttctgcctgcgatgttcattctgggtgcgctgacccagcgccttctcattcagccgctaatggcttctgatgacggtcatgcacagattttcgcaaccgttggcctgtccacggcgatgattaatctggccctgctgatcttcggtgcggatatagccaatacaccgaatttcggactgcggaccccaatcgaaatcgggccgcttcgcgtacttaccgggcaggtctttatttttctgggcgccattgtgcttgtcgttgcgcttcaactgttcctgaagaacagccagactggccgcgcaatccgcgccgttgctcagcatcgcagtgcggcggaattgatgggggtcaatgtttcgcgcatctacattctctgttttggcctgggagccgcctgtgtcggactggctgcggttctgattgcaccgctctatccgacttcttcaaatatcggcacctatttcgtgctgacggccttcgtggttgtggtgctcggtggccttggctcgatccctggagccttcgttggtgcgctgatcatcggcgtgatcgacaccatgtcgggctactacatcggatcagacctgcgggaagccgtcgtattcggcattttcctcctgatcctcatcctcaagccttctggcctctttggcaagcagcttaatctttcgcatttgtcctga

SEQ ID NO: 27778 - protein, 294 aa, Brucella suis
MTTFLQILLNGLMLGGLFAIVAVGLTLIFGIVKVVNFAHGEFLMAGMFVTWLITTKLGLHPYAAVIIVLPAMFILGALTQRLLIQPLMASDDGHAQIFATVGLSTAMINLALLIFGADIANTPNFGLRTPIEIGPLRVLTGQVFIFLGAIVLVVALQLFLKNSQTGRAIRAVAQHRSAAELMGVNVSRIYILCFGLGAACVGLAAVLIAPLYPTSSNIGTYFVLTAFVVVVLGGLGSIPGAFVGALIIGVIDTMSGYYIGSDLREAVVFGIFLLILILKPSGLFGKQLNLSHLS

SEQ ID NO: 27779 - DNA, 909 bp, Brucella suis
  CDS (1)..(909)
atggaatatttcttccagcaggtgatcaacgggcttgcgctcggttcgatctatggcctgatcgccatcggttatacgatggtctatggcattatcggcatgatcaactttgctcatggcgatatcttcatgctcggcgcgttcatggcgctgattgttttcctcattatcacgaccttcaccggaatgctgccggttgcactgatgctgcttttgatgatgatcgtcgccatgcttctgacgggtctgtggagctgggcgatcgagcgcgtggcctatcgaccgctgcgtggttcgttccgccttgcgccgctgatcacggctatcggcatgtcgattgccttgtcgaacttcgttcaggtcacgcagggtccgcgcaacaagccggttccccagcttctgaatggttcctacgagctgttcggcagcggcgtcacgatctcgctcaagcagatcgtggtgatcgtggttacggcaatattgctcacgatcttctggtatgtcgtcaaccgcacctcgctggggcgcgcgcaaagggcttgcgagcaggatcgcaagatggcggcccttcttggcatcaatgtcgaccgtgtcatctcgctcaccttcgtgatgggcgccatgctggcggccgtagccgggacgctttacctctccttctatggcgtgatttcgttcgctgacgggttcatccccggtgtgaaggcgttcacggcggcggttctgggcggcatcggctcgcttccgggggctgttgtcggcgggttgcttatcggtctcatcgaagcgttgtggtcggcctatttctcgatcgactacaaggacgtcgccgcgttctcgatcctggctatcgtgctgatcttcatgccgtccggcattcttggccgacctgaagtcgaaaaggtgtaa

SEQ ID NO: 27780 - protein, 302 aa, Brucella suis
MEYFFQQVINGLALGSIYGLIAIGYTMVYGIIGMINFAHGDIFMLGAFMALIVFLIITTFTGMLPVALMLLLMMIVAMLLTGLWSWAIERVAYRPLRGSFRLAPLITAIGMSIALSNFVQVTQGPRNKPVPQLLNGSYELFGSGVTISLKQIVVIVVTAILLTIFWYVVNRTSLGRAQRACEQDRKMAALLGINVDRVISLTFVMGAMLAAVAGTLYLSFYGVISFADGFIPGVKAFTAAVLGGIGSLPGAVVGGLLIGLIEALWSAYFSIDYKDVAAFSILAIVLIFMPSGILGRPEVEKV

SEQ ID NO: 27781 - DNA, 1077 bp, Bifidobacterium longum
  CDS (1)..(1077)
atgctttccaccaaacagtcctatctggtgtgcttcatcggcatcctcgccgcgttcggcatcgtgatggcgctgtgcgaatccggcttggccgactcctacatcaagggcatcatgatgaccgcgtgcatcgccatcatcatgaccacctccctgaacctcaccatcggcgtgctcggccagctgacgctgggctgctgcggtttcgaggccatcggcgcctacgtggccgcactgacctccaaatacatggtcgccgccggcattgccatcgaccccaccgcccgcttcctgctcaccacgctgatcggcggcgtggtggcctgcgtgttcggcatcctgatcggcattcctgccctgcgactgcacggcgactacctggccatcatcacgctgggcttcggtgagatcatccgcgtgatcatccagaacctcaaggtagccggcggcatgggcctcgacaagggcgccgccggacaggcgctgatcggcatcgaacgcaccgccaacctgtacgtcgtgttctggatcatggtggtcaccgtggtcgtgctcttcatgttcggccgctcccgttacggccgtgcggtcaaggccatccgcgacgacgagatcgccgccggcgcctccggactcaacaccacgtacctcaaggtgctcgtcttcgcgatctccgcgttcttcgcgggcatcgccggcggtatcttcgcccagtacatcggctcgctcaaccccaccatggccggttggctcaactccatcaactacgtgatcatggtggtgttcggcggcatgggttcgctcaccggctcgatcgtctccgccatcggcctgaccatcctgcccgagctgctgcgcgccttcgccgactaccgtatgctcgcctactcggtggtgctggtgctcgtcatgatcttccgcccgcagggcatcttcggatcctgggagttctcactgccgcgtctggtcaaccgcatgctgttccgcggcgccgccggcaagggcgcgaaacccgcggccagcgccaagcagcatgaccagtccgacgacaagaccgtgaaggaggcctcacgatga

SEQ ID NO: 27782 - protein, 358 aa, Bifidobacterium longum
MLSTKQSYLVCFIGILAAFGIVMALCESGLADSYIKGIMMTACIAIIMTTSLNLTIGVLGQLTLGCCGFEAIGAYVAALTSKYMVAAGIAIDPTARFLLTTLIGGVVACVFGILIGIPALRLHGDYLAIITLGFGEIIRVIIQNLKVAGGMGLDKGAAGQALIGIERTANLYVVFWIMVVTVVVLFMFGRSRYGRAVKAIRDDEIAAGASGLNTTYLKVLVFAISAFFAGIAGGIFAQYIGSLNPTMAGWLNSINYVIMVVFGGMGSLTGSIVSAIGLTILPELLRAFADYRMLAYSVVLVLVMIFRPQGIFGSWEFSLPRLVNRMLFRGAAGKGAKPAASAKQHDQSDDKTVKEASR

SEQ ID NO: 27783 - DNA, 927 bp, Bifidobacterium longum
  CDS (1)..(927)
atgaccgatcagatcatcatgttcatcagccagctgttcaacggtctgaaaatcggcagcgtgtacgcgctggtggcattgggctacaccatggtctacggcatcatccgactgatcaactttgcccacggcgatttcatcatggtcggagcctacgtgctcatgctcaccattccggccatcgtggccatgggactgcccgcctgggtggcggtcattcccgccatcctggtatgcgtggccgtcggcgtgatcgtcgaaaaggccgcctataagccggtgcgtgaaaagggcaactccatgaccgccctgatcaccgccatcgccatgtcgttgctgctggagaacggctcacaggccatcttcggcgccgacttccagaccgtcccgaccatcttccacctgccgtccatcgcgttcggcaagctcaagctgccgggagacaccctgctgaccatcgtcatcggcctggtcatcatggtgggcctgcagctgttcgtcaaattcaccaggcagggcaaggccatgcgcgccgtctccgaagacaaggaggccgccgtgctcatgggtatcaacgtgaactccaccatcgccctgacattcgccatcggctccggtctggccgcggtcgcctcgctgatgtactgcgccgcctacccgcaggtctcgcctatgatgggcgccatgctgggcctgaaggcgttcgtcgccgccgtgctcggcggcattggttccatcccgggcgccatgatcggtggtctggccatcggtctgatcgaaagcctgaccaaggcgtatatcggcaccatcacggcgggcatcatcacctcggcgttctccgacgccatcgtgttcgccatcctgatcatcgtgctgctcgtcaaaccgtccggcattatgggcaagaacgaaggggagaaggtctga

SEQ ID NO: 27784 - protein, 308 aa, Bifidobacterium longum
MTDQIIMFISQLFNGLKIGSVYALVALGYTMVYGIIRLINFAHGDFIMVGAYVLMLTIPAIVAMGLPAWVAVIPAILVCVAVGVIVEKAAYKPVREKGNSMTALITAIAMSLLLENGSQAIFGADFQTVPTIFHLPSIAFGKLKLPGDTLLTIVIGLVIMVGLQLFVKFTRQGKAMRAVSEDKEAAVLMGINVNSTIALTFAIGSGLAAVASLMYCAAYPQVSPMMGAMLGLKAFVAAVLGGIGSIPGAMIGGLAIGLIESLTKAYIGTITAGIITSAFSDAIVFAILIIVLLVKPSGIMGKNEGEKV

SEQ ID NO: 27785 - DNA, 822 bp, Pseudomonas resinovorans
  CDS (1)..(822)
atgggcgtcatcaacctggcccacggcgccttctacatggtcggcgcgttctgcgcggcctacaccgcgtcgctgagcggctcgttctggctcgccgggttggcggcggtgatcggctcggccctgtacgggctgctgatcgaaaccagcatcatgcgccgcctctacaaccgcgatcacctcgaccaggtactggccaccctggcggtggtgttcttcaccaacgagttaatcaccgtgctgttcggccgcagcccaccggccatgcccacgcccgagtggtattcgagcttcgtcgaagtgctgccggggttgatgtacccggtcagccgcttgctgttcatcgccgccggggccgtggtggcgatcgccatgtggctgctgataaaccacacgcgcctgggcatgctgatccgcgccggggccgacgaccacgaaatggtcggcgccctgggggtgaacatcgcacgcctgtacaccctggtgttcgtgttcggctgcgtgctttgcggcctcgccgggttcatggccgcacccttgctgtcggtggaaatcggcatgggtgaaaaggtcttgattaccaccttcgtggtcatcgtggtcggcggtgtcggctcggtgcgcggcgccctggccggggccttgctgatcggcatggtcgatggcctggggcgtgcctacatcccgcaattgctggaccaactgttgcccgccgaagtcagcggcaccctgagcggcgggctgatttccgccagcgcctacatcgtcatggccgtggtgttgctggtccgcccccgcggcctgctgcccgcccgtgcctga

SEQ ID NO: 27786 - protein, 273 aa, Pseudomonas resinovorans
MGVINLAHGAFYMVGAFCAAYTASLSGSFWLAGLAAVIGSALYGLLIETSIMRRLYNRDHLDQVLATLAVVFFTNELITVLFGRSPPAMPTPEWYSSFVEVLPGLMYPVSRLLFIAAGAVVAIAMWLLINHTRLGMLIRAGADDHEMVGALGVNIARLYTLVFVFGCVLCGLAGFMAAPLLSVEIGMGEKVLITTFVVIVVGGVGSVRGALAGALLIGMVDGLGRAYIPQLLDQLLPAEVSGTLSGGLISASAYIVMAVVLLVRPRGLLPARA

SEQ ID NO: 27787 - DNA, 1080 bp, Corynebacterium glutamicum
  CDS (1)..(1080)
atgagcactcaactcaagctgaagaagcccgcaaagaagaaaactacgccgaaacttagcgtcgtaaatgctcccacgctgcgcactgcggcgttgggcctggccgcgctcgctgcggtattgctgtgcgccccgctctttttatccacattccagctgacgttgatgtcgcgcttggtgtgttatgcgatcgtcgcagtcggcatcgggctggcgtggggcagaggcggcatgctcacgctggggcaaggcgtgttctttggaatcggcgcgtacatcatggccatgcacatgctgtacagcgattcgcagatttttgggaccacagttccgcaatggtggtccatttttgccaacccggcagtcgcactcatcgcagttgtggcgcttcccggcatcgtggcttttgtgctcggcttctccattttcaaacgacgcatcaaaggcgcctactttgccatcgtgaaccaagcgctcgccgcagctgttgtggtgttgctggtcggacaacaagattcccttggaggttccaatggtctttccggatttcgatcgttcatgggttttgccgtctacgaccccatcaaccgcatcatgttttacttcaccgcagtgggagttctcttggctttggtggctatctcatattggctcatgcgcagccgctatggagaactgctcgtggccaccagagatgcagaagaacgcgtccgattcctcggatatgatcccgcattgatcaaaaccgccgcatatgtcattgctgcgatgattgccggaatcgccggagcgctgttcgtgccgatcgtgggcatcatttcacccgcagaaatcggcgtggtgccatcaatcgtgttcgtgatcgccgtcgccgctggtggcagggcatccctattcggtcccgtagttggcgcgctggtgctgggctgggtggaatccacacttgctcaaactttccccagcatgtggtcctatttccagggtgcgatcctggttctcgtgatcgtgttgctgccgggcggaattgcttcaattaaactttccgcgctcaaaaataaggccaggaaggccacctcatag

SEQ ID NO: 27788 - protein, 359 aa, Corynebacterium glutamicum
MSTQLKLKKPAKKKTTPKLSVVNAPTLRTAALGLAALAAVLLCAPLFLSTFQLTLMSRLVCYAIVAVGIGLAWGRGGMLTLGQGVFFGIGAYIMAMHMLYSDSQIFGTTVPQWWSIFANPAVALIAVVALPGIVAFVLGFSIFKRRIKGAYFAIVNQALAAAVVVLLVGQQDSLGGSNGLSGFRSFMGFAVYDPINRIMFYFTAVGVLLALVAISYWLMRSRYGELLVATRDAEERVRFLGYDPALIKTAAYVIAAMIAGIAGALFVPIVGIISPAEIGVVPSIVFVIAVAAGGRASLFGPVVGALVLGWVESTLAQTFPSMWSYFQGAILVLVIVLLPGGIASIKLSALKNKARKATS

SEQ ID NO: 27789 - DNA, 885 bp, Corynebacterium glutamicum
  CDS (1)..(885)
atggacattttactcaatcagctcgtagccgggctttcagttggatcggtccttctattggtcgcagtgggattgtcactgacctttggacagatgggcgttattaatatggcgcacggagagttcatcatggtcggcgcatacaccgcatatgtggtgcagctggtcgtcggttctgccggtttatccctactgatcagcattccgctggcctttattatcggtgggcttttcggagttctcctcgaacaattcctgctgaagtatctttatcacaggccactagacacgctgctggccacattcggtgtcggtttgatccttcagcagctggcccgaaacattttcggagctcccgcagtggatgtcagggcaccggaatttctccgcggaaacgtcgaagttctaggcgtcttggtgccgaccgcgcgactattcatcctggcgctggccatcgcatcagtgactgcactagctgtgttcctaaatcgcactgcctggggccgacgcatccgcgccgtggttctgaaccgcgacctcgcggaaaccgcaggtattgatacccgagctactgaccgaatgacgttctttgtgggctccggtcttgccggaatcgccggggtagctatcacattgattggcgcgaccggccccaccatcggtcagaactacatcgtggatgccttccttgttgttgccgccggtggcatcggccgggtgaagggcgctgtgatcatggctttcgtgctgggaattactcaagcattcgtggaatatacgacaggtgcgagcatcgcgaagttcatcgtactcatcgctgttgttgccttcctgcagtttaggcctcaaggactcttccaaacccaaactaggagcctcgtatag

SEQ ID NO: 27790 - protein, 294 aa, Corynebacterium glutamicum
MDILLNQLVAGLSVGSVLLLVAVGLSLTFGQMGVINMAHGEFIMVGAYTAYVVQLVVGSAGLSLLISIPLAFIIGGLFGVLLEQFLLKYLYHRPLDTLLATFGVGLILQQLARNIFGAPAVDVRAPEFLRGNVEVLGVLVPTARLFILALAIASVTALAVFLNRTAWGRRIRAVVLNRDLAETAGIDTRATDRMTFFVGSGLAGIAGVAITLIGATGPTIGQNYIVDAFLVVAAGGIGRVKGAVIMAFVLGITQAFVEYTTGASIAKFIVLIAVVAFLQFRPQGLFQTQTRSLV

SEQ ID NO: 27791 - DNA, 927 bp, Fusobacterium nucleatum
  CDS (1)..(927)
atgttttatctttttagatatagaaaatgggagggtaaaatggagtttttacttcaaataattaatggtttacaaataggaagtatctatgctctagtgtctttaggatatacaatggtatatggtatagcacaacttattaactttgcacatggtgatattataatgataggggcatatacttcacttttttcaattccattattcacatcaatgggtttaccaatctggacaacagttattccagcaataattatttgtgcagttataggttgcttagctgaaagaatagcatatagaccacttagaaattcaccaaggatatcaaatttaataactgctattggagttagtttatttatagaaaatgtctttatgaaggtatttacaccaaatacaagatcatttcctaaaatttttaatcaagcaccaataacttttggaaatggaataaatattagtttcggagctgctataactatacttacaacagttattttatctgtgggattacaattatttatgaaaaaaactaaatatggaaaagctatgatagcaacaagtcaagattatgcagcttctgaattagttggaataaatgtagatagaacagtacaattaacatttgcaataggtagtggacttgcagcagtaggttctgtattatatgtttcagcttatccacaaatacaacctttaatgggttcaatgcttggaataaaggcctttattgcagcagttttaggtgggattggaatactgccaggtgctgttttaggtggatttatattaggaattgttgaaagtttaacaagagcatatttatcttcacaacttgcagatgcttttgtattttcaatattaattatagttttattatttaaacctactggaatacttggaaagaatgtaaaggagaaagtataa

SEQ ID NO: 27792 - protein, 308 aa, Fusobacterium nucleatum
MFYLFRYRKWEGKMEFLLQIINGLQIGSIYALVSLGYTMVYGIAQLINFAHGDIIMIGAYTSLFSIPLFTSMGLPIWTTVIPAIIICAVIGCLAERIAYRPLRNSPRISNLITAIGVSLFIENVFMKVFTPNTRSFPKIFNQAPITFGNGINISFGAAITILTTVILSVGLQLFMKKTKYGKAMIATSQDYAASELVGINVDRTVQLTFAIGSGLAAVGSVLYVSAYPQIQPLMGSMLGIKAFIAAVLGGIGILPGAVLGGFILGIVESLTRAYLSSQLADAFVFSILIIVLLFKPTGILGKNVKEKV

SEQ ID NO: 27793 - DNA, 858 bp, Fusobacterium nucleatum
  CDS (1)..(858)
atgattttaataaatgtaattttagcagcaagtctaaatgtaacagttggttgtttaggacaaattaccttaggacatgcaggttttatgtcaataggagcatatacagcagcacttttaactaagtctggtcttctatcaggttatccaggctatgttgtagctttgataattggaggacttgtagcaggaataattggttttataataggaatacctgctttaagacttacaggagattatcttgctattataactctggcttttggagaaattataagagtattgattgaatattttaaatttacaggtggagcacaaggattaacaggtataccaagagtaaataattttactttgatatattttataacaatattttcagttatatttatgtattcagttatgacaagtagacatggtagggcagtcttagctattcgtgaagatgaaatagcaagtggagcttctggaataaatacaacatattataaaacttttgcctttgtactatcagcaatatttgctggtatagcaggtggaatttatgcacataatttaggaattttaggtgcaaaacaattcgactataattattcaataaatatacttgttatggttgtacttggtggaatgggaagtttcacaggttcaatattatcagcaatagttcttactattttaccagaagttttaagaagttttgcagaatatagaatgatagtttacccattaattttaattataatgatgttatttagaccaaaaggattacttggtagagaagaatttcaaataagtaaaataatttcatattttactaaaaaattgaaaagaggtgaagtaaatggaaaataa

SEQ ID NO: 27794 - protein, 285 aa, Fusobacterium nucleatum
MILINVILAASLNVTVGCLGQITLGHAGFMSIGAYTAALLTKSGLLSGYPGYVVALIIGGLVAGIIGFIIGIPALRLTGDYLAIITLAFGEIIRVLIEYFKFTGGAQGLTGIPRVNNFTLIYFITIFSVIFMYSVMTSRHGRAVLAIREDEIASGASGINTTYYKTFAFVLSAIFAGIAGGIYAHNLGILGAKQFDYNYSINILVMVVLGGMGSFTGSILSAIVLTILPEVLRSFAEYRMIVYPLILIIMMLFRPKGLLGREEFQISKIISYFTKKLKRGEVNGK

SEQ ID NO: 27795 - DNA, 873 bp, Rhizobium leguminosarum
  CDS (1)..(873)
atgctctcgaccatactcgagcaatctgtgaatggaatcgtcacgggttccgtttacgccatcgtcgccgtcggcatgaccatgattttcggcgtgctgagagccatcaattttgctcacggcgaatactacatgctcggcacgttcggggcctggtttgcgatcgattatctcggcctgtcctacgaagtgtcgattgtcgtgggcgttcttgcgacaatcgccgttgcctatgtggtcgggcaactcgtcatgcgccggatggtcggcgcgcccgcggagtcgggcgtgctcgccacccttggcatcgcgctgatcctgcagaacaccatcattctcgtcttcggcggaggctacaagttcttcgccggaggctatatcgaaccggtttccatcctgggcttcagtctggccgagcagcgcattctcattctcgtcgtctgcctgttggtattcatcggcctcgaactgatggtcagctacacccgcctcggaatggcgatgcgcgccgtttcccagaacgtcgagtgctgcagcgtcgtcggcatcgatgtgccacaggtggtgcttcgaaccttcatgctgggggcggccctcgccgcactttcgggtgttctgacggcgccggtcaatgtcagtgtttatggcggcatgggcgagttgatcaccttcaagacgctgccgatcattatcatgggcggtttggggaatgtgcgtggaactttcgtcgcggcgatgatccttggcgttgccgagagcctggtcgccacctatgtcggcttgcaattccgcgacacggggtcgttcgccacgctgatcctgatgctgatgtggcgaccgcatggcctcttttcgacgcaggcgcgcttctag

SEQ ID NO: 27796 - protein, 290 aa, Rhizobium leguminosarum
MLSTILEQSVNGIVTGSVYAIVAVGMTMIFGVLRAINFAHGEYYMLGTFGAWFAIDYLGLSYEVSIVVGVLATIAVAYVVGQLVMRRMVGAPAESGVLATLGIALILQNTIILVFGGGYKFFAGGYIEPVSILGFSLAEQRILILVVCLLVFIGLELMVSYTRLGMAMRAVSQNVECCSVVGIDVPQVVLRTFMLGAALAALSGVLTAPVNVSVYGGMGELITFKTLPIIIMGGLGNVRGTFVAAMILGVAESLVATYVGLQFRDTGSFATLILMLMWRPHGLFSTQARF

SEQ ID NO: 27797 - DNA, 885 bp, Burkholderia cepacia
  CDS (1)..(885)
atgacgggatctctgtttctgcaggccattctggctggcatcacgagcggctttgtctatgccttgatcgccgtgggcattgccgtgattttcaggggcagccacatcatcaacgccatgcagggtgagtttgcggtcgttggagctttggttgctgtgttcgcgctgacgaagagcggcttgccctattggctggcagcactgctgggcgtggctgccggcgcggccatcggcgcggcgattgacgtcctcttcgtgcgtcccatgaagcggcgcaacgccagtgaggaaagcttcctgctcctgaccatcggcctcgcgtttacgttgtcagccgctgccctctacttcaccggtcgcgattcgcacctgttgccttcctatgccgagggcgtggtggaaatcgccggcgcaacgattcccaagcatgcgctttggctgatcctgatctcgttgctggtggtgggtgggttgaggcttttctatcgcaagacgcttttgggtctgtccatggcggccgcttctgccgatccggacggcgccaccacgaccggcatcgatgtgaaccgggctcggctctatacgtttctcctgggtggtgcggtcggtgccttggcgggcatcctggtcactcccttgatcgccatgaactaccacatcggcattgtctacaccctcaagggcttcgcggctgccattctgggagggatagccaacccgatcggtgccgtgctgggggggctgatgattggtctgattgagtcgctggccgcagttgtattcccatccggctaccgggatgccgttgcgatggcgttcctgatcctcatcatgatcgtcatgccgaatgggttgatcggccgagccggacgggcgggagggtaa

SEQ ID NO: 27798 - protein, 294 aa, Burkholderia cepacia
MTGSLFLQAILAGITSGFVYALIAVGIAVIFRGSHIINAMQGEFAVVGALVAVFALTKSGLPYWLAALLGVAAGAAIGAAIDVLFVRPMKRRNASEESFLLLTIGLAFTLSAAALYFTGRDSHLLPSYAEGVVEIAGATIPKHALWLILISLLVVGGLRLFYRKTLLGLSMAAASADPDGATTTGIDVNRARLYTFLLGGAVGALAGILVTPLIAMNYHIGIVYTLKGFAAAILGGIANPIGAVLGGLMIGLIESLAAVVFPSGYRDAVAMAFLILIMIVMPNGLIGRAGRAGG

SEQ ID NO: 27799 - DNA, 1827 bp, Ralstonia solanacearum
  CDS (1)..(1827)
atgaccacgctgaccaacgcctccgggaacgccgcaccgcgcggctggctgtcgcgcaaccgcctgctgacggcggctttcgtgatcgggctggcgctgctgccggtgctgcccacgcccgagttctggatcacgctgctcaactacatcgggctgtatagcctggtggcgctcggcctggtgctgctgaccggcgtgggcgggctcacatcgttcgggcaggcggcgttcgtcgggctgggcgcctacagcacggcgtacctgagcacgcaatacggcctgtccccgtggatcggcctgctggcggggctggcgatcacggtggcgtccgcctacgtgatcggcctgatcacgatgcgcatgtcgggccactacctgccgctggcgacgatcgcctgggggctgtcgctgttcttcctgttcggcaacctggcgttcctgggcaagtacgacgggctgaacggcatcccggtgctgaacctgctgggcaagccgctgcagaccgggcgcgagatgttctacctgatctgggccgtggtggtggtggccgtgctggcggtgcagaacctgctgaattcgcgtccgggccgcgccatccgcgcgctcaagggcggcggcaccatggccgaggcgatgggcgtgaacacggcgtggatgaaggtggtgatcttcgtggcggccgccatcctggcgtgcatttcgggcttcctgtatgcgcacctgcagcgcgcggtgaacccgacgccgttcggcctgaactacggcatcgaatacctgttcatggccgtggtgggcggggtggggcacgtgtggggcgcggtgctcggcgccggcctgctgaccatcctgaaggacagcctgcagaacctgctgcccaagctgctcggctccaccggcaacttcgagatcatcgtgttcggcgtgctgctggtgctgctgctgcagtacgcgcgcgacggcgtgtggccgtttctccgccggctgtttccgtccgcgccggccgcccgcgcgccggccgacgcacccgcgctcaggcagcgcgagaagccgcgggccggcgaactcgtcctcgacgtgcgcgccgtgcgcaaggaattcggcgggctggtggccgtcaacgacgtcagcttccaggtcagggccggcgagatcatcggcctgatcggccccaacggcgcgggcaagtcgaccacgttcaacctggtcaccggcgtgctgccggtcacgcgcggcgaggtgctgtaccgcggcgagcgcatcagcggcaagccttcgcgcgagatcgtccggcgcggcatcggccggaccttccagcacgtgcagctgctgccgggcatgaccgtgctggagaacgtcgcgctgggcgcgcacctgcgcggcgatttcgcggcgcagggcggcgtgctggccagcgtggcgcgcatgaaccggcacgaagagcagaagctgctgttcgaggcgcgctgccagctcgagcgcgtgggcctggccgattgcatgtaccaggaggcgggcagcctggcgctgggccagcagcgcatcctggagatcgcgcgcgcgctgtgctgcgatcctgcgctgctgctgctcgacgaacccgccgccggcctgcgctataaggagaagcaggcgctggccgcgctgctggccaggctcagggccgagggcatgagcgtgctgctggtcgagcacgacatggatttcgtcatgaacctcaccgaccggctggtggtgatggagttcggcaccaggatcgccgagggcgtgccgcaggacgtgcagcgggatccggcggtgctggaagcgtacctgggcggcgtggaataa

SEQ ID NO: 27800 - protein, 608 aa, Ralstonia solanacearum
MTTLTNASGNAAPRGWLSRNRLLTAAFVIGLALLPVLPTPEFWITLLNYIGLYSLVALGLVLLTGVGGLTSFGQAAFVGLGAYSTAYLSTQYGLSPWIGLLAGLAITVASAYVIGLITMRMSGHYLPLATIAWGLSLFFLFGNLAFLGKYDGLNGIPVLNLLGKPLQTGREMFYLIWAVVVVAVLAVQNLLNSRPGRAIRALKGGGTMAEAMGVNTAWMKVVIFVAAAILACISGFLYAHLQRAVNPTPFGLNYGIEYLFMAVVGGVGHVWGAVLGAGLLTILKDSLQNLLPKLLGSTGNFEIIVFGVLLVLLLQYARDGVWPFLRRLFPSAPAARAPADAPALRQREKPRAGELVLDVRAVRKEFGGLVAVNDVSFQVRAGEIIGLIGPNGAGKSTTFNLVTGVLPVTRGEVLYRGERISGKPSREIVRRGIGRTFQHVQLLPGMTVLENVALGAHLRGDFAAQGGVLASVARMNRHEEQKLLFEARCQLERVGLADCMYQEAGSLALGQQRILEIARALCCDPALLLLDEPAAGLRYKEKQALAALLARLRAEGMSVLLVEHDMDFVMNLTDRLVVMEFGTRIAEGVPQDVQRDPAVLEAYLGGVE

SEQ ID NO: 27801 - DNA, 900 bp, Ralstonia solanacearum
  CDS (1)..(900)
atggaatggttcgataatttctggtcggtctacagcaacctggtgctcacgctgggcatcaatgcgctgctggcgctgtccatctacctgacgctgtcgtgcggcctgctggcgatggccaatgcggccttcatgggcatcggggcctacacctccgcactgctgacgatgaatgccgagatgccgttcccggtggcgctgctgggcggcatgctggcaccggccgtggtggccgtcatcatcggccggccgacgctgcggttgtcgggcgtgtacctcgccatggcgacgctgggcttcggtgaagtggtgcgcgtgctgatccttaacaccgaatcgtggacgggcggcgcgctcggcctgaacggcatcccgcaactgaccgagtggtggcacgtggcgctggccgtggcgctgacgctgttcgtgctggcgcgcctgcgccgctccaaggtcggccgcgcgttcgaggccatcaaggaggacgagaccgccgccggcctgatgggcatcaacgtggccggcaccaagctgctggcctttgtgctgggggcgatgatcgccggcctggcaggcgcactcaacgcgcatctcacgttcttcatcggcccggcggagttcggcttcgaccgcggcgtggagatcctgaccatggcgatcctgggcggcaccaacggcctcaccgggccggtgctgggcagcgtgatcctgtcgctgctgccggaactgctgcgcgcgttcaaggatttccgcctggtggtcaacggcctgatcctgatgctgatcgtgctgttcctgcccaagggcatctgggacccggcgcgtttcgcgcgctggttcggcatgaagcgcggcggcaccatgccgggcgcgtccgccgcctctaatgaatcgcactga

SEQ ID NO: 27802 - protein, 299 aa, Ralstonia solanacearum
MEWFDNFWSVYSNLVLTLGINALLALSIYLTLSCGLLAMANAAFMGIGAYTSALLTMNAEMPFPVALLGGMLAPAVVAVIIGRPTLRLSGVYLAMATLGFGEVVRVLILNTESWTGGALGLNGIPQLTEWWHVALAVALTLFVLARLRRSKVGRAFEAIKEDETAAGLMGINVAGTKLLAFVLGAMIAGLAGALNAHLTFFIGPAEFGFDRGVEILTMAILGGTNGLTGPVLGSVILSLLPELLRAFKDFRLVVNGLILMLIVLFLPKGIWDPARFARWFGMKRGGTMPGASAASNESH

SEQ ID NO: 27803 - DNA, 882 bp, Ralstonia solanacearum
  CDS (1)..(882)
atgctggaacagcaactcgtcaacgcgctgtcgctcggttgcgtgtatgcgttgttcgcgctgggattcacgctggttttcggcatcctgggcgtgatcaacctgtcgcacggcgcagtgttcatgctgggcgcctacgcggcgctgcagttcgtggcgcatttcgaactgccgctgtgggcggcgctgctggtcggctttgccgcaagcggcgtggcgggcctcatcatcgatgtgctgctgctgcgcccgctgcgccgccgcaacgctccccacctgatcccgatgatcgccaccatcggcgcgggcatcgccatcaacaacgccatgcagggcgtgttcggcgcggagaacctgcgctttccggccgggctcgtctccgatgcgtcgctcgacctgggcggtgttcacctgacgccgctggagctgggcatcatcgtgctgtcgttcgcgctgatggcggcgctgatgctgctgctcaagcgcacgcagctgggccgcgcgctgcgcgccatcgcggagtcgcccaaggcggcggcgctgctgggcatcaatgtcgagggcctgttcctgctgacgtcgttcgcggcggcggcgctgggcgggctggccggcgtgctgattggcctgtattcgaacgcggtgtttccgctgatgggccagccgatgctgcacaagggcatcgcggtcatcatcctgggcggcctgggcgacattcgcggcgcgatgctgggcgggctgttcctcgggttcgccgaggtgctgtcggtggcctacatcggctcgaccatgcgcgacgcggtggcgttcggcctgctgttcctgatcctgctggtgcgcccgcaagggctgttcggcaaggtgctcgaacgcaaggcctga

SEQ ID NO: 27804 - protein, 293 aa, Ralstonia solanacearum
MLEQQLVNALSLGCVYALFALGFTLVFGILGVINLSHGAVFMLGAYAALQFVAHFELPLWAALLVGFAASGVAGLIIDVLLLRPLRRRNAPHLIPMIATIGAGIAINNAMQGVFGAENLRFPAGLVSDASLDLGGVHLTPLELGIIVLSFALMAALMLLLKRTQLGRALRAIAESPKAAALLGINVEGLFLLTSFAAAALGGLAGVLIGLYSNAVFPLMGQPMLHKGIAVIILGGLGDIRGAMLGGLFLGFAEVLSVAYIGSTMRDAVAFGLLFLILLVRPQGLFGKVLERKA

SEQ ID NO: 27805 - DNA, 942 bp, Ralstonia solanacearum
  CDS (1)..(942)
atgtcgtccggcgcgtgccgggcggcgccggcaacggtctctttttcccgatacgtgatggaaatcttcggcgttccgctaccggccatgctcagccagctgttgctgggcctggtcaacggttccttctacgcgatgctgagcctgggccttgcggtcatcttcgggctgctcaacgtcatcaatttcgcgcacggcgcgctgttcatgctgggcgccgtgctcacctggatgggcctgtcgtatctcgacctgccgtactgggtgatgctggtggccgcgccgctcgcggtcggcgtggtgggcgtggtgatcgaacgcaccatgctgcgcttcatctacaagctcgaccacctctacggcctgctgctgacgctgggcgtgacgctagtcatcgaaggcgtgttccgtgccgtctacggtgtgtcgggcctgccgtattcgacgcccgagctgctgtccggcgccaccgatctcggcttcatggtgctgcccaactatcgggcctgggtggtggtggcgtcgctgacggtgtgcttcgccacctggttcatgatcgagaagaccaagctgggtgcctacctgcgcgctggcaccgagaaccccaagctggtcgaggccttcggcgtcaatgtgccgctgatggtcacgctcacctatggcttcggcgtggcgctggcggcgttcgccggcgtgctggccgcgcccgtgatccagatctcgccgctgatggggcagaacatgatcatcaccgtgttcgcggtggtggtgatcggcggcatggggtcgatcctcggctcgatcgtcaccggcctggggctgggcgtgatcgaggggctgaccaaggtggtctatccgcaggcctcgtccaccgtggtgttcgtgatcatggcgctggtgttgctggtgcgcccggcgggcctgttcggcagagagaaataa

SEQ ID NO: 27806 - protein, 313 aa, Ralstonia solanacearum
MSSGACRAAPATVSFSRYVMEIFGVPLPAMLSQLLLGLVNGSFYAMLSLGLAVIFGLLNVINFAHGALFMLGAVLTWMGLSYLDLPYWVMLVAAPLAVGVVGVVIERTMLRFIYKLDHLYGLLLTLGVTLVIEGVFRAVYGVSGLPYSTPELLSGATDLGFMVLPNYRAWVVVASLTVCFATWFMIEKTKLGAYLRAGTENPKLVEAFGVNVPLMVTLTYGFGVALAAFAGVLAAPVIQISPLMGQNMIITVFAVVVIGGMGSILGSIVTGLGLGVIEGLTKVVYPQASSTVVFVIMALVLLVRPAGLFGREK

SEQ ID NO: 27807 - DNA, 936 bp, Ralstonia solanacearum
  CDS (1)..(936)
atggatatctttatccagcagatcgtgaacggcctggtgctcggcagcatttacgcgctgatcgcacttggctacaccatggtctacggcattctcggcatcatcaacttcgcccacggcgatgtcctgatgatcggcgcgatgtccgcactgaccgccatcaacttcctccagaagttcttccccaacctgcctgactggctgacgctggtcctggcgctgctgtttgcgatgccggtctgcgccgtcgtcgcatacaccatcgaacgggtcgcctaccggccgctgcgcaatgcgccgcgcttggcgccgctgatcaccgccatcggcgtgtcgatcgtgctgcagaccctggcgatgatgatctggtcgcgcaacccgctgaccttcccgcaactgctgccctcgtcgccgatcgacatcggttcgaccggcgcgacgatcacgggcaaggagatcgccatcatcctggtgtcgctggcggtcatgaccgggctgacgctgctggtcaaccgcaccaagctcggccgcgccatgcgcgccactgccgagaaccagcgcgtggccggcctgatgggtgttaaccccaacttcgtcatctccgccacgttcatgatcggcgctgccatggcagccgtcgccggcgtgatgatggccaccaactacggcaatgcccacttctacatgggcttcattcccggcctgaaggcgttcaccgccgcggtgctgggcggcatcggcaacctggcgggcgccatggtgggcggtgtgctgctgggcctgatcgaggccctgggtgccggctatatcggcgatctgactggcggtgtgttcggttcgaactaccaggatgtgttcgcgttcattgtgctgatttgcgtgctgctgttccgcccgtccggcatcatgggcgaacgcgttgcagaccgtgcataa

SEQ ID NO: 27808 - protein, 311 aa, Ralstonia solanacearum
MDIFIQQIVNGLVLGSIYALIALGYTMVYGILGIINFAHGDVLMIGAMSALTAINFLQKFFPNLPDWLTLVLALLFAMPVCAVVAYTIERVAYRPLRNAPRLAPLITAIGVSIVLQTLAMMIWSRNPLTFPQLLPSSPIDIGSTGATITGKEIAIILVSLAVMTGLTLLVNRTKLGRAMRATAENQRVAGLMGVNPNFVISATFMIGAAMAAVAGVMMATNYGNAHFYMGFIPGLKAFTAAVLGGIGNLAGAMVGGVLLGLIEALGAGYIGDLTGGVFGSNYQDVFAFIVLICVLLFRPSGIMGERVADRA

SEQ ID NO: 27809 - DNA, 1137 bp, Ralstonia solanacearum
  CDS (1)..(1137)
atgacagaaactgcaacggaattcaaagcgccgaagaagacgcgcgccgcgcttctcggcttcttcgtcctcgccatcttcgccccgttcctcgtgggcgccgtcggcgggaactactgggtacgcgtgctggacttcgcactgctgtacatcatgctggccctgggcctgaacatcgtggtgggttttgccggcctgctcgacctgggctacatcgcgttctacgcggtgggcgcctacatgatggcgctgctgggctcgccgcacctgaccaaccagttcgagtggatccatcagctgttcccgaacgggctgcatctgctgatctggtgggtgatcccgctgggcgcggggctggcggcgctgttcggcatcctgctgggggcgccgacgctcaagctgcgcggcgactacctcgccatcgtgacgctgggcttcggcgagatcatccgcatcttcatgaacaacctcgaccgcccggtgaacatcaccaacggtccgaagggcgtcaacctgatcgagccggtcaagctcttcgggttcgacttctcgaagcggcatgacatcttcggcatccacttcgagccggtgcacatgtactactacctgttcgtgctgctggcgatgggcatcatcacggtgtgcctgcgcctgcagaattcgcggatcggtcgtgcatgggttgccatccgcgaggacgagatcgccgccaaggccatgggcatcaacacccgcaacatcaagctgctggcgttcgccatgggtgcgtcgttcggcggcgtgtcgggggcgatgttcgcgtcgttccagggcttcgtgtcgccggaatcgttcgtgctgtgggagtcgatctacatcctggccatcgtggtgctgggcggcatgggccatatcccgggcgtgatcctgggcggcatcctgctggtgggcttccaggaactgctgcgcgcgctggccgagccgatccagaacaagctgttcggccacgtgatcgtggaagcggaagtgctgcgtcagctgctgttcggcctggcgatggtgggggtgatgctgtatcgccccgcgggcctgtggccctcgccgcgcaaggaagaccgcccgcagaaggcgcgggtcggtggtttgtcccgcatctga

SEQ ID NO: 27810 - protein, 378 aa, Ralstonia solanacearum
MTETATEFKAPKKTRAALLGFFVLAIFAPFLVGAVGGNYWVRVLDFALLYIMLALGLNIVVGFAGLLDLGYIAFYAVGAYMMALLGSPHLTNQFEWIHQLFPNGLHLLIWWVIPLGAGLAALFGILLGAPTLKLRGDYLAIVTLGFGEIIRIFMNNLDRPVNITNGPKGVNLIEPVKLFGFDFSKRHDIFGIHFEPVHMYYYLFVLLAMGIITVCLRLQNSRIGRAWVAIREDEIAAKAMGINTRNIKLLAFAMGASFGGVSGAMFASFQGFVSPESFVLWESIYILAIVVLGGMGHIPGVILGGILLVGFQELLRALAEPIQNKLFGHVIVEAEVLRQLLFGLAMVGVMLYRPAGLWPSPRKEDRPQKARVGGLSRI

SEQ ID NO: 27811 - DNA, 870 bp, Ralstonia solanacearum
  CDS (1)..(870)
atgctcagcgcactgggcgtgctgttcgacgggctggcctacggctgcctgctgttcctgatcggcatcggcctgtcggtgacgatgggcctgatgcgcttcatcaacctcgcgcacggggccttcgccatggcgggcggctacgtgtgcgtggtgctgatgaaccgcctcggcatgccgttcctggccacgctgccgatcgccttcctggccaccgccgccgccggcttcgtgctggagcgcacgctataccggcggctctatcgcgccagcccgctcgaccaggtgctgttctccatcgcgctcgtcttcatggccatggcgggcgccacctatgtctgggggccgtcgcagcagccggtggagctgccggacgcgctgcgcgggcaattgcgcgtgttcgatacggggctcgaagtcgggcgctaccgcttgttcctggtcggcgtggtggtcgtgctgacggcgctgctggcctggctgatcgagcgcacgcgcttcggcgcgcgggtgcgggcgtcggtggacaaccagcaggccgcggccgggctcggcatcaacgtgggcctggtgttctcggtcacgttcgcgctgggctcggggctggccggcctgggcggcggactgggcatcgacgtgctcggtctcgatccggcgttcccgatcaagtacatggtgtatttcctgctcgtggtggcggtgggcggcgcgggctcgatcaaggggacgctgctggcggccctggtgctgggcgtgttcgacgtggcgggcaagtactacgtgcccgaagtcggcgcattcgtcatctacgggttgatggtgctgctgctggcgctgtttccgggcggcctgctggggaggcgcgcatga

SEQ ID NO: 27812 - protein, 289 aa, Ralstonia solanacearum
MLSALGVLFDGLAYGCLLFLIGIGLSVTMGLMRFINLAHGAFAMAGGYVCVVLMNRLGMPFLATLPIAFLATAAAGFVLERTLYRRLYRASPLDQVLFSIALVFMAMAGATYVWGPSQQPVELPDALRGQLRVFDTGLEVGRYRLFLVGVVVVLTALLAWLIERTRFGARVRASVDNQQAAAGLGINVGLVFSVTFALGSGLAGLGGGLGIDVLGLDPAFPIKYMVYFLLVVAVGGAGSIKGTLLAALVLGVFDVAGKYYVPEVGAFVIYGLMVLLLALFPGGLLGRRA

SEQ ID NO: 27813 - DNA, 1617 bp, Ralstonia solanacearum
  CDS (1)..(1617)
atggccatgacacgcttcctcgccgcactgctgtgcgccctctgcctggttgccacgcctgccgcatcggcatgggcggccggacaaccgctgacccaggccgatctcaagccgctggccgaagacgacttcgacgccaaggtgaaggtgctcaacgccctggccgccgcgcccgccgaacaggccggccccatcctgcgggcgttgcagaatgatgcgctgttctatgcgcccgctgccggcatgctgcgccaggagggcgagcgttatctcgatgcgatcagcggccagccggttgccatgaaggccgatgacctgcaagcgctgacgctgaacaatgccctgcgcgcccaggtggacagcgcggccagcggcttcgtgctgcagtcgcccgaccgggccgtgcgcgcgcaggccatcgatacgctgctggcgcatcccgagacggcatcgcgcacggtggtcgatgcggcgcgcaagcaggagaccgatcccgaactgcggacccgcctgcatctgctgtgggccaacctggcgctcgacgacggctcgcctgccgagaagctcgaagcgctcaggctgctcgccggcgataccaacccgcagacccgccagcgcatcgcgccgctgctcgccaaggacagcggcgccgacgacgtgctgcgcgccgctgcccggcaggcgctggacaaccttgccgcgcaggcgcgcaaggccgagctgatcggcaacctgttcgccggcctgagcctgggctcggtgctgttgctggccgcgctggggctggcgatcacctacggcctgatcggcgtcatcaacatggcgcacggtgagttcctgatgatcggcgcgtatgccacctatgtggtgcagacgctttttcgcaaccatttccctgcggcgttcgactggtatctgcccgccgcgctgccggccgcgttcctggccgcggccgtcgtcggcttcgtgctggagcgcatggtgctgcggcacctgtacggccggccgctggagacgctgctcgccaccttcggcgtcagcctgctgctgatgcaggccgtgcgcagcgtgttcggtgcgcagaacgtggaggtggccaacccgagctggatgagcggcggcatcgcgctgtatccggggctgatcctgccgtataaccggctggtgatcctggccttcgcgctggtggtggtcacgctggcgtgggcggtgctcaaccgcacgcggctgggcctgttcgtgcgcgccaccacgcagaaccgcgccatggcggcgtgcgtgggcgtgcggacctggaaggtggacagctacgccttcgcgttcggcgcgggcatcgccggcctgggcggctgcgcgctgtcgcagatcggcaatgtggggccggacctcgggcagggctacatcatcgattccttcatggcggtggtgctgggcggggtggggcagctggccggcaccatcgtcggcgcgttcgggctggggctgatcaacaagtgcatcgagccgttctatggcgcggtgctggcgaagatcttcgtgctggtgctgatcgtgctgttcatccagaagcgtccgcaggggctgttcgccctcaagggccgcagcgcggaggcctga

SEQ ID NO: 27814 - protein, 538 aa, Ralstonia solanacearum
MAMTRFLAALLCALCLVATPAASAWAAGQPLTQADLKPLAEDDFDAKVKVLNALAAAPAEQAGPILRALQNDALFYAPAAGMLRQEGERYLDAISGQPVAMKADDLQALTLNNALRAQVDSAASGFVLQSPDRAVRAQAIDTLLAHPETASRTVVDAARKQETDPELRTRLHLLWANLALDDGSPAEKLEALRLLAGDTNPQTRQRIAPLLAKDSGADDVLRAAARQALDNLAAQARKAELIGNLFAGLSLGSVLLLAALGLAITYGLIGVINMAHGEFLMIGAYATYVVQTLFRNHFPAAFDWYLPAALPAAFLAAAVVGFVLERMVLRHLYGRPLETLLATFGVSLLLMQAVRSVFGAQNVEVANPSWMSGGIALYPGLILPYNRLVILAFALVVVTLAWAVLNRTRLGLFVRATTQNRAMAACVGVRTWKVDSYAFAFGAGIAGLGGCALSQIGNVGPDLGQGYIIDSFMAVVLGGVGQLAGTIVGAFGLGLINKCIEPFYGAVLAKIFVLVLIVLFIQKRPQGLFALKGRSAEA

SEQ ID NO: 27815 - DNA, 948 bp, Ralstonia solanacearum
  CDS (1)..(948)
atggaattcctagtcatcaacctgttgaacggcatcagctacgggctgctgctgttcatgctgtcgtcgggcctgacgctgatcttcagcatgatgggcgtcctcaacttcgcgcatgccagcttctacatgctgggcgcgtacttcgcctacgtcgtcagcggatacctgggcttctgggccgcgctgatcgtggcgccgctgctggtgggcgcgctgggggcgctggtcgagcgcttcggcctgcgcacggtgcaccgctacggccatgtcgccgagctgctgttcaccttcggcctggcctacctgatcgaagagggcgtgaagctggtgtggggcctgccggccgtgccgtaccgcgtgcccgaggcgctggacgggccgctgttcacgctgttcacctcgtccttcccgaagtaccgcgccttcatgatgctggtgtcgctgctgatgctggtgggcatcttcctgctgctcacgcgcacgcgcatcgggctggtcatccaggcggcgctgacgcatccggacatggtcgaggcgctcggtcacaacgtgccgcgcgtcttcatgctggtgttcggcgggggctgcgcgctggccgggctggccggagtgatcggcggcaacgcgttcgtgaccgagccgtcgatggcggcggcggtcgggtcgatcgtcttcgtggtggcggtggtgggcggcatgggctcgctggtgggcgccttcatcgcctcgctgctgatcggttgcatccagacctttgccgtcacgctcgatgtgtcggtgacgagcctgctgggcaagctcggtgtcgcgctcaacccggacgtgccgctgatctccgtgtggaacctgaccatcgcgcaggtggcgccggtgctgccgtacctgctgctggtgctgatgctgatcttccgcccgcgcgggctgatgggcacgcgggagggataa

SEQ ID NO: 27816 - protein, 315 aa, Ralstonia solanacearum
MEFLVINLLNGISYGLLLFMLSSGLTLIFSMMGVLNFAHASFYMLGAYFAYVVSGYLGFWAALIVAPLLVGALGALVERFGLRTVHRYGHVAELLFTFGLAYLIEEGVKLVWGLPAVPYRVPEALDGPLFTLFTSSFPKYRAFMMLVSLLMLVGIFLLLTRTRIGLVIQAALTHPDMVEALGHNVPRVFMLVFGGGCALAGLAGVIGGNAFVTEPSMAAAVGSIVFVVAVVGGMGSLVGAFIASLLIGCIQTFAVTLDVSVTSLLGKLGVALNPDVPLISVWNLTIAQVAPVLPYLLLVLMLIFRPRGLMGTREG

SEQ ID NO: 27817 - DNA, 960 bp, Pyrobaculum aerophilum
  CDS (1)..(960)
atggagttatttattaacgtagactatccaactcttgcaagagctataattttctctaatatttacgtactcctcagcctaggcctaaacctcacgtacataactactaagatcccctcatttgcgcacggggatttagccacaataggggcttatgtgagctattatactattgtatttctactattaccttttggactatccgctagtatatatttaaccttccccctcgtagctctagtcacaggtcttgtggctttggcaacttatatagcagtttttagacctatgatcaggagaggggccggaattacgccactaatgatcgcttcatttggtgtacactacgttttatttgcaatagtggccattatcgccgattatactcggaacacctaccaaattcttagcagaaatgtcctcttaagccggtgggagtttatttggccgggcacagacttcttgacctcgtctctaataaataccactattatagtcattgtagtcactctgttattatactttttattgtacagaactagatatggagtaataatgagggccagcattgacaacttatacctagctaaagcagttgggattaatatagagagagtattcgcagtggcgtggctattaataggggcggtgacggggatagcagggatctatatggctatgttcttccccatgactgaagagctcggctggcttaggctacctgttattttcgtggcttctgtcgtcggcggtctctccagtatatacggcgcagtgcttggcggatatgtcgtcggcctaagcctagtcctaggcgccacttatattttaacgcctttgggggtgcccactgagttccaattagtaattccgtttgcctttgtgatagcgatattgttatttgcccctcaaggcttggcgggaattatttcaagtatagcacagaaagtgagaaaatga

SEQ ID NO: 27818 - protein, 319 aa, Pyrobaculum aerophilum
MELFINVDYPTLARAIIFSNIYVLLSLGLNLTYITTKIPSFAHGDLATIGAYVSYYTIVFLLLPFGLSASIYLTFPLVALVTGLVALATYIAVFRPMIRRGAGITPLMIASFGVHYVLFAIVAIIADYTRNTYQILSRNVLLSRWEFIWPGTDFLTSSLINTTIIVIVVTLLLYFLLYRTRYGVIMRASIDNLYLAKAVGINIERVFAVAWLLIGAVTGIAGIYMAMFFPMTEELGWLRLPVIFVASVVGGLSSIYGAVLGGYVVGLSLVLGATYILTPLGVPTEFQLVIPFAFVIAILLFAPQGLAGIISSIAQKVRK

SEQ ID NO: 27819 - DNA, 960 bp, Pyrobaculum aerophilum
  CDS (1)..(960)
atggctaaatggtatgtatttattgtacttgtcgcttggattgtaatatcttctttttattttccgcgcgaagtcgcagatgcgttagtatacgcctcagttttagtgctcgcatcagtcggcttgacattaacctaccagaccactaaagtgcctaacttcgcgcacggagtttttataaacctcggcgtgatggccgccctcacagtggcgcagatttataaaacatctccttatgcggcgttgcccctggccgtggtcttgtcaactgcatcttcactcgccttgtattttttcctcctcccgctttataagaggcaaagcccgccggaggttatgatgatggccacaatggcttataacatagtctttataggagttttaaacgcgtatgcggattggatagggagagctgccggtattttcactagggggattaccttaaggccctacgacgtggaaatactcggcaccgccggcgtttacatattagccccactgacggcctccgcgatctccctcgccctttacctttttttaaaaacaaaaatcggcactgcgctgagggccgcggttgagaacgaggaactggccaggaccttggggataaacgttgaaaggatgtacgcaattgcctgggcaatatcgggcgccgtcgccggcgttgcgggggtttttctgcctttgtacatagaggctacgcctgacgttgggtggctcctcctcgcgagcttcttcgcggcgagtatagtggggggtttgaataatatctacggggcgttggccggaggggttttaatgggctttgtggagctgctcggcactattcaattcgcagcgcttttaaacgcccttttcgctacgcctcagtaccaagtcaccgcctacaggcctctagtgccgttgctcgcaatagccattactctactcatatcccctaaaggactgttggggcgatga

SEQ ID NO: 27820 - protein, 319 aa, Pyrobaculum aerophilum
MAKWYVFIVLVAWIVISSFYFPREVADALVYASVLVLASVGLTLTYQTTKVPNFAHGVFINLGVMAALTVAQIYKTSPYAALPLAVVLSTASSLALYFFLLPLYKRQSPPEVMMMATMAYNIVFIGVLNAYADWIGRAAGIFTRGITLRPYDVEILGTAGVYILAPLTASAISLALYLFLKTKIGTALRAAVENEELARTLGINVERMYAIAWAISGAVAGVAGVFLPLYIEATPDVGWLLLASFFAASIVGGLNNIYGALAGGVLMGFVELLGTIQFAALLNALFATPQYQVTAYRPLVPLLAIAITLLISPKGLLGR

SEQ ID NO: 27821 - DNA, 873 bp, Pyrobaculum aerophilum
  CDS (1)..(873)
atggatataatcccctattttttaactggattggtaattggatctatttacggcttgacgacgctggggcttagccttatttttggcgtgttgcgtgtggcaaatgtggcccacggatcgtttataatgattggggcgtacgtggcttatacctttttcgtggcatgggcaattccgccgattgtctcagcaacggcggctttgttaataggaatggcggctgggtatttagtatacgtaggcgttatcaagcctcttggaaaagccgagctgaacatattagttgccctatttgccctaggggcgttgctggcagaggtggcgaggctgatttggggccccgatttcgtgggctataggtggagtataggctctatagaaatcgcaggcctccagctggagatcacaaagctgatgggggccgtggcctctctgataatcgccgtattgttagagttgacgttgaggcggacgtacttcggccgcgctattaaggcagtagttcaagacccaataggcgcaatggtagtggggataaacgtggagagaatactggctttaagcgccgccgttggaataggcgtaaccgcattaggaggagtgttgctaacgttgttcataccagttgggattaacccttacatgggcgggccctataccctaataggctttgtcattgcagttttgggcgggctcggctctgtaatgggggcttacattgccgggttgttgtttggagttttcgagtcagtggggttttacgtcttctcgtcgctgggcttcgccgagccgtcacaaatggcgcttttcttatcctttgtactgctgttgctactgttattattcaagcctacaggtctgtttaggatatga

SEQ ID NO: 27822 - protein, 290 aa, Pyrobaculum aerophilum
MDIIPYFLTGLVIGSIYGLTTLGLSLIFGVLRVANVAHGSFIMIGAYVAYTFFVAWAIPPIVSATAALLIGMAAGYLVYVGVIKPLGKAELNILVALFALGALLAEVARLIWGPDFVGYRWSIGSIEIAGLQLEITKLMGAVASLIIAVLLELTLRRTYFGRAIKAVVQDPIGAMVVGINVERILALSAAVGIGVTALGGVLLTLFIPVGINPYMGGPYTLIGFVIAVLGGLGSVMGAYIAGLLFGVFESVGFYVFSSLGFAEPSQMALFLSFVLLLLLLLFKPTGLFRI

SEQ ID NO: 27823 - DNA, 888 bp, Rhizobium meliloti
  CDS (1)..(888)
atgacgatgattttcggaattcccctccaggccttcctcgggcagctgctgatcgggctcatcaacggctccttctatgcgctcctgagcctcggcctcgccatcatcttcgggctcctgcgcgtcatcaacttcgcccacggtgcgcagtatatgctcggcgccttcatggcctggctgctgctctcctatttgggcatcggctattggccggcgctcattctcgcgccccttctcgtcggcctcatcggcgccgttatcgaacgcacgatgctgagacggctctatacgctcgatccgctctacggcctcctcttcaccttcggcctggcgctcaccatcgaaggcaccttccgctatctctacggcgcgtccggccagccctatgcgacgccggcgctgcttatgggcggggccaatctcggcttcatgttcctgccaatctatcgcggctgggtcatcgtcttttcgctggtgatctgcctcggcacctggctcatgatcgagaagaccaagctcggctcctatctgcgcgccgctacggagaatccggtcctggtgcaatccttcggcatcaacgtgccctttctgctgacgctgacctacgggctcggcgcggcgctcgccgcaattgccggagttctcgcggcgccgatctaccaggtctcgccgctgatgggatcgaacatcatcatcgtcgtcttcgcagtggtcgtcgtcggcggcatgggctcgatcatgggcgcgatcgtcaccggttatctgctgggcatcgccgaaggactgaccaaggtcttctatccggaggcctccaacatcgtgatcttcgtgatcatggccatcgttctcctgctgaggcccgcgggtctcttcggtcgggatgcttga

SEQ ID NO: 27824 - protein, 295 aa, Rhizobium meliloti
MTMIFGIPLQAFLGQLLIGLINGSFYALLSLGLAIIFGLLRVINFAHGAQYMLGAFMAWLLLSYLGIGYWPALILAPLLVGLIGAVIERTMLRRLYTLDPLYGLLFTFGLALTIEGTFRYLYGASGQPYATPALLMGGANLGFMFLPIYRGWVIVFSLVICLGTWLMIEKTKLGSYLRAATENPVLVQSFGINVPFLLTLTYGLGAALAAIAGVLAAPIYQVSPLMGSNIIIVVFAVVVVGGMGSIMGAIVTGYLLGIAEGLTKVFYPEASNIVIFVIMAIVLLLRPAGLFGRDA

SEQ ID NO: 27825 - DNA, 891 bp, Rhizobium meliloti
  CDS (1)..(891)
atggctttcgcgatccagttcgtcatcgacgtcctgagcctcggcggcgcctatgcgctcatggcactcggcctcgtcatcatctacggcatcctgcgcctcgtgaacttcgcctatggcgaactcatcatggtggccggctacacgatgtttctcgccagcggctcgggcctgccctggatcgtcatggcggtgctcgccgtcggcatggccatcctcttcggcatcatcaccgactatgccgccttccgtccggtgcgggccaaatcggtgacggcggtgctgatcacatccttcgccttctccaacctgctgcagaacgcggcgctcctcttcatctcgccgcgccctcgcaacgtgccgctcccggatatcttctcgcagaccgtctcgatcggcggtgcgatcaccccggtccgcaatctcatcaccatcgccgcctccatcgcactgctcgccggcgtcgccttcctgatgcgcaggacgacgctcggcatcgccatgcgcgcagcggcgacgaacttcaccatggcgcgcatgctgggagtgccggcgaacctcatcatctcgtccgccttcgccctttccggcttcctcgccggcgtcgtcggcattctctggatcggccgcatcggcaccgtcgttccgggcatcggcctggagccgctgctcgtcgccttcatcgccacggtcatcggcggcatgcggagcctgcccggcgccgttgtcgggggcttcctgctcgccctcatcgacaccacgctcaactacaccctgtcgcaggacctgctgaaattccgcgacgccttcaccttcagcctcgtcatcctgatcctgctctggcgccccgacggcctcatcaggggtccggcgagcggacagcggacctga

SEQ ID NO: 27826 - protein, 296 aa, Rhizobium meliloti
MAFAIQFVIDVLSLGGAYALMALGLVIIYGILRLVNFAYGELIMVAGYTMFLASGSGLPWIVMAVLAVGMAILFGIITDYAAFRPVRAKSVTAVLITSFAFSNLLQNAALLFISPRPRNVPLPDIFSQTVSIGGAITPVRNLITIAASIALLAGVAFLMRRTTLGIAMRAAATNFTMARMLGVPANLIISSAFALSGFLAGVVGILWIGRIGTVVPGIGLEPLLVAFIATVIGGMRSLPGAVVGGFLLALIDTTLNYTLSQDLLKFRDAFTFSLVILILLWRPDGLIRGPASGQRT

SEQ ID NO: 27827 - DNA, 903 bp, Rhizobium meliloti
  CDS (1)..(903)
atggagtattttgtccagcagctcgtcaacgggctgacgcttgggtctatttatggtatgatcgcgatcggttataccatggtctacggcatcatcggcatgatcaacttcgcccacggcgatattttcatgcttggcggctttgccgcattgatcgtcttcttgcttctcacgacatttattgccggcgtgccggttgtactggcgcttttgatcatgatggtcgtcggtatgctgacggctgcgctttggaactggaccatcgagcgcgtggcctatcgcccgcttcgcggctccttccgtctggcgccgctgatcacggcgatcggcatgtcgatcgtgctgtcgaacttcattcaggtgacgcagggtccgcggaacaagccgatcccgccgctggtctcctcggtctatgacctgttcggcatctcggtttcgctgaagcagatcatcatcgtcgtcatcacggcaatcctgctttcggtcttctggtacatcgtcaaccgaactccgctcggacgagcccagcgtgcgaccgaacaggaccgcaagatggcagccttgctcggtgtcgatgtcgatcggacaatctcggtgaccttcatcatgggagccgcactcgccgccgtcgccgggacgatgtacctgatgtattacggcgtggtcgtgttcaccgacggtttcgctccgggtgtcaaggcgtttaccgctgccgttctcggtgggatcggttcgctgcccggcgccgtgctcggcggcttgctgatcggtctcatcgagtcgctgtggtccgcctacttcaccatcgactacaaggatgtcgcgaccttctcgattctcgcgatcgtcctgatcttcaagccgtcgggtattctcggacgaccggaagtcgagaaggtatag

SEQ ID NO: 27828 - protein, 300 aa, Rhizobium meliloti
MEYFVQQLVNGLTLGSIYGMIAIGYTMVYGIIGMINFAHGDIFMLGGFAALIVFLLLTTFIAGVPVVLALLIMMVVGMLTAALWNWTIERVAYRPLRGSFRLAPLITAIGMSIVLSNFIQVTQGPRNKPIPPLVSSVYDLFGISVSLKQIIIVVITAILLSVFWYIVNRTPLGRAQRATEQDRKMAALLGVDVDRTISVTFIMGAALAAVAGTMYLMYYGVVVFTDGFAPGVKAFTAAVLGGIGSLPGAVLGGLLIGLIESLWSAYFTIDYKDVATFSILAIVLIFKPSGILGRPEVEKV

SEQ ID NO: 27829 - DNA, 897 bp, Rhizobium meliloti
  CDS (1)..(897)
atggcctattttctgcagcagatcgccaatgccgtacccgtggccgcgctttatgcggcgctcgccttcggatacgcgatcgcctttgctgtcacacggcgggcggacctgacctatggcgcgctcttcgcctttgccgggcaaatcttcgtgctcttcgcggatgtcggctggaaccggctgtggctggtactgccggcggcgctcgggctcggggcgacagcggcgctcgcattcgggctaggtgccggtcttattgccggccgctacgtcatgcggcccctggctttttcctccgccaatgccgtggtcgtcgcctcgctcggaagcctgctggtgctgatggaaacggcccggctcgcctccgacaccagaagcctctggctgccgcccttcctgaacgacgtggtggtgttctggccgaaccctgcctttccggtcgcgctgacggtcgtgcagctcgtcaacaccgcgctcatgatggcccttgtcgccggcggccattggctgttgacccgttcctatgcaggccgctactggcgcgccgtttccgaggatcgcaaggccgccgcgctttgcggcatcgatccgggagcggtctatatcgccgcctatggcgtggcgtcgctgatcgctgcgttctgcgggattctcgctgcttcctattacggcaacatggatttcggcaccgggctgaccttcggggtcaaggtcctgttcatcgccgccatcggcgggcagacttcgccgttattcgcggcactgggcgcagccggcatcggcctcatggagacggtgtggagcgcctatggacccatcctctggcgggacttcgccatattcggctttctggtgatcgtgctcgtggtcacgcgccgggaaaagatcattccctga

SEQ ID NO: 27830 - protein, 298 aa, Rhizobium meliloti
MAYFLQQIANAVPVAALYAALAFGYAIAFAVTRRADLTYGALFAFAGQIFVLFADVGWNRLWLVLPAALGLGATAALAFGLGAGLIAGRYVMRPLAFSSANAVVVASLGSLLVLMETARLASDTRSLWLPPFLNDVVVFWPNPAFPVALTVVQLVNTALMMALVAGGHWLLTRSYAGRYWRAVSEDRKAAALCGIDPGAVYIAAYGVASLIAAFCGILAASYYGNMDFGTGLTFGVKVLFIAAIGGQTSPLFAALGAAGIGLMETVWSAYGPILWRDFAIFGFLVIVLVVTRREKIIP

SEQ ID NO: 27831 - DNA, 942 bp, Synechococcus sp
  CDS (1)..(942)
atggattggttgcaaccgctgatcaatggtctggccatcgggggcgtctatgccctgtttgccttggggtataccttggtcttttcgatcctgggggtcattaactttgcccatggtgccgtttttaccctcggtgcctacctgacttacgctctagtgggtgggcgtttcagcttcaacgggttgctcgccaatgccgcgctgcccttcagtttgccgttcgccttggctctgctgctcggcagtttgctggccggcggtgccagcctcttgattgagcaagtggcctttcgtcccctgcgccgccgccaagcggatcccctcctaaccctgatctccagccttggcgtggcggtgtttatcgtcaatttgattcaaatcttggtgggagccgagatttacaccttcccaagcaacatctacggcgacctacccagtgccatcaacttaggcagcagcgatcgcccgatccagatccgcacggtgcaaatcatcctgtttgtcgtggcgatcgcgatgttcagtctgctgacttggctgatcaacggcacccgcgttggccatgccctgaaagctgttgccgaagatgccaccaccgctagcctgctgggcatcgatcccgatcgctacatccggctgaccttcttcctgagtggcgtccttggtggtttggcgggcaccttggtcggtaccagtgtcagtatcaccggcccctatttcgggattgcctacgggctgaaaggcctgagtgtgatggtcttaggtggactcggcaatattcccggcacgattgcgggcggcttgttgttgggtctggcggaagcttgggtgccgccacaatggtcgggctatcgcgatgccgttgcctttgcgctgctatttgccatgctcttgatccgtccccagggcttgtttagtcgtgctcggacagagaaggtgtag

SEQ ID NO: 27832 - protein, 313 aa, Synechococcus sp
MDWLQPLINGLAIGGVYALFALGYTLVFSILGVINFAHGAVFTLGAYLTYALVGGRFSFNGLLANAALPFSLPFALALLLGSLLAGGASLLIEQVAFRPLRRRQADPLLTLISSLGVAVFIVNLIQILVGAEIYTFPSNIYGDLPSAINLGSSDRPIQIRTVQIILFVVAIAMFSLLTWLINGTRVGHALKAVAEDATTASLLGIDPDRYIRLTFFLSGVLGGLAGTLVGTSVSITGPYFGIAYGLKGLSVMVLGGLGNIPGTIAGGLLLGLAEAWVPPQWSGYRDAVAFALLFAMLLIRPQGLFSRARTEKV

SEQ ID NO: 27833 - DNA, 1011 bp, Rhizobium loti
  CDS (1)..(1011)
atgccaaatggtggaacgcgaacaaggacgcggcgctcccggtcctcgcacagggcggtcaggttccggccaacaagtagaaaccccagcaagcgaagtggtcgcgctgatgcgaccacttctacgccgcagaggtggtcgacgctcatgcaaatcgtcctgaattgtctctcgctcacgtcgttctacctttgcttcgccctgggcctggcattggtgttcggagtgatgcggatcatcaacttcgctcacggcgagttcttcatgatcggcgcctacgcgacgtatttgtgcgtcgccacgcttgcaccccaaatcggaggaccaagcgcctggctcgtcggcgcaatcgtggcagcagggataaccgggctgctaggtgccgtgctttacaggacggtggtcgttccattggctgacaagccgcttgcgattttcattgcgacgctcgcgctctcgtacgttctgcagacgattgtcgtccagatattcggtccggttggcctctccatctcgcccccactgcgcggcgtcgtgagcgtgggaggggcaatcctcccagcctcgcgggcaatggtcattgtagccgcggccgccctttcaataggtttatggatctacctcatgagaactgaatcaggtcgtcgcatccgcgcggtcgctcagaatcctcgaggcgcattgctgcagggcattaagacgcggaatgttggcaatctgacgctgattatcggatcggggatcgcaggcatctgcggggcagcgatgggaccgataagccagatatcgccctacatgggtggtcctgctctctggaaagcgttcatcatcataattgtgggcgggatcggcaatgtctggggagcggtggcggcggcggcaatctttggggtgcttgatacacttatgtcgcagttcggcggcgggcgctttcttgctctgacgagtgcggccatcatgctgttcgtccttagcgtaaaaccctccggtctattcggggaaaaagaatga

SEQ ID NO: 27834 - protein, 336 aa, Rhizobium loti
MPNGGTRTRTRRSRSSHRAVRFRPTSRNPSKRSGRADATTSTPQRWSTLMQIVLNCLSLTSFYLCFALGLALVFGVMRIINFAHGEFFMIGAYATYLCVATLAPQIGGPSAWLVGAIVAAGITGLLGAVLYRTVVVPLADKPLAIFIATLALSYVLQTIVVQIFGPVGLSISPPLRGVVSVGGAILPASRAMVIVAAAALSIGLWIYLMRTESGRRIRAVAQNPRGALLQGIKTRNVGNLTLIIGSGIAGICGAAMGPISQISPYMGGPALWKAFIIIIVGGIGNVWGAVAAAAIFGVLDTLMSQFGGGRFLALTSAAIMLFVLSVKPSGLFGEKE

SEQ ID NO: 27835 - DNA, 897 bp, Rhizobium loti
  CDS (1)..(897)
atgagcaaccagatcatccagggcatcctgcttggcggctactatgcgctgatcgcctgcggcctgtccttcatgttctcggtgatgcgcatcatcaacctcgcccatggcagcctcgccgtgttcgcggcctttgcgctgtggtggctggcctcgcggttccatgtctcgccgtttgtcggcctgctcatcgtgctgccgctgatggcggcgatcggctgggcgctgcagcgcttcttgctcgagcgcagcgcgcgcggcggtgcgctgctgccgatcctgaccacgtttgggctggccatcgtcatcgacaacatgctgttcgagcagttcggcgccgacacccgctcactggcaccctatatcggcagcctgtcctatgattcctgggagtggccgggcagcatctatgtcggcaagctggccgtgatcatgttcgccaccgccgtgatcctgctgggagggctgcagctgttcctcacccgcacccggcttggccgctcgatccgcgcaacgtcggaagattccgacacggccggcctggtcggcgtcgatgcgcgtcgcgccaatgccatagccgcttccatcgccatggtcacggtcggccttgccggcgcgttcctgggcatgcgcgccaccttcgatccctatgccggcgcgccgcaactgctgttcgctttcgaagccgcagtgatcggcggcgccggttcgctgtggggcacgctggtcggcggcatcgtgctggcgcttgcgcagacacttggcgcgcaagtgcatccgcaaggctttctgatcggcggccacacggtgttcctcgtcgtgctcttcgtgcggctgtccacgtcgggccttggcctgcgcggcctgttgcgccttccttcccggagcgcgtcatga

SEQ ID NO: 27836 - protein, 298 aa, Rhizobium loti
MSNQIIQGILLGGYYALIACGLSFMFSVMRIINLAHGSLAVFAAFALWWLASRFHVSPFVGLLIVLPLMAAIGWALQRFLLERSARGGALLPILTTFGLAIVIDNMLFEQFGADTRSLAPYIGSLSYDSWEWPGSIYVGKLAVIMFATAVILLGGLQLFLTRTRLGRSIRATSEDSDTAGLVGVDARRANAIAASIAMVTVGLAGAFLGMRATFDPYAGAPQLLFAFEAAVIGGAGSLWGTLVGGIVLALAQTLGAQVHPQGFLIGGHTVFLVVLFVRLSTSGLGLRGLLRLPSRSAS

SEQ ID NO: 27837 - DNA, 909 bp, Rhizobium loti
  CDS (1)..(909)
atgagcctgcaatttgtcgtcgatggattgctgacgggttcgatgatcggccttggcgccattggcgtgacgctgacctattcgatcctgcgcttctcgaattttgcccatggcgacttcatggcctggggcacctatgcgacgctcgccgtcgtcagcgccattggtgccaccttcggcaaggtagcacccatcgcgccgctgtccttcggctggccgctcctggttgcgctggtcgtcggcatggccttcaccgccttgctggccctgctgctcgacagagtgctgttctcgcggctgcgctcccagggccaggcgattatcgtggtgatggcgagcttcggtgcctcgatggcgttgaggagcctgctcgaattcaccttcagctcgcggccgacctatttcagccgggcgatccagattgccatgccggtcggcttcggcatccgcgtcacccccgaccagatcgcgcttctgctgctgaccacggtgctggtgctcggcgtgcatctgttgatgacgcgcacgcagaccggccgcgccatgcaggcgctcagccagaacgcggcgctggcccgcatcgtcggcatcgacgtcgccagcgtcgtgcgcgtcacctggatcatcggcggcgcgctcgcctgcgtcgccggcgtgatgatcggcatcctggtgcagatccgtccgttcatgggcttcgacatgctgctgccgatgttcgccgccgccatcctcggcggcatcggcagcattccgggtgcggtgctcggcgggctgatcatcgggctcgccgaggccggcgcggtgcagctgatcggcgccgaatggcgcgccgccgtctccttcatcatcctgatggcggtgctgttcgtgcggccgatcggccttttcggagttcgggaaagatga

SEQ ID NO: 27838 - protein, 302 aa, Rhizobium loti
MSLQFVVDGLLTGSMIGLGAIGVTLTYSILRFSNFAHGDFMAWGTYATLAVVSAIGATFGKVAPIAPLSFGWPLLVALVVGMAFTALLALLLDRVLFSRLRSQGQAIIVVMASFGASMALRSLLEFTFSSRPTYFSRAIQIAMPVGFGIRVTPDQIALLLLTTVLVLGVHLLMTRTQTGRAMQALSQNAALARIVGIDVASVVRVTWIIGGALACVAGVMIGILVQIRPFMGFDMLLPMFAAAILGGIGSIPGAVLGGLIIGLAEAGAVQLIGAEWRAAVSFIILMAVLFVRPIGLFGVRER

SEQ ID NO: 27839 - DNA, 900 bp, Rhizobium loti
  CDS (1)..(900)
atgatcgccgatttcgactaccagttcttcatcgaagtgctcgtcggcggcctgctctccggcgtcatgtactcgctggtcgcgatcggcttcgtgctgatctacaagacatcaggcgtgctcaatttcgcgcaaggcgcgctgctcttgttcgcggcactcaccttcgtcagcctcgtcgaacgcggtgttcccttcgcgctggcgctggtggccaccttcgccatcatggtggcgatcggcatcgccatcgagcgcacggtgctcaggccgctcaccaacaagccgccgatcacgctcttcatggccacgctcggcctgtcctacatcatcgagggcgccgcccagttgatctggggcacgcaggtccatggcctcgacctcggcatcgaggatgtgccgctggaagtcggcggtgtgctgatcagccagttcgacatcttcgcggctgtggtcgccgccggcatggttctgctgctgtcgctgttcttccgctacacccgcatcggcctctccttccgcgccgtcgccgacgatcagttcgccgccctagcggtcggcctcaggctgccgctgatctgggcgaccgtctgggccgcggccggcctcgtcgcgctggtcgcgggactgctctggggcgcccgcctcggcgtgcagttctcactgtccctggtggtgctcaaggcgctgccggtgctggtgcttggcggcttcgattcgatcctcggcgccatcgtcggcggcctcttgatcggcgccagcgagaagctcgccgaggtctatatcggcgactatttcggcggcggcatcgagagctggttcgcctatgtcgtggcgcttgccttcctcctgatccgtccctccggcctgttcggccagaagctcgtggagagggtctga

SEQ ID NO: 27840 - protein, 299 aa, Rhizobium loti
MIADFDYQFFIEVLVGGLLSGVMYSLVAIGFVLIYKTSGVLNFAQGALLLFAALTFVSLVERGVPFALALVATFAIMVAIGIAIERTVLRPLTNKPPITLFMATLGLSYIIEGAAQLIWGTQVHGLDLGIEDVPLEVGGVLISQFDIFAAVVAAGMVLLLSLFFRYTRIGLSFRAVADDQFAALAVGLRLPLIWATVWAAAGLVALVAGLLWGARLGVQFSLSLVVLKALPVLVLGGFDSILGAIVGGLLIGASEKLAEVYIGDYFGGGIESWFAYVVALAFLLIRPSGLFGQKLVERV

SEQ ID NO: 27841 - DNA, 906 bp, Rhizobium loti
  CDS (1)..(906)
atgctctatttcttccagcaggtgctgaacgggctgcattccggcgcgctctatgcgttgctcgccttcggctacgtgctgatcaacggcatcctgcaccgcaccaacctcgcctatggcgcgctgttcgccttcagcggacaggcaatgatcctgagcgtcgccttcggctaccaggtgctgtggctgacgctgctggtgtcggtgctgttcggcgtggtcgcggcattcctttatgccgcgctgatcagccatgtcctgtcgcgcagcgtcttcgaaccgttggccgaccgctcgcccaacgccatcgtggtgacgacgctgggcatcctgatcgtgctgtcggaagcaagtcgcatcgcggccgacacgcatgatctgtggctgccgccaatgctggcacagcccatcgttttcgccgaaggcgccggcttcaaggcgacgctgacgctgatccaggtgctcgactgcgcggtggtgctggcggcggtcgcactcgccacctcagcgtttgcccgctccagcttcggccggcgctggcgcgccgtgtccgacgacccgcgcgccgccgccctgtgcggcgtcgacgtgcgcggcgtgttccgccatgccgtgctgctcggcggcttttgcgccgcgctggccggcgtcatggccagcctctactacggcaatgtcagcttcggttccggcctcgtctatggcctgaagatcctgttcgtgacggcggtcggcggctatctctcgccgccacgggcagcgcttggcgcggccgccttcggcatggccgaatcactgtgggccggttatttcccgatcgaatggcgcgatgcgtggatgtatctgttcctggtggccatgctgatcctcatcggcgccggtcgcgacaccggcaaggtcgtctga

SEQ ID NO: 27842 - protein, 301 aa, Rhizobium loti
MLYFFQQVLNGLHSGALYALLAFGYVLINGILHRTNLAYGALFAFSGQAMILSVAFGYQVLWLTLLVSVLFGVVAAFLYAALISHVLSRSVFEPLADRSPNAIVVTTLGILIVLSEASRIAADTHDLWLPPMLAQPIVFAEGAGFKATLTLIQVLDCAVVLAAVALATSAFARSSFGRRWRAVSDDPRAAALCGVDVRGVFRHAVLLGGFCAALAGVMASLYYGNVSFGSGLVYGLKILFVTAVGGYLSPPRAALGAAAFGMAESLWAGYFPIEWRDAWMYLFLVAMLILIGAGRDTGKVV

SEQ ID NO: 27843 - DNA, 882 bp, Rhizobium loti
  CDS (1)..(882)
atgcacttcggaccgcatctcctccttgccgccctcgaaggcctcgtcacatcagccgtgctggcgctgacggcgcttggactgtcgctggtgttcggcgtgatgcgggtggtcaacgtcgcgcatggcgagttcttcatgctgggcgccgtgctcgcctgggcaatcacatcagcaatcggcggccatccggcgctcggcttcctagcggcgctggtgatcgcgccgctgatcgtcggtgccattgcgctggtcgccgaacggctggtgttgcgccggctgaactacaatccggaagccaccatcgttgccaccatcggcatgctttacatcatccagcagctggcactgagcttctatggtcccgaagcgcggccggtggagccgccgttcagctaccgcatccttttgccgtggttcggctattccggctacaaactgtcgatcattgccgcctcggcgcttctcttgatcgctacatggctggtgctgacgcgcaccaggatcggcctgatcatgcgcgccacgcagtatgacagcgagacggcgcaagctttcggcattccggtcgaccgcgtctatggcggcgtcttcgcgctcggcgccatgctggcggcgatcgccgcggtgctgatcgtgccgatcagccaggcgcattacctgatggggcaggatccgctgctcttgtccttcatcgtcgtcatcatcggcggcctcggctcgctgcgcggcaccgtcgtcgccgccgtgctgatcggcctgtccgacggcatcatctcgatgttcttctcgccgaccttggccaagatgatcgccacgctgctggtcgccatggtgctggtgttccgcccgcaaggcctgttcgggacggcagcgcgatga

SEQ ID NO: 27844 - protein, 293 aa, Rhizobium loti
MHFGPHLLLAALEGLVTSAVLALTALGLSLVFGVMRVVNVAHGEFFMLGAVLAWAITSAIGGHPALGFLAALVIAPLIVGAIALVAERLVLRRLNYNPEATIVATIGMLYIIQQLALSFYGPEARPVEPPFSYRILLPWFGYSGYKLSIIAASALLLIATWLVLTRTRIGLIMRATQYDSETAQAFGIPVDRVYGGVFALGAMLAAIAAVLIVPISQAHYLMGQDPLLLSFIVVIIGGLGSLRGTVVAAVLIGLSDGIISMFFSPTLAKMIATLLVAMVLVFRPQGLFGTAAR

SEQ ID NO: 27845 - DNA, 963 bp, Rhizobium loti
  CDS (1)..(963)
atgagcgaagcttcgccggcaaaggcttatgcgctgcatctcggcgtcatcgcgctgctcttcgtgctgagcttcgttctgcccgaatactatcacggcctgctcgcccgcatcatggtgctggcggtgttcgccatgggctacaacatgctgttcggctatgtcggcctgctcagcctcggccatgccatgttcttcggcgccgggctttacggcgccggccttgccatcatccagctcggctggggcgtgcccctggccttcctcggcgggattgccagcggcgcggttctggcgctggtgatcggcctgctggcgttgcgcgccacgggcgtcgccttcatgatcgtcaccatgatgttcgcgcaggtgttttatctcctgatcctctacttcgcggcatggaccggcggcgatcagggccaggtcgtgccgcagccggcgcgcgccctcaatctcggcgcaacctcgctcgacctcaccaacccgaccgtgcgctacatgagcgcgctcgtgctgttctcgctcgtgcttctgctcacgctggccgtcgtccgctctcgctatggccgcgtgctcgtcgccatccgcgagaatgaggagcgcaccaagatgctgggctacgacaccttctccaacaagctcatcgccgtggtcgtctccggcacgatctgcgcggcgtcgggtgccgcctatgcgctgctgttcggctatgtcggctcgagcttcgcgtcggtgcagtattcgatcctgccgctgctgtgggtcttgctcggcggtgccgccacgacgctagggccgctgatcggcaccgtcttcatgtactatgtcatcgacgtctccagcggctacacctcggcctatctcctgatcgtcggcattgcgctcatcctgctggtgctgtttttcccgaaaggcattctcggcagcatccgccagcgctggctcgggtggctgccatga

SEQ ID NO: 27846 - protein, 320 aa, Rhizobium loti
MSEASPAKAYALHLGVIALLFVLSFVLPEYYHGLLARIMVLAVFAMGYNMLFGYVGLLSLGHAMFFGAGLYGAGLAIIQLGWGVPLAFLGGIASGAVLALVIGLLALRATGVAFMIVTMMFAQVFYLLILYFAAWTGGDQGQVVPQPARALNLGATSLDLTNPTVRYMSALVLFSLVLLLTLAVVRSRYGRVLVAIRENEERTKMLGYDTFSNKLIAVVVSGTICAASGAAYALLFGYVGSSFASVQYSILPLLWVLLGGAATTLGPLIGTVFMYYVIDVSSGYTSAYLLIVGIALILLVLFFPKGILGSIRQRWLGWLP

SEQ ID NO: 27847 - DNA, 867 bp, Agrobacterium tumefaciens
  CDS (1)..(867)
atggattttgctatcattcttttacttcagatcgcgattgcgatcgcgaccattattcttttcagcatcggtctcgctgtcgtgttcgggatgatgcgcgtcatcaatctcgcgcatggcgaattcatcatgctcggcgcgtatggtgcgctcaaaagctacgaggccggtctgaacctctgggtcggcatgctgatcgtcgcgccgcttgtctccgccatttacgggctcgtcgtcgagcgcatcctgatccggcgcctttacggccgtctgatcgatactctgttggcgacatgggggctgagtctttttacggtcggcatggtgacgatgatcttcggaaataccgccggaagcgtccccacgccattgtcgacgctacagatcggccagtacggccttggtatttacaatctgtttatcgtcgccatcacgggtgtcgtgcttctggcgatatacctcgtgctgaaacggaccaatctggggacgctcgcgcgcggcaccatgcaggatgccgatatggtggctgccctcggctataatccgaagacagtctacgctgcgaccttcgccataggcgcagccctcgcgggccttgccggtggattgcttgccccggtaaccggcatcattccgaccatgggggctgccttcgtggcgaaggccttcatcaccgtcatctccggcggcgcggcgatcatacttggtacagggtctacggccgcgatcttcggtgccatcaaccagatcgtgacattcgtttccacacctgttctcggtgaagctgcccttcttctggcggcgatattgcttttgcgcatgttgccgaatggcctgtccggacgctttttcaaagggggcgtataa

SEQ ID NO: 27848 - protein, 288 aa, Agrobacterium tumefaciens
MDFAIILLLQIAIAIATIILFSIGLAVVFGMMRVINLAHGEFIMLGAYGALKSYEAGLNLWVGMLIVAPLVSAIYGLVVERILIRRLYGRLIDTLLATWGLSLFTVGMVTMIFGNTAGSVPTPLSTLQIGQYGLGIYNLFIVAITGVVLLAIYLVLKRTNLGTLARGTMQDADMVAALGYNPKTVYAATFAIGAALAGLAGGLLAPVTGIIPTMGAAFVAKAFITVISGGAAIILGTGSTAAIFGAINQIVTFVSTPVLGEAALLLAAILLLRMLPNGLSGRFFKGGV

SEQ ID NO: 27849 - DNA, 1716 bp, Pseudomonas resinovorans
  CDS (1)..(1716)
atgggcgtcatcaacctggcccacggcgccttctacatggtcggcgcgttctgccggcctacaccgcgtcctgagcggctcgttctggctcgccgggttggcagcggatcatccgctcggccctatacgcgctgcttatcgaaaccagcatcatgcgccgcctctacaacagcgatcacctcgaccaggtactggcccaccctggcggtggtgttcttcaccaacgagttaatcaccgtgctgttcggccgcagcccaccggccatgcccacgcccgagtggtattcgagcttcgtcgaagtgctgccggggttgatgtacccggtcagccgcttgctgttcatcgccgccggggccgtggtggcgatcgccatgtggctgctgataaaccacacgcgcctgggcatgctgatccgcgccggggccgacgaccacgaaatggtcggcgccctgggggtgaacatcgcacgcctgtacaccctggtgttcgtgttcggctccgtgctttgcggcctcgccgggttcatggccgcacccttgctgtcggtggaaatcggcatgggtgaaaaggtcttgattaccaccttcgtggtcatcgtggtcggcggtgtcggctcggtgcgcggcgccctggccggggccttgctgatcggcatggtcgatggcctggggcgtgcctacatcccgcaattgctggaccaactgttgcccgccgaagtcagcggcaccctgagcggcgggctgatttccgccagcgcctacatcgtcatggccgtggtgttgctggtccgcccccgcggcctgctgcccgcccgtgccttgaggagaaccccatgttcccgtcgagtcctgatcgacctgctttgcctggcgacgttcgccctcctgccgctgctggcctcgctgctgcacgaaccctttctggtcagcctgtttacgcgcctggcgatctacggcatggccgccgccagcctggacctgctgatcggctatggcgcgatgattagcttcggccacgcggccttcttcggcctgggcggctacgtggtgggggtgatcggttttcacacctcccaggccttgccgctgtggggctgggacggttccaacagcgcgctgctcgtttggccgctgtcgctgctggtgtgtgcgctgtttgccgtggtggtgggctacctgtcgctgcgtaccagcggggtgcaattcatcatgattaccctggcgttcggccagatgctctatttcgtcctcagttcgctgtcgctgtatggcggcgacgacggcattttgctcagcgagcgcaacaccctgccgggcatcgacctggataacccggtgcagttctactacctgtgcctgggcctgttggtggcttggctgctgttctgccggcgcctggtcaattcgcgtttcggctacgtgctgcgcggcctcaagcaaagcgaacggcgcagcatcagcctgggcctgcacccgctgcgctatcgcctcggggcgtttgtcatcgccggtgtcggggggggcctggcgggcattctctgggccaactacgcgatgttcgtcagcccggacatgggcgcctggcacaagtccggcgaactgatggcgatggtcatcctcggcggcgtcggcaccctgctggggccggtcctcggcgccgccgtgtacctgggcctggaacagtgctcagcctgtggaccgagcactggctgctga

SEQ ID NO: 27850 - protein, 571 aa, Pseudomonas resinovorans
MGVINLAHGAFYMVGAFCRPTPRPERLVLARRVGSGSSARPYTRCLSKPASCAASTTAITSTRYWPTLAVVFFTNELITVLFGRSPPAMPTPEWYSSFVEVLPGLMYPVSRLLFIAAGAVVAIAMWLLINHTRLGMLIRAGADDHEMVGALGVNIARLYTLVFVFGSVLCGLAGFMAAPLLSVEIGMGEKVLITTFVVIVVGGVGSVRGALAGALLIGMVDGLGRAYIPQLLDQLLPAEVSGTLSGGLISASAYIVMAVVLLVRPRGLLPARALRRTPCSRRVLIDLLCLATFALLPLLASLLHEPFLVSLFTRLAIYGMAAASLDLLIGYGAMISFGHAAFFGLGGYVVGVIGFHTSQALPLWGWDGSNSALLVWPLSLLVCALFAVVVGYLSLRTSGVQFIMITLAFGQMLYFVLSSLSLYGGDDGILLSERNTLPGIDLDNPVQFYYLCLGLLVAWLLFCRRLVNSRFGYVLRGLKQSERRSISLGLHPLRYRLGAFVIAGVGGGLAGILWANYAMFVSPDMGAWHKSGELMAMVILGGVGTLLGPVLGAAVYLGLEQCSACGPSTGC

SEQ ID NO: 27851 - DNA, 873 bp, Streptomyces coelicolor
  CDS (1)..(873)
atgtcgcagttcttcgacttcaccctctccggactcggagccggcaccacctacgcactggtcgggcttggggtcgccctggtgtaccaagtcaccggcgtgatcaacttcgcgcagggcgacttcgtcatgctcggcgggctgggctgcgcggtgctgcacgaggcgggcacgcccctgtgggcggcggccctgaccgcgatcgccgccaccgctgccgtcggtgccctgctggatctcgtcgtcgtccgacgagcccgggacgccgacggcgaacggctcatcatcttgacgatcggcgcctcggtgacccttgagggcgcggcgctcctcgtgttcggccccgactcccacttcgtcccgtccttctccgagggccgcgcgttcgaggtgttcggcgcccatgtggtccgccagtacgtgtggtgcggggtggccactggggtggcggtcctgctgatgtggctgttcctcaccagaaccctgtggggcaccgcgatgcgcgccacggccatggagccggaggcggtccgcctcgtgggtgtctcgccggcccggatgagcctgctggcgttcaccctggccgcggcgctcggcgcgctcgccggagtgttcctggctccgctccagccgccggacgcgtccgtgggcatccccttcgggctcaagggcttcaccgcggcggtcatcggcggactcgtctccccggcgggtgccgtggccggcgggctgctggtcggactggtggaggcgttcgccaccggatatctcagcagcgagtacaaggacacgctcacctacgggctgctgctcgcggtgctgctgctgcggcccaccgggctgctgcgccgggcgtcggtggtgcgggtatga

SEQ ID NO: 27852 - protein, 290 aa, Streptomyces coelicolor
MSQFFDFTLSGLGAGTTYALVGLGVALVYQVTGVINFAQGDFVMLGGLGCAVLHEAGTPLWAAALTAIAATAAVGALLDLVVVRRARDADGERLIILTIGASVTLEGAALLVFGPDSHFVPSFSEGRAFEVFGAHVVRQYVWCGVATGVAVLLMWLFLTRTLWGTAMRATAMEPEAVRLVGVSPARMSLLAFTLAAALGALAGVFLAPLQPPDASVGIPFGLKGFTAAVIGGLVSPAGAVAGGLLVGLVEAFATGYLSSEYKDTLTYGLLLAVLLLRPTGLLRRASVVRV

SEQ ID NO: 27853 - DNA, 900 bp, Streptomyces coelicolor
  CDS (1)..(900)
atgaccggcttcctggacagtctgctgggcggcctcgcgctgggctccgtgtacgccctgatcgccctcggcttcgtcaccatcttcaaggcctccggagtcctgagcttcacccacggctcgctgctgctgctcggcgggtacctcgtcgccgtcctccacgacgacctcggcttcgccggggcactcgccgtcgcggtgctcgtgacggcggccgtggccggggccctggaccggctggtgctgcaacgcgtcggcgggagcgacccgcacgccgcccacgtccagaccatcgtcaccatcggcgtcgacatcgtcctggtcaccgacctcgcccggcgcatcggcggcgacctgctgccgctcggcgacccctggggctccgccgtgaccgacctcggcccggtgaccgtggccgacagccgcatcgccgcgatcctggtgtccgccgtcgccatcggcggcgccttcgccctcttccggtacaccccctggggcctgtcgctgcgcgcggcggccgaggaccgggaggccgccgccctcatgggcgtacgcctcacccgcgtacgcaccgccgcctggtgcctggccggcgccctcgccgccctcgccgccgtcttcctggtcgccttcccggcgcccggcctcgaacgcaccaccggccagatcgcgctgaaggccttccccgccgccatcctcggcggcatgacctccccggtcggcgccctggtcggcagcatgctgatcggcctcaccgaggcgttcgtcgccggttaccagtccgacctgcacgtcctcggcgagggcttcggcgacgtcgctccgtacgccgtgatggtgctggtgctgctggtgcgtccggccggactcttcgcggcgaagggagcggcccgtgtctga

SEQ ID NO: 27854 - protein, 299 aa, Streptomyces coelicolor
MTGFLDSLLGGLALGSVYALIALGFVTIFKASGVLSFTHGSLLLLGGYLVAVLHDDLGFAGALAVAVLVTAAVAGALDRLVLQRVGGSDPHAAHVQTIVTIGVDIVLVTDLARRIGGDLLPLGDPWGSAVTDLGPVTVADSRIAAILVSAVAIGGAFALFRYTPWGLSLRAAAEDREAAALMGVRLTRVRTAAWCLAGALAALAAVFLVAFPAPGLERTTGQIALKAFPAAILGGMTSPVGALVGSMLIGLTEAFVAGYQSDLHVLGEGFGDVAPYAVMVLVLLVRPAGLFAAKGAARV

SEQ ID NO: 27855 - DNA, 26 bp, Primer
atgtctgagcagtttttgtatttctt

SEQ ID NO: 27856 - DNA, 24 bp, Primer
ttatactttctctacctccgggcg

SEQ ID NO: 27857 - DNA, 5356 bp, Saccharomyces cerevisiae; identical to SEQ ID NO: 16132
  CDS (428)..(3355)

SEQ ID NO: 27858 - protein, 975 aa, Saccharomyces cerevisiae; identical to SEQ ID NO: 16133

SEQ ID NO: 27859 - DNA, 1053 bp, Arabidopsis thaliana; identical to SEQ ID NO: 16134
  CDS (1)..(1053)

SEQ ID NO: 27860 - protein, 350 aa, Arabidopsis thaliana; identical to SEQ ID NO: 16135

SEQ ID NO: 27861 - DNA, 1935 bp, Arabidopsis thaliana; identical to SEQ ID NO: 16136
  CDS (1)..(1905)

SEQ ID NO: 27862 - protein, 634 aa, Arabidopsis thaliana; identical to SEQ ID NO: 16137

SEQ ID NO: 27863 - DNA, 1132 bp, Arabidopsis thaliana; identical to SEQ ID NO: 16138
  CDS (1)..(1083)

SEQ ID NO: 27864 - protein, 360 aa, Arabidopsis thaliana; identical to SEQ ID NO: 16139

SEQ ID NO: 27865 - DNA, 900 bp, Arabidopsis thaliana; identical to SEQ ID NO: 16140
  CDS (1)..(900)

SEQ ID NO: 27866 - protein, 299 aa, Arabidopsis thaliana; identical to SEQ ID NO: 16141

SEQ ID NO: 27867 - DNA, 1219 bp, Pisum sativum; identical to SEQ ID NO: 16142
  CDS (68)..(952)

SEQ ID NO: 27868 - protein, 294 aa, Pisum sativum; identical to SEQ ID NO: 16143

SEQ ID NO: 27869 - DNA, 933 bp, Arabidopsis thaliana; identical to SEQ ID NO: 16144
  CDS (1)..(933)

SEQ ID NO: 27870 - protein, 310 aa, Arabidopsis thaliana; identical to SEQ ID NO: 16145

SEQ ID NO: 27871 - DNA, 1299 bp, Arabidopsis thaliana; identical to SEQ ID NO: 16146
  CDS (66)..(1124)

SEQ ID NO: 27872 - protein, 352 aa, Arabidopsis thaliana; identical to SEQ ID NO: 16147

SEQ ID NO: 27873 - DNA, 2841 bp, Saccharomyces cerevisiae; identical to SEQ ID NO: 16148
  CDS (1)..(2841)

SEQ ID NO: 27874 - protein, 946 aa, Saccharomyces cerevisiae; identical to SEQ ID NO: 16149

SEQ ID NO: 27875 - DNA, 2808 bp, Rattus norvegicus (Norway rat); identical to SEQ ID NO: 16150
  CDS (1)..(2808)

SEQ ID NO: 27876 - protein, 935 aa, Rattus norvegicus (Norway rat); identical to SEQ ID NO: 16151

SEQ ID NO: 27877 - DNA, 855 bp, Listeria innocua; identical to SEQ ID NO: 16152
  CDS (1)..(855)

SEQ ID NO: 27878 - protein, 284 aa, Listeria innocua; identical to SEQ ID NO: 16153

SEQ ID NO: 27879 - DNA, 1281 bp, Listeria monocytogenes; identical to SEQ ID NO: 16154
  CDS (1)..(1281)

SEQ ID NO: 27880 - protein, 426 aa, Listeria monocytogenes; identical to SEQ ID NO: 16155

SEQ ID NO: 27881 - DNA, 1800 bp, Vibrio cholerae; identical to SEQ ID NO: 16156
  CDS (1)..(1800)

SEQ ID NO: 27882 - protein, 599 aa, Vibrio cholerae; identical to SEQ ID NO: 16157

SEQ ID NO: 27883 - DNA, 1671 bp, Streptococcus pneumoniae; identical to SEQ ID NO: 16158
  CDS (1)..(1671)

SEQ ID NO: 27884 - protein, 556 aa, Streptococcus pneumoniae; identical to SEQ ID NO: 16159

SEQ ID NO: 27885 - DNA, 1629 bp, Thermotoga maritima; identical to SEQ ID NO: 16160
  CDS (1)..(1629)

SEQ ID NO: 27886 - protein, 542 aa, Thermotoga maritima; identical to SEQ ID NO: 16161

SEQ ID NO: 27887 - DNA, 1677 bp, Neisseria meningitidis; identical to SEQ ID NO: 16162
  CDS (1)..(1677)

SEQ ID NO: 27888 - protein, 558 aa, Neisseria meningitidis; identical to SEQ ID NO: 16163

SEQ ID NO: 27889 - DNA, 1923 bp, Caenorhabditis elegans; identical to SEQ ID NO: 16164
  CDS (1)..(1923)

SEQ ID NO: 27890 - protein, 640 aa, Caenorhabditis elegans; identical to SEQ ID NO: 16165

SEQ ID NO: 27891 - DNA, 1671 bp, Clostridium acetobutylicum; identical to SEQ ID NO: 16166
  CDS (1)..(1671)

SEQ ID NO: 27892 - protein, 556 aa, Clostridium acetobutylicum; identical to SEQ ID NO: 16167

SEQ ID NO: 27893 - DNA, 1668 bp, Lactococcus lactis subsp. lactis; identical to SEQ ID NO: 16168
  CDS (1)..(1668)

SEQ ID NO: 27894 - protein, 555 aa, Lactococcus lactis subsp. lactis; identical to SEQ ID NO: 16169

SEQ ID NO: 27895 - DNA, 1668 bp, Staphylococcus aureus; identical to SEQ ID NO: 16170
  CDS (1)..(1668)

SEQ ID NO: 27896 - protein, 555 aa, Staphylococcus aureus; identical to SEQ ID NO: 16171

SEQ ID NO: 27897 - DNA, 1894 bp, Clostridium cylindrosporum; identical to SEQ ID NO: 16172
  CDS (155)..(1825)

SEQ ID NO: 27898 - protein, 556 aa, Clostridium cylindrosporum; identical to SEQ ID NO: 16173

SEQ ID NO: 27899 - DNA, 3452 bp, Homo sapiens (man); identical to SEQ ID NO: 16174
  CDS (108)..(3044)

SEQ ID NO: 27900 - protein, 978 aa, Homo sapiens (man); identical to SEQ ID NO: 16175

SEQ ID NO: 27901 - DNA, 2802 bp, Spodoptera frugiperda (fall armyworm); identical to SEQ ID NO: 16176
  CDS (1)..(2802)

SEQ ID NO: 27902 - protein, 933 aa, Spodoptera frugiperda (fall armyworm); identical to SEQ ID NO: 16177

SEQ ID NO: 27903 - DNA, 2910 bp, Schizosaccharomyces pombe; identical to SEQ ID NO: 16178
  CDS (1)..(2910)

SEQ ID NO: 27904 - protein, 969 aa, Schizosaccharomyces pombe; identical to SEQ ID NO: 16179

SEQ ID NO: 27905 - DNA, 2814 bp, Schizosaccharomyces pombe; identical to SEQ ID NO: 16180
  CDS (1)..(2814)

SEQ ID NO: 27906 - protein, 937 aa, Schizosaccharomyces pombe; identical to SEQ ID NO: 16181

SEQ ID NO: 27907 - DNA, 1803 bp, Pseudomonas paucimobilis; identical to SEQ ID NO: 16182
  CDS (36)..(1709)

SEQ ID NO: 27908 - protein, 557 aa, Pseudomonas paucimobilis; identical to SEQ ID NO: 16183

SEQ ID NO: 27909 - DNA, 2835 bp, Candida glabrata; identical to SEQ ID NO: 16184
  CDS (1)..(2835)

SEQ ID NO: 27910 - protein, 944 aa, Candida glabrata; identical to SEQ ID NO: 16185

SEQ ID NO: 27911 - DNA, 2841 bp, Candida glabrata; identical to SEQ ID NO: 16186
  CDS (1)..(2841)

SEQ ID NO: 27912 - protein, 946 aa, Candida glabrata; identical to SEQ ID NO: 16187

SEQ ID NO: 27913 - DNA, 900 bp, Bartonella quintana str; identical to SEQ ID NO: 16188
  CDS (1)..(900)

SEQ ID NO: 27914 - protein, 299 aa, Bartonella quintana str; identical to SEQ ID NO: 16189

SEQ ID NO: 27915 - DNA, 846 bp, uncultured bacterium; identical to SEQ ID NO: 16190
  CDS (1)..(846)

SEQ ID NO: 27916 - protein, 281 aa, uncultured bacterium; identical to SEQ ID NO: 16191

SEQ ID NO: 27917 - DNA, 1608 bp, Picrophilus torridus DSM 9790; identical to SEQ ID NO: 16192
  CDS (1)..(1608)

SEQ ID NO: 27918 - protein, 535 aa, Picrophilus torridus DSM 9790; identical to SEQ ID NO: 16193

SEQ ID NO: 27919 - DNA, 1755 bp, Photobacterium profundum; identical to SEQ ID NO: 16194
  CDS (1)..(1755)

SEQ ID NO: 27920 - protein, 584 aa, Photobacterium profundum; identical to SEQ ID NO: 16195

SEQ ID NO: 27921 - DNA, 1653 bp, Corynebacterium diphtheriae; identical to SEQ ID NO: 16196
  CDS (1)..(1653)

SEQ ID NO: 27922 - protein, 550 aa, Corynebacterium diphtheriae; identical to SEQ ID NO: 16197

SEQ ID NO: 27923 - DNA, 1683 bp, Listeria monocytogenes str; identical to SEQ ID NO: 16198
  CDS (1)..(1683)

SEQ ID NO: 27924 - protein, 560 aa, Listeria monocytogenes str; identical to SEQ ID NO: 16199

SEQ ID NO: 27925 - DNA, 1632 bp, Thermus thermophilus; identical to SEQ ID NO: 16200
  CDS (1)..(1632)

SEQ ID NO: 27926 - protein, 543 aa, Thermus thermophilus; identical to SEQ ID NO: 16201

SEQ ID NO: 27927 - DNA, 1689 bp, Bacillus cereus; identical to SEQ ID NO: 16202
  CDS (1)..(1689)

SEQ ID NO: 27928 - protein, 562 aa, Bacillus cereus; identical to SEQ ID NO: 16203

SEQ ID NO: 27929 - DNA, 879 bp, Wolbachia pipientis wMel; identical to SEQ ID NO: 16204
  CDS (1)..(879)

SEQ ID NO: 27930 - protein, 292 aa, Wolbachia pipientis wMel; identical to SEQ ID NO: 16205

SEQ ID NO: 27931 - DNA, 1665 bp, Treponema denticola; identical to SEQ ID NO: 16206
  CDS (1)..(1665)

SEQ ID NO: 27932 - protein, 554 aa, Treponema denticola; identical to SEQ ID NO: 16207

SEQ ID NO: 27933 - DNA, 882 bp, Treponema denticola; identical to SEQ ID NO: 16208
  CDS (1)..(882)

SEQ ID NO: 27934 - protein, 293 aa, Treponema denticola; identical to SEQ ID NO: 16209

SEQ ID NO: 27935 - DNA, 858 bp, Geobacter sulfurreducens; identical to SEQ ID NO: 16210
  CDS (1)..(858)

SEQ ID NO: 27936 - protein, 285 aa, Geobacter sulfurreducens; identical to SEQ ID NO: 16211

SEQ ID NO: 27937 - DNA, 1674 bp, Lactobacillus johnsonii; identical to SEQ ID NO: 16212
  CDS (1)..(1674)

SEQ ID NO: 27938 - protein, 557 aa, Lactobacillus johnsonii; identical to SEQ ID NO: 16213

SEQ ID NO: 27939 - DNA, 2898 bp, Ashbya gossypii; identical to SEQ ID NO: 16214
  CDS (1)..(2898)

SEQ ID NO: 27940 - protein, 965 aa, Ashbya gossypii; identical to SEQ ID NO: 16215

SEQ ID NO: 27941 - DNA, 2820 bp, Ashbya gossypii; identical to SEQ ID NO: 16216
  CDS (1)..(2820)

SEQ ID NO: 27942 - protein, 939 aa, Ashbya gossypii; identical to SEQ ID NO: 16217

SEQ ID NO: 27943 - DNA, 1674 bp, Streptococcus pyogenes SSI; identical to SEQ ID NO: 16218
  CDS (1)..(1674)

SEQ ID NO: 27944 - protein, 557 aa, Streptococcus pyogenes SSI; identical to SEQ ID NO: 16219

SEQ ID NO: 27945 - DNA, 1749 bp, Vibrio vulnificus; identical to SEQ ID NO: 16220
  CDS (1)..(1749)

SEQ ID NO: 27946 - protein, 582 aa, Vibrio vulnificus; identical to SEQ ID NO: 16221

SEQ ID NO: 27947 - DNA, 1668 bp, Porphyromonas gingivalis W83; identical to SEQ ID NO: 16222
  CDS (1)..(1668)

SEQ ID NO: 27948 - protein, 555 aa, Porphyromonas gingivalis W83; identical to SEQ ID NO: 16223

SEQ ID NO: 27949 - DNA, 2826 bp, Neurospora crassa; identical to SEQ ID NO: 16224
  CDS (1)..(2826)

SEQ ID NO: 27950 - protein, 941 aa, Neurospora crassa; identical to SEQ ID NO: 16225

SEQ ID NO: 27951 - DNA, 1671 bp, Haemophilus ducreyi 35000HP; identical to SEQ ID NO: 16226
  CDS (1)..(1671)

SEQ ID NO: 27952 - protein, 556 aa, Haemophilus ducreyi 35000HP; identical to SEQ ID NO: 16227

SEQ ID NO: 27953 - DNA, 1671 bp, Enterococcus faecalis V583; identical to SEQ ID NO: 16228
  CDS (1)..(1671)

SEQ ID NO: 27954 - protein, 556 aa, Enterococcus faecalis V583; identical to SEQ ID NO: 16229

SEQ ID NO: 27955 - DNA, 846 bp, Enterococcus faecalis V583; identical to SEQ ID NO: 16230
  CDS (1)..(846)

SEQ ID NO: 27956 - protein, 281 aa, Enterococcus faecalis V583; identical to SEQ ID NO: 16231

SEQ ID NO: 27957 - DNA, 2186 bp, Methylobacterium extorquens; identical to SEQ ID NO: 16232
  CDS (301)..(1974)

SEQ ID NO: 27958 - protein, 557 aa, Methylobacterium extorquens; identical to SEQ ID NO: 16233

SEQ ID NO: 27959 - DNA, 1749 bp, Vibrio parahaemolyticus; identical to SEQ ID NO: 16234
  CDS (1)..(1749)

SEQ ID NO: 27960 - protein, 582 aa, Vibrio parahaemolyticus; identical to SEQ ID NO: 16235

SEQ ID NO: 27961 - DNA, 1656 bp, Lactobacillus plantarum; identical to SEQ ID NO: 16236
  CDS (1)..(1656)

SEQ ID NO: 27962 - protein, 551 aa, Lactobacillus plantarum; identical to SEQ ID NO: 16237

SEQ ID NO: 27963 - DNA, 1680 bp, Clostridium tetani; identical to SEQ ID NO: 16238
  CDS (1)..(1680)

SEQ ID NO: 27964 - protein, 559 aa, Clostridium tetani; identical to SEQ ID NO: 16239

SEQ ID NO: 27965 - DNA, 1668 bp, Bacteroides thetaiotaomicron VPI; identical to SEQ ID NO: 16240
  CDS (1)..(1668)

SEQ ID NO: 27966 - protein, 555 aa, Bacteroides thetaiotaomicron VPI; identical to SEQ ID NO: 16241

SEQ ID NO: 27967 - DNA, 1668 bp, Staphylococcus epidermidis ATCC 12228; identical to SEQ ID NO: 16242
  CDS (1)..(1668)

SEQ ID NO: 27968 - protein, 555 aa, Staphylococcus epidermidis ATCC 12228; identical to SEQ ID NO: 16243

SEQ ID NO: 27969 - DNA, 1671 bp, Streptococcus agalactiae 2603V; identical to SEQ ID NO: 16244
  CDS (1)..(1671)

SEQ ID NO: 27970 - protein, 556 aa, Streptococcus agalactiae 2603V; identical to SEQ ID NO: 16245

SEQ ID NO: 27971 - DNA, 1713 bp, Shewanella oneidensis; identical to SEQ ID NO: 16246
  CDS (1)..(1713)

SEQ ID NO: 27972 - protein, 570 aa, Shewanella oneidensis; identical to SEQ ID NO: 16247

SEQ ID NO: 27973 - DNA, 3061 bp, Mus musculus; identical to SEQ ID NO: 16248
  CDS (247)..(2448)

SEQ ID NO: 27974 - protein, 733 aa, Mus musculus; identical to SEQ ID NO: 16249

SEQ ID NO: 27975 - DNA, 1671 bp, Streptococcus pyogenes; identical to SEQ ID NO: 16250
  CDS (1)..(1671)

SEQ ID NO: 27976 - protein, 556 aa, Streptococcus pyogenes; identical to SEQ ID NO: 16251

SEQ ID NO: 27977 - DNA, 1668 bp, Thermoanaerobacter tengcongensis; identical to SEQ ID NO: 16252
  CDS (1)..(1668)

SEQ ID NO: 27978 - protein, 555 aa, Thermoanaerobacter tengcongensis; identical to SEQ ID NO: 16253

SEQ ID NO: 27979 - DNA, 1635 bp, Fusobacterium nucleatum; identical to SEQ ID NO: 16254
  CDS (1)..(1635)

SEQ ID NO: 27980 - protein, 544 aa, Fusobacterium nucleatum; identical to SEQ ID NO: 16255

SEQ ID NO: 27981 - DNA, 3452 bp, Homo sapiens; identical to SEQ ID NO: 16174
  CDS (843)..(3044)

SEQ ID NO: 27982 - protein, 733 aa, Homo sapiens; identical to SEQ ID NO: 16257

SEQ ID NO: 27983 - DNA, 1671 bp, Clostridium perfringens str; identical to SEQ ID NO: 16258
  CDS (1)..(1671)

SEQ ID NO: 27984 - protein, 556 aa, Clostridium perfringens str; identical to SEQ ID NO: 16259

SEQ ID NO: 27985 - DNA, 1707 bp, Rhizobium meliloti; identical to SEQ ID NO: 16260
  CDS (1)..(1707)

SEQ ID NO: 27986 - protein, 568 aa, Rhizobium meliloti; identical to SEQ ID NO: 16261

SEQ ID NO: 27987 - DNA, 1611 bp, Thermoplasma volcanium; identical to SEQ ID NO: 16262
  CDS (1)..(1611)

SEQ ID NO: 27988 - protein, 536 aa, Thermoplasma volcanium; identical to SEQ ID NO: 16263

SEQ ID NO: 27989 - DNA, 1680 bp, Rhizobium loti; identical to SEQ ID NO: 16264
  CDS (1)..(1680)

SEQ ID NO: 27990 - protein, 559 aa, Rhizobium loti; identical to SEQ ID NO: 16265

SEQ ID NO: 27991 - DNA, 4160 bp, Yarrowia lipolytica; identical to SEQ ID NO: 16266
  CDS (180)..(2993)

SEQ ID NO: 27992 - protein, 937 aa, Yarrowia lipolytica; identical to SEQ ID NO: 16267

SEQ ID NO: 27993 - DNA, 1611 bp, Thermoplasma acidophilum; identical to SEQ ID NO: 16268
  CDS (1)..(1611)

SEQ ID NO: 27994 - protein, 536 aa, Thermoplasma acidophilum; identical to SEQ ID NO: 16269

SEQ ID NO: 27995 - DNA, 2808 bp, Homo sapiens; identical to SEQ ID NO: 16270
  CDS (1)..(2808)

SEQ ID NO: 27996 - protein, 935 aa, Homo sapiens [sequence omitted]

SEQ ID NO: 27997 - DNA, 1914 bp, Spinacia oleracea; identical to SEQ ID NO: 16272
  CDS (1)..(1914)

SEQ ID NO: 27998 - protein, 637 aa, Spinacia oleracea; identical to SEQ ID NO: 16273

SEQ ID NO: 27999 - DNA, 1671 bp, Streptococcus mutans; identical to SEQ ID NO: 16274
  CDS (1)..(1671)

SEQ ID NO: 28000 - protein, 556 aa, Streptococcus mutans; identical to SEQ ID NO: 16275

SEQ ID NO: 28001 - DNA, 3003 bp, Drosophila melanogaster; identical to SEQ ID NO: 16276
  CDS (199)..(3003)

SEQ ID NO: 28002 - protein, 934 aa, Drosophila melanogaster; identical to SEQ ID NO: 16277

SEQ ID NO: 28003 - DNA, 1358 bp, Oryza sativa; identical to SEQ ID NO: 16278
  CDS (32)..(1219)

SEQ ID NO: 28004 - protein, 395 aa, Oryza sativa; identical to SEQ ID NO: 16279

SEQ ID NO: 28005 - DNA, 876 bp, Oryza sativa; identical to SEQ ID NO: 16280
  CDS (1)..(876)

SEQ ID NO: 28006 - protein, 291 aa, Oryza sativa; identical to SEQ ID NO: 16281

SEQ ID NO: 28007 - DNA, 26 bp, Primer
atgttgtcgagactatctttattgag

SEQ ID NO: 28008 - DNA, 26 bp, Primer
ttaaaatagaccttcaatttcaccgt

SEQ ID NO: 28009 - DNA, 432 bp, Saccharomyces cerevisiae; identical to SEQ ID NO: 6880
  CDS (1)..(432)

SEQ ID NO: 28010 - protein, 143 aa, Saccharomyces cerevisiae; identical to SEQ ID NO: 6881

SEQ ID NO: 28011 - DNA, 309 bp, Arabidopsis thaliana (mouse-ear cress); identical to SEQ ID NO: 6882
  CDS (1)..(309)

SEQ ID NO: 28012 - protein, 102 aa, Arabidopsis thaliana (mouse-ear cress); identical to SEQ ID NO: 6883

SEQ ID NO: 28013 - DNA, 501 bp, Brucella melitensis; identical to SEQ ID NO: 6884
  CDS (28)..(306)

SEQ ID NO: 28014 - protein, 92 aa, Brucella melitensis; identical to SEQ ID NO: 6885

SEQ ID NO: 28015 - DNA, 324 bp, Nostoc sp. PCC 7120; identical to SEQ ID NO: 6886
  CDS (1)..(324)

SEQ ID NO: 28016 - protein, 107 aa, Nostoc sp. PCC 7120; identical to SEQ ID NO: 6887

SEQ ID NO: 28017 - DNA, 309 bp, Arabidopsis thaliana (mouse-ear cress); identical to SEQ ID NO: 6888
  CDS (1)..(309)

SEQ ID NO: 28018 - protein, 102 aa, Arabidopsis thaliana (mouse-ear cress); identical to SEQ ID NO: 6889

SEQ ID NO: 28019 - DNA, 540 bp, Arabidopsis thaliana (mouse-ear cress); identical to SEQ ID NO: 6890
  CDS (1)..(540)

SEQ ID NO: 28020 - protein, 179 aa, Arabidopsis thaliana (mouse-ear cress); identical to SEQ ID NO: 6891

SEQ ID NO: 28021 - DNA, 327 bp, vaccinia virus; identical to SEQ ID NO: 6892
  CDS (1)..(327)

SEQ ID NO: 28022 - protein, 108 aa, vaccinia virus; identical to SEQ ID NO: 6893

SEQ ID NO: 28023 - DNA, 312 bp, Arabidopsis thaliana (mouse-ear cress); identical to SEQ ID NO: 6894
  CDS (1)..(312)

SEQ ID NO: 28024 - protein, 103 aa, Arabidopsis thaliana (mouse-ear cress); identical to SEQ ID NO: 6895

SEQ ID NO: 28025 - DNA, 309 bp, Arabidopsis thaliana (mouse-ear cress); identical to SEQ ID NO: 6896
  CDS (1)..(309)

SEQ ID NO: 28026 - protein, 102 aa, Arabidopsis thaliana (mouse-ear cress); identical to SEQ ID NO: 6897

SEQ ID NO: 28027 - DNA, 309 bp, Arabidopsis thaliana (mouse-ear cress); identical to SEQ ID NO: 6898
  CDS (1)..(309)

SEQ ID NO: 28028 - protein, 102 aa, Arabidopsis thaliana (mouse-ear cress); identical to SEQ ID NO: 6899

SEQ ID NO: 28029 - DNA, 393 bp, Arabidopsis thaliana (mouse-ear cress); identical to SEQ ID NO: 6900
  CDS (1)..(393)

SEQ ID NO: 28030 - protein, 130 aa, Arabidopsis thaliana (mouse-ear cress); identical to SEQ ID NO: 6901

SEQ ID NO: 28031 - DNA, 589 bp, Bos primigenius taurus (cattle); identical to SEQ ID NO: 6902
  CDS (36)..(356)

SEQ ID NO: 28032 - protein, 106 aa, Bos primigenius taurus (cattle); identical to SEQ ID NO: 6903

SEQ ID NO: 28033 - DNA, 309 bp, Arabidopsis thaliana (mouse-ear cress); identical to SEQ ID NO: 6904
  CDS (1)..(309)

SEQ ID NO: 28034 - protein, 102 aa, Arabidopsis thaliana (mouse-ear cress); identical to SEQ ID NO: 6905

SEQ ID NO: 28035 - DNA, 309 bp, Arabidopsis thaliana (mouse-ear cress); identical to SEQ ID NO: 6906
  CDS (1)..(309)

SEQ ID NO: 28036 - protein, 102 aa, Arabidopsis thaliana (mouse-ear cress); identical to SEQ ID NO: 6907

SEQ ID NO: 28037 - DNA, 575 bp, Oryza sativa (rice); identical to SEQ ID NO: 6908
  CDS (45)..(383)

SEQ ID NO: 28038 - protein, 112 aa, Oryza sativa (rice); identical to SEQ ID NO: 6909

SEQ ID NO: 28039 - DNA, 333 bp, Saccharomyces cerevisiae; identical to SEQ ID NO: 6910
  CDS (1)..(333)

SEQ ID NO: 28040 - protein, 110 aa, Saccharomyces cerevisiae; identical to SEQ ID NO: 6911

SEQ ID NO: 28041 - DNA, 612 bp, Saccharomyces cerevisiae; identical to SEQ ID NO: 6912
  CDS (1)..(612)

SEQ ID NO: 28042 - protein, 203 aa, Saccharomyces cerevisiae; identical to SEQ ID NO: 6913

SEQ ID NO: 28043 - DNA, 321 bp, Homo sapiens (man); identical to SEQ ID NO: 6914
  CDS (1)..(321)

SEQ ID NO: 28044 - protein, 106 aa, Homo sapiens (man); identical to SEQ ID NO: 6915

SEQ ID NO: 28045 - DNA, 583 bp, Ricinus communis (castor bean); identical to SEQ ID NO: 6916
  CDS (44)..(352)

SEQ ID NO: 28046 - protein, 102 aa, Ricinus communis (castor bean); identical to SEQ ID NO: 6917

SEQ ID NO: 28047 - DNA, 531 bp, Arabidopsis thaliana (mouse-ear cress); identical to SEQ ID NO: 6918
  CDS (1)..(531)

SEQ ID NO: 28048 - protein, 176 aa, Arabidopsis thaliana (mouse-ear cress); identical to SEQ ID NO: 6919

SEQ ID NO: 28049 - DNA, 698 bp, Mesembryanthemum crystallinum (common ice plant); identical to SEQ ID NO: 6920
  CDS (60)..(464)

SEQ ID NO: 28050 - protein, 134 aa, Mesembryanthemum crystallinum (common ice plant); identical to SEQ ID NO: 6921

SEQ ID NO: 28051 - DNA, 441 bp, Caenorhabditis elegans; identical to SEQ ID NO: 6922
  CDS (1)..(441)

SEQ ID NO: 28052 - protein, 146 aa, Caenorhabditis elegans; identical to SEQ ID NO: 6923

SEQ ID NO: 28053 - DNA, 361 bp, Schizosaccharomyces pombe; identical to SEQ ID NO: 6924
  CDS (24)..(329)

SEQ ID NO: 28054 - protein, 101 aa, Schizosaccharomyces pombe; identical to SEQ ID NO: 6925

SEQ ID NO: 28055 - DNA, 501 bp, Schizosaccharomyces pombe; identical to SEQ ID NO: 6926
  CDS (1)..(501)

SEQ ID NO: 28056 - protein, 166 aa, Schizosaccharomyces pombe; identical to SEQ ID NO: 6927

SEQ ID NO: 28057 - DNA, 309 bp, Arabidopsis thaliana (mouse-ear cress); identical to SEQ ID NO: 6928
  CDS (1)..(309)

SEQ ID NO: 28058 - protein, 102 aa, Arabidopsis thaliana (mouse-ear cress); identical to SEQ ID NO: 6929

SEQ ID NO: 28059 - DNA, 312 bp, Arabidopsis thaliana (mouse-ear cress); identical to SEQ ID NO: 6930
  CDS (1)..(312)

SEQ ID NO: 28060 - protein, 103 aa, Arabidopsis thaliana (mouse-ear cress); identical to SEQ ID NO: 6931

SEQ ID NO: 28061 - DNA, 391 bp, Arabidopsis thaliana (mouse-ear cress); identical to SEQ ID NO: 6932
  CDS (33)..(341)

SEQ ID NO: 28062 - protein, 102 aa, Arabidopsis thaliana (mouse-ear cress); identical to SEQ ID NO: 6933

SEQ ID NO: 28063 - DNA, 330 bp, Neurospora crassa; identical to SEQ ID NO: 6934
  CDS (1)..(330)

SEQ ID NO: 28064 - protein, 109 aa, Neurospora crassa; identical to SEQ ID NO: 6935

SEQ ID NO: 28065 - DNA, 533 bp, Fritillaria agrestis; identical to SEQ ID NO: 6936
  CDS (39)..(353)

SEQ ID NO: 28066 - protein, 104 aa, Fritillaria agrestis; identical to SEQ ID NO: 6937

SEQ ID NO: 28067 - DNA, 330 bp, Plasmodium yoelii yoelii; identical to SEQ ID NO: 6938
  CDS (1)..(330): m means a or c

SEQ ID NO: 28068 - protein, 109 aa, Plasmodium yoelii yoelii; identical to SEQ ID NO: 6939
  misc_feature (54)..(54): Xaa can be Asn or His

SEQ ID NO: 28069 - DNA, 294 bp, Bordetella bronchiseptica; identical to SEQ ID NO: 6940
  CDS (1)..(294)

SEQ ID NO: 28070 - protein, 97 aa, Bordetella bronchiseptica; identical to SEQ ID NO: 6941

SEQ ID NO: 28071 - DNA, 342 bp, Triticum aestivum; identical to SEQ ID NO: 6942
  CDS (1)..(342)

SEQ ID NO: 28072 - protein, 113 aa, Triticum aestivum; identical to SEQ ID NO: 6943

SEQ ID NO: 28073 - DNA, 324 bp, Aphelenchus avenae; identical to SEQ ID NO: 6944
  CDS (1)..(324)

SEQ ID NO: 28074 - protein, 107 aa, Aphelenchus avenae; identical to SEQ ID NO: 6945

SEQ ID NO: 28075 - DNA, 327 bp, Cowpox virus; identical to SEQ ID NO: 6946
  CDS (1)..(327)

SEQ ID NO: 28076 - protein, 108 aa, Cowpox virus; identical to SEQ ID NO: 6947

SEQ ID NO: 28077 - DNA, 495 bp, Oryza sativa; identical to SEQ ID NO: 6948
  CDS (1)..(495)

SEQ ID NO: 28078 - protein, 164 aa, Oryza sativa; identical to SEQ ID NO: 6949

SEQ ID NO: 28079 - DNA, 270 bp, Vibrio vulnificus; identical to SEQ ID NO: 6950
  CDS (1)..(270)

SEQ ID NO: 28080 - protein, 89 aa, Vibrio vulnificus; identical to SEQ ID NO: 6951

SEQ ID NO: 28081 - DNA, 525 bp, Arabidopsis thaliana; identical to SEQ ID NO: 6952
  CDS (1)..(525)

SEQ ID NO: 28082 - protein, 174 aa, Arabidopsis thaliana; identical to SEQ ID NO: 6953

SEQ ID NO: 28083 - DNA, 608 bp, Arabidopsis thaliana; identical to SEQ ID NO: 6954
  CDS (68)..(445)

SEQ ID NO: 28084 - protein, 125 aa, Arabidopsis thaliana; identical to SEQ ID NO: 6955

SEQ ID NO: 28085 - DNA, 340 bp, Arabidopsis thaliana; identical to SEQ ID NO: 6956
  CDS (1)..(309)

SEQ ID NO: 28086 - protein, 102 aa, Arabidopsis thaliana; identical to SEQ ID NO: 6957

SEQ ID NO: 28087 - DNA, 618 bp, Arabidopsis thaliana; identical to SEQ ID NO: 6958
  CDS (54)..(461)

SEQ ID NO: 28088 - protein, 135 aa, Arabidopsis thaliana; identical to SEQ ID NO: 6959

SEQ ID NO: 28089 - DNA, 420 bp, Populus tremula x Populus tremuloides; identical to SEQ ID NO: 6960
  CDS (1)..(420)

SEQ ID NO: 28090 - protein, 139 aa, Populus tremula x Populus tremuloides; identical to SEQ ID NO: 6961

SEQ ID NO: 28091 - DNA, 664 bp, Mus musculus; identical to SEQ ID NO: 6962
  CDS (37)..(507)

SEQ ID NO: 28092 - protein, 156 aa, Mus musculus; identical to SEQ ID NO: 6963

SEQ ID NO: 28093 - DNA, 508 bp, Tilia platyphyllos; identical to SEQ ID NO: 6964
  CDS (28)..(375)

SEQ ID NO: 28094 - protein, 115 aa, Tilia platyphyllos; identical to SEQ ID NO: 6965

SEQ ID NO: 28095 - DNA, 604 bp, Deschampsia antarctica; identical to SEQ ID NO: 6966
  CDS (85)..(426)

SEQ ID NO: 28096 - protein, 113 aa, Deschampsia antarctica; identical to SEQ ID NO: 6967

SEQ ID NO: 28097 - DNA, 327 bp, Plasmodium berghei; identical to SEQ ID NO: 6968
  CDS (1)..(327)

SEQ ID NO: 28098 - protein, 108 aa, Plasmodium berghei; identical to SEQ ID NO: 6969

SEQ ID NO: 28099 - DNA, 498 bp, Homo sapiens; identical to SEQ ID NO: 6970
  CDS (1)..(498)

SEQ ID NO: 28100 - protein, 165 aa, Homo sapiens; identical to SEQ ID NO: 6971

SEQ ID NO: 28101 - DNA, 456 bp, Theileria parva; identical to SEQ ID NO: 6972
  CDS (1)..(456)

SEQ ID NO: 28102 - protein, 151 aa, Theileria parva; identical to SEQ ID NO: 6973

SEQ ID NO: 28103 - DNA, 336 bp, Arabidopsis thaliana; identical to SEQ ID NO: 6974
  CDS (1)..(336)

SEQ ID NO: 28104 - protein, 111 aa, Arabidopsis thaliana; identical to SEQ ID NO: 6975

SEQ ID NO: 28105 - DNA, 383 bp, Mus musculus; identical to SEQ ID NO: 6976
  CDS (15)..(383)

SEQ ID NO: 28106 - protein, 122 aa, Mus musculus; identical to SEQ ID NO: 6977

SEQ ID NO: 28107 - DNA, 318 bp, Caenorhabditis elegans; identical to SEQ ID NO: 6978
  CDS (1)..(318)

SEQ ID NO: 28108 - protein, 105 aa, Caenorhabditis elegans; identical to SEQ ID NO: 6979

SEQ ID NO: 28109 - DNA, 324 bp, Trypanosoma brucei; identical to SEQ ID NO: 6980
  CDS (1)..(324)

SEQ ID NO: 28110 - protein, 107 aa, Trypanosoma brucei; identical to SEQ ID NO: 6981

SEQ ID NO: 28111 - DNA, 336 bp, Plasmodium falciparum; identical to SEQ ID NO: 6982
  CDS (1)..(336)

SEQ ID NO: 28112 - protein, 111 aa, Plasmodium falciparum; identical to SEQ ID NO: 6983

SEQ ID NO: 28113 - DNA, 654 bp, Homo sapiens; identical to SEQ ID NO: 6984
  CDS (11)..(505)

SEQ ID NO: 28114 - protein, 164 aa, Homo sapiens; identical to SEQ ID NO: 6985

SEQ ID NO: 28115 - DNA, 478 bp, Drosophila melanogaster; identical to SEQ ID NO: 6986
  CDS (48)..(392)

SEQ ID NO: 28116 - protein, 114 aa, Drosophila melanogaster; identical to SEQ ID NO: 6987

SEQ ID NO: 28117 - DNA, 351 bp, Drosophila melanogaster; identical to SEQ ID NO: 6988
  CDS (1)..(351)

SEQ ID NO: 28118 - protein, 116 aa, Drosophila melanogaster; identical to SEQ ID NO: 6989

SEQ ID NO: 28119 - DNA, 644 bp, Homo sapiens; identical to SEQ ID NO: 6990
  CDS (26)..(481)

SEQ ID NO: 28120 - protein, 151 aa, Homo sapiens; identical to SEQ ID NO: 6991

SEQ ID NO: 28121 - DNA, 572 bp, Gallus gallus; identical to SEQ ID NO: 6992
  CDS (47)..(352)

SEQ ID NO: 28122 - protein, 101 aa, Gallus gallus; identical to SEQ ID NO: 6993

SEQ ID NO: 28123 - DNA, 321 bp, Homo sapiens; identical to SEQ ID NO: 6994
  CDS (1)..(321)

SEQ ID NO: 28124 - protein, 106 aa, Homo sapiens; identical to SEQ ID NO: 6915

SEQ ID NO: 28125 - DNA, 531 bp, Lycopersicon esculentum; identical to SEQ ID NO: 6996
  CDS (45)..(371)

SEQ ID NO: 28126 - protein, 108 aa, Lycopersicon esculentum; identical to SEQ ID NO: 6997

SEQ ID NO: 28127 - DNA, 473 bp, Mus musculus; identical to SEQ ID NO: 6998
  CDS (9)..(332)

SEQ ID NO: 28128 - protein, 107 aa, Mus musculus; identical to SEQ ID NO: 6999

SEQ ID NO: 28129 - DNA, 575 bp, Sus scrofa; identical to SEQ ID NO: 7000
  CDS (24)..(344)

SEQ ID NO: 28130 - protein, 106 aa, Sus scrofa; identical to SEQ ID NO: 7001

SEQ ID NO: 28131 - DNA, 432 bp, Saccharomyces cerevisiae; identical to SEQ ID NO: 6880
  CDS (1)..(432)

SEQ ID NO: 28132 - protein, 143 aa, Saccharomyces cerevisiae; identical to SEQ ID NO: 6881

SEQ ID NO: 28133 - DNA, 441 bp, Caenorhabditis elegans; identical to SEQ ID NO: 6922
  CDS (1)..(441)

SEQ ID NO: 28134 - protein, 146 aa, Caenorhabditis elegans; identical to SEQ ID NO: 6923

SEQ ID NO: 28135 - DNA, 324 bp, Rattus norvegicus; identical to SEQ ID NO: 7006
  CDS (1)..(324)

SEQ ID NO: 28136 - protein, 107 aa, Rattus norvegicus; identical to SEQ ID NO: 7007

SEQ ID NO: 28137 - DNA, 378 bp, Arabidopsis thaliana; identical to SEQ ID NO: 7008
  CDS (1)..(378)

SEQ ID NO: 28138 - protein, 125 aa, Arabidopsis thaliana; identical to SEQ ID NO: 7009

SEQ ID NO: 28139 - DNA, 651 bp, Ashbya gossypii; identical to SEQ ID NO: 7010
  CDS (1)..(651)

SEQ ID NO: 28140 - protein, 216 aa, Ashbya gossypii; identical to SEQ ID NO: 7011

SEQ ID NO: 28141 - DNA, 336 bp, Ashbya gossypii; identical to SEQ ID NO: 7012
  CDS (1)..(336)

SEQ ID NO: 28142 - protein, 111 aa, Ashbya gossypii; identical to SEQ ID NO: 7013

SEQ ID NO: 28143 - DNA, 25 bp, Primer
atggagaccaatttttccttcgact

SEQ ID NO: 28144 - DNA, 26 bp, Primer
ctattgaaataccggcttcaatattt

SEQ ID NO: 28145 - DNA, 1321 bp, Saccharomyces cerevisiae
  CDS (228)..(1025)
ataattcattgtatgtaaccatcaaattcgttatttagcaatcttacccggaaaacttcttgtatcgtaacattaattctcccttacaaggggacctcgatgaataaataaagtgtttgtgttgaaggtacttgcaaaagggcaactcactgtcgtttataatttgatttactaatcgcatctgtatttggaaaagcatttctttttggaagaggaacaagaacgccatgtcagcagacgaaacggatgcgaaatttcatccattagaaacagatctgcaatctgatacagcggctgcaacatcaacggcagcagcttcacgcagtccctctcttcaagagaagcccatagagatgcccttggatatgggaaaagcgccttctccaagaggcgaagatcaacgggttacaaatgaagaagatttgtttttgtttaacagattgcgggcatcacagaatagagttatggactccttggaaccacaacaacagtcacagtatacatcttccagtgtcagtacgatggaaccatctgccgactttactagtttctctgcagtgactactttaccgcctcctcctcatcaacaacaacagcaacaacagcagcagcagcagcagcagcaattggtggttcaagcccagtacacccaaaatcaaccaaacttgcaaagcgatgttttaggaaccgctatagcagagcaaccattttatgttaatgccaagcagtactaccgaattttgaaaaggcgatatgcaagagctaaactagaggaaaagctacgaatatcaagagaacgaaagccatacttacacgaatctcgacataaacatgcgatgcgaagacctcgtggtgaaggtgggaggttcttgacagccgctgagatcaaagccatgaaatcgaagaaaagtggggctagcgatgatcctgacgatagtcatgaggataaaaaaatcactactaaaataatacaagaacagccgcatgctacttccaccgcagctgcagcagacaaaaaaacataattttgtaatattccaatgttaatatcattcctaaaagaactaaaagtgccctcttataccacatggtatccatatggcctatttaatctgaatcaatatgtatatgtacttttaccaatctcgtttcgtttcgtttcgtttcatttctaacagacctatgtactccgctggaaaagaaaccatattgcgatcgtatttacgtgcttttcttttttcatttttgcttactctatctacatataaacagctattcaaaagagctccattttcatctatatataattctctacaccatg

SEQ ID NO: 28146 - protein, 265 aa, Saccharomyces cerevisiae
MSADETDAKFHPLETDLQSDTAAATSTAAASRSPSLQEKPIEMPLDMGKAPSPRGEDQRVTNEEDLFLFNRLRASQNRVMDSLEPQQQSQYTSSSVSTMEPSADFTSFSAVTTLPPPPHQQQQQQQQQQQQQQLVVQAQYTQNQPNLQSDVLGTAIAEQPFYVNAKQYYRILKRRYARAKLEEKLRISRERKPYLHESRHKHAMRRPRGEGGRFLTAAEIKAMKSKKSGASDDPDDSHEDKKITTKIIQEQPHATSTAAAADKKT

SEQ ID NO: 28147 - DNA, 681 bp, Arabidopsis thaliana (mouse-ear cress)
  CDS (1)..(681)
atgttttgctggtcagataacaatgaaagtcatgcgaagaaagaacgtccagattcccaaacccgaccacaggttccttcaggacgaagttcggaatctattgatacaaactctgtctactcagagcccatgttttgttttgatgcttacaatgccaaaacttggttgtttgagataattcaagcaagaaagtcccgggatcatcgcctttctgcagttttagacttcgcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatcttga

SEQ ID NO: 28148 - protein, 226 aa, Arabidopsis thaliana (mouse-ear cress)
MFCWSDNNESHAKKERPDSQTRPQVPSGRSSESIDTNSVYSEPMFCFDAYNAKTWLFEIIQARKSRDHRLSAVLDFAHGLYPYPDPYYRSVFAQQAYLPHPYPGVQLQLMGMQQPGVPLQCDAVEEPVFVNAKQYHGILRRRQSRAKLEARNRAIKAKKPYMHESRHLHAIRRPRGCGGRFLNAKKENGDHKEEEEATSDENTSEASSSLRSEKLAMATSGPNGRS

SEQ ID NO: 28149 - DNA, 1220 bp, Brassica napus (rape)
  CDS (62)..(1006)
gttaatctgagaggaggaggctttggcaatcaaggcagcagggaaggcgtggtagcagactatgatatctctgacagtgactacaccgagtttgagagaaactgaagacatgcattcaaaatctgaaagtgggaatcagatcgtttcagaggctcatcatcatacatcatcaacgtccattaacagtttaaacccttggctgcgtgctgctgcttcctgcaatgcaaactcttctgtggaagaagctggagataagtcgatagcattggagaaccaaaccaatttggaatcatcaaacgggtccaagtcaccatctaaccgagatgaaaatggtaacaaggagtcacaagtcacagcctctccccaacagtcagctgcggattacagtgaaaaaagccaagaacttgtgcatcctggcagtacaccacctcctcaccctcaacttgttagccacactgttggatgggcatcctcaaatccataccaggattcatattatgctggaatgatgggagcctatcccttgacttatgttccacacggtgggatgcctcattcaagaatgcaactgcctcctgagatggcacaagaacctgtttacgtgaatgctaaacagtaccaggcgattatgaggcgaaggcaggcacgcgccaaggctgagctagagaagaagcttatcaaatccagaaagcgttatctacatgaatctcggcatcagcatgctatgaggaggcctaggggtactggaggacggtttgcaaagaaaactaacaccgaagcttcacagcaaaaagatggagaaaagagaaatgcttgtgctactcagtccccgacgtcatctcattctgatcagcatgaaggttgtagtgatgagtatagaacaaatcagtccgatgagatgcagagttcagcttataagataagggaagaagcagactgttcagggcagcagtggaacaacatttcctcaaaccatccttctcaacctcttttagctatcaagtaacctctacgctggcaaatcattcttggctctatctttgttggcttatgtgttagcagccattgaagagttatctcagttttcttctttcttgttttgtacaaacactagtgtgcttatgttagaatgcttctttgtcaacaccctttaggtttaataacaaacttgaagttttgaatccgaaactatgtgattgagaactaaaaaaaaaaaaaaa

SEQ ID NO: 28150 - protein, 314 aa, Brassica napus (rape)
MISLTVTTPSLRETEDMHSKSESGNQIVSEAHHHTSSTSINSLNPWLRAAASCNANSSVEEAGDKSIALENQTNLESSNGSKSPSNRDENGNKESQVTASPQQSAADYSEKSQELVHPGSTPPPHPQLVSHTVGWASSNPYQDSYYAGMMGAYPLTYVPHGGMPHSRMQLPPEMAQEPVYVNAKQYQAIMRRRQARAKAELEKKLIKSRKRYLHESRHQHAMRRPRGTGGRFAKKTNTEASQQKDGEKRNACATQSPTSSHSDQHEGCSDEYRTNQSDEMQSSAYKIREEADCSGQQWNNISSNHPSQPLLAIK

SEQ ID NO: 28151 - DNA, 1104 bp, Aspergillus oryzae
  CDS (1)..(1104)
atggaatatcctccacaatatcaacagcctcatggccaacacccacatgccccctcccacatcgctgccccgtatcagaccgcaccccagaacccaggctcaacggtgggttcgatgacctctcccaccaatccccaggcacacatgcagcaagcccatcctacgcatcaagcatctcccattgtcccatcgcagtctcattaccaacaggcacagaatgcgccgggttcagtacaccagcagatgaactttcctcaatcctatggggtaactacagcgatgccgcagacgttcggcatctcaccaacacaggcggcggctatggctactgcggctgcgtctgggcaattctaccctttgcatcaggactcaatggctggccaaatgcagcaagggcctcgtggctcgccacgtatggctggagtgcaacaggtgaagaatgagcggaatccacgctcgccaccgcagatgccagggcaaatgccttctatgggttcgcaagtacagatgcagcagaatgcacagatacaacagcgtcgcatgagccatgttggcagcccccacgttcaagctgctcagccggtccttaatcacgttgttcgaccttcagtacctccacctatgccgcccccacctcagcctgcggtgcaacaaagccaaccttccccagatatggctgttggcgccgtggaagaatctcctctttacgtcaatgcaaagcaattccaccgcattttgaaacggcgcgttgctaggcaaaaattggaggaacaactccgactcacgtccaagggccgtaagccatatttgcatgagtcgcgtcataatcatgccatgcgacggccacgcggtcctggtggtcgattcctgacggcagacgaagtcgctaacttggagaagaagaataacgctggtggacaagagaatgtcgatagcaagccgaccggtgagaatcctccgtcggcacagaaaagaaaatctagtgatgttaacgatgagaacacgaactcagcgaagaaggcgaagactagtgttgcaaaaacgagcacgagcgctgaggagagcgaacacgaatccgccgaaccatccgatgaggatggttga

SEQ ID NO: 28152 - protein, 367 aa, Aspergillus oryzae
MEYPPQYQQPHGQHPHAPSHIAAPYQTAPQNPGSTVGSMTSPTNPQAHMQQAHPTHQASPIVPSQSHYQQAQNAPGSVHQQMNFPQSYGVTTAMPQTFGISPTQAAAMATAAASGQFYPLHQDSMAGQMQQGPRGSPRMAGVQQVKNERNPRSPPQMPGQMPSMGSQVQMQQNAQIQQRRMSHVGSPHVQAAQPVLNHVVRPSVPPPMPPPPQPAVQQSQPSPDMAVGAVEESPLYVNAKQFHRILKRRVARQKLEEQLRLTSKGRKPYLHESRHNHAMRRPRGPGGRFLTADEVANLEKKNNAGGQENVDSKPTGENPPSAQKRKSSDVNDENTNSAKKAKTSVAKTSTSAEESEHESAEPSDEDG

SEQ ID NO: 28153 - DNA, 1110 bp, Emericella nidulans
  CDS (1)..(1110)
atggaatattctccacaatatcaacaacaacatggtcaacatccgcacccggcctctcatatgaccggcgcatatccaacagcacctcagaaccccgggtccgctctgggatcgatgacatccccaaccaaccctcaaacacacatacaacaagcacatcccacgcatcaggcctctcctgttgttccatcccagtcccattaccagcaggcgcagaatgccccgggctcgatgcaccagcaaatgaactttcctcagtcatatggcgtcacgacggccatgccgccgcaaccatacggtatatctcccacccaggctgctgcgatggcgacggcagcggcttcagggcagttctatcctacacacggggattcgatagctggtcaaatggcacaaggcccgcgcggctcaccccgcatggcaggagtgccggtgaagactgaccggaatccccggtctccgcctcaaattcccggccagatgccaccgatgggttcgcaggtaccgctaacaccaaccgctcaaatgcagcagcgtcgcatgagccatgtcggtagcccgcacgtgcagaacgcccagcctgtcatgaatcacgttggtagaccttcagtgcctccgccgatgccacctcctcagcaccccgttcagcagacgcaaacttccccagacatgatgcctagtggcgcagaggagtcgccattgtacgtgaatgcaaaacagtttcaccgtatcctcaagcgacgcgttgcgcgacagaaattagaagaacagttacgactcacatctaaaggtcgcaaaccgtatctccatgagtcccgtcacaaccacgcgatgcgtcgcccccgaggccccggcggtcgattcctgaccgcagacgaagtggccgcgatggagaagaagaatgctgcaggtggacaggagaatgcagatccgaatgcttcaaaagcggtcagtgacagttcacctgcgtctcagaaacgcaaagccagtgatggcaataacgaaaaccctaactctgcgaagaaagcaaagaccggcgcccagaaagccagtaacaatgccgacgaaagcgaggcagagtccggcggtccctcggatgaagatggctga

SEQ ID NO: 28154 - protein, 369 aa, Emericella nidulans
MEYSPQYQQQHGQHPHPASHMTGAYPTAPQNPGSALGSMTSPTNPQTHIQQAHPTHQASPVVPSQSHYQQAQNAPGSMHQQMNFPQSYGVTTAMPPQPYGISPTQAAAMATAAASGQFYPTHGDSIAGQMAQGPRGSPRMAGVPVKTDRNPRSPPQIPGQMPPMGSQVPLTPTAQMQQRRMSHVGSPHVQNAQPVMNHVGRPSVPPPMPPPQHPVQQTQTSPDMMPSGAEESPLYVNAKQFHRILKRRVARQKLEEQLRLTSKGRKPYLHESRHNHAMRRPRGPGGRFLTADEVAAMEKKNAAGGQENADPNASKAVSDSSPASQKRKASDGNNENPNSAKKAKTGAQKASNNADESEAESGGPSDEDG

SEQ ID NO: 28155 - DNA, 1565 bp, Schistosoma mansoni
  CDS (320)..(1126)
gttccgttcttgattgctgaataatttaagccactgaaaatcccagcgagtgattatcaccttattctcgacctatcactgatacgtacatgtgagtatgacccaataagcgagaatcaagtagaagtagatgcaccaatgtattcgtatattattcgttcattttcgaggtttttcacttactttaagcgcttccatcaatttttgtgttggcgcttgtttaaaatgaggtggaattcatttttcgcaacccgcccaaaagagttggttccggaatttacgtatttggagtatatcttggaactagacgttttctgtaatgatggacggttatatacacgctggtcaagtccttccggcccaaactattctacagccgttgcaacagcctttgataatggatgcaaacggtgccgctcaaccaactacgttcgctgttcaggctagcgatggtagcctgattcccgttcaactagctacgtctgctggtgggggtcaggtcatcatgttccttccaagtgcagctcagcaaacaatatacacaactcaacctatagtgtctgctgcaaccacttctttagacgctaaccttacatcggcccaagggcagattatagggacaactgttgaagacgaaactcacatacttcaacaattacagcagtcttcacaagtccaagttattcaccagacccagtctggattatctcaagccgtttcaaacactcaagttgttcaggtttctagtccgcaacccgaaactgctataggtcagcagggaatgtccacacaagcatcctcaacaatatcacctggtcttactcctggcggcgaagaacctctttatgttaatgctaaacagtaccacagaattctaaaacgtcgccaagcacgagcgaaattagaagcacaaggtcgcattccgaaggaaagacggaagtatcttcatgagtccaggcataagcatgctatgaaccgcatacgaagttctggtggtcggttcttttctgtaccgtcttattctgatgcaaataacagtactgcctcgacctcttccagtaattcatcagcgataacatccttccaaacaaatgaggactgtaaaactaagattttgtctaactgatatcctaattgtacgctgttaatttcctcatggattcaacttgttgacaatccggaaaacgatccaccgtacttagatattaaaatatgttaaatattacaagctactaagtactaagtatattcccattattgcctggataaacattggtaatgattatgtgacttttggagatgcccatattgattatcacgtcattattatcattgttaccataacctcagttctgtacacatctattttctatatggtatttcctatattctccccatgcttgtctgtaaatatttattacgacttgaaactttttcccatgaagttgaatcttttgttttaactttactgtctttatatttaacgaatactaattgatcctaaatttacaacaaagaataaatacactcggttttcttttttattagaaggaaatattttttcg

SEQ ID NO: 28156 - protein, 268 aa, Schistosoma mansoni
MMDGYIHAGQVLPAQTILQPLQQPLIMDANGAAQPTTFAVQASDGSLIPVQLATSAGGGQVIMFLPSAAQQTIYTTQPIVSAATTSLDANLTSAQGQIIGTTVEDETHILQQLQQSSQVQVIHQTQSGLSQAVSNTQVVQVSSPQPETAIGQQGMSTQASSTISPGLTPGGEEPLYVNAKQYHRILKRRQARAKLEAQGRIPKERRKYLHESRHKHAMNRIRSSGGRFFSVPSYSDANNSTASTSSSNSSAITSFQTNEDCKTKILSN

SEQ ID NO: 28157 - DNA, 1222 bp, Brassica napus
  CDS (97)..(1008)
gaaaacttgctcagatcgttcatcttccaagcggaagcgtctccttccatcaccgtagacgccttccgtgacggtctctactcgctctttccctgaatggaaactgaagacatgcattcaaaatctgaaagtgggaatcagatcgtttcagaggctcatcatcatacatcatcaacgtccattaacagtttaaacccttggctgcgtgctgctgcttcctgcaatgcaaactcttctgtggaagaagctggagataagtcgatagcattggagaaccaaaccaatttggaatcatcaaacgggtccaagtcaccatctaaccgagatgaaaatggtaacaaggagtcacaagtcacagcctctccccaacagtcagctgcggattacagtgaaaaaagccaagaacttgtgcatcctggcagtacaccacctcctcaccctcaacttgttagccacactgttggatgggcatcctcaaatccataccaggattcatattatgctggaatgatgggagcctatcccttgacttatgttccacacggtgggatgcctcattcaagaatgcaactgcctcctgagatggcacaagaacctgtttacgtgaatgctaaacagtaccaggcgattatgaggcgaaggcaggcacgcgccaaggctgagctagagaagaagcttatcaaatccagaaagcgttatctacatgaatctcggcatcagcatgctatgaggaggcctaggggtactggaggacggtttgcaaagaaaactaacaccgaagcttcacagcaaaaagatggagaaaagagaaatgcttgtgctactcagtccccgacgtcatctcattctgatcagcatgaaggttgtagtgatgagtatagaacaaatcagtccgatgagatgcagagttcagcttataagataagggaagaagcagactgttcagggcagcagtggaacaacatttcctcaaaccatccttctcaacctcttttagctatcaagtaacctctacgctggcaaatcattcttggctctatctttgttggcttatgtgttagcagccattgaagagttatctcagttttcttctttcttgttttgtacaaacactagtgtgcttatgttagaatgcttctttgtcaacaccctttaggtttaataacaaacttgaagttttgaatccgaaactatgtgattgagaactaaaaaaaaaaaaaaa

SEQ ID NO: 28158 - protein, 303 aa, Brassica napus
METEDMHSKSESGNQIVSEAHHHTSSTSINSLNPWLRAAASCNANSSVEEAGDKSIALENQTNLESSNGSKSPSNRDENGNKESQVTASPQQSAADYSEKSQELVHPGSTPPPHPQLVSHTVGWASSNPYQDSYYAGMMGAYPLTYVPHGGMPHSRMQLPPEMAQEPVYVNAKQYQAIMRRRQARAKAELEKKLIKSRKRYLHESRHQHAMRRPRGTGGRFAKKTNTEASQQKDGEKRNACATQSPTSSHSDQHEGCSDEYRTNQSDEMQSSAYKIREEADCSGQQWNNISSNHPSQPLLAIK

SEQ ID NO: 28159 - DNA, 747 bp, Debaryomyces hansenii CBS767
  CDS (1)..(747)
atgacatctttacatcatccggttaacgattccacggggtattacgaagatcaagtacccgcacccacatactataatccgcatactaataaccaacctcaccaaattattgataatttagactcagcaccgaattctaatagttcaacctcatattatggaggtgaacaacaaataaaccaagaacaacctgtcccttctaataactacgagggacaagcatcacagacgcctacaaactcacaatttttccaaggttctccggattcccagtcccatcaatctcaacataatagtccgaacaataattcaaccacaatcgcacaaccgcccactgagcagccattttacgttaatgccaagcaatatcacagaatattgaaaagaagaatagcaagagctaaattagaagagactttaaaaattgcaagaactagaaaaccgtatttacacgagtcaagacacaaacatgcgatgagaagaccaaggggacaaggagggcggtttttaactgctgctgagattgcggaaaaagaaagattagataagttgaaagctttagaggataaggagaaaatagataatttcaacggagaccaacctcaagaagaacaaagtgattcgtcgaaatcttcaacaactcccactacagaaaagactacatcaaatgctgggaatgttgcatcaaatgaagatgattcaatattccaaaatttaattaatgaaaatgggagtacagaggattaa

SEQ ID NO: 28160 - protein, 248 aa, Debaryomyces hansenii CBS767
MTSLHHPVNDSTGYYEDQVPAPTYYNPHTNNQPHQIIDNLDSAPNSNSSTSYYGGEQQINQEQPVPSNNYEGQASQTPTNSQFFQGSPDSQSHQSQHNSPNNNSTTIAQPPTEQPFYVNAKQYHRILKRRIARAKLEETLKIARTRKPYLHESRHKHAMRRPRGQGGRFLTAAEIAEKERLDKLKALEDKEKIDNFNGDQPQEEQSDSSKSSTTPTTEKTTSNAGNVASNEDDSIFQNLINENGSTED

SEQ ID NO: 28161 - DNA, 891 bp, Candida glabrata CBS138
  CDS (1)..(891)
atgtctcgaagagaagttatatactctgaaacaatgaatctacagaatgtacatccaccgtcctctattgttggtggtacttcaaacgccagccccgcaggtaccgatttgtacacctcaaatccggatgataacgaatctcaggcacctacaaacgaggagctatatctctacaacgaactgaaaagagtctcagaaaatgtggattctgataaccttgaaggaaagcaacaagaagatacaggagtaccacaaaatattataaccaaacaatatgttcaaacaattcccagaacagctttggataatgaatcaaataatggaaatatcaaaatggaatctgaaccaccaataaactcaacaactagagtccctgataataaaaacacacatataaatggaaaagagaaaaactacaagtttgatggaccacagcgtagctctactaatgataatgttcgtaagtcagttccaaaaaattatgaaaatccctctaataagttttcaactgaaattccagaatcgaatctgccgaaagaagagagtacttcagagcaaccgtattatgttaatgccaagcaatattatagaattctgaagaggagatatgctagagcaaaattagaagaatctttacgaatatgtagagaaaggaaaccatatttacatgaatctcgtcacaagcatgctttgagaagaccgcgcggtgaaggtggccggttcctcactgctgcagagatcaaagagctcaaggaaaagggtgaattgaaggatactgaaaaaactaaaagtcaatcagatgcagaaaaatctatagatacaaatgcagacattgtaaatagtcaaaaatcaggtgctagtactggagacttagacaccaaaaaagattaa

SEQ ID NO: 28162 - protein, 296 aa, Candida glabrata CBS138
MSRREVIYSETMNLQNVHPPSSIVGGTSNASPAGTDLYTSNPDDNESQAPTNEELYLYNELKRVSENVDSDNLEGKQQEDTGVPQNIITKQYVQTIPRTALDNESNNGNIKMESEPPINSTTRVPDNKNTHINGKEKNYKFDGPQRSSTNDNVRKSVPKNYENPSNKFSTEIPESNLPKEESTSEQPYYVNAKQYYRILKRRYARAKLEESLRICRERKPYLHESRHKHALRRPRGEGGRFLTAAEIKELKEKGELKDTEKTKSQSDAEKSIDTNADIVNSQKSGASTGDLDTKKD

SEQ ID NO: 28163 - DNA, 1434 bp, Daucus carota
  CDS (141)..(1052)
gtggtagcagcagcagagagggaatttcacagatttttgactaataaaaaaacacactctcattctcatttgctttgccccaatttctagggtttcgctcttctgaattctctccaatcaggtttgaagaggacctatatatgatgcacccaaaacctagatccagtaatcagctggaatacggttcatataatcttccacccatatcttcagaaccatggtggcagagcttgggcaagaactctaccaatactgatggaattcaggagaatggatctgattcatcttcacagtcggtagatggtagtgaagatgaggatgatggatccaatgagtcacagaatactggaaatatgccttctgatccaaattttgctcaagaacatcagaaccagcatgttgcaactaatgtgcctcctgggaatgctgaaaacccacctcaggcttcacaacttgaacttgctggtcaatcagtagcttatgatccaaatgcatactatgacccatattactatagaggaatgatggcggcctatggtcaacctctggttcaacctcacttgctcgatacacatcacaacagaatgcctttgcccattgatatgacacaagagcctgtttatgtgaatgccaagcagtaccgtgcaattctacggcgcagagaatcccgtgcaaaggccgaactcaaaaggaagttgattaaagatcgaaagccatatcttcatgaatctcggcataggcatgctattagaagggcaagggcttctggaggccgttttgcaaagaagtctgatactgatgcttcggagaacccgcagacaagtgaggtaaaaggggttaatattagctcctcagtttctgctcaatctgcaaattcgtccggatctcaagtatttccttccaattgcaatctgaattcccatcaagaagcaagagggccggatgctacatatgtcaataattctggaggctatgagaaccaagaagcgtttagggtgtcaacatatgacttgcactcgaacagagaggggggatctgtttgccagcagtaaaaacacataggatctgattaacctccaaaaagggccgtggcaatgcattaaggccatattttggtagggactggcgtatcaaaaggttaaaattattcagaactttttcttctgtcaaatattgggttattttggctttcaaagtcagctggcaaatcattcttggcttaatttctttcctttttttttttctcttggtgagaatggagtttagaagttatgggtttgatcaacatttctgcttctcacaatgtagagaatgtactttcttatactatacaaaagatgacaaattagagaactagtttgtggcaagtttttgagtgtcggaccctttgtggtgttagatacttttcttatggttatggacttaggtttgttt

SEQ ID NO: 28164 - protein, 303 aa, Daucus carota
MMHPKPRSSNQLEYGSYNLPPISSEPWWQSLGKNSTNTDGIQENGSDSSSQSVDGSEDEDDGSNESQNTGNMPSDPNFAQEHQNQHVATNVPPGNAENPPQASQLELAGQSVAYDPNAYYDPYYYRGMMAAYGQPLVQPHLLDTHHNRMPLPIDMTQEPVYVNAKQYRAILRRRESRAKAELKRKLIKDRKPYLHESRHRHAIRRARASGGRFAKKSDTDASENPQTSEVKGVNISSSVSAQSANSSGSQVFPSNCNLNSHQEARGPDATYVNNSGGYENQEAFRVSTYDLHSNREGGSVCQQ

SEQ ID NO: 28165 - DNA, 945 bp, Neurospora crassa
  CDS (1)..(945)
atgatggaatacgcccaataccagccggcgcaaaacagccattctaatccacatatgcaaacggcctactccagctcagcgggtggtaacagcatcacatccccatcgagccagcatctaccgcaaacatcgccaattctccagacccagcagcatcagccttcgccaacccaaggtcacagcatgtaccaaacccagtacggcgtgcctcagcagaacatgcactatggcatgcccctacaggctgcagctctggctgccaccgcggctgcgtcaggaaccaactacccgaacccatacatggcagcggacccgaacttgcagcagtcgcctagaatgtctggtgtaaactctaagaaggacgtcagagcgggacctcgatctccgccgcaaatgaacagcatacctccaggacagcgccgtctcagtcaggtcgccagccccggtgtgcctaatgcgcaagcgatgctcaaccacgcctctaggtctgccgtcccgccgccgatgacggccgcacagcaaatgcccccaccccagtccccagagatggcttccggagccgtggaagagtcacctctgtatgtcaacgcaaagcagttccaccggatcttgaagcgccgagtcgctagacaaaagctggaggaacaattgcggttgacgaacaagggacgcaagccgtatctccatgagtcgagacacaaccatgccatgcgacgccctcgtggtcctggtggccgtttcctgacagcagacgaggttgcgcagatggagcgggacaaggtcaacggggatgtaaagcaagatggttcggagcagtcctcggtaacagcagggtcgaaaacgactggaggaaccaagaggaaagccgaaagtacttcgggcgccccgaataagaaggcgaaggccgctcccgaaagcccagaggacgatgacgcttcggactaa

SEQ ID NO: 28166 - protein, 314 aa, Neurospora crassa
MMEYAQYQPAQNSHSNPHMQTAYSSSAGGNSITSPSSQHLPQTSPILQTQQHQPSPTQGHSMYQTQYGVPQQNMHYGMPLQAAALAATAAASGTNYPNPYMAADPNLQQSPRMSGVNSKKDVRAGPRSPPQMNSIPPGQRRLSQVASPGVPNAQAMLNHASRSAVPPPMTAAQQMPPPQSPEMASGAVEESPLYVNAKQFHRILKRRVARQKLEEQLRLTNKGRKPYLHESRHNHAMRRPRGPGGRFLTADEVAQMERDKVNGDVKQDGSEQSSVTAGSKTTGGTKRKAESTSGAPNKKAKAAPESPEDDDASD

SEQ ID NO: 28167 - DNA, 1122 bp, Aspergillus niger
  CDS (1)..(1122)
atgatggaatacccgccgcagtatcaacagcctcacggccagcatccccacgcctcctctcacatcactgccccgtatcagacagctccccaaagtgctgggtcgacggtggggtcaatgacttctcccaccaacccccaagcgcgcatgcaacaagctcacgcgacacatcaagcgtctcccattgttccctcacaatctcattatcagcctgctcaaaatgccccgggctctgtacatcagcaaatgaatttcccccagtcgtatggagttaccacggcgatgccacaggcatatggtatctcccctacgcaggcagccgcaatggccaccgctgcagcatcgggtcaattttatcctctccatcaagactcgatggctggccagatggctccgggtccccgcggatcaccgcgcatggctggggtgcaggtcaagagtgaccgcaatcctcgttcaccaccccagattccgggccagatgccctcaatgggatcccaggtacagatgtcccagaacgcccagatgcagcaacgtcgcatgagccatgtcagtagtccacatgttcaaaatgcgcaaccacttatcaaccatgctggacggccttcggtgcccccatctatgccgccaccaccacagccgcctgttcagcaaagccagccttcgccggatatggtcgccggcgccgctgaggagccacctttatacgtgaacgcgaagcaatttcatcgcatcttgaaacgacgagtggctcgccagaaactggaggaacagttgcggcttacttccaagggtcgcaagccatatctgcacgaatcgcgtcataaccatgccatgcgccgccctcgtggtcctggcgggcggttcttaacggctgacgaagtggctgctatggggaagaagcaagcatcggggtctacgaccgctggactcgaaggcgctgacgattatgcggtgaaaccacctggcgataacccgccatccgcacagaaacgaaaatcaagtgatgtcaacgatgacaccatcaattcgtctaaaaagacgaaaactagcgccaagccaagcaccagtgcggatgaaagcgagaatgaatctgctgagctgtccgacgaggatggttga

SEQ ID NO: 28168 - protein, 373 aa, Aspergillus niger
MMEYPPQYQQPHGQHPHASSHITAPYQTAPQSAGSTVGSMTSPTNPQARMQQAHATHQASPIVPSQSHYQPAQNAPGSVHQQMNFPQSYGVTTAMPQAYGISPTQAAAMATAAASGQFYPLHQDSMAGQMAPGPRGSPRMAGVQVKSDRNPRSPPQIPGQMPSMGSQVQMSQNAQMQQRRMSHVSSPHVQNAQPLINHAGRPSVPPSMPPPPQPPVQQSQPSPDMVAGAAEEPPLYVNAKQFHRILKRRVARQKLEEQLRLTSKGRKPYLHESRHNHAMRRPRGPGGRFLTADEVAAMGKKQASGSTTAGLEGADDYAVKPPGDNPPSAQKRKSSDVNDDTINSSKKTKTSAKPSTSADESENESAELSDEDG

SEQ ID NO: 28169 - DNA, 953 bp, Arabidopsis thaliana
  CDS (123)..(719)
ggagagacctttaacaattttctgagggtaagatccagagattgattgaatcagcttactattttatataattcagtttgttgttcctcagacttgtaactaggacagtcttctcatgaatcatgacttcttcagtacatgagctctctgataacaatgaaagtcatgcgaagaaagaacgtccagattcccaaacccgaccacaggttccttcaggacgaagttcggaatctattgatacaaactctgtctactcagagcccatggcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatcttgaggaaggtttctgcacaaccacaagtttagtttctattttgggtggatgttctcagggcatcatcgtctttagtgtttttggatacgctgtgtacaggttatttgctagggtaaactttgttttagcgattagaaataaaactaagcaaagaaatgaaaagtgtgattggaagtattgttgtaccaaattgatattctttgccaatgaactcatgttttggaaagtaaaaaaaaa

SEQ ID NO: 28170 - protein, 198 aa, Arabidopsis thaliana
MTSSVHELSDNNESHAKKERPDSQTRPQVPSGRSSESIDTNSVYSEPMAHGLYPYPDPYYRSVFAQQAYLPHPYPGVQLQLMGMQQPGVPLQCDAVEEPVFVNAKQYHGILRRRQSRAKLEARNRAIKAKKPYMHESRHLHAIRRPRGCGGRFLNAKKENGDHKEEEEATSDENTSEASSSLRSEKLAMATSGPNGRS

SEQ ID NO: 28171 - DNA, 1262 bp, Arabidopsis thaliana
  CDS (145)..(1056)
aataataaaattcaattccataaatatttttttttttgttctttcctctgactggaaaaagcttcctcagatcgtttcatcgtccaagcggaagaagcgtctccttcaatcaccgtggacacctccgagactgtctccgattgaatgggaattgaagacatgcattcaaaatctgacagtggtgggaacaaggttgattcagaggttcatggtacagtatcgtcgtcgataaatagtttaaacccttggcatcgtgctgctgctgcttgcaatgcaaattctagtgtggaagctggagataaatcttctaagtcaatagcattagcattggaatcaaacggttccaaatcaccatccaatagagataatactgttaacaaggaatcacaagttacaacgtctccacaatcagctggagattatagtgataaaaaccaagaatctctgcatcatggcatcacacaacctcctcctcaccctcaacttgttggccacacagttggatgggcatcctcaaatccataccaggatccatattatgcaggagtgatgggagcctatggacatcatcccctggggtttgttccatatggtgggatgcctcattcaagaatgccactgccgcctgagatggcacaagaaccagttttcgtgaatgctaaacagtaccaggcgattctgaggcgaaggcaggcacgcgccaaggcagagctagagaagaagctaataaaatccagaaagccttatctacatgaatctcggcatcaacatgctatgaggaggccaaggggtactggaggacggtttgcaaagaaaaccaacaccgaagcttcaaagcgtaaagctgaagaaaagagcaatggtcatgttactcagtccccgtcatcatctaattctgatcaaggtgaagcttggaatggtgactatagaacacctcagggagatgagatgcagagctcagcttataagagaagggaagaaggagagtgttcagggcagcaatggaacagcctttcctcaaaccatccttctcaagctcgtctagccattaaatgacctcacaaggcggcaattcattcttggctttctctttgttggcttattcggtagcagccatgaaagagtattttctctcgtttttttttcttctgattttgtacaaatactttttgtagctttttgtgactttttccctttcagtttggaatacttcagatgttgccacttttctttttcaattctatcttaactaaacatttctc

SEQ ID NO: 28172 - protein, 303 aa, Arabidopsis thaliana [sequence omitted]

SEQ ID NO: 28173 - DNA, 1038 bp, Trichoderma reesei
  CDS (1)..(1038)
atgatggaatacgcgcaatatccacagcagcaacacaattcccacgcaggttacgcgagctctgccgccggtgcaagtatcacgtcgcccaccagccacggcatcaaccagcacgccgtgcaatcgtcgcccgtcaacgcatcgcagcagcagcagcaacaacaacagcaacagcaacaacaacaacaacaacagcaacaacagcagcagcagcaacaacaacagcagcagcagcagcagcagcagcagtctcagcagcaacaccagcctgctcaggccccagctcacggcatgtatcaaccacagtacggcgtgccccagcccagcatgcagcaggtgccgtatggcatccctggcatccaggctgccgcaatggccgccacagccgccgcctcaggctccggctacccttacatgcactcggatccgagcatgcctcacacgtcgccgcgcatgcccagcgctaagaaggatggccggccgtctcctcgcatgaacagcatttcccagatccccggccgccgcatgagccaagtcaccagcccgggcgtgccgagtgcccccggcatgatgaaccacggcggaccccggcccccgcccatgcctcccgcccctgccatgcagcacccacagtcgccagagatgcccgccggcgccgtcgaagagtcgccattgtacgtcaatgcgaaacagttccaccgaatcctcaagcggcgcgtcgcccgccagcgtctcgaagagcagttgcggttgacttccaaaggacgaaagccctacctgcacgagtccagacacaaccatgcgatgcgcaggcctcgtggacccggtggtcgattcttgacagcagaggaggtggccgccatggaatccaagggagggctagacggcaagggtgagggttcggacgatgtctcacctggcaagtcctcagatgccccgagcgggaagcgcaagtcggaatctggcccctcgacgtccagcaagaagcccaaaacacaaagcgacaacggcgaaggaaatgcagaagacgccagttaa

SEQ ID NO: 28174 - protein, 345 aa, Trichoderma reesei
MMEYAQYPQQQHNSHAGYASSAAGASITSPTSHGINQHAVQSSPVNASQQQQQQQQQQQQQQQQQQQQQQQQQQQQQQQQQQQSQQQHQPAQAPAHGMYQPQYGVPQPSMQQVPYGIPGIQAAAMAATAAASGSGYPYMHSDPSMPHTSPRMPSAKKDGRPSPRMNSISQIPGRRMSQVTSPGVPSAPGMMNHGGPRPPPMPPAPAMQHPQSPEMPAGAVEESPLYVNAKQFHRILKRRVARQRLEEQLRLTSKGRKPYLHESRHNHAMRRPRGPGGRFLTAEEVAAMESKGGLDGKGEGSDDVSPGKSSDAPSGKRKSESGPSTSSKKPKTQSDNGEGNAEDAS

SEQ ID NO: 28175 - DNA, 903 bp, Kluyveromyces lactis
  CDS (1)..(903)
atgcccactgaacttatcacttatgagcagaacttctcttctggtgtagatgctgaaaacgactaccctcctttggattccggcatgggcagtttccaagtttctgaacttgaacgtcaaggtgattcacataagcgttcgaatgatgagatatcggagctccgagacgaaactcttaacggcagagagaaaaaactacgacaatcggaaagcatttcgaggaacagtacagggaatgctcaagttgaagcaatcccacatcatagcattaacgtagatcaaagcgataaccttctgagtgaacaggagaacccaactaaagtgtatctgtatgacgatcctcatttagagaatgatcctcagcagcggcaggaggaatctgatgcgaacgggatcatggaaaagttaactgatgataatagcatgaagcaggtctccaatgctaagacttccctagaaactgcacaatttctcgaaacttcaaactcgatggaacttcagcggacaaaaccgcatgatatgaatattatatctccctctgagcctttagagcaacccttttacgttaatgccaaacaatattatcgtatcctaaagagaagatatgctcgtgctaaacttgaagaaaatctaaagatttcaagagaacgcaggccgtatttacatgaatctagacataaacacgctatgagaagaccaagaggacaaggaggaagatttttgactgctgcagagatggctgaaatgaaaagaaaagaagaagagggtacagacaatgatagttttctgcaggaacatgtacctaaaatgaatgttcttccacagcaattgcctgggcctgtcaaagataataacaatgaaaagtcagacgaaaaacctgtggctaaagaagcttctaattga

SEQ ID NO: 28176 - protein, 300 aa, Kluyveromyces lactis
MPTELITYEQNFSSGVDAENDYPPLDSGMGSFQVSELERQGDSHKRSNDEISELRDETLNGREKKLRQSESISRNSTGNAQVEAIPHHSINVDQSDNLLSEQENPTKVYLYDDPHLENDPQQRQEESDANGIMEKLTDDNSMKQVSNAKTSLETAQFLETSNSMELQRTKPHDMNIISPSEPLEQPFYVNAKQYYRILKRRYARAKLEENLKISRERRPYLHESRHKHAMRRPRGQGGRFLTAAEMAEMKRKEEEGTDNDSFLQEHVPKMNVLPQQLPGPVKDNNNEKSDEKPVAKEASN

SEQ ID NO: 28177 - DNA, 23 bp, Primer
atgtcagcagacgaaacggatgc

SEQ ID NO: 28178 - DNA, 25 bp, Primer
ttatgtttttttgtctgctgcagct

SEQ ID NO: 28179 - DNA, 1716 bp, Saccharomyces cerevisiae; identical to SEQ ID NO: 230
  CDS (1)..(1716)

SEQ ID NO: 28180 - protein, 571 aa, Saccharomyces cerevisiae; identical to SEQ ID NO: 231

SEQ ID NO: 28181 - DNA, 2817 bp, Neurospora crassa; identical to SEQ ID NO: 1285
  CDS (1)..(2817)

SEQ ID NO: 28182 - protein, 938 aa, Neurospora crassa; identical to SEQ ID NO: 239

SEQ ID NO: 28183 - DNA, 2658 bp, Mus musculus; identical to SEQ ID NO: 1287
  CDS (1)..(2658)

SEQ ID NO: 28184 - protein, 885 aa, Mus musculus; identical to SEQ ID NO: 245

SEQ ID NO: 28185 - DNA, 2583 bp, Xenopus laevis; identical to SEQ ID NO: 246
  CDS (1)..(2583)

SEQ ID NO: 28186 - protein, 860 aa, Xenopus laevis; identical to SEQ ID NO: 247

SEQ ID NO: 28187 - DNA, 2568 bp, Homo sapiens; identical to SEQ ID NO: 1291
  CDS (1)..(2568)

SEQ ID NO: 28188 - protein, 855 aa, Homo sapiens; identical to SEQ ID NO: 241

SEQ ID NO: 28189 - DNA, 2625 bp, Homo sapiens; identical to SEQ ID NO: 242
  CDS (1)..(2625)

SEQ ID NO: 28190 - protein, 874 aa, Homo sapiens; identical to SEQ ID NO: 243

SEQ ID NO: 28191 - DNA, 2076 bp, Caenorhabditis elegans; identical to SEQ ID NO: 1295
  CDS (1)..(2076)

SEQ ID NO: 28192 - protein, 691 aa, Caenorhabditis elegans; identical to SEQ ID NO: 235

SEQ ID NO: 28193 - DNA, 1782 bp, Schizosaccharomyces pombe; identical to SEQ ID NO: 1297
  CDS (1)..(1782)

SEQ ID NO: 28194 - protein, 593 aa, Schizosaccharomyces pombe; identical to SEQ ID NO: 237

SEQ ID NO: 28195 - DNA, 26 bp, Primer
atgaatgatcctcgtgaaattttagc

SEQ ID NO: 28196 - DNA, 25 bp, Primer
ttatattatctcaagatcgctggca

SEQ ID NO: 28197 - DNA, 1179 bp, Saccharomyces cerevisiae; identical to SEQ ID NO: 19714
  CDS (1)..(1179)

SEQ ID NO: 28198 - protein, 392 aa, Saccharomyces cerevisiae; identical to SEQ ID NO: 19715

SEQ ID NO: 28199 - DNA, 28 bp, Primer
atgtccaactttaagaattttactttaa

SEQ ID NO: 28200 - DNA, 26 bp, Primer
tcatttgtttatcagtgtaacaagca

SEQ ID NO: 28201 - DNA, 1110 bp, Saccharomyces cerevisiae; identical to SEQ ID NO: 14358
  CDS (1)..(1110)

SEQ ID NO: 28202 - protein, 369 aa, Saccharomyces cerevisiae; identical to SEQ ID NO: 14359

SEQ ID NO: 28203 - DNA, 948 bp, Candida glabrata; identical to SEQ ID NO: 14360
  CDS (1)..(948)

SEQ ID NO: 28204 - protein, 315 aa, Candida glabrata; identical to SEQ ID NO: 14361

SEQ ID NO: 28205 - DNA, 24 bp, Primer
atgaatcagagcgatagcagcttg

SEQ ID NO: 28206 - DNA, 25 bp, Primer
tcatcttcgaagataaggggtattc

SEQ ID NO: 28207 - DNA, 354 bp, Saccharomyces cerevisiae; identical to SEQ ID NO: 14354
  CDS (1)..(354)

SEQ ID NO: 28208 - protein, 117 aa, Saccharomyces cerevisiae; identical to SEQ ID NO: 14355

SEQ ID NO: 28209 - DNA, 23 bp, Primer
atggcggttgcgatcaaaaagga

SEQ ID NO: 28210 - DNA, 28 bp, Primer
tcaattgataaatgtactttcaatgatg

SEQ ID NO: 28211 - DNA, 1617 bp, Saccharomyces cerevisiae
  CDS (1)..(1617)
atgagttctgtcgcagaaaatataatacaacatgccactcataattctacgctacaccaattggctaaagaccagccctctgtaggcgtcactactgccttcagtatcctggatacacttaagtctatgtcatatttgaaaatatttgctactttaatctgtattcttttggtttgggaccaagttgcatatcaaatcaagaaaggttccatcgcaggtccaaagtttaagttctggcccatcatcggtccatttttggaatccttagatccaaagtttgaagaatataaggctaagtgggcatccggtccactttcatgtgtttctattttccataaatttgttgttatcgcatctactagagacttggcaagaaagatcttgcaatcttccaaattcgtcaaaccttgcgttgtcgatgttgctgtgaagatcttaagaccttgcaattgggtttttttggacggtaaagctcatactgattacagaaaatcattaaacggtcttttcactaaacaagctttggctcaatacttaccttcattggaacaaatcatggataagtacatggataagtttgttcgtttatctaaggagaataactacgagccccaggtctttttccatgaaatgagagaaattctttgcgccttatcattgaactctttctgtggtaactatattaccgaagatcaagtcagaaagattgctgatgattactatttggttacagcagcattggaattagtcaacttcccaattattatcccttacactaaaacatggtatggtaagaaaactgcagacatggccatgaagattttcgaaaactgtgctcaaatggctaaggatcatattgctgcaggtggtaagccagtttgtgttatggatgcttggtgtaagttgatgcacgatgcaaagaatagtaacgatgatgattctagaatctaccacagagagtttactaacaaggaaatctccgaagctgttttcactttcttatttgcttctcaagatgcctcttcttctttagcttgttggttgttccaaattgttgctgaccgtccagatgtcttagctaagatcagagaagaacaattggctgttcgtaacaatgacatgtctaccgaattgaacttggatttgattgagaaaatgaagtacaccaatatggtcataaaagaaactttgcgttacagacctcctgtcttgatggttccatatgttgttaagaagaatttcccagtttcccctaactataccgcaccaaagggcgctatgttaattccaaccttatacccagctttacatgatcctgaagtttacgaaaatcctgatgagttcatccctgaaagatgggtagaaggctctaaggctagtgaagcaaagaagaattggttggtttttggttgtggtccacacgtttgcttaggtcaaacatatgtcatgattaccttcgccgctttgttgggtaaatttgcactatatactgatttccatcatacagtgactccattaagtgaaaaaatcaaggttttcgctacaattttcccaaaagatgatttgttactgactttcaaaaagagagacccaattactggagaagtcttcgaataa

SEQ ID NO: 28212 - protein, 538 aa, Saccharomyces cerevisiae
MSSVAENIIQHATHNSTLHQLAKDQPSVGVTTAFSILDTLKSMSYLKIFATLICILLVWDQVAYQIKKGSIAGPKFKFWPIIGPFLESLDPKFEEYKAKWASGPLSCVSIFHKFVVIASTRDLARKILQSSKFVKPCVVDVAVKILRPCNWVFLDGKAHTDYRKSLNGLFTKQALAQYLPSLEQIMDKYMDKFVRLSKENNYEPQVFFHEMREILCALSLNSFCGNYITEDQVRKIADDYYLVTAALELVNFPIIIPYTKTWYGKKTADMAMKIFENCAQMAKDHIAAGGKPVCVMDAWCKLMHDAKNSNDDDSRIYHREFTNKEISEAVFTFLFASQDASSSLACWLFQIVADRPDVLAKIREEQLAVRNNDMSTELNLDLIEKMKYTNMVIKETLRYRPPVLMVPYVVKKNFPVSPNYTAPKGAMLIPTLYPALHDPEVYENPDEFIPERWVEGSKASEAKKNWLVFGCGPHVCLGQTYVMITFAALLGKFALYTDFHHTVTPLSEKIKVFATIFPKDDLLLTFKKRDPITGEVFE

SEQ ID NO: 28213 - DNA, 2040 bp, Rattus norvegicus (Norway rat)
  CDS (82)..(1596)
ttactgaattcggatgcagagcatcagaggcccagctagagggacaacacagaggagtaatttgctgacagacctgcagggatggacctgctttcagctctcacactggaaacctgggtcctcctggcagtcgtcctggtgctcctctacggatttgggacccgcacacatggacttttcaagaaacaggggattcctgggcccaaacctctgcctttttttggcactgtgctgaattactatatgggtttatggaaattcgatgtggagtgccataaaaagtatggaaaaatatgggggttgtttgatggtcaaatgcctctgtttgccatcacggacacagaaatgatcaagaatgtgctagtgaaggaatgcttttctgtcttcacaaaccggcgggattttggcccagtggggattatggggaaagctgtctctgtagctaaggatgaggagtggaagagatatagagccttgctgtcccccacgttcaccagtggaagactcaaggagatgttccccatcattgaacagtatggagacattttggtaaagtacttgaagcaagaggcggagacaggcaagcctgtcaccatgaaaaaagtgtttggtgcctacagcatggatgtgatcaccagcacatcatttggagtgaacgtcgattcccttaacaacccaaaggatccttttgtggagaaaaccaagaaattgttaagatttgacttttttgatccgttgttcttgtcagtagtactctttccattcctcaccccaatatatgagatgttaaacatctgcatgttcccaaaagattcaatagaatttttcaaaaaatttgtgtacagaatgaaggaaacccgcctggattctgtgcagaagcatcgagtggattttcttcagctgatgatgaatgctcataatgattctaaagacaaagaatctcatacagccctatccgatatggagatcacagcccagtcaatcatttttatttttgctggatatgaacccaccagcagcacactttcctttgtcctgcattccctggccactcacccagatacacagaagaaactgcaggaggagatcgacagggctctgcccaataaggcacctcccacctatgatactgtgatggaaatggaatacctggatatggtgttgaatgaaaccctcagattgtatccaattggtaatagacttgagagagtctgtaaaaaagatgttgaaatcaatggtgtgtttatgcccaaagggtcagtggtcatgattccatcttatgctcttcaccgtgatccacagcactggccagagcctgaggaatttcgcccagaaaggttcagcaaggagaacaagggcagcattgatccttatgtatatctgccctttggaaatggacccaggaactgcattggcatgaggtttgctctcatgaatatgaaactcgctctcactaaagttctgcaaaacttctccttccagccttgtaaggaaacacagatacctctgaaattaagcagacaaggacttcttcaaccaacaaaacccattattctaaaggttgtgccacgggatgaaatcataactggatcatgattttccctcaaggagttctgctgaattcttcagaaatgtggtgtctaagaacaccagaccctttaatttatgtcatgaataaaattcagatgaaattagggcttaatcgactttgttttgattcggtacatctttgatctttctcagtgtctacaatgtacccatctaatataaaggaaatgacaagtcagtgacagaacaggaacttaacctttggtgattctcacgggactacctccatccacatctggttgtctctgttaatttcttttgatagtaaccttgtctctgtgtaatttgatcaagaactttttcatgaaaatgtgaactattgtgacaactttaattgtagatttggtatcagatgttttagatgcattattctacactaaatgttacatggaaaaaatgtgaataaacacttctttaaaaatccccaggggc

SEQ ID NO: 28214 - protein, 504 aa, Rattus norvegicus (Norway rat)
MDLLSALTLETWVLLAVVLVLLYGFGTRTHGLFKKQGIPGPKPLPFFGTVLNYYMGLWKFDVECHKKYGKIWGLFDGQMPLFAITDTEMIKNVLVKECFSVFTNRRDFGPVGIMGKAVSVAKDEEWKRYRALLSPTFTSGRLKEMFPIIEQYGDILVKYLKQEAETGKPVTMKKVFGAYSMDVITSTSFGVNVDSLNNPKDPFVEKTKKLLRFDFFDPLFLSVVLFPFLTPIYEMLNICMFPKDSIEFFKKFVYRMKETRLDSVQKHRVDFLQLMMNAHNDSKDKESHTALSDMEITAQSIIFIFAGYEPTSSTLSFVLHSLATHPDTQKKLQEEIDRALPNKAPPTYDTVMEMEYLDMVLNETLRLYPIGNRLERVCKKDVEINGVFMPKGSVVMIPSYALHRDPQHWPEPEEFRPERFSKENKGSIDPYVYLPFGNGPRNCIGMRFALMNMKLALTKVLQNFSFQPCKETQIPLKLSRQGLLQPTKPIILKVVPRDEIITGS

SEQ ID NO: 28215 - DNA, 2036 bp, Rattus norvegicus (Norway rat)
  CDS (67)..(1581)
gcagagtatcagaggcccagctagagggagaacaccgaggagtaatttgctgacagacaagcagggatggacctgctttcagctctcacactggaaacctgggtcctcctggcagtcatcctggtgcttctctaccgacttggaacccatagacatggaatttttaagaaacaaggaattcctgggccaaaacctctgccctttttaggcactgtgctgaattactacaagggcttagggagatttgacatggagtgctataaaaagtatggaaaaatatgggggttgtttgatggtcaaacgcctgtgtttgccatcatggacacagagatgattaagaatgtactagtgaaggaatgcttttctgtcttcacaaaccggcgggattttggcccagtggggattatggggaaagctgtctctgtagctaaggatgaggagtggaagagatatagagccttgctgtcccccacgttcaccagtggaagactcaaggagatgttccccatcattgaacagtatggagacattttggtaaagtacttgaagcaagaggcggagacaggcaagcctgtcaccatgaaaaaagtgtttggtgcctacagcatggatgtgatcaccagcacatcatttggagtgaacgtcgattcccttaacaacccaaaggatccttttgtggagaaaaccaagaaattgttaagatttgacttttttgatccgttgttcttgtcagtagtactctttccattcctcaccccaatatatgagatgctaaatatctgcatgttcccaaaggattcaatagcatttttccaaaaatttgtgcacagaataaaggaaacccgtctggattctaagcataagcaccgagtggattttctccagctgatgctgaacgctcataataattccaaagacgaagtgtctcataaagccctgtctgatgttgaaatcatagcccagtcagttatctttatttttgctggctatgaaaccaccagcagcacactctcctttgtcttgtatttcctggccactcaccctgatattcagaagaaactgcaggaggagatcgatggggccctgccgagtaaggcacctcctacctacgatattgtgatggaaatggaatacctggatatggtgttgaatgaaactctcagattgtatccaattggtaatagacttgagagagtctgtaaaaaagatatagaacttgatggtttgtttatacccaaagggtcagtagtgacgattccaacatatgctcttcatcatgacccacagcactggccaaagcctgaggaatttcatccagaaaggtttagcaaggagaacaagggaagcattcatccttatgtatatctgccctttggaaatggacccaggaactgcattgacatgaggtttgctctcatgaatatgaaactcgctctcactaaagttctgcaaaacttctccttccagccttgcaaggaaacacagatacctctgaaattgagtagacaagcaattcttgaaccagaaaaacccattgttctaaaggttctgccacgggatgcagtcataaatggagcctgactttccctcaaggaattttattgggatcttcacaaaggcagtgtctaagaacattgaaccttttaatttacttactgaattgaattcagataaaactgggacttaattgactgctcttgatgcatggttaaagatttggtacatttatggatctttctaagtgtctatacgaagtaccacataataaaaaggagttggcaaggtctgtgatggaacaggaaattcacctttgctgattctcatgggaccatctccatccacatctggtggtctctgttaatttcttttgagctcttttgatagtaaccatgtcctcgtcctttgatcaataatactttgatgtaaaggtgaactattgtggtaattctatttgtagatttggtatcagatgtttttcattgcaatattctagaataaatgctacatggaaagtaaaaaaaaaatccccaggggca

SEQ ID NO: 28216 - protein, 504 aa, Rattus norvegicus (Norway rat)
MDLLSALTLETWVLLAVILVLLYRLGTHRHGIFKKQGIPGPKPLPFLGTVLNYYKGLGRFDMECYKKYGKIWGLFDGQTPVFAIMDTEMIKNVLVKECFSVFTNRRDFGPVGIMGKAVSVAKDEEWKRYRALLSPTFTSGRLKEMFPIIEQYGDILVKYLKQEAETGKPVTMKKVFGAYSMDVITSTSFGVNVDSLNNPKDPFVEKTKKLLRFDFFDPLFLSVVLFPFLTPIYEMLNICMFPKDSIAFFQKFVHRIKETRLDSKHKHRVDFLQLMLNAHNNSKDEVSHKALSDVEIIAQSVIFIFAGYETTSSTLSFVLYFLATHPDIQKKLQEEIDGALPSKAPPTYDIVMEMEYLDMVLNETLRLYPIGNRLERVCKKDIELDGLFIPKGSVVTIPTYALHHDPQHWPKPEEFHPERFSKENKGSIHPYVYLPFGNGPRNCIDMRFALMNMKLALTKVLQNFSFQPCKETQIPLKLSRQAILEPEKPIVLKVLPRDAVINGA

SEQ ID NO: 28217 - DNA, 1882 bp, Oryctolagus cuniculus (domestic rabbit)
  CDS (55)..(1560)
cacacgcccagcccagcaaagagcagcacccacagctgcagaaggacagtggcgatggatctgatcttttccctggaaacatgggttctcctggctgccagcctggtgctcctgtatctatatggtaccagtactcatggactttttaagaagatgggaattcctgggccaacacctttgcctttcattggtactattctggagtaccgcaagggtatatgggatttcgacatagaatgtcgtaaaaaatatggaaagatgtgggggttgttcgatggtcggcaacctttgatggttatcactgatccagacatgataaagacagtactggtgaaagaatgctattctgtcttcacaaaccggcggtcttttggaccagtgggatttatgaaaaaagccgtctccatatctgaggatgaagattggaagagagttagaacattgctgtctccaaccttcacgagtggaaaactcaaggagatgttacccatcattgcgcagtatggagatgtgttggtgaaaaacctgaggcaggaagcagagaaaggcaagcccgtcgacttgaaagaaatctttggggcctacagcatggacgtgatcaccggtacatccttcggagtgaacattgattcccttagaaatccacaagatccgtttgtgaaaaacgtcaggaggctgttgaaatttagtttcttcgatcctctacttctctcaataacactctttccattccttaccccaatttttgaggcattgcatatcagtatgttcccaaaagatgttatggattttttgaaaacatccgtggaaaagattaaagatgatcgtctcaaagacaagcaaaagcgccgagtggattttctccagctgatgattaactctcagaattccaaagaaatcgattcccacaaagctctggatgatatagaggttgtagcccaatcaattatcattctctttgcgggctatgagacaactagcagcaccctctccttcattatgcatttgttggccactcaccctgatgtccagcagaaactccaggaggagattgatacacttttgcccaataaggaacttgctacatatgataccctggtcaagatggaatatctggacatggtggtgaatgaaactctcagattatacccaattgctggcagacttgagagagtctgtaagaaagatgttgacatcaatgggacattcattcccaaagggacaattgtgatgatgccaacgtatgcgcttcaccgagatccacagcactggactgagcctgatgaattccgccctgaaaggttcagtaagaagaacaaagacaacatcaatccttacatataccatccctttggagctggaccccgaaattgccttggcatgaggtttgctctcatgaatataaaacttgctcttgtgagattaatgcagaacttctccttcaaactttgtaaggaaactcaggtccctctaaaattaggtaagcaaggacttcttcaaccagaaaaacccatcgttctaaaggttgtgtcgagagacgggatcatacgtggagcttgactttcctatggaattttgctttactcttcaaggaggccatatcccagaatgagacctacatttactttgtgaataatagttggaaataaagatggggttaacctgtggtacttaaagagtgatggtggagtgtgggttcactgagccatccctgtgtgtgtagagtgctgtctgttgtgtaatagaggaggtgactacatcagtgccacacctgcagattaggcctctccaatcctcggggattccctctctccatgctcattctgtcatatcacccctcacttagcttgatcagacaataaacttggctcactggtttttg

SEQ ID NO: 28218 - protein, 501 aa, Oryctolagus cuniculus (domestic rabbit)
MDLIFSLETWVLLAASLVLLYLYGTSTHGLFKKMGIPGPTPLPFIGTILEYRKGIWDFDIECRKKYGKMWGLFDGRQPLMVITDPDMIKTVLVKECYSVFTNRRSFGPVGFMKKAVSISEDEDWKRVRTLLSPTFTSGKLKEMLPIIAQYGDVLVKNLRQEAEKGKPVDLKEIFGAYSMDVITGTSFGVNIDSLRNPQDPFVKNVRRLLKFSFFDPLLLSITLFPFLTPIFEALHISMFPKDVMDFLKTSVEKIKDDRLKDKQKRRVDFLQLMINSQNSKEIDSHKALDDIEVVAQSIIILFAGYETTSSTLSFIMHLLATHPDVQQKLQEEIDTLLPNKELATYDTLVKMEYLDMVVNETLRLYPIAGRLERVCKKDVDINGTFIPKGTIVMMPTYALHRDPQHWTEPDEFRPERFSKKNKDNINPYIYHPFGAGPRNCLGMRFALMNIKLALVRLMQNFSFKLCKETQVPLKLGKQGLLQPEKPIVLKVVSRDGIIRGA

SEQ ID NO: 28219 - DNA, 1482 bp, Arabidopsis thaliana (mouse-ear cress)
  CDS (1)..(1482)
atggtttcctcagtttccctatttgcttctcttacaccgtacttagtctcagcattacttctattccttctgctcgagcaactcttttaccgtctcaagaaacgtaacctccctggccctctctttgtctttccgataattggaaatgttgttgcacttattcgcgacccaacttccttctgggacaagcaatccgcgatggcggacacgtccgttggcctctccgtcaactaccttattggaaaattcatcatatacattaaagacgcagagctctccaataaagtcttctccaacattcgtcccgatgctttccaacttgttggacatccattcggaaagaagctcttcggtgatcatagccttatctttatgtttggcgagaatcacaaatccgttcgtcgtcaagtcgctcctaacttcacccgcaagccactctctgcttattcttccctccagcaaatagttatcctccgtcatttacggcagtgggaggaaagtttttccagtggatctcgtccggtttcgatgagacaactcatccgtgaactcaacctcgagacttctcagacggtttttgttggaccatatctcgacaaggaagtcaagaacacgatccgtgatgattacaatgtgttcaatcctggaacaatggcgctcccgatcgacctccctggcttcacgttcggggaggctcgtcgggcggtatcgaggctagtgaatacaatgtctctttgcgtgagaaaatcaaaagaaaagatggccgcaggagagaatccaacatgtttagtcgatttctggacgcattcgatcgtagctgagagtcctccaccgcctcactccaaagacgaagagattagttgtgtgctcgttgattttctgtttgcctcacaggacgcgtctacgtcatcactcctctgggcagtggtgctgcttgagtccgagccagaagtgctaagaagagtgagggaggacgttgcaagattttggtcgcctgagtccaaggagtcgatcacagccgatcagctcgcggagatgaagtacattcgggctgtggcgcgtgaggtcttaagataccgaccaccagcaagtatggtcccacatgttgctgttagtgacttccgtctcacggaatcgtacacaatcccaaaaggtacaattgtgtttccttccctttttgacgcctcttttcaagggtttactgaaccagaccggttcgatcctgaccggtttagcgagacaaggcaagaggatgaggtgttcaaacgcaatttcctaacttttggaattggctcgcaccaatgcgtgggccaacgttacgcgctgaaccacctcgtgctcttcattgccatgttctcctcgatgtttgatttcaagagggtccgatcagatggttgcgatgagattgtgcatatccccacgatgtcgccaaaggacgggtgcacggtgttcttgtctagccgcctcgttacctctccttga

SEQ ID NO: 28220 - protein, 493 aa, Arabidopsis thaliana (mouse-ear cress)
MVSSVSLFASLTPYLVSALLLFLLLEQLFYRLKKRNLPGPLFVFPIIGNVVALIRDPTSFWDKQSAMADTSVGLSVNYLIGKFIIYIKDAELSNKVFSNIRPDAFQLVGHPFGKKLFGDHSLIFMFGENHKSVRRQVAPNFTRKPLSAYSSLQQIVILRHLRQWEESFSSGSRPVSMRQLIRELNLETSQTVFVGPYLDKEVKNTIRDDYNVFNPGTMALPIDLPGFTFGEARRAVSRLVNTMSLCVRKSKEKMAAGENPTCLVDFWTHSIVAESPPPPHSKDEEISCVLVDFLFASQDASTSSLLWAVVLLESEPEVLRRVREDVARFWSPESKESITADQLAEMKYIRAVAREVLRYRPPASMVPHVAVSDFRLTESYTIPKGTIVFPSLFDASFQGFTEPDRFDPDRFSETRQEDEVFKRNFLTFGIGSHQCVGQRYALNHLVLFIAMFSSMFDFKRVRSDGCDEIVHIPTMSPKDGCTVFLSSRLVTSP

SEQ ID NO: 28221 - DNA, 1672 bp, Arabidopsis thaliana (mouse-ear cress)
  CDS (50)..(1531)
caaaaaagcatgcaatacaaaaaaagcaaataatagaaaacaaagagcaatggtttcctcagtttccctatttgcttctcttacaccgtacttagtctcagcattacttctattccttttgctcgagcaactcttttaccgtgtcaagaaacgtaacctccctggccctctctttgtctttccgatcattggaaatgttgttgcacttatccgcgacccaacttccttctgggacaagcaatccgcgatggcggacacgtccgttggcctctccgtcaactaccttattggaaaattcatcatatacattaaagacgcagagctctccaataaagtcttgtccaacattcgtcccgatgctttccaacttactggacatccattcggaaagaagctcttcggtgatcacagccttatctttatgtttggcgaggatcacaaatccgttcgtcgtcaagtcgctcctaacttcacccgcaagccactctctgcttattcttccctccagcaaatagttatcctccgtcatttacggcagtgggaggaaagtttttctagtggatctcgtccggtttcgatgagacaactcatccgtgaactcaacctcgagacttcccaaacagtttttgttggaccatatctcgacaaagaagtcaagaaaacgatttgtgatgattacagtttgttaactcttggaacaatggcgatcccgatcgacctccctggcttcacgttcggggaggctcgtcaggcggtatcgaggctagtgaacacaatgtctgtttgcgtgggaaaatcaaaagcaaagatggccgcaggagagaatccaacatgtctagtcgatttctggacgcattcgattatagaagagaatcctccaccgcctcactccaaagataaagagattagttgtgtgctcgttgactttatgtttgcctcacaagacgcgtccacgtcatcactcctctgggcagtggtgatgcttgagtcggagccggaagtgctaagaagagtgagggaggacgttgcaagattttggtcgtcggagtccaacgagttgatcacagccgatcagcttgcggagatgaagtacactcgggctgtggcgcgtgaggtcttaagataccgaccaccagcaagtatgattccacatgttgctgttagtgacttccgtctcacggaatcgtacacaatcccaaaaggtacaattgtgtttccttccctttttgacgcctcgtttcaagggtttactgaaccagaccggttcgatcctgaccggtttagcgagacaaggcaagaggatgaggtgttcaaacgtaatttcctaacttttggaaatggctcgcaccagtgtgtgggccaacgttacgcgatgaaccacctcgtgctcttcattgccatgttctcctcgatgtttgatttcaagagggtccgatcggatggttgcgatgacattgtgcatatccccacaatgtcgcccaaggacggatgcacggtgttcttgtctagccgcctcgttacctctccttgaattgatttgataaaagtcatcgtcagtgtatattctatgattgttcatgatgttccctaagtgttattaaatttgagaggagatgtcattgtttcgccatgtcttcaccatatttaattcgtgttcttgttttattttgtc

SEQ ID NO: 28222 - protein, 493 aa, Arabidopsis thaliana (mouse-ear cress)
MVSSVSLFASLTPYLVSALLLFLLLEQLFYRVKKRNLPGPLFVFPIIGNVVALIRDPTSFWDKQSAMADTSVGLSVNYLIGKFIIYIKDAELSNKVLSNIRPDAFQLTGHPFGKKLFGDHSLIFMFGEDHKSVRRQVAPNFTRKPLSAYSSLQQIVILRHLRQWEESFSSGSRPVSMRQLIRELNLETSQTVFVGPYLDKEVKKTICDDYSLLTLGTMAIPIDLPGFTFGEARQAVSRLVNTMSVCVGKSKAKMAAGENPTCLVDFWTHSIIEENPPPPHSKDKEISCVLVDFMFASQDASTSSLLWAVVMLESEPEVLRRVREDVARFWSSESNELITADQLAEMKYTRAVAREVLRYRPPASMIPHVAVSDFRLTESYTIPKGTIVFPSLFDASFQGFTEPDRFDPDRFSETRQEDEVFKRNFLTFGNGSHQCVGQRYAMNHLVLFIAMFSSMFDFKRVRSDGCDDIVHIPTMSPKDGCTVFLSSRLVTSP

SEQ ID NO: 28223 - DNA, 1956 bp, Arabidopsis thaliana (mouse-ear cress)
  CDS (195)..(1757)
caagataagaagaaaccaaactcgcaaagaaacaaaaaggaaaaaaaaaaaaaaaacgaattaaaaaaagaagaaataaatcctcctttttaacacctcattccctctttctccggcactcaaaagagaccaaagaagaaaactttagctctcctttttgtgttttctctcttttctttgttggtgttccgacaatggaggaagaaagtagcagctggttcattccaaaggttcttgttctgtctgtaatcttaagtcttgtaatagtgaagggtatgtctctgttatggtggagaccaagaaagattgaagaacatttctctaaacaaggaattcgaggtcctccttatcatttcttcatcggaaatgttaaagaacttgttggaatgatgcttaaagcttcttctcatcctatgcctttctctcacaatattcttcctagagttctctctttttaccatcactggagaaaaatctacggtgctacatttctggtttggttcggtccaactttccggttaacggtagccgatcctgatttgatcagagagatcttctctaagtctgagttctacgagaagaatgaagctcaccctttggttaaacaacttgaaggcgatggactacttagtctcaaaggtgaaaaatgggctcatcatcgaaaaatcattagccctacttttcatatggagaatcttaagttgcttgtaccagttgtgttgaagagtgtgactgatatggtggataaatggtccgataagttatcagaaaacggtgaagttgaggtagatgtctatgagtggtttcagattttgactgaagatgttattagtagaacagcttttggaagtagctatgaagatggtcgagcagtttttcgacttcaagctcaacaaatgcttctttgtgctgaagcttttcaaaaagtcttcattcctggctatagattttttccgacaagagggaatttgaagtcttggaagttagacaaggagataaggaagtcgttgttgaagctgatagagcggcggagacaaaacgctatagatggagaaggggaagaatgtaaggagccggcggcgaaggatttgttgggattaatgattcaggcaaagaatgtgacggttcaggacattgtggaggagtgtaaaagctttttcttcgccgggaaacagacaacttctaatctgctgacgtggacgaccatcttgctatccatgcacccggagtggcaggccaaagcacgtgatgaggtcctcagggtctgcggctcacgtgatgtccctaccaaggaccatgtcgttaagcttaaaacgttgagtatgatcttgaacgagtctttaaggttgtatccaccaatagtagctacgattcgacgcgctaaatcggatgtgaagctaggagggtacaaaatcccatgtggcacggagcttctaatcccaatcatagcggtccatcatgaccaagccatttggggtaatgacgtgaacgaattcaatccagctcggtttgcggatggagtgccgcgtgctgccaaacaccccgttggcttcataccgtttggcctcggagttcgtacatgcattggtcagaatcttgctatacttcaggccaaattgacactcgctgtaatgatccaacgcttcacctttcacttggctcctacttatcagcatgcacctaccgtccttatgttgctttatcctcaacatggtgcaccaatcaccttccggagattgaccaatcatgaggattgatgaaagatcttcaacggtcaaaaatttgttccggacttggaagaaaaatgtctcaagctttcataactgacatgctctttttgttgtcttttttttttttaactttcataaatatatagttttaactttcaaaccattgttttttttttcattccatttttctctaaaatttatttttatcagcttcaatttggggttt

SEQ ID NO: 28224 - protein, 520 aa, Arabidopsis thaliana (mouse-ear cress)
MEEESSSWFIPKVLVLSVILSLVIVKGMSLLWWRPRKIEEHFSKQGIRGPPYHFFIGNVKELVGMMLKASSHPMPFSHNILPRVLSFYHHWRKIYGATFLVWFGPTFRLTVADPDLIREIFSKSEFYEKNEAHPLVKQLEGDGLLSLKGEKWAHHRKIISPTFHMENLKLLVPVVLKSVTDMVDKWSDKLSENGEVEVDVYEWFQILTEDVISRTAFGSSYEDGRAVFRLQAQQMLLCAEAFQKVFIPGYRFFPTRGNLKSWKLDKEIRKSLLKLIERRRQNAIDGEGEECKEPAAKDLLGLMIQAKNVTVQDIVEECKSFFFAGKQTTSNLLTWTTILLSMHPEWQAKARDEVLRVCGSRDVPTKDHVVKLKTLSMILNESLRLYPPIVATIRRAKSDVKLGGYKIPCGTELLIPIIAVHHDQAIWGNDVNEFNPARFADGVPRAAKHPVGFIPFGLGVRTCIGQNLAILQAKLTLAVMIQRFTFHLAPTYQHAPTVLMLLYPQHGAPITFRRLTNHED

SEQ ID NO: 28225 - DNA, 1782 bp, Rattus norvegicus (Norway rat)
  CDS (123)..(1736)
gcgattggctggttcagcccagctcaacttcccgcacagcttccggcaagtcggaagccagggacaaaaagttttcaaagaagataggaggttgtggaggactcgctgctcatgagagaaggatgctacaactaagcctgtcccggctgggaatggggtccctgacagcctctccatggcatctactgctgctgggaggagcctcttggatactagcccgaattctggcctggatctataccttctatgacaactgctgccgccttcgttgcttccctcagccccctaaaccaagttggttttggggtcacttgaccttgatgaagaacaacgaggaaggcatgcagttcatagcacatctgggccgcaacttccgtgatatccacctctcttgggtgggacccgtgtacccgatcctgcgactcgtccaccctaacgtcattgctcccctgctccaagcctcagctgctgttgcacccaaggaaatgaccctctatggcttcctgaagccctggctgggggatgggctcctgatgagcgctggtgagaagtggaaccaccaccgacgcctgctgacacccgccttccactttgacatcctgaagtcctacgtgaagatttttaacaagagcgtgaacaccatgcatgccaagtggcagcgtctgactgccaagggcagtgcccgtctggacatgttcgagcacatcagcctgatgaccttggacagcctgcaaaaatgcatcttcagcttcgacagcaactgtcaggagtctaacagtgaatacatagctgcgatcctggaactcagctccctcatagtgaaacggcaacgccagcccttcctgtacctggacttcctgtattacctcactgctgatgggcggcgcttccgcaaggcctgcgacgtggtgcacaacttcacagatgctgtcatcagggagagacgcagcaccctcaatacccagggcgttgatgaattcctaaaggccagggctaagactaaaactttagactttattgatgttctcttgctggccaaggatgagcatgggaaggggctgtcggatgtggacatccgagcagaggctgacaccttcatgttcggaggtcatgacaccacggccagcgcactctcctggatcctgtacaacctggcaaggcacccggaataccaggagcgctgccggcaggaggtgcgggagctgctgagggaccgagagcctgaggagattgaatgggacgacctggcccagctgcccttcctaaccatgtgcatcaaggagagtctgcggctgcaccctccagtcttattaatctcccgctgctgttcccaggacattgtgctgccagatggccgggtcatccccaaagggaacatctgtgtcatcagcatctttggggttcaccacaatccttcagtgtggccagaccctgaggtctacaaccccttccgctttgacccagaaaacccacagaagaggtcacctctggcttttattcccttctcagcgggacccaggaactgcataggacagactttcgccatgagcgagataaaggtggcgctggcgctgacgctgctgcgcttctgcgtcctgccagatgacaaggagccgcgccggaagccggagctgatcctgcgtgcggagggcggactgtggctgcgggtggaaccgctgagcacagtgacctcacagctgccttgggacctcctcgcccaccctcctacctcttgagatctctgaataaagaattaaataagaaaaaaaaaaaaaaaaaaaa

SEQ ID NO: 28226 - protein, 537 aa, Rattus norvegicus (Norway rat)
MLQLSLSRLGMGSLTASPWHLLLLGGASWILARILAWIYTFYDNCCRLRCFPQPPKPSWFWGHLTLMKNNEEGMQFIAHLGRNFRDIHLSWVGPVYPILRLVHPNVIAPLLQASAAVAPKEMTLYGFLKPWLGDGLLMSAGEKWNHHRRLLTPAFHFDILKSYVKIFNKSVNTMHAKWQRLTAKGSARLDMFEHISLMTLDSLQKCIFSFDSNCQESNSEYIAAILELSSLIVKRQRQPFLYLDFLYYLTADGRRFRKACDVVHNFTDAVIRERRSTLNTQGVDEFLKARAKTKTLDFIDVLLLAKDEHGKGLSDVDIRAEADTFMFGGHDTTASALSWILYNLARHPEYQERCRQEVRELLRDREPEEIEWDDLAQLPFLTMCIKESLRLHPPVLLISRCCSQDIVLPDGRVIPKGNICVISIFGVHHNPSVWPDPEVYNPFRFDPENPQKRSPLAFIPFSAGPRNCIGQTFAMSEIKVALALTLLRFCVLPDDKEPRRKPELILRAEGGLWLRVEPLSTVTSQLPWDLLAHPPTS

SEQ ID NO: 28227 - DNA, 2101 bp, Rattus norvegicus (Norway rat)
  CDS (280)..(1791)
agcagccttatatgtatcaagatgcattttattaagtcttcatgggtatctggggaagaataaattgtttgtttggcctgagcaccaattagtgtccacatctctgagaaagaacatggatctacaactatccgtgaaagcccaatgcatgggggcaacatcaattagtactcgtgccgaattcggcacgaggggagctcagcacgttcagccctgcaaagggcagtacacaaaattgagagtaaagctcgaagagagacttgtttaaagaaaacggcaatggatttgatcccaaacttttccatggaaacctggctgctcctggttatcagcctggtgctcctctacctatatggaactcattcacatggaatttttaaaaagttgggaattcctgggcccaaacctttgcctttcttggggacgattcttgcttacaggaagggcttctgggaatttgacaaatactgccataaaaaatatgggaaattatgggggttgtacgatggtcgacagcctgtgctagcgatcacggatccagacataatcaaaacagtgctggtgaaggaatgttactctaccttcacaaaccgacggaactttggtccagtgggtattttgaaaaaagccatctccatctctgaggatgaagaatggaagagaattcgagccctgctgtctccaaccttcaccagtgggaagctcaaggagatgttccccatcattaaccagtatacagatatgttggtgagaaacatgaggcagggatcggaggaaggcaagcccaccagcatgaaagacatctttggggcctacagcatggatgtgatcacagccacctcatttggagtgaatgttgattcccttaacaacccacaggacccttttgtggaaaaagtcaagaagctcttaaaatttgatatctttgatccattgttcctctcagtgacactttttccattccttaccccactatttgaagcactaaatgtctccatgtttccaagagatgtcattgacttttttaaaacttcagtagaacgaatgaaagagaatcgcatgaaagagaaagaaaagcaaagaatggactttcttcagctgatgataaactcccagaattccaaagtcaaagactctcataaagcattatccgatgtggagattgtggcccagtcagttatcttcatttttgccggctatgagaccactagcagtgctctttcctttgttttgtatttgctggccattcaccctgatatacagaagaaactgcaggatgaaattgatgcagctctccccaataaggcacatgccacctatgataccctgctacaaatggagtatctagatatggtggtgaatgaaaccctcagattatatccaattgctggaaggcttgagagggtctgtaagacagatgttgaaatcaatggggtgttcattcccaaagggactgtggtgatgataccaacctttgctcttcacaaagacccgcattactggccagagcctgaggaattccgccctgaaaggttcagcaagaagaatcaggataacatcaatccttatatgtacctgccctttgggaatggacccaggaactgtattggcatgaggtttgctctcatgaacatgaaagttgctcttgtcagagtcctgcagaacttctccttccaaccttgtaaggaaactcagatccctttaaaattgagcaaacaaggacttcttcaaccagaaaagccactgcttctaaaagttgtgtccagagatgagactgtgaatggagcttgatgtagaatggcctatagtggtgttgtatcacatggaccagaaaccagttcatattgtgaatgaatccagagatgaagattgcagtaattttgttcactcctgggggttttgggtgttctttgagctttctcagcctctgtgcaagttgttttctgtggaacataaggatctaatgacataaatccaagataaatatattcaactcgtggttcttgtgggatggcctatgttaccttcattgttaccaccaaatactctgatttctgatgagaaaataaataaacatcaattactagttctatcaccatta

SEQ ID NO: 28228 - protein, 503 aa, Rattus norvegicus (Norway rat)
MDLIPNFSMETWLLLVISLVLLYLYGTHSHGIFKKLGIPGPKPLPFLGTILAYRKGFWEFDKYCHKKYGKLWGLYDGRQPVLAITDPDIIKTVLVKECYSTFTNRRNFGPVGILKKAISISEDEEWKRIRALLSPTFTSGKLKEMFPIINQYTDMLVRNMRQGSEEGKPTSMKDIFGAYSMDVITATSFGVNVDSLNNPQDPFVEKVKKLLKFDIFDPLFLSVTLFPFLTPLFEALNVSMFPRDVIDFFKTSVERMKENRMKEKEKQRMDFLQLMINSQNSKVKDSHKALSDVEIVAQSVIFIFAGYETTSSALSFVLYLLAIHPDIQKKLQDEIDAALPNKAHATYDTLLQMEYLDMVVNETLRLYPIAGRLERVCKTDVEINGVFIPKGTVVMIPTFALHKDPHYWPEPEEFRPERFSKKNQDNINPYMYLPFGNGPRNCIGMRFALMNMKVALVRVLQNFSFQPCKETQIPLKLSKQGLLQPEKPLLLKVVSRDETVNGA

SEQ ID NO: 28229 - DNA, 1887 bp, Mus musculus (house mouse)
  CDS (10)..(1539)
ttctgaactatgagtgtctctgctctaagcccaacccgatttgcagacagcctctctggcttcctccaagtggcctctgtgctcggtctgctcctgctgctggtgaaagctgtccagttctacctccacaggcaatggctactcaaggctttccagcagttcccatcacctccttttcactggttctttgggctagagaagttcaaaggtgaccaagaactacaggaaattgtgtcgtgcatagagaacttcccaagtgcctttcctagatggttctggggaagcaaggcctacttaactgtctatgaccctgactacatgaaagtgattctggggcgatcagatccaaaggctaatggtgcgtacagattgctagctccttggattgggtatggtttgctcttgttgaatggacagccatggttccagcacaggaggatgctaaccccagccttccactatgacattctgaaaccctatgtgaaaaacatggccgactccattcgattgatgctagacaaatgggaacggctggctgatcaggactcctctatagagatctttcaacacatctccttaatgaccctagacactgtcatgaaatgtgccttcagccacaagggcagtgttcaggtagatggaaattacaggacctacctccaggccattggggacttgaataacctatttcactcccgtgtgaggaataactttcatcagaatgataccatctacaaactttcttccaatggccgcttggccaaacaagcttgtcaacttgcccatgatcacacagatggagtgatcaagctgagaaaggatcagctgcaggatgagggagagctggaaaagatcaagaagaagagacgtttggattttctggatatccttttatttgccagaatggagaatggggacagcatgtctgacaaggacctacgtgctgaggtggacacattcatgttcgagggccatgacaccacagccagtggagtctcctggatcttctatgctctggccacacaccctgatcaccaacagagatgcagagaggaagttcagagcctcctgggggatggatcctctatcacctgggatcacctagaccagattccctataccacaatgtgcatcaaggaggccctaaggctctacccacctgtcccaggcattgtcagagaactcagtacatctgtcaccttccctgatggacgctctttacccaaaggtgtccaggtcacactctccatttatggtctccaccacaacccgaaggtgtggccaaatccagaggtgtttgacccttccaggtttgcaccagactctccccgacacagccactcattcctgcccttctcaggaggagccaggaactgcattgggaaacaatttgctatgagtgagctgaaggtgattgtggccctgacactgctccgcttcgaactactgccagatcctaccagggtccccatgcccttagcccgacttgtgctgaagtccaaaaatgggatctacctacatctcaagaagctccactgattctgttgtggagctccaatgtctgagaagagtttcactggagaaagctaagttgttggtgtgacctacctttttcagaagaatacatccagagagtctctcaacctctgttcagtatagatcaacattcctcggcactggaatattcccctgcttcaaagccagcaccctcctcatcccctctccttctaatgtccttcccttttacaaacgcttatgactactacaagacccctaaaaactccaagtaagttttccctactaaatgtatcttatttgaggtaacctactaagtcccttttgaatttagaggttaattacaatttgtccatagggctccaaatcaca

SEQ ID NO: 28230 - protein, 509 aa, Mus musculus (house mouse)
MSVSALSPTRFADSLSGFLQVASVLGLLLLLVKAVQFYLHRQWLLKAFQQFPSPPFHWFFGLEKFKGDQELQEIVSCIENFPSAFPRWFWGSKAYLTVYDPDYMKVILGRSDPKANGAYRLLAPWIGYGLLLLNGQPWFQHRRMLTPAFHYDILKPYVKNMADSIRLMLDKWERLADQDSSIEIFQHISLMTLDTVMKCAFSHKGSVQVDGNYRTYLQAIGDLNNLFHSRVRNNFHQNDTIYKLSSNGRLAKQACQLAHDHTDGVIKLRKDQLQDEGELEKIKKKRRLDFLDILLFARMENGDSMSDKDLRAEVDTFMFEGHDTTASGVSWIFYALATHPDHQQRCREEVQSLLGDGSSITWDHLDQIPYTTMCIKEALRLYPPVPGIVRELSTSVTFPDGRSLPKGVQVTLSIYGLHHNPKVWPNPEVFDPSRFAPDSPRHSHSFLPFSGGARNCIGKQFAMSELKVIVALTLLRFELLPDPTRVPMPLARLVLKSKNGIYLHLKKLH

SEQ ID NO: 28231 - DNA, 2005 bp, Rattus norvegicus (Norway rat)
  CDS (60)..(1553)
tgcaagactgtcagctgggaaggaaacttggaggcctgaactgctgaaggagagctaagatggagatcattcccaacctttctatagagacctgggtgcttctagctactagcttgatgctcttctacatatatgggacctattctcatggcctgtttaagaaactaggaattcctggacccaaacctgtgcctttatttggcaccattttcaactacggtgatggcatgtggaaatttgatgatgactgctataaaaagtatggaaaaatatgggggttttatgagggcccacagccttttttggctatcatggatccagagatcatcaaaatggtgctggtgaaagaatgttactcagtcttcacaaaccgtcggtgttttgggccaatgggatttatgaaaaaggccattaccatgtctgaggatgaagaatggaagagacttcgaacaatcctgtctccaaccttcaccagtggcaaactcaaggagatgttccccctcatgagacagtatggagatacattgttgaagaacttgaggcgagaagaagcaaaaggggagcccatcaacatgaaagacatctttggagcttatagcatggacgtgatcactggcacatcatttggagtgaacgtcgattccctcaacaatccacaggatcccttcgtgcagaaagccaagaagatcttaaaatttcaaatttttgatccatttcttctctctgtagttctgtttccatttcttactccaatatatgagatgttaaatttttcaatttttccaagacagtcaatgaactttttcaaaaaattcgtaaaaacaatgaagaaaaatcgccttgattcaaaccagaagaaccgagtggattttcttcaactgatgatgaatactcagaactccaaaggccaagagtcccagaaagctctttctgatctagaaatggcagcacaagctattattttcatttttgggggttatgatgccacaagcacctccatttccttcataatgtatgaactggccactcgccccaatgtgcaaaagaaactccagaatgagattgatagagctctgcccaataaggcacctgtcacctatgatgctctgatggaaatggagtacctggacatggtggtgaatgaaagtctaagattgtacccaattgctaccaggctagacagagtctcaaaaaaggatgtggaaatcaatggagtttttattcccaaagggactgtagttacgataccaatctatcctcttcatcggaaccctgagtactggctagagcctgaggaattcaaccctgaaaggttcagcaaggagaacaagggcagcattgatccttatgtatatctgccctttggaaatggacccaggaactgcattggcatgaggtttgctctcatcagcatgaaacttgctgtcataggagtcctgcagaacttcaatatccagccttgtgagaagacacagatccctctgaagatcagtaggcaaccaattttccaaccagaaggacccatcatcctaaagcttgtgtcaagagattaaacccagatttggacagtgaatttccctcaggaaccatgttataatcttcaaggagactgtttcacagaacaccagagaatttaattaacattagaataagagcaatataatataggcttcatcaattttcctcgattactgagtattcagaaattcactgaacaggctcagtggctctgcggtgtatcatctattttatgattcaaagaaaattattaactcaatggtagatgtggaggttcatcatatgattcttgtggaccatctatacagattccagttagttccatcagttctgtattctaactgcagtagctgtttctctagagttctatcaatagaaactgttgtattgacagttagtaaatgtgtagcaaattttctctttgtaaaaatatatgatattaagaatataaataaatatatctttcatgaaaaaaaaaaaaaaaaaa

SEQ ID NO: 28232 - protein, 497 aa, Rattus norvegicus (Norway rat)
MEIIPNLSIETWVLLATSLMLFYIYGTYSHGLFKKLGIPGPKPVPLFGTIFNYGDGMWKFDDDCYKKYGKIWGFYEGPQPFLAIMDPEIIKMVLVKECYSVFTNRRCFGPMGFMKKAITMSEDEEWKRLRTILSPTFTSGKLKEMFPLMRQYGDTLLKNLRREEAKGEPINMKDIFGAYSMDVITGTSFGVNVDSLNNPQDPFVQKAKKILKFQIFDPFLLSVVLFPFLTPIYEMLNFSIFPRQSMNFFKKFVKTMKKNRLDSNQKNRVDFLQLMMNTQNSKGQESQKALSDLEMAAQAIIFIFGGYDATSTSISFIMYELATRPNVQKKLQNEIDRALPNKAPVTYDALMEMEYLDMVVNESLRLYPIATRLDRVSKKDVEINGVFIPKGTVVTIPIYPLHRNPEYWLEPEEFNPERFSKENKGSIDPYVYLPFGNGPRNCIGMRFALISMKLAVIGVLQNFNIQPCEKTQIPLKISRQPIFQPEGPIILKLVSRD

SEQ ID NO: 28233 - DNA, 1874 bp, Ustilago maydis (corn smut)
  CDS (44)..(1729)
ggatccacacagaccgacgtggttgtcgtacacttgcgtactcatggtggcctcctcgtcttcggcgacagcgtcgttgctcgaccagctgtttgcgcttacgcctctcgccgattcttcggcctggatcaaaaccatcacggtgctcgttttgcttcccttgctcgcggtcgttctcaacgtagcatcgcagcttctgcttgcgactcccaagaatcatcctccggtggtgtttcactttgtgcctgtgattggatcggcgatctactatggtatcgacccttacaagttctttttcgaatgccgcgaaaagtatggcgatgtgttcacgtttgttctgctcggacgcaagatcacggtggcgttgggacccaagggaagcaatcttgtctttaacgccaagcatcagcaggtgacggcagaggacgcgtatacgcacctcaccacgcccgtgtttggcaaagaggtggtatacgatgtgcctaatgcggtgtttatggagcagaaaaagtttgtcaaggtgggtctgtcgatcgaaaactttcgcgtctacgtgccgcagatcgtggatgaagtgcgagagtacatcaagagcgatgcgcgtttcagcgcactcaagacgcgcaagacgatcacagtcgatatttttcaagccatgtcggaactcatcatcctgaccgcatccagaacgctgcagggcaaggaagtcagacagggtctcgacaagtcatttgcgcaactgtatcacgatctcgactcgggcttcactccgatcaactttgtgattcccaacctgccgctgccgagcaactttaaacgcgacagggcgcagaagaaaatgtcgcagttctaccaggacattgtggcgaaacgacgagctgcgggtgcatccacgtctgccgacgacgccagtggcgaaaacgatatgatcgcagcactgatcgagcaaaagtacaagaacggacgtgcactcagcggcgtcgagattgcacatatgatgattgcactcttgatggcgggtcagcacacgagcagcgccacgtcgtcgtgggcgtttctgcgtctggctagtcgacccgaaatcatcgaggagctatacgaggagcagctcaacgtgtactctgacggacacggtggtttgagggaactcgactacgagacgcaaaagacgtcggtgcctctgctggatgctgtggtcaaagagacgttgcgactgcacccgcctctgcacagcatcatgcgatatgtgaaatccgaccttgccgttccacctacgctctcgtcgccgacgtcgactaaatccgagccggatgcccactatgtgattcccaagggccactacattatggctgcacctggcgtgtcgcaagtggatcctcagatttggaagtcatcggaccagtttgatccacaccggtggttggacgctacgaccgctgcggcgatgcaggactcgggcgaggacaagcaagactttggcttcggaatgatctccaccggtgccaatagcccataccttccctttggcgccggaagacatcggtgcatcggagagcagttcgcctatctccagatcggcgtcatcctagccaccttcgtccgcatcttcaaatggcacctcgactccaaattccccgatcccgactaccaaagcatggtcgtccttcccagcaaaaacggttgcgccatcgtcctcaccccccgagccgaatccctccacctcgactagccacatgcccaatcccatcccctttccctcgctcccctttccccatcctgtacatagttacctcacgctacccttaatctcgcctgccattcctcacggactctcacgcacactcacgcacactcacgacttgatcaccaagtcc

SEQ ID NO: 28234 - protein, 561 aa, Ustilago maydis (corn smut)
MVASSSSATASLLDQLFALTPLADSSAWIKTITVLVLLPLLAVVLNVASQLLLATPKNHPPVVFHFVPVIGSAIYYGIDPYKFFFECREKYGDVFTFVLLGRKITVALGPKGSNLVFNAKHQQVTAEDAYTHLTTPVFGKEVVYDVPNAVFMEQKKFVKVGLSIENFRVYVPQIVDEVREYIKSDARFSALKTRKTITVDIFQAMSELIILTASRTLQGKEVRQGLDKSFAQLYHDLDSGFTPINFVIPNLPLPSNFKRDRAQKKMSQFYQDIVAKRRAAGASTSADDASGENDMIAALIEQKYKNGRALSGVEIAHMMIALLMAGQHTSSATSSWAFLRLASRPEIIEELYEEQLNVYSDGHGGLRELDYETQKTSVPLLDAVVKETLRLHPPLHSIMRYVKSDLAVPPTLSSPTSTKSEPDAHYVIPKGHYIMAAPGVSQVDPQIWKSSDQFDPHRWLDATTAAAMQDSGEDKQDFGFGMISTGANSPYLPFGAGRHRCIGEQFAYLQIGVILATFVRIFKWHLDSKFPDPDYQSMVVLPSKNGCAIVLTPRAESLHLD

SEQ ID NO: 28235 - DNA, 1488 bp, Arabidopsis thaliana (mouse-ear cress)
  CDS (1)..(1488)
atggttttctctgtttctatatttgcctctcttgcaccatacttaatctcagcatttcttcttttccttctcgtcgagcaactctcttaccttttcaagaaacgaaacatccctggccctttcttcgtccctccaatcatcggaaacgccgttgcactcgttcgtgaccccacttccttctgggacaagcaatcctccacggcgaacatctcaggcctctccgccaactacctcatcggaaaattcatcgtctatatcagagacactgagctttcccatcaaatcttctcaaacgttcgtcccgatgccttccaccttatcggacatccctttggtaagaagctcttcggtgaccacaaccttatatacatgttcggcgaggatcacaaatccgttcgccgtcagctagcacctaacttcactcccaaggcactgtccacttactctgccctccagcaattagttattctccgtcatctacggcagtgggaggggagtacctccggcggatctcgtccagtgtcactgcgacagcttgtccgtgaactcaacctagaaacttcgcagacggtttttgttggaccctaccttgacaaggaagccaagaacaggttccgtactgattataatttgttcaatctcggatccatggctctccccatagacctccctggctttgcgttcggcgaggctcgcagggctgtaaagaggctaggggagacgctcggcatttgcgcgggaaaatccaaagcgaggatggcagcaggagaagaaccagcatgcctaatcgatttctggatgcaggcgatcgtcgcggagaatccgcagccaccgcactcgggagacgaagagatcggtggtttgctcttcgattttctctttgccgctcaagacgcgtccacgtcatcactcctctgggccgtgacgcttcttgattcagagccagaggtgctgaacagagtaagagaagaagtagccaagatctggtcacctgagtccaacgccttgatcaccgttgatcagctcgcagagatgaagtatacacgctccgtggcgcgtgaggtcattagatacaggcctcctgcaactatggtcccacacgtcgctgctatagacttccctctcacggaaacgtacactatcccaaaaggtacaattgtctttccttcggttttcgactcctcgttccaagggtttactgaaccggaccggtttgatcctgaccggtttagcgagacaagacaagaggaccaggtgttcaaacgcaacttcctagcttttggatgggggcctcaccaatgcgtaggccagcgttacgcgttgaaccacctcgtactcttcattgcaatgttctcgtcgttgttggatttcaagaggcttcgatcagacggttgtgatgagatcgtgtactgccctactatatcgcccaaggatgggtgcaccgtgttcttgtctaggcgcgtcgcaaagtatcccaacttttcctaa

SEQ ID NO: 28236 - protein, 495 aa, Arabidopsis thaliana (mouse-ear cress)
MVFSVSIFASLAPYLISAFLLFLLVEQLSYLFKKRNIPGPFFVPPIIGNAVALVRDPTSFWDKQSSTANISGLSANYLIGKFIVYIRDTELSHQIFSNVRPDAFHLIGHPFGKKLFGDHNLIYMFGEDHKSVRRQLAPNFTPKALSTYSALQQLVILRHLRQWEGSTSGGSRPVSLRQLVRELNLETSQTVFVGPYLDKEAKNRFRTDYNLFNLGSMALPIDLPGFAFGEARRAVKRLGETLGICAGKSKARMAAGEEPACLIDFWMQAIVAENPQPPHSGDEEIGGLLFDFLFAAQDASTSSLLWAVTLLDSEPEVLNRVREEVAKIWSPESNALITVDQLAEMKYTRSVAREVIRYRPPATMVPHVAAIDFPLTETYTIPKGTIVFPSVFDSSFQGFTEPDRFDPDRFSETRQEDQVFKRNFLAFGWGPHQCVGQRYALNHLVLFIAMFSSLLDFKRLRSDGCDEIVYCPTISPKDGCTVFLSRRVAKYPNFS

SEQ ID NO: 28237 - DNA, 1395 bp, Lycopersicon esculentum (tomato)
  CDS (1)..(1395)
atggccttcttcttaatttttctttcatccttttttggcctatgtatcttttgtactgctttattaagatggaatcaagtcaagtataaccaaaaaaacttgccccctggtactatgggttggccactttttggtgaaactactgagtttcttaaacttggtccaagtttcatgaaaaaccaaagagccagatatgggagtttttttaaatcacacatacttggttgtccaacaattgtttcaatggattcagaactgaacagatatatactagtgaatgaagcgaaaggactggtcccaggatacccacagtctatgatagatattttaggaaaatgtaatattgcagctgtcaatggttcagctcacaagtacatgaggggtgcattgttatccctaattagccctacaatgatcagagaccaacttttgcctaaaattgatgagtttatgagatcccacttaaccaattgggataataaagttattgacattcaagagaaaaccaataagatggcatttctatcatcgttgaagcaaattgctggtattgaatctacctctttagctcaagaattcatgtctgaatttttcaatctagtgctaggcactctttcactacctatcaatcttccaaacaccaactatcatcgcggatttcaggcaaggaaaattattgtgaacttattacgaacactcatagaagagagaagagcttcaaaggaaattcaacatgatatgcttggttacctgatgaatgaggaagcaacacgattcaaattaacagatgatgagatgattgatttaattataactattttgtactctggatatgaaactgtttccaccacttctatgatggctgtgaaatatcttcatgatcatccaaaagttcttgaagaacttagaaaagaacacatggctattagagaaaagaaaaaacctgaggatcctatcgattacaacgattacaggtcaatgcggttcacacgagctgtgattttagagacctccaggttagcaacaatagtaaatggggttttgagaaaaacaactcaagatatggaaataaatgggtatatcattcctaaaggatggagaatatacgtatatacaagggagttgaattacgatccaagactttatcctgatccatattcgttcaatccatggagatggatggataagagcctggaacaccaaaactcatttttggtatttggaggtggtactagacaatgtcctggaaaggaacttggtgtagcagaaatttccacatttcttcattacttcgtaacaaaatacagatgggaagaaataggtggagataaactgatgaaattcccaagagttgaagcaccaaatggtctacggattagagtttcagctcactaa

SEQ ID NO: 28238 - protein, 464 aa, Lycopersicon esculentum (tomato)
MAFFLIFLSSFFGLCIFCTALLRWNQVKYNQKNLPPGTMGWPLFGETTEFLKLGPSFMKNQRARYGSFFKSHILGCPTIVSMDSELNRYILVNEAKGLVPGYPQSMIDILGKCNIAAVNGSAHKYMRGALLSLISPTMIRDQLLPKIDEFMRSHLTNWDNKVIDIQEKTNKMAFLSSLKQIAGIESTSLAQEFMSEFFNLVLGTLSLPINLPNTNYHRGFQARKIIVNLLRTLIEERRASKEIQHDMLGYLMNEEATRFKLTDDEMIDLIITILYSGYETVSTTSMMAVKYLHDHPKVLEELRKEHMAIREKKKPEDPIDYNDYRSMRFTRAVILETSRLATIVNGVLRKTTQDMEINGYIIPKGWRIYVYTRELNYDPRLYPDPYSFNPWRWMDKSLEHQNSFLVFGGGTRQCPGKELGVAEISTFLHYFVTKYRWEEIGGDKLMKFPRVEAPNGLRIRVSAH

SEQ ID NO: 28239 - DNA, 1494 bp, Homo sapiens
  CDS (1)..(1494)
atggggctcccggcgctgctggccagtgcgctctgcaccttcgtgctgccgctgctgctcttcctggctgcgatcaagctctgggacctgtactgcgtgagcggccgcgaccgcagttgtgccctcccattgccccccgggactatgggcttccccttctttggggaaaccttgcagatggtactgcagcggaggaagttcctgcagatgaagcgcaggaaatacggcttcatctacaagacgcatctgttcgggcggcccaccgtacgggtgatgggcgcggacaatgtgcggcgcatcttgctcggagacgaccggctggtgtcggtccactggccagcgtcggtgcgcaccattctgggatctggctgcctctctaacctgcacgactcctcgcacaagcagcgcaagaaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcagtgctcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctga

SEQ ID NO: 28240 - protein, 497 aa, Homo sapiens
MGLPALLASALCTFVLPLLLFLAAIKLWDLYCVSGRDRSCALPLPPGTMGFPFFGETLQMVLQRRKFLQMKRRKYGFIYKTHLFGRPTVRVMGADNVRRILLGDDRLVSVHWPASVRTILGSGCLSNLHDSSHKQRKKVIMRAFSREALECYVPVITEEVGSSLEQWLSCGERGLLVYPEVKRLMFRIAMRILLGCEPQLAGDGDSEQQLVEAFEEMTRNLFSLPIDVPFSGLYRGMKARNLIHARIEQNIRAKICGLRASEAGQGCKDALQLLIEHSWERGERLDMQALKQSSTELLFGGHETTASAATSLITYLGLYPHVLQKVREELKSKGLLCKSNQDNKLDMEILEQLKYIGCVIKETLRLNPPVPGGFRVALKTFELNGYQIPKGWNVIYSICDTHDVAEIFTNKEEFNPDRFSAPHPEDASRFSFIPFGGGLRSCVGKEFAKILLKIFTVELARHCDWQLLNGPPTMKTSPTVYPVDNLPARFTHFHGEI

SEQ ID NO: 28241 - DNA, 1626 bp, Schizosaccharomyces pombe
  CDS (1)..(1626)
atgaatcaaactgagactttgattcctgcagcccgaaacgttattcgggtgctgggatacgaaattgaatattcgaaatggacaatttgcttcgcccttttggctgtctgcattgcttatgatcaaatctcgtatcagatgcaaaaggggcatatccctggacctagatttaagatccctttcatgggatctttcttggatagtatgaaaccaacttttgagaaatacaatgctaaatggcaaaccggacccctttcttgtgtttctgttttccacaaatttgttgttatcgcttccgaacgcgatttggcccgtaagattttaaattctccaagttatgttcaaccctgcgttgttgatgctggaaagaaaattctaaaacacacgaattgggtttttcttgatggtcgcgatcacattgagtaccgtaaaggactcaatggtttattcactacccgtgctcttgcgtcttatttaccagcccaagaagctgtttataacaaatatttcaaagaattcctcgctcatagtaaagatgactatgctcaatatatgattccattccgtgacataaatgttgctacctcttgtcgcacattttgcggttactatatctccgacgatgctattaagcacattgctgacgaatattggaagattactgctgctatggagttggttaacttccctatcgtattgccgtttaccaaagtttggtacggtattcaatcacgcaaagtcgttatgcgctactttatgaaggctgctgctgaatcccgtaagaacatggaggctggtaatgcccctgcttgcatgatggaagaatggattcatgaaatgatcgaaactcgtaaatacaaatctgaaaataaagagggggctgagaagcctagtgtccttattcgcgagttttctgatgaggaaatttcacttacgtttttgtcatttttatttgcttcccaagacgctacttctagtgctatgacttggctctttcaacttttggctgatcatcctgatgttttgcagaaggttcgtgaagaacagcttcgtattcgcaaaggagacattgatgtcccactcagcttggacttgatggaaaagatgacttatacccgtgccgttgttaaggaatgtttacgtcttcgtcctcctgtattgatggttccttatcgtgttaagaaagctttccctattactcctgactacacagtacccaaggatgccatggttattcctaccctctatggtgcacttcacgattctaaggtttatccagagccagaaacatttaatcctgaccgctgggcaccaaatggtcttgccgagcaaagtcctaagaattggatggtttttggtaatggtcctcatgtatgtttgggccagcgttatgccgttaatcatttaattgcttgcattggaaaggccagtatcatgcttgattggaaacataaaagaacccctgactctgatactcaaatgattttcgctacgacatttcctcaagatatgtgttacctcaaattttcaccttttgatgcttcaactgttgactggaaaaactccaaggaggctttttcaaatgaagcagtctctgccgcaactgtggagactgagagcgcttga

SEQ ID NO: 28242 - protein, 541 aa, Schizosaccharomyces pombe
MNQTETLIPAARNVIRVLGYEIEYSKWTICFALLAVCIAYDQISYQMQKGHIPGPRFKIPFMGSFLDSMKPTFEKYNAKWQTGPLSCVSVFHKFVVIASERDLARKILNSPSYVQPCVVDAGKKILKHTNWVFLDGRDHIEYRKGLNGLFTTRALASYLPAQEAVYNKYFKEFLAHSKDDYAQYMIPFRDINVATSCRTFCGYYISDDAIKHIADEYWKITAAMELVNFPIVLPFTKVWYGIQSRKVVMRYFMKAAAESRKNMEAGNAPACMMEEWIHEMIETRKYKSENKEGAEKPSVLIREFSDEEISLTFLSFLFASQDATSSAMTWLFQLLADHPDVLQKVREEQLRIRKGDIDVPLSLDLMEKMTYTRAVVKECLRLRPPVLMVPYRVKKAFPITPDYTVPKDAMVIPTLYGALHDSKVYPEPETFNPDRWAPNGLAEQSPKNWMVFGNGPHVCLGQRYAVNHLIACIGKASIMLDWKHKRTPDSDTQMIFATTFPQDMCYLKFSPFDASTVDWKNSKEAFSNEAVSAATVETESA

SEQ ID NO: 28243 - DNA, 2547 bp, Mus musculus
  CDS (27)..(1550)
tcgactcgatccagaaactactaaccatgggtttttttttatttagccctacaaggtacttggatggtatctctgggttcttccaatgggccttcttgctcagtctatttctggtgctgttcaaggcagtccaattctacttacgaaggcagtggctgctcaagaccctccagcatttcccatgcatgccttcccactggctttgggggcaccatctgaaggacaaggagctccagcagattcttatatgggtagagaaattcccaagtgcctgcttacagtgtctctcggggagcaatatacgagtcctgctttatgatcctgactatgtgaaggtggttctggggagatcagatccaaaggcttctggaatttatcaattctttgctccctggattggttatggtttgctcctgttgaatgggaagaagtggttccagcatcggcggatgttgactccagccttccactatgacatcctcaaaccctatgtcaaaatcatggcggactctgtcaatataatgctagataaatgggagaagcttgatggccaggaccaccctctggagatcttccactgtgtttcattgatgacactggacactgttatgaagtgtgctttcagctaccaaggcagtgttcagttggatgaaaattccaagttgtatactaaggctgtcgaggatctaaacaacctgactttctttcgcctgcggaatgccttttataagtacaacatcatctacaatatgtcctctgatggacgtttgtcccaccatgcctgccagattgctcacgagcacacagatggagtgatcaagatgaggaagtctcagctgcagaatgaggaagagctgcagaaggccaggaagaagagacacttggatttcttggacatcctcttgtttgccagaatggaggataggaacagcttgtctgatgaggacctgcgtgcagaggtggacacattcatgtttgagggtcatgacactacagccagtggaatttcctggattttctatgctctggccacccaccctgagcaccaacagagatgcagagaggaggtgcagagcattctgggtgatggaacctctgtcacatgggaccatctgggccagatgccctacaccaccatgtgcatcaaggaggccctgaggctctatccaccagtaatatctgtgagtcgagagctcagctcacctgtcaccttcccagatggacgctccatacccaaaggtatcacagccacaatttccatttatggcctacatcataacccacgtttctggccaaacccaaaggtgtttgacccctctagatttgcaccagattcttctcaccatagccatgcttatctgccattctcaggaggatcaaggaactgcattgggaaacagtttgctatgaacgagctgaaggtggctgtggccctgaccctgctccgctttgaattgctgccagatcccaccaggatcccagtccccattgcaagacttgtgttgaagtccaagaatgggatccacctgtgtctcaagaagctaagataattctgatggagtcagggcagctccagaggtctgctgcctgcaatacctgcttttgtctctggcttttctgtactttgctttctctttgattcccattcttctgctctctgcaatgtgtcctgtcatctcatctttctgccctcatttctgtagcttttcctctagacaccttcctaacctgtgcatgtacctgtttcccatctcgctttaactctgaccagccactgaacctgcagccagcagcctgtcccccagcctgttcacccctcataaccattgcactgacagaggaagatatattttagagggagacacttgtacctttctctcccttcagttattagactcttgggacaatggacatcatgaattaaaacgttcttagaaatcacatgctgggagaaaattaacactaaaatctggtaccagccagaggaaggaacttgactcaaaataagagatttttagatatttctgtctgtctcatagttaaaattaatgttttcctgctttctggcatatgcctcatcttttctatgaagtagtaatactgatacagaaaggtagagagaaatgaatagtttttgctactttgggccaaactgtgaaaaaatccattttatttcatcaatttctgtttcccaatttcatttaagacacaggaaaactactcagcatgaactttggggagccagagcagttttggcaatccagggaagcatgttgccatctggtccctactgttagaatgtggtagaattctcagctcctgagaggttgttctctgcttttgactcctgagctggttgtgttaaaatgcaagttggcgttttttgtgaacctaaagaattttctgaatttaacccggtcttatttgtttaaaattactcgaatattccccttaatgatttggagaattcccattaaaatcccatgacatggatgtggagtcttttgtgaccatggggagaaactataaagaagtgtttgctgtcca

SEQ ID NO: 28244 - protein, 507 aa, Mus musculus
MGFFLFSPTRYLDGISGFFQWAFLLSLFLVLFKAVQFYLRRQWLLKTLQHFPCMPSHWLWGHHLKDKELQQILIWVEKFPSACLQCLSGSNIRVLLYDPDYVKVVLGRSDPKASGIYQFFAPWIGYGLLLLNGKKWFQHRRMLTPAFHYDILKPYVKIMADSVNIMLDKWEKLDGQDHPLEIFHCVSLMTLDTVMKCAFSYQGSVQLDENSKLYTKAVEDLNNLTFFRLRNAFYKYNIIYNMSSDGRLSHHACQIAHEHTDGVIKMRKSQLQNEEELQKARKKRHLDFLDILLFARMEDRNSLSDEDLRAEVDTFMFEGHDTTASGISWIFYALATHPEHQQRCREEVQSILGDGTSVTWDHLGQMPYTTMCIKEALRLYPPVISVSRELSSPVTFPDGRSIPKGITATISIYGLHHNPRFWPNPKVFDPSRFAPDSSHHSHAYLPFSGGSRNCIGKQFAMNELKVAVALTLLRFELLPDPTRIPVPIARLVLKSKNGIHLCLKKLR

SEQ ID NO: 28245 - DNA, 2085 bp, Mus musculus
  CDS (22)..(1551)
caacagaagagtggatgaactatgagtgtctctgctctaagcccaacccgatttgcagacagcctctctggcttcctccaagtggcctctgtgctcggtctgctcctgctgctggtgaaagctgtccagttctacctccacaggcaatggctactcaaggctttccagcagttcccatcacctccttttcactggttctttgggcatgagcagttcaaaggtgaccacgaactacaggaaattgtgtcgtgcatagagaacttcccaagtgcctttcctagatggttctggggaagcaaggcctacttaactgtctatgaccctgactacatgaaagtgattctggggcgatcagatccaaaggctaatggtgcgtacagattgctagctccttggattgggtatggtttgctcttgttgaatggacagccatggttccagcacaggaggatgctaaccccagccttccactatgacattctgaaaccctatgtgaaaaacatggccgactccattcgattgatgctagacaaatgggaacggctggctgatcaggactcctctatagagatctttcaacacatctccttaatgaccctagacactgtcatgaaatgtgccttcagccacaagggcagtgttcaggtagatggaaattacaggacctacctccaggccattggggacttgaataacctatttcactcccgtgtgaggaatatctttcatcagaatgataccatctacaaactttcttccaatggccgcttggccaaacaagcttgtcaacttgcccatgatcacacagatggagtgatcaagctgagaaaggatcagctgcaggatgagggagagctggaaaagatcaagaagaagagacgtttggattttctggatatccttttatttgccagaatggagaatggggacagcatgtctgacaaggacctacgtgctgaggtggacacattcatgttcgagggccatgacaccacagccagtggagtctcctggatcttctatgctctggccacacaccctgatcaccaacagagatgcagagaggaagttcagagcctcctgggggatggatcctctatcacctgggatcacctagaccagattccctataccacaatgtgcatcaaggaggccctaaggctctacccacctgtcccaggcattgtcagagaactcagtacatctgtcaccttccctgatggacgctctttacccaaaggtgtccaggtcacactctccatttatggtctccaccacaacccgaaggtgtggccaaatccagaggtgtttgacccttccaggtttgcaccagactctccccgacacagccactcattcctgcccttctcaggaggagccaggaactgcattgggaaacaatttgctatgagtgagctgaaggtgattgtggccctgacactgctccgcttcgaactactgccagatcctaccagggtccccatgcccttagcccgacttgtgctgaagtccaaaaatgggatctacctacatctcaagaagctccactgatactgttgtggagctccaatgtctgagaagagtttcactggagaaagctaagttgttggtgtgacctacctttttcagaagaatactccagagagtcctctcatcctctgttcagtatagatcatcattccttggcactggaatattcccctgcttcaaagccagcaccctcctcatcccctctcttctaatgtccttaccttttacagatgcttatgacatcattaagatccctaaaagctccaagatagttttcccatctaaatgtatcttattcaatctaacctactaagttccttctgaattatgaggaatcattcaatatgtaccatggtctccaaaatccaaggcctgaacatcattgtgaagacattattcagcttagtatcattttcacatgacagttacctaatgtgttcatctaaatctaccctgcatagtctctttctacctgattaatcctcacacgagtttctccatcttccctcctttctgcaataaagttcccagtgtcatgcaaaaaaaaaaaaaaaa

SEQ ID NO: 28246 - protein, 509 aa, Mus musculus
MSVSALSPTRFADSLSGFLQVASVLGLLLLLVKAVQFYLHRQWLLKAFQQFPSPPFHWFFGHEQFKGDHELQEIVSCIENFPSAFPRWFWGSKAYLTVYDPDYMKVILGRSDPKANGAYRLLAPWIGYGLLLLNGQPWFQHRRMLTPAFHYDILKPYVKNMADSIRLMLDKWERLADQDSSIEIFQHISLMTLDTVMKCAFSHKGSVQVDGNYRTYLQAIGDLNNLFHSRVRNIFHQNDTIYKLSSNGRLAKQACQLAHDHTDGVIKLRKDQLQDEGELEKIKKKRRLDFLDILLFARMENGDSMSDKDLRAEVDTFMFEGHDTTASGVSWIFYALATHPDHQQRCREEVQSLLGDGSSITWDHLDQIPYTTMCIKEALRLYPPVPGIVRELSTSVTFPDGRSLPKGVQVTLSIYGLHHNPKVWPNPEVFDPSRFAPDSPRHSHSFLPFSGGARNCIGKQFAMSELKVIVALTLLRFELLPDPTRVPMPLARLVLKSKNGIYLHLKKLH

SEQ ID NO: 28247 - DNA, 1377 bp, Oryza sativa
  CDS (1)..(1377)
atggcagcctccttcgtcatcgtcatcgtcatctccttcttcatttctcttgcttttatgtgctatgtccactacacgagccggcagaggaggaaactccatggctacggccatgagaaagccgtcaggctgccgccgggctccatgggttggccttacatcggcgagacccttcagctctactcccaagaccccaacgtcttcttcgcctccaaacagaagaggtacggcgagatcttcaagacgcacattctgggttgcccgtgcgtgatgctggcgagcccggaggcggcgcggttcgtgctggtgacgcaggcgcacctgttcaagccgacgtacccgcggagcaaggagcggatgatcggcccgtcggcgctcttcttccaccagggcgactaccacctccgccttcgcaagctcgtccagggccctctcggccccgacgccctgcgcgcgctcgtgccggacgtcgaggccgccgtccgctccacgctcgcctcctgggacggcaacgtctccagcaccttccacgccatgaagaggctctcgttcgatgtcggcatcgtgaccatcttcggcgggcggctggacgagcggcggaaagcggagctgaggcagaactacgccatcgtggagaagggctacaactccttccccaacagcttccccgggacgctgtactacaaggcgatccaggcgaggcggcggctgcacggcgtgctgagcgacatcatgcgggagcggcgggcgcggggggagcccggcagcgacctcctcggctgcctcatgcagtcgcgggcgggcgacgacggcgcgctcctcaccgacgagcaggtcgccgacaacatcatcggcgtgctgttcgcggcgcaggacacgacggccagcgtgctcacctggatcgtcaagtacctccacgaccatcccaagctgctcgaggccgtcagggcggagcaggcggcgatccgcgccgccaacgacggcggccggctgccgctgacgtgggcgcagacgcggagcatggccctaacccacaaggtgattttggagagcttaaggatggccagcatcatctcgttcacgttcagggaggccgtggctgacgtggagtacaaagggttccttatccccaagggatggaaggtgatgccgctcttcaggaacatccatcacaacccagactacttccaggatccacagaagttcgacccttctagattcaaggtgtcgccgaggccgaacaccttcatgccatttgggaacggcgtgcacgcgtgccccgggaacgagctggccaagctcgagatgctcgtcctcatccaccacctggtcactggctacagggtgggagattgttggttccagcgacgaggttga

SEQ ID NO: 28248 - protein, 458 aa, Oryza sativa
MAASFVIVIVISFFISLAFMCYVHYTSRQRRKLHGYGHEKAVRLPPGSMGWPYIGETLQLYSQDPNVFFASKQKRYGEIFKTHILGCPCVMLASPEAARFVLVTQAHLFKPTYPRSKERMIGPSALFFHQGDYHLRLRKLVQGPLGPDALRALVPDVEAAVRSTLASWDGNVSSTFHAMKRLSFDVGIVTIFGGRLDERRKAELRQNYAIVEKGYNSFPNSFPGTLYYKAIQARRRLHGVLSDIMRERRARGEPGSDLLGCLMQSRAGDDGALLTDEQVADNIIGVLFAAQDTTASVLTWIVKYLHDHPKLLEAVRAEQAAIRAANDGGRLPLTWAQTRSMALTHKVILESLRMASIISFTFREAVADVEYKGFLIPKGWKVMPLFRNIHHNPDYFQDPQKFDPSRFKVSPRPNTFMPFGNGVHACPGNELAKLEMLVLIHHLVTGYRVGDCWFQRRG

SEQ ID NO: 28249 - DNA, 1569 bp, Debaryomyces hansenii CBS767
  CDS (1)..(1569)
atgagtactaattctacgtctgaaatagttgacaacttatctggttccttcggggacaccagtttttttatcaaaacagccaacgacctttatatgaatatgtcgtggttacaacttattatcaccacaattgtattgggattgtcgtatgatcagattatgtatcaaatccgaaagggtagtattgttggtcctcgtttgaaggtatggcctatcattgggccatttttagaatcattagatcctaaattcgaagaatataaggccaagtgggattctggtcctttatcgtgtgtgtcgattttccataagtttgttgttattgcatcttcaagagacttggctagaaagatcttagggtcgcctaagtatgtcaagccatgtgtcgttgatgtcgctattaagattttaagaccaactaactgggttttcttggatggtaaggcacattcggattatcgtaaatctttgaatggtttatttagtcaaaaggctttggaattatatattcctgttcaagaaaagtatatggatttataccttgaaaaatttgttaccttggatggtccaactgaattcttccctcaatttagagaattattgtgtgccctttctttaagaactttctgtggggattatattactgaagaacaaatttccttgattactgacaactatttccgtatcactgctgccttagagttagttaacttcccaatcattattccatacactaagacttggtatggtaaaaaaattgcagatgaaactatgaaaattttcgaatcctgtgccggtatgtctaaaaaacatattaacgaagacaacggtaaaccaggatgtgttatggatgaatggatttatttaatgaaggatgcaagagaaaagcactcagatgatccagaatctaagttattaattcgtgagttctcaaacagagaaatatctgaggttatttttactttcctctttgcttcccaagatgcatcttcatctttagcttgctggttgttccaggttgtagccgatcgtcctgatattgttgccaagataagagaagaacaattaagagttcgtgatcaagacccatccaagccattgaatttagaattgattaatgaaatgacatacactaataatgttgttaaggaatcattacgttaccgtcctccagtcttgatggtcccttatgttgttaaacagagtttcccagttactgacacatataccgccccaaagggttctatgattattcctacattgtacccagcattacacgacccagaagtatatgaagatccagatagttttattccagaaagatgggaaaatgccactggtgatatgaacaagcgtaactggttagttttcggtaccggcccacatatttgtttaggtaaaacctatgttttgatgttatttaccagtatgttaggtaaatttgttatgaactcggatatcattcattatcctactccgttatccgaagaaattaaagtcttcgctacaatcttcccaaaagacgatttaatcttagagtggaagagaagaaacccacttcaagtctag

SEQ ID NO: 28250 - protein, 522 aa, Debaryomyces hansenii CBS767
MSTNSTSEIVDNLSGSFGDTSFFIKTANDLYMNMSWLQLIITTIVLGLSYDQIMYQIRKGSIVGPRLKVWPIIGPFLESLDPKFEEYKAKWDSGPLSCVSIFHKFVVIASSRDLARKILGSPKYVKPCVVDVAIKILRPTNWVFLDGKAHSDYRKSLNGLFSQKALELYIPVQEKYMDLYLEKFVTLDGPTEFFPQFRELLCALSLRTFCGDYITEEQISLITDNYFRITAALELVNFPIIIPYTKTWYGKKIADETMKIFESCAGMSKKHINEDNGKPGCVMDEWIYLMKDAREKHSDDPESKLLIREFSNREISEVIFTFLFASQDASSSLACWLFQVVADRPDIVAKIREEQLRVRDQDPSKPLNLELINEMTYTNNVVKESLRYRPPVLMVPYVVKQSFPVTDTYTAPKGSMIIPTLYPALHDPEVYEDPDSFIPERWENATGDMNKRNWLVFGTGPHICLGKTYVLMLFTSMLGKFVMNSDIIHYPTPLSEEIKVFATIFPKDDLILEWKRRNPLQV

SEQ ID NO: 28251 - DNA, 1524 bp, Yarrowia lipolytica CLIB99
  CDS (1)..(1524)
atgaacgctacccaaccggagtcgcacattgtgcaatggctgacgtggacccaggacacgattgggttcggcacactggccgcaacggtgctgttaatcgctctactttacgaccagttttcctacgtcaagtccaaggggtccattgccggcccgcctctgaaaatgtggccaatcatcggcccatttctggactccatcaacccggactttgagaaatacaaggcccagtgggcgtcgggggcgctcagctgcgtgtctgtgttccacaagtttgtggtgctcgcatctgatcgggacctgacccgtaagatcttcaactccagcgcatacgtcaagccctgtgtggtggacgtggccattaaaatcctgcggcccaccaactgggtctttctggacggtaaggcccatgtcgactaccgacgaggtctcaacggcctcttcaccaacagagccctcagcatgtacctgcccatccaggagggcatctacgacacctactttgacaagtttgttgaaatgagcaaggacggccacgtgccctacatgcccattttccgagaaatcaactgcgcgctctctctgcgaaccttctgcggcaactacatcaccgaggagcagatcaaggaaattgcccacgactactacctggtgactgccgccctcgagctcgtcaacttccccatcattctgcccttcaccaaggcctggtacggcaaaaaggccgccgacaaggtgatggacattttcgcaaagtgcgcccagatggccaaggaccacatcaaggccggaggagatgtcacctgcactatggacgcctggatcgccatcatgaacggccgggactttgacagcgaccacggcaccgtgcccaacaagaagattcgaaagttcaccaacaaggagatttcagagaccatcttcacatttctgtttgcctctcaggacgcgtcctcttccgccaccacctggctcttccagattgttgccgaccgaccagacgtgtacgccaagattcgagaggagcagctggcggtgcgaggaggtgaccccaacgtacccctgtcgctggagctcaccgagaaaatgacttacaccaacatggtggtcaaggagtgtctgcggctgcgaccccctgtcattatggttccctacgtggccaagaaggacttccccatctcggacacctacacagtgcccaagggctccatgatcatccccacggtctacccctcgctgcatgaccccgaggtgtacgagcggccggacgagtttgtgcccgagcgatggctgcctgacggagacggcaccaaaaacgcaaagaactggctcgtgttcggcaccgggccccactactgtctgggacagaagtacgcgctcatgaacttcaccaacatgattggaaaggcctgcatgaacctcgactttacacacaaggtgacgcctctcagtgaaaaggtgcgtgtgtttgccacaatcttccccgatgacgattgtctgttgcagtttaagaagagggagtag

SEQ ID NO: 28252 - protein, 507 aa, Yarrowia lipolytica CLIB99
MNATQPESHIVQWLTWTQDTIGFGTLAATVLLIALLYDQFSYVKSKGSIAGPPLKMWPIIGPFLDSINPDFEKYKAQWASGALSCVSVFHKFVVLASDRDLTRKIFNSSAYVKPCVVDVAIKILRPTNWVFLDGKAHVDYRRGLNGLFTNRALSMYLPIQEGIYDTYFDKFVEMSKDGHVPYMPIFREINCALSLRTFCGNYITEEQIKEIAHDYYLVTAALELVNFPIILPFTKAWYGKKAADKVMDIFAKCAQMAKDHIKAGGDVTCTMDAWIAIMNGRDFDSDHGTVPNKKIRKFTNKEISETIFTFLFASQDASSSATTWLFQIVADRPDVYAKIREEQLAVRGGDPNVPLSLELTEKMTYTNMVVKECLRLRPPVIMVPYVAKKDFPISDTYTVPKGSMIIPTVYPSLHDPEVYERPDEFVPERWLPDGDGTKNAKNWLVFGTGPHYCLGQKYALMNFTNMIGKACMNLDFTHKVTPLSEKVRVFATIFPDDDCLLQFKKRE

SEQ ID NO: 28253 - DNA, 1584 bp, Kluyveromyces lactis NRRL Y
  CDS (1)..(1584)
atgtcaacgaaatcagaatcggtggttgttaaggtgtttgaagctgctcaagcagtgttgggccaatttttggcgttttcaattgctcagcagatttctattgtgatcttgttgccatttgtgtacacaattgtctggcagttgttgtactcgatgagaaaagaccgtgttccattggtattttactggattccatgggttggttctgctgttagttatggtatgagaccatacgagtttttcgaagaatgtagagaaaaatacggtgatatatttgcgtttgttttgttgggaaaagtgatgacagtttatttgggacctaagggtcatgagttcatcttgaacgccaaattggccgatgtttccgcagaagccgcttatacgcatttgactacgcctgtgtttggtaatggtgttatttacgattgtccaaaccatcgtttgatggatcaaaagaagttcgttaagggtgcattgactactgatgcatttagaaaatacgtgccattgatcgcagaagaagttcaaaagtactttttaacctctaaaaatttctccattggtgaaaaagaccatggtaagatcaacgtcatggtcactcaacctgagatgaccattttcactgcttctagatcgctacttggctctgaaatgagagaaaaattaaacactgatttcgcttacttgtactctgatctagataagggttttactcctttgaactttgtgttctcccatttgcctctagataactatcgtaagagagataacgctcaaagagttatctcttcgacttacttgtccttgatcaagaagagacgtgatacaaacgatattcaagatagagatttgattgattctttgatgaagaattctacttacaaagatggtgttaagatgaccgaccaagaaatcgctaatctattgattggtgttctaatgggtggacaacatacttctgctgctacttctgcttgggttattttgcacttagctgaaagacctgacattcaggaaaagttatacgaagaacaaatgaaggttttggataacggcacgaaagaattgactttcgacttgctacaagaaatgcctttgttaaatcaaactatcaaggagacactaagattgcaccatccattgcattctttgttccgtaaagttatgaacgatatgcctgtgccaaacagttcatatgttgttccaaagggtcatcacgttttggtttctccaggttactgccatctacaagataaatatttcccaaatgcctcagagttcaatcctaaccgttgggataatgatgctgcttcttcttatgcctcaaacgaaaaggtggattatggttttggttccatctccaagggtgtttcttctccttacttaccatttggtggtggtagacacagatgcatcggtgaacattttgcttacatgcaattaggaaccattttgtccaactacattagaactcttacttggaaatttgctgatccttcagcaaccgttccaactccagatttccaatctatggttaccttgcctctagagccatctgaaattgaatggacattaagaaagtag

SEQ ID NO: 28254 - protein, 527 aa, Kluyveromyces lactis NRRL Y
MSTKSESVVVKVFEAAQAVLGQFLAFSIAQQISIVILLPFVYTIVWQLLYSMRKDRVPLVFYWIPWVGSAVSYGMRPYEFFEECREKYGDIFAFVLLGKVMTVYLGPKGHEFILNAKLADVSAEAAYTHLTTPVFGNGVIYDCPNHRLMDQKKFVKGALTTDAFRKYVPLIAEEVQKYFLTSKNFSIGEKDHGKINVMVTQPEMTIFTASRSLLGSEMREKLNTDFAYLYSDLDKGFTPLNFVFSHLPLDNYRKRDNAQRVISSTYLSLIKKRRDTNDIQDRDLIDSLMKNSTYKDGVKMTDQEIANLLIGVLMGGQHTSAATSAWVILHLAERPDIQEKLYEEQMKVLDNGTKELTFDLLQEMPLLNQTIKETLRLHHPLHSLFRKVMNDMPVPNSSYVVPKGHHVLVSPGYCHLQDKYFPNASEFNPNRWDNDAASSYASNEKVDYGFGSISKGVSSPYLPFGGGRHRCIGEHFAYMQLGTILSNYIRTLTWKFADPSATVPTPDFQSMVTLPLEPSEIEWTLRK

SEQ ID NO: 28255 - DNA, 1605 bp, Kluyveromyces lactis NRRL Y
  CDS (1)..(1605)
atggataatatcgttgtttctcagacatctaatgcgacgcaagtggcctctgaggctagcgttaagctgtttagtttagctaatgctcaacaattggttgaaactgtccagcaaatgtcttattttaaattgttttgcactttggtagccattgttatcgtttgggaccaagtgtcttatcaaatacaaaagggaaatattgcaggtccaaaatggaaggtttggccagttatcggtccattcttggagtcttttgatcctaagttcgaagaatatttagctaaatggaattctggtccattgtcctgtgtttccatcttccataagttcgtggtcatcgcttctaccagggatttggctagaaaaattttccaatctcctcaatacgttaagccttgtgtcgttgacgttgcagttaagatcttaagaccaagcaattgggtgtttttggatggtaaagaacatgtggattacagaaaatctttgaacgggttgttcactaagcaagcgttggccaaatacatgccttctcaagaattgctgatggataaatacattgagaaattcattgaattgtccaaggaaaataagtacgaggctcgtgttttcttccacgatatgagagaaatcatgtgtgctttatctttaaaggccttctgtggtgattacattactgaagatcaaattagaaaagttgctgacgattactatttggtcactgctgctttggaattggtgaacttcccaattattatcccatacaccaagacttggtacggtaagaagacggctgatatgaccatgaaaattttcgaacagtgtgctcaaatggccaaggaccacattgctgctggtggtgaaagtacttgtgtgttggatgcttggtgttccttgatgcatgaggctaagaacaaggatgacgctgattccaagttgtaccacagagaattcactaacagagaaatgtcagaagcaattttcacctttttgtttgcttctcaagatgcttcttcctctttggcttgttggattttccaaattatcgctgatagaccagatgtcatggcaaatattagagaagaacaattaagagtcagaaacaatgatccaaacgtcaaattgtctatggatttgattgacgaaatgaaatacacaaacatggttgttaaggaaacccttcgttataggccacctgtcattatggttccatactatgtgaagaagtctttccctgtcgttccaacttactctgctccaaagggttctatgttgattccaactttgtaccctgctctacatgacccagaggtttacgaagatccagatgaatttattccagaaaggtgggttgaaggatctgcagctaaccaagcaaagaagaactggttggtcttcggctgtggtcctcacgtttgtttgggtcaaacctacgtcatgcaaaccttcactggtttaatcggtaagtttgccatgttctctgattgggaacacaaagtgaccccattatctgaaaagattaaggtcttcgccactatcttccctaaagatgacttgttgttgagcttcaagaaaagagatccattaactggcgaagttgaactttga

SEQ ID NO: 28256 - protein, 534 aa, Kluyveromyces lactis NRRL Y
MDNIVVSQTSNATQVASEASVKLFSLANAQQLVETVQQMSYFKLFCTLVAIVIVWDQVSYQIQKGNIAGPKWKVWPVIGPFLESFDPKFEEYLAKWNSGPLSCVSIFHKFVVIASTRDLARKIFQSPQYVKPCVVDVAVKILRPSNWVFLDGKEHVDYRKSLNGLFTKQALAKYMPSQELLMDKYIEKFIELSKENKYEARVFFHDMREIMCALSLKAFCGDYITEDQIRKVADDYYLVTAALELVNFPIIIPYTKTWYGKKTADMTMKIFEQCAQMAKDHIAAGGESTCVLDAWCSLMHEAKNKDDADSKLYHREFTNREMSEAIFTFLFASQDASSSLACWIFQIIADRPDVMANIREEQLRVRNNDPNVKLSMDLIDEMKYTNMVVKETLRYRPPVIMVPYYVKKSFPVVPTYSAPKGSMLIPTLYPALHDPEVYEDPDEFIPERWVEGSAANQAKKNWLVFGCGPHVCLGQTYVMQTFTGLIGKFAMFSDWEHKVTPLSEKIKVFATIFPKDDLLLSFKKRDPLTGEVEL

SEQ ID NO: 28257 - DNA, 1608 bp, Candida glabrata CBS138
  CDS (1)..(1608)
atggcttctgtagtagatcaggtgcatatgagcatgaatgccactgcgcatgcagctggcgctgcaagcgcaggcgctgtcatggctgccccatcgcttctagacaagttgcaaggcatgtcctacttgcaaatgtttgttacattgatttgtggtgtgctggtgtgggaccaggtctcctaccagatgaagaaaggtaacatcgctggtcctcgtttcaaagtctaccctatcatcggtcctttcttggagtccctagaccccaagttcgaagagtacaaggccaagtgggacagcggtccattgtcctgtgtctccatcttccacaagttcgtcatcatcgcctccaccagagacctggctagaaaagtgttgcaagctccaaagtacgtcaagccatgtgttgtcgacgtggccgtcaagatcctgagaccaagcaactgggtgttcctggacggtaaagcccacaccgactatagaaagtccctgaacggtttgttcactaagaccgccttggcccagtacttgcctcctttggaagaattgatggacaagtacatcgagaagttcgtcgaattgtccaaggaaaacaactacgagccacagatcttcttccatgaaatgagagagatcctgtgtgctttgtccctaagatccttctgtggtgactacatcagcgaggaccagatcagaaagatcgctgacgactactacttggtcaccgccgctttggaattggtcaacttcccaatcatcctgcctttcaccaagacctggtacggtaagagaactgcagacatggctatgaagattttcgagtcctgtgcccaaagagctaaggaccacatcgccgccggtggtaagccaatctgtgttatggacaactggtgtaaattgatgcacgatgctaagaaccgtaccgacgatgactctagactactgcacagagaattcactaacagagaaatctccgaggccgtcttcactttcttgttcgcttctcaagatgcttcctcttctttggcttgttggttgttccaaatcgtcgctgacagaccagatgtcttggctaagatcagagaagaacaattgcgtgtccgtgaaggtgacattaacaaaagattggacattgacttggtagacaagatggaatacactcacatggtcgttaaggaaactttgcgttacagacctccagtcttgatggtcccatatgtcgtcaagaacaagttcccagttgtaccagactaccaagctccaaagggttccatgcttatcgccactttgtacccagccctacacgacccagaagtttatgaaaacccagatgattttatcccagaaagatgggtcgaaggttctccagctaacgaagctaagaagaactggttggtcttcggctgtggtccacacgtttgtctaggtcaaacctatgtcatgattaccatgactgctttgatcggtaagttcgctctattcactgacttcaagcacaaggtcactccattgagtgaaaagattaaagtcttcgctactatcttccctaaggatgatctattgctaagcttcaagaagagggatccagttactggagaaatcaaggaataa

SEQ ID NO: 28258 - protein, 535 aa, Candida glabrata CBS138
MASVVDQVHMSMNATAHAAGAASAGAVMAAPSLLDKLQGMSYLQMFVTLICGVLVWDQVSYQMKKGNIAGPRFKVYPIIGPFLESLDPKFEEYKAKWDSGPLSCVSIFHKFVIIASTRDLARKVLQAPKYVKPCVVDVAVKILRPSNWVFLDGKAHTDYRKSLNGLFTKTALAQYLPPLEELMDKYIEKFVELSKENNYEPQIFFHEMREILCALSLRSFCGDYISEDQIRKIADDYYLVTAALELVNFPIILPFTKTWYGKRTADMAMKIFESCAQRAKDHIAAGGKPICVMDNWCKLMHDAKNRTDDDSRLLHREFTNREISEAVFTFLFASQDASSSLACWLFQIVADRPDVLAKIREEQLRVREGDINKRLDIDLVDKMEYTHMVVKETLRYRPPVLMVPYVVKNKFPVVPDYQAPKGSMLIATLYPALHDPEVYENPDDFIPERWVEGSPANEAKKNWLVFGCGPHVCLGQTYVMITMTALIGKFALFTDFKHKVTPLSEKIKVFATIFPKDDLLLSFKKRDPVTGEIKE

SEQ ID NO: 28259 - DNA, 1443 bp, Photobacterium profundum
  CDS (1)..(1443)
atgacggagtcagtggtacgggaaaatcaactgataaaacgaacactggatgacctaccccagcccaaaggctggccattgctgggcaatttcctgcagctacagtctaaaaacctgcatcaggtgctggagcaatggtgtttggaatatggtgatacatataaagtcgatattgctggcctgttgtttgtggtgatagcagatcctgtggtggtcaaagatatcctgcggcgccgcccaaagtctttcaatcgtaccgctagtctcgagcgggtattcaaagaactcgggatccacggtgtactttcagccaatggcgaaagctggaagcgacagcgcaggctaatcatgcccgcattcagtaaaaagagcctagcttcattttttcctctgctggaacaaaccactgaacggcttcgccttcgtctcgttaagaaaagagggcaagatactctcgccatccatgatgatcttcgccgttttaccgtcgatatcaccacctctctggtgttcggacatgacaccagattactggaacatgacggagatggtctgcagaaacatctagaagtgatcttcccgcagttaaacagccgcaccaggatgccttttccctactggcaatacatcaaattcaaaaaggatcgcaaattagatcaggcactgattgaagttgagaaatatgcgctaaagatagtagaacaaacccgggatgaactgcaattcaacccgcagctggcagatgcccccgagaccatactacaggcgatggtcgcggcttctgatgatgataaccgcctgaccaacgaagagctgtttgccaatatcctgacattactgctggcaggtgaagacacaacctctaacctgatcgcctggatgctgtattttatcagccagaggccggatattcagtgcaaaatcaatgaagaggcggaacagatccgattgaagcataagggtcagatcaacgtgcaggggctagatgagctgacttatctggaggccgtcgcccgtgaaaccttgcgcctaaagtccaccgctcccatgatatcagctgaaaccgctgatcaggtgacgctactggatggcactgagttaccagctggtaccggtctctttttgatgacgcggctaggcggacttaacaaagagcactttaaggacgcagagcaattcaggcctgagcgctggcaggaagaagcagtggcagcggaagcttgcccgcataaagcaaccagccactttccctttggcggtggtgcacgccactgccccggtgaaacactggcttttatggaaacaaaaatggtcatcgccatgctatgccagcaatttgacatctctcagccggagagcccgccagtagtggaggagtatgccattaccatgcgacccaagaaccttcagatctgtttgcgactcaaacctgtgggcagataa

SEQ ID NO: 28260 - protein, 480 aa, Photobacterium profundum
MTESVVRENQLIKRTLDDLPQPKGWPLLGNFLQLQSKNLHQVLEQWCLEYGDTYKVDIAGLLFVVIADPVVVKDILRRRPKSFNRTASLERVFKELGIHGVLSANGESWKRQRRLIMPAFSKKSLASFFPLLEQTTERLRLRLVKKRGQDTLAIHDDLRRFTVDITTSLVFGHDTRLLEHDGDGLQKHLEVIFPQLNSRTRMPFPYWQYIKFKKDRKLDQALIEVEKYALKIVEQTRDELQFNPQLADAPETILQAMVAASDDDNRLTNEELFANILTLLLAGEDTTSNLIAWMLYFISQRPDIQCKINEEAEQIRLKHKGQINVQGLDELTYLEAVARETLRLKSTAPMISAETADQVTLLDGTELPAGTGLFLMTRLGGLNKEHFKDAEQFRPERWQEEAVAAEACPHKATSHFPFGGGARHCPGETLAFMETKMVIAMLCQQFDISQPESPPVVEEYAITMRPKNLQICLRLKPVGR

SEQ ID NO: 28261 - DNA, 1380 bp, Rhodopseudomonas palustris
  CDS (1)..(1380)
atgtcgatccaggttgcggattcgtcactcgtcgcacggctgtcgccgccaaagccgagtgcgctcgcccacgttcccggtgacgaaggctggccgatcatcggccgcaccctggcggtgctcgccgatccaaagggcgaggtcgagaagatggcgcggacctatggtccggtctatcgcagccgcgtgctcggcgagacctcgatcaccctgctcgggcctgaagccaacgagctggtgttgttcgataacaccaagctgttttcctcgacccatggctggggcccgatcctcgggcggctgtttccgcggggcctgatgatgctcgacttcgacgagcaccggctgcaccggcgcacactgtcggtggcgttcaaggccgggccgatgcagtcctatctggccgagctcaacgccggcatcgcccaccgcgtcgccgagtggcgcgcccgccccggcgagatgctgtgctacccggcgatgaagcagctcacgctcgatctcgccgcgacctcgttcctcggcaccgcgatcggcgccgagaccgaagaggtcaaccgcgccttcatcgacatggtcgccgcttccgtggcgccgatccgcaagccatggccgggcaccgcgatggcccgcggcgtcaagggccggcaacgcatcgtcgcttacttcgccgaacagattccgatccgccgtgccaagggcggcgacgatctgttctcgcagctctgccgcgccacccacgacgacggcgcgctgctgtcgaaccaggcgatcatcgaccatatgagcttcctgatgatggcggcgcacgacacgctcacctcgtcgctgacctcgttcgttgccgcgctggcggcgcatccggaatggcagcagaagctgcgcgaagagatcgccggcctaggtctgaagccgggcgaaccgatcagcttcgaacagctcgacgcgctgccgctcaccgagatggcgttcaaggaagcgatgcggctgcggccaccggtgccgtcgctgccgcggcgggcgacgcgcgctttcagcttcaagggctacacaatcccggccggcaccatggtggcggtcaatccgctgttcactcaccacatgccggagatctggccgaacccggatcagttcgatccgctgcgcttcaccgacgaagcttcccgcggtcgccaccgcttcgcctggattccctatggcggcggcgcccacatgtgcctcgggctcaactttgcctacatgcaggcgaagtgcttcgccgtacacctgctgcaacacctcgacctgtcgttgccgccgaactatcaggcttcgtggcagatgtggccgatcccgaaaccgaaagacgggctgcgggtcaatgttgcgccgctgaattag

SEQ ID NO: 28262 - protein, 459 aa, Rhodopseudomonas palustris
MSIQVADSSLVARLSPPKPSALAHVPGDEGWPIIGRTLAVLADPKGEVEKMARTYGPVYRSRVLGETSITLLGPEANELVLFDNTKLFSSTHGWGPILGRLFPRGLMMLDFDEHRLHRRTLSVAFKAGPMQSYLAELNAGIAHRVAEWRARPGEMLCYPAMKQLTLDLAATSFLGTAIGAETEEVNRAFIDMVAASVAPIRKPWPGTAMARGVKGRQRIVAYFAEQIPIRRAKGGDDLFSQLCRATHDDGALLSNQAIIDHMSFLMMAAHDTLTSSLTSFVAALAAHPEWQQKLREEIAGLGLKPGEPISFEQLDALPLTEMAFKEAMRLRPPVPSLPRRATRAFSFKGYTIPAGTMVAVNPLFTHHMPEIWPNPDQFDPLRFTDEASRGRHRFAWIPYGGGAHMCLGLNFAYMQAKCFAVHLLQHLDLSLPPNYQASWQMWPIPKPKDGLRVNVAPLN

SEQ ID NO: 28263 - DNA, 1536 bp, Brachydanio rerio
  CDS (1)..(1536)
atgctcttcgagagttttgaccttgtctcggcgttggcgacgctggctgcgtgtttagtgtccatggcacttcttctggccgtgtcccagcagctctggcagctgaggtggaccgcaacacgggacaagagctgcaagctgcccatgcccaagggctccatggggttccccatcatcggagaaacatgccactggttctttcagggtgcaggtttccatgcatccagaagacagaagtatgggaatgtattcaagactcatctactgggacggccgctgatccgggtcactggggcagagaatgtgcgtaaggttcttatgggagagcacagcctggtcactgtggactggccccaaagcaccagcactcttctggggccaaacagtttggccaactcaataggagacatccatcgcaaaaggaggaagatctttgctaaagtttttagccatgaggctctggaaagctacctgcccaagatccagcaggtcattcaggagaccctacgtgtgtggagctccaatcctgaccccatcaatgtgtatcgcgagtcccagcggctatccttcaacatggctgtacgtgtgctcctgggtttccgcatcccagaagaagagatgcactgtttgttcagcaccttccaggagtttgtggagaacgtcttcagtcttcccatcgacctgccatttagtggttacagaaagggtattcgagcaagagactcactccaaaaaagcatagagaaagccatcagagagaaaccactccacacacaggggaaagattacactgatgctcttgatgtgcttctagaaagcgccaaggagaacaacacggagcttacaatgcaggagctcaaggagtccactattgagctgatttttgcagcgtttgccactacagccagcgccagcacgtctctggtgatgcagctgctgcgtcaccctgcggtgctggagaagctgcgtgaagagctgcggagctgtggtcttcttcatgacggctgtctgtgtcagggggagctgcggttggacagcatcatcagcctaaagtacctggactgtgtcattaaagaggtcctacgtctcttcgccccagtgtcaggaggatacagaatagccactcaaacctttgagctggatggagttcaggttcctaaaggctggagtgtgatgtacagtatccgcgacacccatgacacctcggctgtgttcaaggacgtcgaggcctttgacccagatcgattcagccccgagcgcagcgaggaccgcgagggccgcttccactacctgccctttggtggtggcgttcgttcctgccttggtaaacagctggccactcttttcctcaaactgctggctgtggagctcgctggaggcagccggtttgagctgtcaaccagaacattcccacgaatgatctctgtccctgtggtccatccgaccgacggcctccgcgtcaaattcttcggcctcgactccaatcagaaccagatcatggcaaagtcggatgaaatgcttgacgccactgtgtga

SEQ ID NO: 28264 - protein, 511 aa, Brachydanio rerio
MLFESFDLVSALATLAACLVSMALLLAVSQQLWQLRWTATRDKSCKLPMPKGSMGFPIIGETCHWFFQGAGFHASRRQKYGNVFKTHLLGRPLIRVTGAENVRKVLMGEHSLVTVDWPQSTSTLLGPNSLANSIGDIHRKRRKIFAKVFSHEALESYLPKIQQVIQETLRVWSSNPDPINVYRESQRLSFNMAVRVLLGFRIPEEEMHCLFSTFQEFVENVFSLPIDLPFSGYRKGIRARDSLQKSIEKAIREKPLHTQGKDYTDALDVLLESAKENNTELTMQELKESTIELIFAAFATTASASTSLVMQLLRHPAVLEKLREELRSCGLLHDGCLCQGELRLDSIISLKYLDCVIKEVLRLFAPVSGGYRIATQTFELDGVQVPKGWSVMYSIRDTHDTSAVFKDVEAFDPDRFSPERSEDREGRFHYLPFGGGVRSCLGKQLATLFLKLLAVELAGGSRFELSTRTFPRMISVPVVHPTDGLRVKFFGLDSNQNQIMAKSDEMLDATV

SEQ ID NO: 28265 - DNA, 1560 bp, Drosophila melanogaster
  CDS (1)..(1560)
atggaactggtactgctcatcctcgtggcatccctaatagggattgcctttctggcgctgcagcagcattactcctattggcggcgaatgggagtacgcgaaatcaggcccaaatggatagtgggcaacctgatgggactgctcaacatgcgaatgagtcccgcggagttcatatcgcaattgtataaccatcccgatgcggagaacgaacccttcgtgggcatccatgtgttccacaagccggcgctgcttttgagagaccccgaaatggtgagaaatatcctggtcaaggacttcgctggcttctccaaccggtactcgagctccgaccccaagggcgaccctttgggatcccagaacatattcttcctgaagaatcccgcctggaaggaggtacgtttgaagctatcgcccttcttcaccggcaatcgactgaagcagatgtttcccctgatcgaggaggtgggcgccagcttggatgcccatctccgccagcagccgctgcacaacgagcggatgcgctgcttcgacttggaggccaaggagctgtgtgctctctacaccacggatgtgatagccacggtagcgtacggagtgagtgccaacagtttcacggatccgaagtgcgagttccgccgccatggacgttctgtgttcgagttcaacctgctgcgtgccgcggagttcactctagtgtttttcctgccccacctggtcccgttcgttagattcaaggtggtgccggcggaggccactcgttttctgcgcaagaccatcaactatgtgatgtcggagcgggaaaaatccggacagaagcgcaacgatctcatcgacattctcattgagttccgtaggagcacgcagctggcgaaggcatcgggtatcaaggatcaatttgtgttcgagggcgacatcctggtcgcccaggcggtactcttcttcaccgccggctttgagtcctcctcctcgaccatggcgttcgcgatgtacgagttggccaaggatacggacgtacagcagcgcctgcgggaggagatcaaggatgcactagtcgaaagtggaggtcaggtgacgctgaagatgatcgagtcactggagttcatgcaaatgattctgctggaggtgctgcgcatgtatccgccattgccgtttttggatcgcgagtgcacttctgggagggattactcgctggctccgttccacaaaaagttcgtggtgcccaagggcatgcccgtttatataccctgctatgccctgcacatggatccccagtactttcctcaaccgcgaaaatttctgcctgaaagattctcgcccgagaatcacaagctacacacgccctacacctacatgcccttcggcctgggtccgcatggctgcatcggagaacgttttggatatctccaggcgaaggtgggtttggttaacctgctgcgcaaccacatgataaccacctcggagcgcacaccccatcgcatgcagctggatcccaaggccatcataacccaagccaagggcggcatccacctacggctggttcgcgatgctttgggcgtctaa

SEQ ID NO: 28266 - protein, 519 aa, Drosophila melanogaster
MELVLLILVASLIGIAFLALQQHYSYWRRMGVREIRPKWIVGNLMGLLNMRMSPAEFISQLYNHPDAENEPFVGIHVFHKPALLLRDPEMVRNILVKDFAGFSNRYSSSDPKGDPLGSQNIFFLKNPAWKEVRLKLSPFFTGNRLKQMFPLIEEVGASLDAHLRQQPLHNERMRCFDLEAKELCALYTTDVIATVAYGVSANSFTDPKCEFRRHGRSVFEFNLLRAAEFTLVFFLPHLVPFVRFKVVPAEATRFLRKTINYVMSEREKSGQKRNDLIDILIEFRRSTQLAKASGIKDQFVFEGDILVAQAVLFFTAGFESSSSTMAFAMYELAKDTDVQQRLREEIKDALVESGGQVTLKMIESLEFMQMILLEVLRMYPPLPFLDRECTSGRDYSLAPFHKKFVVPKGMPVYIPCYALHMDPQYFPQPRKFLPERFSPENHKLHTPYTYMPFGLGPHGCIGERFGYLQAKVGLVNLLRNHMITTSERTPHRMQLDPKAIITQAKGGIHLRLVRDALGV

SEQ ID NO: 28267 - DNA, 2199 bp, Oryza sativa
  CDS (252)..(1784)
tagcaccaccatttggaagaatcctccccaagattgctcgatcccctcgtgtccctctctcccaacaacactgcgccacagacacaaatcacactcagatacgaaagataagtacagagagagagagagggcacggattatacactgcacacaagcatatatatatatatatcgattagccatccgtgctgatctgaagagtatcatcggtagagagttttacagagttgtttggacaaggagacacacacatggctttcttgctcttctttgtctttgtgacagctgcagtgctgtgcttcgtcgtcccggcgttcttgctgctctgcacgagcgtgcagaggaggagagatgttggacagggtggagggcgagattggcagaagaagaagaagctcaggcttcctccgggatccatgggctggccgtacgtcggcgagacgctccagctctactcccaggaccccaacgtcttcttcgcctccaagcagaagaggtacggcgagatattcaagacgaatctgctggggtgcccgtgcgtgatgctggcgagcccggaggcggcgaggttcgtgctggtgtcgcaggcgaggctgttcaagccgacgtacccgccgagcaaggagcggatgatcgggccgtcggcgctcttcttccaccagggcgagtaccacctccgcctccgccgcctcgtccaggccgccctcgccccggactccctccgcgccctcgtcccggacgtcgacgccgccgtcgccgccacgctcgccgcctggtccggcggccacgtcgccagcaccttccacgccatgaagaagctctcgttcgacgtcggcgtcgtgaccatcttcggcggccggctcggccgccggcacagggaggagctgaggacgaactactccgtcgtggagagaggctacaactgcttccccaaccgcttcccggggacgctctaccacaaggcgatccaggcgaggaagcggctgcgcgcgatcctgagcgagatcgtggcggagcggcgggcgcgcggcggcggcggcggcggcggcggcgacgacctcctcggcggcctcatgcggtcgcgcgacgacggcaccgccggcgcggtggcgctgctcaccgacgaccagatcgccgacaacgtcgtcggcgtgctgttcgcggcgcaggacaccaccgccagcgtcctcacctggatcctcaagtacctccacgactcgccgaagcttctcgaagccgtcaaggcggagcagatggcgatctacgtggccaacgagggcgggaagcggccgctgacgtggacgcagacgaggagcatgacactcacgcatcaggttatactggagagcttgaggatggcgagcataatctccttcacgttcagagaggcagtcgccgacgtggagtacaaaggtttcctgattccaaaggggtggaaggtgatgcctctgttcaggaacatccatcacaacccggactacttccaggatccacaaaagtttgatccttctagattcaaggtggcgccgcgtccaagcacgttcctgccgttcgggagcggcgtgcacgcgtgcccgggcaacgagctggccaagctggagatgctcgtcctcgtccaccgcctcgtcaccgcctacaggtgggagatcgtcggggcgagcgacgaggtggagtacagcccgttcccggtgccgaggggcgggctcaacgccaagctgtggaagcaggaggcggaggaggacatgtacatggccatgggcaccatcacagcagcaggtgcttgacacgtactactgctgatggtggctgatgtgtccttggtttcttttcgtcgccgtgtgtgtggatgcaatggtcgatcgatcgatctctcctgtaatcctcggataaagcaaaggccatgggagggatgagatgatcgtgtagcaaaatctctcttcactttttcgtgtgtgtgtgttgggttggataatggtggtccatggatatcgttcgatgatcgatgatgatgatgctaaacctagtcttggtgtgcctagtgtagcactaggagtagtagtttatcaattgcttagctgttagctagcatcgctttgcattgggttaatacagctagctgtcaagcttataagtaattaagctctctaatcagggttttaaatctcctgtttgagaagtttgagaaggattctctcatgt

SEQ ID NO: 28268 - protein, 510 aa, Oryza sativa
MAFLLFFVFVTAAVLCFVVPAFLLLCTSVQRRRDVGQGGGRDWQKKKKLRLPPGSMGWPYVGETLQLYSQDPNVFFASKQKRYGEIFKTNLLGCPCVMLASPEAARFVLVSQARLFKPTYPPSKERMIGPSALFFHQGEYHLRLRRLVQAALAPDSLRALVPDVDAAVAATLAAWSGGHVASTFHAMKKLSFDVGVVTIFGGRLGRRHREELRTNYSVVERGYNCFPNRFPGTLYHKAIQARKRLRAILSEIVAERRARGGGGGGGGDDLLGGLMRSRDDGTAGAVALLTDDQIADNVVGVLFAAQDTTASVLTWILKYLHDSPKLLEAVKAEQMAIYVANEGGKRPLTWTQTRSMTLTHQVILESLRMASIISFTFREAVADVEYKGFLIPKGWKVMPLFRNIHHNPDYFQDPQKFDPSRFKVAPRPSTFLPFGSGVHACPGNELAKLEMLVLVHRLVTAYRWEIVGASDEVEYSPFPVPRGGLNAKLWKQEAEEDMYMAMGTITAAGA

SEQ ID NO: 28269 - DNA, 2322 bp, Homo sapiens
  CDS (220)..(1746)
aagtggccttggccttctgttatttcagatccagcagatggggagactgaacaaagtggtatcctgggcccaccagtttttctacactcacccactctggtttgaaccgttcactggcttccagaacatttgagcccaactatgtcaaagctgtgtgtagccacaggggtgaggtgttcttgggagagctgctcttcctgagaacaaagggctcaggctatgatgtggggaggaggcctggacctgtgtcctatgcctgggcagctgaagttcccaccctgcttatcaaggtgcctcctctgggaaccccctagtctctatttgacccaaccaacttcttcacttgcagaacctcaagccctaatatgtatgacttcttcctccagtggattgtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatatagtcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattcctt

SEQ ID NO: 28270 - protein, 508 aa, Homo sapiens [sequence omitted]

SEQ ID NO: 28271 - DNA, 1548 bp, Ashbya gossypii
  CDS (1)..(1548)
atggacgcaataggcttcggggagcaggcaggctggttgtggcgcgcgctggcggcgctgtgggcgtggcgcgtgctggcggcgctggtgctggtgctggtggcggaccaggcggcgtaccggcgcaacaagggacggatagcgggccctgcgtggaaaatgtggccgctgattgggccgttcctggagtcgctggacccgaagttcgaggtgtaccaggcgaagtgggcgtcggggccgctgtcgtgcgtgtcgatcttccacaagttcgtggtgatagcgtcgacccgggacctgacgcggaagatcctgcagtcgcccaagtacgtgaagccgtgcctggtggacgtggcgaagaagatcctgcggccgacgaactgggtgttcctggacggccaggcgcacctggactaccggcgctcgctgaacgggctgttcacgcgggacgcgctggcgcggtacctgccgtcgcaggaggcggtcatcgaccgctacatggcgaagttcgtggccttctcgcgcgagaccgactacgagcaccgcgtgttcttccacgagatgcgcgagatgctgtgcgcgctgtcgctgaaggccttctgcggcagctacatcaccgacgaccaggtgcgcaagattgccgacgactactacctggtgaccgccgcgctcgagctggtcaacttcccgctgatccttcccttcaccaagacctggtacggtaagcgcaccgccgacatggccatgaagatcttcgagcggtgcgcccaggaggccaagcagcacatcgcggccggcggcgagcccacgtgcgtcgtggacgcctggtgcaagctgatgctggacgcgaaggccaaggacgacgctgactcgcgtctgttacatcgtaagttcaccaaccgcgagatgtccgaggcgctctttacattcctctttgcctctcaggacgcctcttcctctcttgcctgctggcttttccagatcgttgccgataggcccgatgtgctcgcgaaaattcgcgaagaacaactcgcagttcgcaggaacgacccttcggtgcctttatccctggaactcattgaccaaatgaagtacactcacatggccgtcaaggaatgcctgcgctacaggccgcccgtcctcatggtcccgtaccaagtacatgaggcgtttgcggtgtccgcggactatacagcgccaaagggctcaatgctggtggcgactatgtacccggcgctgcacgacccagcggtgtacgagaacccagatgactacattcccgagcgctgggacggagagcagtcgcccgcgaaccaggcaaagaagaattggctggttttcggatccgggccccatgtatgcctgggtcagaagtacgttttcatgaccttcacggccctaatcgggaaatttgccctattcacggaattcgaccacaaggtcacgtcgctcagcgagaaaatcaaggtttttgcgaccatcttcccgcaggacgacctgctgatgagcttcaaaaagagggaccccctcacaggtcagacgactgagtag

SEQ ID NO: 28272 - protein, 515 aa, Ashbya gossypii
MDAIGFGEQAGWLWRALAALWAWRVLAALVLVLVADQAAYRRNKGRIAGPAWKMWPLIGPFLESLDPKFEVYQAKWASGPLSCVSIFHKFVVIASTRDLTRKILQSPKYVKPCLVDVAKKILRPTNWVFLDGQAHLDYRRSLNGLFTRDALARYLPSQEAVIDRYMAKFVAFSRETDYEHRVFFHEMREMLCALSLKAFCGSYITDDQVRKIADDYYLVTAALELVNFPLILPFTKTWYGKRTADMAMKIFERCAQEAKQHIAAGGEPTCVVDAWCKLMLDAKAKDDADSRLLHRKFTNREMSEALFTFLFASQDASSSLACWLFQIVADRPDVLAKIREEQLAVRRNDPSVPLSLELIDQMKYTHMAVKECLRYRPPVLMVPYQVHEAFAVSADYTAPKGSMLVATMYPALHDPAVYENPDDYIPERWDGEQSPANQAKKNWLVFGSGPHVCLGQKYVFMTFTALIGKFALFTEFDHKVTSLSEKIKVFATIFPQDDLLMSFKKRDPLTGQTTE

SEQ ID NO: 28273 - DNA, 1827 bp, Xenopus laevis
  CDS (93)..(1679)
gagagggcaatgtatcaaagtatcaaaacaagattcaaagaagttatatttgttggcataataattgtgcttttgttggtactcttgccaggatgttgccgtttttggaccattttctggactccttaaacctgagtcactcaactttccgagtttatattttctatgctgttattctctttttctctcttataatgtttcgaaccatattaaagatggtgacatatatttatgcttatatcatcaatgccagacgtctgcgttgttttccagagcctccaagacgtagctggcttttaggacatttgggactgtttatgccaacagaggagggccttacagaagtgagtgacgccatttcttcttttcgtaaaacatttctgacatggatgggacccatctctttagtatcagtgtttcatccggacacagttaaaccaatagttgcagcctcagctgccattgctcctaaagatgatctgttctatggtttcctcagaccctggttaggggatggactgttgcttagccatggggagaaatgggggaggcaccggcgccttctgacacctgcctttcactttgacatccttaagagctatgtgaagatttttaatcagagcacagatatcatgcttgcaaagtggcggagaatgacagtagagggccctgtgtctctggatatgtttgaacatatcagtctgatgaccttggatacacttcttaaatgtactttcagctatgacagtgactgccaagagaagccaagtgattatattgctgctatttatgaactgagctcactaatggtgaaacgtgagcactacttgccccatcatttagattttatctacaacctttcctccaatggaaggaatttccggcaggcttgcaaaaaagtgcatgaattcactgccggagtggtacagcaaagacagaaggcattgaaggagaaggggatggaggaatggattaagtctaaacaaggcaaaaccaaggatttcattgatattctattgctgtcaaaggttgaagatggaaaccagctatccgatgaagatatgagggccgaagttgacacatttatgtttgaaggtcatgataccacagcaagtggcttatcatggattctatacaatttggctcgccaccctgaatatcaggagaaatgcagaaaggagattatagagttgctggaagggaaaatcctgaagcatttggagtgggatgaattgtctcagttgccattcactacaatgtgcatcaaggagagtctgcggcttcaccctcctgtaactgcagtatccagacgctgtacagaggatatcaaattacctgatggcaaagtcatccccaaaggaaacacctgcttgatcagtatttatggaacccaccacaaccctgagatctggcctaatccacaggtttatgacccatatcgatttgatccagagaacgtccaagaaaggtcttcccatgcatttgtaccattctcagctggacccaggaattgtattggacagaatttcgctatggccgagatgaagattgttttagctctaatcctttacaaatttcatgtgagattggatgagaccaaggcagtgcgcagaaaacctgagttgatcctacgtgcagaaaatgggctctggctgcaggtggaagaactgaaacgttaatgacatgcctgctgatgccagaagcaactggtttggcaaagcgaaccatttaatattatgtgtgttataggaaagaataattgtaatagcgcagaactgtgtttactcaataacatgaaataaaatgaaaatattacttgctaaaacc

SEQ ID NO: 28274 - protein, 528 aa, Xenopus laevis
MLPFLDHFLDSLNLSHSTFRVYIFYAVILFFSLIMFRTILKMVTYIYAYIINARRLRCFPEPPRRSWLLGHLGLFMPTEEGLTEVSDAISSFRKTFLTWMGPISLVSVFHPDTVKPIVAASAAIAPKDDLFYGFLRPWLGDGLLLSHGEKWGRHRRLLTPAFHFDILKSYVKIFNQSTDIMLAKWRRMTVEGPVSLDMFEHISLMTLDTLLKCTFSYDSDCQEKPSDYIAAIYELSSLMVKREHYLPHHLDFIYNLSSNGRNFRQACKKVHEFTAGVVQQRQKALKEKGMEEWIKSKQGKTKDFIDILLLSKVEDGNQLSDEDMRAEVDTFMFEGHDTTASGLSWILYNLARHPEYQEKCRKEIIELLEGKILKHLEWDELSQLPFTTMCIKESLRLHPPVTAVSRRCTEDIKLPDGKVIPKGNTCLISIYGTHHNPEIWPNPQVYDPYRFDPENVQERSSHAFVPFSAGPRNCIGQNFAMAEMKIVLALILYKFHVRLDETKAVRRKPELILRAENGLWLQVEELKR

SEQ ID NO: 28275 - DNA, 1653 bp, Sus scrofa domestica
  CDS (89)..(1600)
cgttgctgtcgctgcactgtgagaggcaaagagcagcacacacggctgaagggacgctcagaggagggaaccccagaccacggtggccatggacctgatcccaagcttttctgtggaaacctggctgcttctggctaccagcctggtgctcctctatctatatgggacctattcacacggactttttaagaagctggggattcccgggccgaaacctctgccttatttgggaagtgttctagaataccgtaagggcatgtggcattttgacaataaatgttttaaaaagtatgggaaaatgtgggggttttatgacggtagacagcctgtgctggctatgagagacccagaaatgatcaaagcagtgcttgtgaaagaatgttactcggctttcacaaatcggcggaattttggtccagcgggagttatgaaaaatgccatctctgtggctaaggatgagcaatggaagcgagtacgaacattgctgtctccaaccttcaccagtggaaagctcaaagagatgttccccatcattgcccagtatggagatatgctggtgaggaacctgaggaaggaagcagagaaaggcaattccatcaacacgaaagaaatctttggggcctacagcatggacgtgatcacaagcacagcatttggagtggacgtcgattccctcaacaacccacgagacccctttgtacaatatgccaggaagctcctaagatttgatttcctcgatccatttattctctcaataatattatttccattcctcagcccattctttgaagtattagacatcactttgtttccaagaagttctgtgaaatttttcacacagtctgtaaaaaggatgaaagaaagtcgcctcaaagatcaacaaatgcgccgagtggaccttcttcagctgatgattaactcccagaattccaaagaaacggacgcccataaagctctgtctgatcaagaacttgtggcccaaagtattatcttcatttgtgccggctatgagaccactagcagttctctctccttcctggcgtatatactggctactcaccctgacgtccagcagaatctgcaggaggagattgatgcgaccttccccagcaaggcccttcccagctacgacgccctggcacagatggagtaccttgacatggtggtgaatgaaattctcagattatacccaattgctgcaagactggagagggtctgtaagaaggatgtggaaatccatggcgtgtccgttcccaaggggaccgtgatgatggtaccggttttctcgattcacagagacccggagctctggccggagcctgaggagttccggcctgaaaggttcagtaagaagaacaaggactccataaacccttacacttacctgccctttgggactggaccccgcaactgcatcggcatgaggtttgccctcatgaacatgaaactcgctctcgtcagagtcctgcagaacttctccttcaaaccttgtaaagaaacacagacgcccctgaaactaagctctcaaggacttatacaaccagaaaaacccattcttctgaaggttgtgcccagagatgggaccgtaagtggagcctgacttgacttcctttgtgataagaactcgaaataaagataagcttaatctagtgc

SEQ ID NO: 28276 - protein, 503 aa, Sus scrofa domestica
MDLIPSFSVETWLLLATSLVLLYLYGTYSHGLFKKLGIPGPKPLPYLGSVLEYRKGMWHFDNKCFKKYGKMWGFYDGRQPVLAMRDPEMIKAVLVKECYSAFTNRRNFGPAGVMKNAISVAKDEQWKRVRTLLSPTFTSGKLKEMFPIIAQYGDMLVRNLRKEAEKGNSINTKEIFGAYSMDVITSTAFGVDVDSLNNPRDPFVQYARKLLRFDFLDPFILSIILFPFLSPFFEVLDITLFPRSSVKFFTQSVKRMKESRLKDQQMRRVDLLQLMINSQNSKETDAHKALSDQELVAQSIIFICAGYETTSSSLSFLAYILATHPDVQQNLQEEIDATFPSKALPSYDALAQMEYLDMVVNEILRLYPIAARLERVCKKDVEIHGVSVPKGTVMMVPVFSIHRDPELWPEPEEFRPERFSKKNKDSINPYTYLPFGTGPRNCIGMRFALMNMKLALVRVLQNFSFKPCKETQTPLKLSSQGLIQPEKPILLKVVPRDGTVSGA

SEQ ID NO: 28277 - DNA, 1602 bp, Neurospora crassa
  CDS (1)..(1602)
atggcttccaacgcaaccagctttacctcgccgctggccagcgccaagctcggcaccgttgctgtccctccccagctcgaatacgttatcgataccatctcccaggcgagcggctggactattgtctttactcttcttgctgttcttgttgcttgggatcagatcaagtacgtcctcaacaagggcacaatcgctggtccatcatggaagattccctttatcggacccttcttggagtcccttgaccccaagttcgaggaatactatgccaagtggctgagcggtcctctcagctgcgtttccgtcttccacaagtttgtcgtgattgcctcgactcgcgatatggcccgtaaggtcttcaacagccccagttatgtcaagccctgcgtcgtcgatgtcgcccacaagctcctcggcgccgataactgggtcttcctcgatggccccgcccacgtcgagttccgcaagggtctcaacggcctcttcactcgcagggctctcgagatctaccttcccggacaggaggaggtgtacaaccgctacttcaagtccttcctggagatcaccaagaacgccggcggaaagcccgtcccctggatgccccacttccgtgaggtcattactgctgtctcttgccgttccttcgtcggtcactacatttctgatgaggctgtcaagaagattgccgacgactactacctgatcaccgccgctctcgagcttgtcaacttccccatcattattccctacaccaagacgtggtatggcaagaaggcggctgatatggtccttgccgagtttgccaagtgtgctgcgaagagcaaggtccgcatggctgctggaggcgaggccacctgcatcatggatgcctggatcaagcagatgattgactccaagaagtggcgcgaggccgttgccagcggtaacaccgagggtctggagaagcctactcacctgctccgcgacttcaccgactatgagatctcgcagaccattttcaccttcctcttcgcttcccaggatgccaccagctccgccgctacttggctcttccagatcatggctcagcgccctgatgtgctcgaccgtgtccgtgaggagaacctcaaggttcgcaacggtgatatccacgctcccatcaacatggagcagcttgagtcgatgacctacacccgtgccgttgttcgtgagctcctccgttaccgccctcctgtgctcatggtcccctacctggtcaagaaggctttccccatcactgaggattacaccatccccaaggggtccatggttgttcccaccacctacatggctctccgcgaccccgaagtttaccccaaccccgactactttgaccccgagcgttactactcgggtgatgccgaggccaagggtgccaagaactatctcgttttcggcgttggtccacactactgcctcggtcagcactatgctcagctcaaccttgcccttttcgttggcaaggcttctcttctcctcgactggaagcaccaccccactcctctgtccgaggagatcaaggtgtttgccaccatcttccccaaggatgactgtcccctcactttcgaggagcgcaagtggtaa

SEQ ID NO: 28278 - protein, 533 aa, Neurospora crassa
MASNATSFTSPLASAKLGTVAVPPQLEYVIDTISQASGWTIVFTLLAVLVAWDQIKYVLNKGTIAGPSWKIPFIGPFLESLDPKFEEYYAKWLSGPLSCVSVFHKFVVIASTRDMARKVFNSPSYVKPCVVDVAHKLLGADNWVFLDGPAHVEFRKGLNGLFTRRALEIYLPGQEEVYNRYFKSFLEITKNAGGKPVPWMPHFREVITAVSCRSFVGHYISDEAVKKIADDYYLITAALELVNFPIIIPYTKTWYGKKAADMVLAEFAKCAAKSKVRMAAGGEATCIMDAWIKQMIDSKKWREAVASGNTEGLEKPTHLLRDFTDYEISQTIFTFLFASQDATSSAATWLFQIMAQRPDVLDRVREENLKVRNGDIHAPINMEQLESMTYTRAVVRELLRYRPPVLMVPYLVKKAFPITEDYTIPKGSMVVPTTYMALRDPEVYPNPDYFDPERYYSGDAEAKGAKNYLVFGVGPHYCLGQHYAQLNLALFVGKASLLLDWKHHPTPLSEEIKVFATIFPKDDCPLTFEERKW

SEQ ID NO: 28279 - DNA, 1848 bp, Brachydanio rerio
  CDS (74)..(1552)
agtttgtgcgtaaagacgcgtctcctctccagaagcttgtttttcgttttggcgatcagttgcgcgcttcaacatggggctgtacacccttatggtcacctttctctgcaccatcgtgctacccgttttactctttctcgccgcggtgaagttgtgggagatgttaatgatccgacgagtcgatccgaactgcagaagtcctctaccgccaggtaccatgggcttgccgttcattggagaaacgctccagctgatcctccagagaaggaagtttctgcgcatgaaacggcagaaatacgggtgcatctacaagacgcacctcttcgggaacccgactgtcagggtgatgggagctgataatgtgaggcagattctgctgggcgaacacaagctggtgtctgttcagtggccagcatcagtgagaaccatcctgggctctgacaccctctccaatgtccatggagttcaacacaaaaacaagaaaaaggccattatgagggcgttctctcgagatgctctggagcactacattcccgtgatccagcaggaggtgaagagcgccatacaggaatggctgcaaaaagactcctgcgtgctggtttatccagaaatgaagaaactcatgtttcggatagctatgagaatcctgcttggttttgaaccagagcaaataaagacggacgagcaagaactggtggaagcttttgaggaaatgatcaaaaacttgttctccttgccaatcgacgttcctttcagtggtctgtacaggggtttgagggcacgcaatttcattcactctaaaattgaggaaaacatcaggaagaaaattcaagatgacgacaatgaaaacgagcagaaatacaaagacgctcttcagctgttgatcgagaacagcagaagaagtgacgaaccttttagtttgcaggcgatgaaagaagcagctacagagcttctatttggaggtcatgaaaccaccgccagtactgcaacctcactagtcatgtttctgggtctgaacacagaagtggtgcagaaggtcagagaggaggttcaggagaaggttgaaatgggcatgtatacaccgggaaaaggcttgagcatggagctgttggaccagctgaagtacactggatgtgtgattaaagaaactctcagaatcaaccctcctgttcctggaggattcagagtcgcactcaaaacctttgaattgaatggttaccaaattcctaaaggatggaacgtcatttacagcatctgtgacacgcacgatgtggccgacgtctttccaaacaaagacgagttccagccggagagattcatgagcaaaggtctggaggacgggtccaggtttaactacatccccttcggaggaggatccaggatgtgtgtgggcaaagagttcgccaaagtgttactcaagatctttttagttgagttaacgcagcattgcaattggattctctcaaacggacccccgacaatgaaaacaggcccgactgtttacccagtggacaatctccctaccaaattcactagttatgtcagaaattagcctaaccggagctttgtacatatgtttttattttagatgaactgtgatgtattggatattttctattttgtttatataaagcagatgtgtatataagtctatgcgaggaagcgaaaacgagggcactactttctcatggatcactgtaatgctacagagtgtctgtgatgtatatttataatgtagttgtgttatatagcttttgtactgtatgcaacttatttaactcgctctttatctcatgggttttatttaataaaacatgttcttacaaatttcaaaaaaaaaaaaaaaaa

SEQ ID NO: 28280 - protein, 492 aa, Brachydanio rerio
MGLYTLMVTFLCTIVLPVLLFLAAVKLWEMLMIRRVDPNCRSPLPPGTMGLPFIGETLQLILQRRKFLRMKRQKYGCIYKTHLFGNPTVRVMGADNVRQILLGEHKLVSVQWPASVRTILGSDTLSNVHGVQHKNKKKAIMRAFSRDALEHYIPVIQQEVKSAIQEWLQKDSCVLVYPEMKKLMFRIAMRILLGFEPEQIKTDEQELVEAFEEMIKNLFSLPIDVPFSGLYRGLRARNFIHSKIEENIRKKIQDDDNENEQKYKDALQLLIENSRRSDEPFSLQAMKEAATELLFGGHETTASTATSLVMFLGLNTEVVQKVREEVQEKVEMGMYTPGKGLSMELLDQLKYTGCVIKETLRINPPVPGGFRVALKTFELNGYQIPKGWNVIYSICDTHDVADVFPNKDEFQPERFMSKGLEDGSRFNYIPFGGGSRMCVGKEFAKVLLKIFLVELTQHCNWILSNGPPTMKTGPTVYPVDNLPTKFTSYVRN

SEQ ID NO: 28281 - DNA, 1733 bp, Pisum sativum
  CDS (57)..(1529)
taagagactatagtttctcattcaaattgagtgagtgagttcatagagttctagtgatggcatccttatggttcatctttggtgcaattgcaggtgctcttttggtcctaagatctctcctcaagaatgtgaattggtttctctatgaagcaaaacttggtgacaagcaatactctttgccaccaggtgacatgggttggccaatcattgggaacatgtggtctttcctaagggcattcaagtccagtaaaccagattctttcatggattctatcgtcaaaaggtttggaaacacaggcatatacaaggtgtttatgtttggattcccaagtgtaattgtgacatcaccagaggcatgcaagaaagttctaactgatgatgaaaactttgaacctggttggccacaatcaacggttgaattaatcggcgaaaaatcgttcatcaaaatgccgtttgaagaacatagacgactaaggcgtttaacatcggcttcgatcaatggctacgaggcactttcagtgtacttgaaatatatagaagaaattgtgattagttcattggaaaaatggactcaaatgggtgaaattgagttcttaactcaaatgagaaaacttacttttaaaattattattcacattttccttggttcagaaagtgaacctgttatggaagctttggaaagagaatatactgttcttaaccttggtgttagagctatgagaattaatattcctggatttgcttttcataagtcacttaaggctaggaaaaatctggtggctatatttcaatcaattgtggacaagagaagaaacgaaaggagaggaaaagaaccagcccctggcaaaaaagctaaagatatgatggattctttgatagatgctgtggatgaaaatggaagaaaattgggtgatgatgaaatcattgatatcatgttgatgtatttgaatgctggtcatgaatcttcaggacatatcactatgtgggctacctatttcttgcagaggcatcctgaatttttccgaaaggctaaggaagaacaagttgaaatgcttaagagaaggcctccatcacaaaaagggttgaaactagaggatgttagaaaaatggaatatctttctaaggtgattgatgaaacaatgagagtggttactttctcgcttatggtctttcgacaggcaaggaacgacgtcaaagttaatggttacctcattccaaagggttggagagtgctgacatggttcagatcagttcactttgattctgaactttatcctgatccaagggagttcaatcctgaaaattttagtgtggtgcgcaaggctggtgaattccttccctttggagcaggaactagactctgtcctggcaatgatcttgccaagctggaaatctcagttttccttcaccattttctcctcaaatacgagcttgaacagcttaacccaaaatctccgataagattcttaccacacacaaggccattggacaactgtttggcaaggattaagaaacaagaagctgcatgattcaaagatggagaagcacacgcattttgagagttttcatccaataattttattttctgcacttttttttacgacgaataataatccagagacctgaaaatttacagaagttgcatttatcagacaggttttattagctggtgtgtactggtttatccatttgcttgaatgaataaaaattgaaggattattttctggcaaaaa

SEQ ID NO: 28282 - protein, 490 aa, Pisum sativum
MASLWFIFGAIAGALLVLRSLLKNVNWFLYEAKLGDKQYSLPPGDMGWPIIGNMWSFLRAFKSSKPDSFMDSIVKRFGNTGIYKVFMFGFPSVIVTSPEACKKVLTDDENFEPGWPQSTVELIGEKSFIKMPFEEHRRLRRLTSASINGYEALSVYLKYIEEIVISSLEKWTQMGEIEFLTQMRKLTFKIIIHIFLGSESEPVMEALEREYTVLNLGVRAMRINIPGFAFHKSLKARKNLVAIFQSIVDKRRNERRGKEPAPGKKAKDMMDSLIDAVDENGRKLGDDEIIDIMLMYLNAGHESSGHITMWATYFLQRHPEFFRKAKEEQVEMLKRRPPSQKGLKLEDVRKMEYLSKVIDETMRVVTFSLMVFRQARNDVKVNGYLIPKGWRVLTWFRSVHFDSELYPDPREFNPENFSVVRKAGEFLPFGAGTRLCPGNDLAKLEISVFLHHFLLKYELEQLNPKSPIRFLPHTRPLDNCLARIKKQEAA

SEQ ID NO: 28283 - DNA, 1601 bp, Pisum sativum
  CDS (44)..(1510)
gaattgagagtgaagtaagagaagttaggtgaatcaattagtgatgattttagagatgggttccatgtgggtggtcctcatggccattggtggtgctcttttggtcctaagatccattctcaaaaatgtaaattggtggctctatgaatccaaattaggtgtcaagcagtactctctgccaccaggtgatatgggatggcccttcataggtaacatgtggtcctttcttagagctttcaagtctaaagatcctgactccttcatctcttccattgtatccagatatggaagtagtggaatatacaaagccttaatgtttggaaatccaagtgtgattgtgacaacaccagaaggatgcaaaagagttctaaccgatgatgaaaaattcacaactggttggcctcaatctacaatagagctcattggaaagaactcattcattgcaatgacttacgaagaacacaagcgccttcgacgtttaacatcgtcttccatcaatggcatggaagcattgtctttgtacttgaaatatatcgaagaaaacgttataatttcgctagagaaatggtctaacatgggacaaatcgagtttttaaccgaaattcggaagcttacttttaaaatcattatgcatatttttcttagttcagaaagtgaacctgttatggaagctttggaaaaagaatacacaatacttaatcatggagttagagctatgcaaatcaatgttcctggatttgcatactataaagcgctcaaggctaggaaaaatctagttggaatatttcaatctattgtggatgatagaagaaacataagaaaggtttattcgcaaaagaaagcgaaagatatgatggattctcttatagatgttgaagatgataatggaagaaagttgaatgatgaagatatcattgatataatgttaatgtacttgaatgctggtcatgagtcttcgggacatattacaatgtgggctacctatttcctacaaaagcaccctgaatatcttaaaaaagctaaggaagaacaagaagaaataataaagaggagaccttcaacacagaaagggttgacacttaaggaaattcgcggcatggattttctttataaggtaatcgatgaaacaatgcgcgtgataaccttttcattggtggtttttcgagaggcgaaatccgatgtaactatcaatggttataccataccaaaaggttggaaagtgcttacatggttcagatcagttcaccttgatcctgaaatatatcctaatccaaaggaatttaatcctaatagatggaataaggaacataaagcaggggagttccttccctttggagcaggaactagattatgtcctggcaatgatcttgccaaaatggaaatagcggtttttcttcatcatttcactcttaattaccggcttgaacagcttaatcctaaatgtcctattagatatttaccacatacaaggcctatggacaattgcttaggaagggttaagaaatgttgatcaacataaatttcaaatggaaaagagagttcatggttctttgtattgtgaaaattgttttcatgtttgtattttggtaaaaccacaaatc

SEQ ID NO: 28284 - protein, 488 aa, Pisum sativum
MILEMGSMWVVLMAIGGALLVLRSILKNVNWWLYESKLGVKQYSLPPGDMGWPFIGNMWSFLRAFKSKDPDSFISSIVSRYGSSGIYKALMFGNPSVIVTTPEGCKRVLTDDEKFTTGWPQSTIELIGKNSFIAMTYEEHKRLRRLTSSSINGMEALSLYLKYIEENVIISLEKWSNMGQIEFLTEIRKLTFKIIMHIFLSSESEPVMEALEKEYTILNHGVRAMQINVPGFAYYKALKARKNLVGIFQSIVDDRRNIRKVYSQKKAKDMMDSLIDVEDDNGRKLNDEDIIDIMLMYLNAGHESSGHITMWATYFLQKHPEYLKKAKEEQEEIIKRRPSTQKGLTLKEIRGMDFLYKVIDETMRVITFSLVVFREAKSDVTINGYTIPKGWKVLTWFRSVHLDPEIYPNPKEFNPNRWNKEHKAGEFLPFGAGTRLCPGNDLAKMEIAVFLHHFTLNYRLEQLNPKCPIRYLPHTRPMDNCLGRVKKC

SEQ ID NO: 28285 - DNA, 1542 bp, Pneumocystis carinii
  CDS (1)..(1542)
atgggatttttaaagactattcttaaagtattaggaatagaaaattttacactcagttttgtaataatcatcttaacatttttttttcttctacatatttttcctcaattataccaaaaagattcgtcaaaacctcctgtagtatttcattggcttccttttattggatcaactattcaatatggcatggacccgtataagttttttcaaaaacaaaaaaaaaaacatggaaatatttttacttttattctacttggaaaaaaaatgacagtagcattaggacctaaaggcaatgatatactttttaatggaaaattatcaagtttatcagcagaagaagcatatactcatctgacaacacccgtttttggtacagatgtcgtttatgatgttcctaatcatgtattaatggaacagaaaaaatttgtaaaaactggttttactatagaaacatttagagcatatgttccattgattattgaagaagtaaaaacgtacttagaaactagcccgatttttggaaaggataaactctctggtgtttcatctttaatgaaagctttgcctgaaataacaatttttactgcatctcgtactcttcaaggaaaagaagtacgcagtaattttgacgcatcatttgcaaagctttatcatgacttagatgggggatttactccaattaactttctagctccttggttaccacttccaaaaaatcgtctacgtgatgctgctcaaaaaaaaatggcacaaatttatatgaatattataaagcaaagaagaaaaacatgccaacatgaagaaaaggatatgatttggaatcttatgaatcaacattacaaagatggccgtaaattaacagataaagaaattgctcatttaatgattgctatattaatggctggccagcataccagtgcagcgacaggatgttgggctttattacatcttgcagaaaagccagagtatattaagctattgcttgaggaacaaaaaagagtatttggagacaacttagacgatctaacatatgacaatcttaaggatatggaattgttatcttatgtaataaaagaaactctaagattacatcctcctcttcatagtattataagaaaagtcaaatcaccgattctaatagaaaactcaccctacattgttcctaaaaatcattatttgttagcagcgccaggtgtcagctcagttgatgaagaatactttgaaaatgcattagaatttatacctgaaagatggaaatgcgaaaaaaatacagaagattccgataaaattgattacggatatggtttagttactaaaggagcattttcgccctatttgccatttggtgcaggaagacatagatgtattggagagcaatttgcatacatgcaacttggtacaattattacaatatttgttcatgaattagaatggactttaccaaaaaatcaaattactattccaaagcctgactacactagcatggttgtattaccagaaagaccttctaacattgaatggagaagaagacaaaaaagataa

SEQ ID NO: 28286 - protein, 513 aa, Pneumocystis carinii
MGFLKTILKVLGIENFTLSFVIIILTFFFLLHIFPQLYQKDSSKPPVVFHWLPFIGSTIQYGMDPYKFFQKQKKKHGNIFTFILLGKKMTVALGPKGNDILFNGKLSSLSAEEAYTHLTTPVFGTDVVYDVPNHVLMEQKKFVKTGFTIETFRAYVPLIIEEVKTYLETSPIFGKDKLSGVSSLMKALPEITIFTASRTLQGKEVRSNFDASFAKLYHDLDGGFTPINFLAPWLPLPKNRLRDAAQKKMAQIYMNIIKQRRKTCQHEEKDMIWNLMNQHYKDGRKLTDKEIAHLMIAILMAGQHTSAATGCWALLHLAEKPEYIKLLLEEQKRVFGDNLDDLTYDNLKDMELLSYVIKETLRLHPPLHSIIRKVKSPILIENSPYIVPKNHYLLAAPGVSSVDEEYFENALEFIPERWKCEKNTEDSDKIDYGYGLVTKGAFSPYLPFGAGRHRCIGEQFAYMQLGTIITIFVHELEWTLPKNQITIPKPDYTSMVVLPERPSNIEWRRRQKR

SEQ ID NO: 28287 - DNA, 3237 bp, Bradyrhizobium japonicum
  CDS (1)..(3237)
atgtcatccaagaaccgtctggacccgatcccgcagccgccgaccaagccggtggtcggcaatatgctgtcgctggactcggcggctcccgtgcagcacctgacgcggctcgccaaggagctcggcccgatcttctggctcgacatgatgggctcgccgatcgtcgtcgtctcgggccacgatctcgtcgacgagctgtccgacgagaagcgcttcgacaagacggtgcgcggcgcgctgcggcgcgtgcgtgcggtcggcggcgacggcctgttcacggccgacaccagggagccgaactggagcaaggcgcacaacatcctgctccagccgttcggcaaccgcgcgatgcagtcctaccacccgagcatggtcgacatcgccgagcagctcgtccaaaaatgggagcggctcaacgccgacgacgagatcgacgtcgtccacgacatgaccgccctgacgctggacacgatcggcctgtgcggcttcgactaccgattcaattcgttctaccggcgcgactaccatcccttcgtcgagtcgctggtgcgctcgctcgaaaccatcatgatgacgcggggtcttccgttcgagcagatatggatgcagaagcggcgcaagaccctcgctgaagacgtcgccttcatgaacaagatggttgacgagatcatcgcggagcgccgcaagagcgcggaggggatcgacgacaagaaggacatgctcgcggcgatgatgaccggcgtcgaccgctcgaccggcgagcagctcgacgacgtcaacatccgctaccagatcaacacgtttttgatcgccggccacgagacgacaagcggcctgttgtcctacacgctctatgcgctcctgaagcatcccgacatcctcaagaaggcctatgacgaggtcgatcgcgtcttcggtccagatgtcaacgcgaagccgacctatcagcaggtgacgcagctcacctacatcacgcagatcctgaaggaggcgttgcggctgtggccgccggcgccggcctacggcatctcaccgctcgcggacgaaaccatcggtggcggcaagtacaagctcaggaaaggcacgttcatcaccattctggtgacggcgctgcatcgcgatccctccgtctgggggccgaatcccgatgccttcgatcccgaaaatttcagccgcgaggcggaggccaagcggcccatcaatgcctggaagccgttcggcaacggtcagcgcgcctgcatcggccgcggctttgccatgcacgaggcggcgctcgcgctcggcatgatcctccagcgtttcaagctgatcgaccaccagcgctaccagatgcacctgaaggaaacgctgacgatgaagccggagggcttcaagatcaaggttcgtccgcgcgccgatcgcgagcgcggtgcctatggcgggcctgtcgcggctgtgtcctcggcgccgcgagcaccgcgtcagccgacggcgcggcccggccacaacacgccgatgctggtgctgtacggctccaatctcggcaccgccgaagaactcgcgacacgcatggccgacctcgccgagatcaacggctttgccgtgcatctcggggcgctcgacgaatacgtcggcaagctgccgcaggagggcggcgtgctgatcatctgcgcctcctataacggagcgccgccggacaatgcgacgcaattcgtcaaatggctcggcagcgacctgcccaaggatgcctttgccaatgtgcgctacgccgtgttcggctgcggcaacagcgactgggctgcgacctatcaatcggtgccgcgcttcatcgacgagcaattgtcggggcatggcgcgcgcgcggtctatccgcgcggcgaaggcgacgcgcgcagcgatctcgacggccagttccagaagtggtttccggcagccgcgcaggtcgcgaccaaggagttcggcatcgactggaattttacccgcaccgcggaggacgatccgctctacgcgatcgaacctgtcgcggtgactgccgtcaataccatcgtcgcacagggcggcgcggtggcgatgaaggtgctggtcaatgacgagcttcagaacaagagcgggtccaatccgtcggagcgctcgacgcgccatatcgaggtgcagctgccatccaacatcacctaccgcgtcggcgatcatctgagcgtcgttccgcgcaacgatccgacgctggtggattcggtcgcccgccgcttcggcttcctgccggccgaccagatcaggcttcaggtggccgaaggccgccgtgcgcaattgccggtcggcgaggccgtgtcggtcggccgcctgctcagcgagttcgtcgagctgcagcaggtggcgacgcggaagcagatccagatcatggccgagcacacgcgctgcccggtcaccaagccgaagctgctggccttcgtcggcgaggaggccgagccggccgagcgctatcgcaccgagattctggcgatgcgcaaatcggtgtacgatctgctgctcgaatatccggcctgcgaattgccgttccacgtttatctggaaatgctctcgctgctggcgccgcgctactactcgatctcctcttccccgtcggtcgatccagcgcggtgcagtatcacggtcggcgtcgtcgaggggccggccgcttccgggcgcggcgtctacaaaggcatctgctcgaactatctcgccaaccggcgcgcgagcgatgcgatctacgccacggtgcgcgagaccaaggccggcttccggctcccggacgattcatccgtgccgatcatcatgatcggcccgggcacggggctggcgccgttccgcggcttcctccaggagcgcgccgcgcgcaaggcgaaaggcgcttcgcttggcccggccatgctgttcttcggctgccgtcaccccgatcaggattttctctacgccgacgagctgaaggcgctggcggcaagcggcgtcaccgagctcttcaccgcgttctcgcgcgcggacggaccgaagacctatgtgcagcacgtgctcgcggcgcagaaggacaaggtctggccactgatcgagcagggcgccatcatctacgtctgcggcgacgggggccaaatggagcccgacgtgaaggcggcccttgtcgcgatccgtcacgagaagagcggtagcgataccgcgacagccgcgcgctggatcgaggagatgggcgcgacgaaccgctatgtgctcgacgtctgggcgggcggttag

SEQ ID NO: 28288 - protein, 1078 aa, Bradyrhizobium japonicum
MSSKNRLDPIPQPPTKPVVGNMLSLDSAAPVQHLTRLAKELGPIFWLDMMGSPIVVVSGHDLVDELSDEKRFDKTVRGALRRVRAVGGDGLFTADTREPNWSKAHNILLQPFGNRAMQSYHPSMVDIAEQLVQKWERLNADDEIDVVHDMTALTLDTIGLCGFDYRFNSFYRRDYHPFVESLVRSLETIMMTRGLPFEQIWMQKRRKTLAEDVAFMNKMVDEIIAERRKSAEGIDDKKDMLAAMMTGVDRSTGEQLDDVNIRYQINTFLIAGHETTSGLLSYTLYALLKHPDILKKAYDEVDRVFGPDVNAKPTYQQVTQLTYITQILKEALRLWPPAPAYGISPLADETIGGGKYKLRKGTFITILVTALHRDPSVWGPNPDAFDPENFSREAEAKRPINAWKPFGNGQRACIGRGFAMHEAALALGMILQRFKLIDHQRYQMHLKETLTMKPEGFKIKVRPRADRERGAYGGPVAAVSSAPRAPRQPTARPGHNTPMLVLYGSNLGTAEELATRMADLAEINGFAVHLGALDEYVGKLPQEGGVLIICASYNGAPPDNATQFVKWLGSDLPKDAFANVRYAVFGCGNSDWAATYQSVPRFIDEQLSGHGARAVYPRGEGDARSDLDGQFQKWFPAAAQVATKEFGIDWNFTRTAEDDPLYAIEPVAVTAVNTIVAQGGAVAMKVLVNDELQNKSGSNPSERSTRHIEVQLPSNITYRVGDHLSVVPRNDPTLVDSVARRFGFLPADQIRLQVAEGRRAQLPVGEAVSVGRLLSEFVELQQVATRKQIQIMAEHTRCPVTKPKLLAFVGEEAEPAERYRTEILAMRKSVYDLLLEYPACELPFHVYLEMLSLLAPRYYSISSSPSVDPARCSITVGVVEGPAASGRGVYKGICSNYLANRRASDAIYATVRETKAGFRLPDDSSVPIIMIGPGTGLAPFRGFLQERAARKAKGASLGPAMLFFGCRHPDQDFLYADELKALAASGVTELFTAFSRADGPKTYVQHVLAAQKDKVWPLIEQGAIIYVCGDGGQMEPDVKAALVAIRHEKSGSDTATAARWIEEMGATNRYVLDVWAGG

SEQ ID NO: 28289 - DNA, 1796 bp, Rattus norvegicus
  CDS (94)..(1587)
cagggaggagactcggcaagctcagccataaaggtgcagcacacacagctaagaataaaggacaaaggagagacttgattaaagaaagcagcaatggacctgatcccaaacatttccttggaaacctggatgctcctggctaccatcctcgtgctcctgtatctgtatggaacctccacacatggaaattttaagaaattagggatttctggacctaaaccactgccttttgtgggaaatattcttgcataccgccatggattttgggagtttgatagacactgccataaaaaatatggggatatatgggggttttatgagggacgacaacctattttggctataacagatccagatataataaaaacagtgctggtaaaggaatgttattctaccttcacaaaccgtcggagctttggtccagcgggaattttgaaaaaagctatcaccttatctgaggatgaagaatggaagagattaagaacattgctatctcccaccttcaccagtgggaagctcaaggagatgttccccatcattaaccagtatgcagatttgctggtgaaaaacgtgaaacatgaagcagaaaaaggcaatcctatcaccatgaaagacatctttggggcctatagcatggatgtgatcacaggcacatcatttggagtaaacgtggattccctcaacaacccacagaatccctttgtacaaaaagtgaagaaactcttaaaatttaatttcttggacccattctttctctcagtgatactctttccattccttaccccagtttttgaagcatttgacataactgtgtttccaaaagatgttatgaagttttttaggacttctgtagaacgaatgaaagagaaccgcatgcaagagaaagtaaagcaaagattagattttcttcaactgatgataaactcccaaagttctggagataaagagtctcaccaaggtttaactgatgtggagattgtggctcagtccattttctttatttttgccggctatgagaccactagcagtgctctttcctttgctttgtatttgctggccacacaccctgatctccagaagaaactgcaggatgaaattgatgcagctctgcccaataaggcacctgtgacctatgatgtcctggtagagatggagtacttggacatggtgttaaatgaaactctcagattatttccagttggtggaagactcgagagggtctgtaagaaagatgttgaaatcaatggggtttttatacccaaagggactgtggtgatggtaccaacctttgctcttcacaaagacccaaagtgctggccagagcctgaggaattttgtcctgaaaggttcagaaagaagaatcaggacagcatcaatccttacatatacctgccctttggtaatggacccaggaactgtattggcatgaggtttgctctcatgaacatgaaaattgctcttgtcagagtcctgcagaacttctcctttggactttgtaaagaaactcagattcctttaaaactaagaaagaaaggattttttcaaccagaaaaacccatcattctaagggctgtatcaagagattgaaccatgagtggagcttgatattatgcctactctagccccatgacacatggcatcagaaaccaaattatttgtgaagaaaatgcagcgatgaagacgggattgattctcttcatgtatggtggactctgggccttcatcaagatgctcacctcctctagccaccaaagttcagcaatcacatgcttcccaaaatagaaaaaagcaagggt

SEQ ID NO: 28290 - protein, 497 aa, Rattus norvegicus
MDLIPNISLETWMLLATILVLLYLYGTSTHGNFKKLGISGPKPLPFVGNILAYRHGFWEFDRHCHKKYGDIWGFYEGRQPILAITDPDIIKTVLVKECYSTFTNRRSFGPAGILKKAITLSEDEEWKRLRTLLSPTFTSGKLKEMFPIINQYADLLVKNVKHEAEKGNPITMKDIFGAYSMDVITGTSFGVNVDSLNNPQNPFVQKVKKLLKFNFLDPFFLSVILFPFLTPVFEAFDITVFPKDVMKFFRTSVERMKENRMQEKVKQRLDFLQLMINSQSSGDKESHQGLTDVEIVAQSIFFIFAGYETTSSALSFALYLLATHPDLQKKLQDEIDAALPNKAPVTYDVLVEMEYLDMVLNETLRLFPVGGRLERVCKKDVEINGVFIPKGTVVMVPTFALHKDPKCWPEPEEFCPERFRKKNQDSINPYIYLPFGNGPRNCIGMRFALMNMKIALVRVLQNFSFGLCKETQIPLKLRKKGFFQPEKPIILRAVSRD

SEQ ID NO: 28291 - DNA, 1524 bp, Oryza sativa
  CDS (1)..(1524)
atggatcatgtaacaagtagcacaatcgccagaggcgccatgtcgtgggtcgccgccaccgtagctctcctgctgaccaccgcggtcatactgaccgcgttgcagaagagaaagatcagcagcccggccgcggcggcgccgccggttgtgcggggagccggtctcgtacggttcgcgcgcgccatggcgagggacgggccgctggaggcgatccgcgagcagcaggcgaagctggggagcgtgttcacggcgatcgccccgtttggcctcttcaaggtgaccttcctgatcgggccggaggtgtcgagccacttctacctggcgccggagtcggagatggggcagggtagcatctacaggttcaccgtgcctttgtttgggcccgaggttggctacgccgtcgacccggacactcgtgctgagcagatgcgcctcttctgggacgtcctcaagccacggagcatcgaggccagggtaggcgccatggctgaggaggtccagaactacttctcgagatggggagagcaagggacggttgatctgaagaaagagttggagcaggtactgatgttgatcgcgagtcggtgcctgctgggaagggaggtgcgggagagcatggtggacgaagtatacgagctcttccgtgatcttgacaacggcttgcacctcatcagcaccatgctcccctacctcccaaccccggcacaccgccgtcgtgacagggcgcgccaaaggctcggggagatattcaccgaggtgattaggtcacgcaggaactctggcactgccgacaacggcgacgacgtgctgcaacgcctcattgacggcaggtacaaggacgagcgtgacttgacggatgtggaggtcgtcggtctactcgtggcgcttgtgttcgcggggaaacactcgagctccagcgtgagcacctggaccggcatcaacctgctctcccacccaaaccaccttgtcgccgtcatcgccgagcaggaccggctgatggcgtcgcgcgctagaaccgacgatgaccatgatcgcgtcaactatgataccgtgcaggagatgaccactctgcaccgctgcatcaaggaggcgctccgactgcacccaccggcagtggcaatgttccgtcaagcccgcaagcacttcaccgtgcagacaaaggaaggtaaagagtacacgatcccaggagggcacacggtgatgagcacgatcttggtgaaccaccacatgcccaatgtctacaaggaccctcatgtgtttgacccttcacggtttgcacgcggtaggggggaagacaaggccgctggccccttctccttcctggcctttggcgccgggaggcattcatgcgcaggtgagtccttcgcgtacacacagataaaggtgatatggagccatttgctgaggaactttgagctcaagatggtatctcctttccctgagacaagctggagaatggtgacgccagagccaaaggggacagtgatgattagctacaggagacggaacctaacttgtaaatag

SEQ ID NO: 28292 - protein, 507 aa, Oryza sativa
MDHVTSSTIARGAMSWVAATVALLLTTAVILTALQKRKISSPAAAAPPVVRGAGLVRFARAMARDGPLEAIREQQAKLGSVFTAIAPFGLFKVTFLIGPEVSSHFYLAPESEMGQGSIYRFTVPLFGPEVGYAVDPDTRAEQMRLFWDVLKPRSIEARVGAMAEEVQNYFSRWGEQGTVDLKKELEQVLMLIASRCLLGREVRESMVDEVYELFRDLDNGLHLISTMLPYLPTPAHRRRDRARQRLGEIFTEVIRSRRNSGTADNGDDVLQRLIDGRYKDERDLTDVEVVGLLVALVFAGKHSSSSVSTWTGINLLSHPNHLVAVIAEQDRLMASRARTDDDHDRVNYDTVQEMTTLHRCIKEALRLHPPAVAMFRQARKHFTVQTKEGKEYTIPGGHTVMSTILVNHHMPNVYKDPHVFDPSRFARGRGEDKAAGPFSFLAFGAGRHSCAGESFAYTQIKVIWSHLLRNFELKMVSPFPETSWRMVTPEPKGTVMISYRRRNLTCK

SEQ ID NO: 28293 - DNA, 1618 bp, Arabidopsis thaliana
  CDS (60)..(1559)
aaatacagagcagaaacctttaagagaagatctaataagaaagaagaggaaaaaaaaggatggttttctcagtttccatttttgcctctctcgctccgtacttagtctcttcgttactactcttctttctcatcgagcagctctcttacctcgtcaagaaacgtaacctccctggtcctctctttgtccctccgatcatcggaaacgccatttcactcgtccgtgatcctacttccttctggttcaagcaatccgacacggcaggcacttcccctggcctcgctgctaactacctcatcggcaaattcatcatctacatcagagacacagagctttctcatcaaatattctccaacgttcgtcttgaagcttttcaccctctaggacatccttttggcaaacaactattcggtgatcatagcctaatctacttgtttggtgaggatcacaaaactgttcgccgtcaccttgctcctaacttcacccccaaggcactctccacttactctgatctccaacaaatagttatgctccgtcatctacgacagtgggaggaaagtttctccggcggaactaagccggtttctatgcgagaccttgtccgtgaactcaatcttgagacttctcaaacggttttcgttggaccctaccttgacaaggaagctaggaacacgttctgtactgattacaatctgttcaatctcggatctatggcgctcccgatcaacctgcccggctttgcgttcaacaaggctcgccgggcggtaatgaacctggagaagacgctctccgtctgtgcgggaaaatccaaaaagaggatggctacaggagaggagccaacatgcttaatcgatttttggatgcatgcattcgtcacggagatagaatccggtaatccaccgccgcttcactccgaagacgaagccatcggcggtttgctcttcgattttctctttgccgcacaagacgcgtcgacgtcatcactcctttgggcggtgacgtttctagaatctcatccgaaagtgctgagcaaagtgagggaggaagtggccaagatttggtcacctcagtctggccatctgatcacggccgatcagctcgcggagatgaagtatactcgcgctgtggcacgtgaggtggtgagatatcgaccaccggcaactatggtcccacacattgctactaatgatttccctcttacagaatcgtacactatcccaaaaggtacaatagtgtttccctcggttttcgacgcctcgtttcaagggtttactgaaccgaaccggttcgatccggaccggtttagtgagacaaggcaagaggatcaagtgttcaaacgaaactacctagcttttggatggggtgcacaccaatgcgtaggccagcgttacgcattgaaccacctcgtgctcttcatcgctatgttctcatcgttgtttgatttcaagagacttcaatcggacggttgcgatgacatcatatactgtcccacgatatcgccaaaggacgggtgcacggtgttcttgtctaagcgcatcgtaacgtatccgaacctctgatttggatttttgttacaaattattggtgatcaaagtcaatactcatgagtgtgattact

SEQ ID NO: 28294 - protein, 499 aa, Arabidopsis thaliana
MVFSVSIFASLAPYLVSSLLLFFLIEQLSYLVKKRNLPGPLFVPPIIGNAISLVRDPTSFWFKQSDTAGTSPGLAANYLIGKFIIYIRDTELSHQIFSNVRLEAFHPLGHPFGKQLFGDHSLIYLFGEDHKTVRRHLAPNFTPKALSTYSDLQQIVMLRHLRQWEESFSGGTKPVSMRDLVRELNLETSQTVFVGPYLDKEARNTFCTDYNLFNLGSMALPINLPGFAFNKARRAVMNLEKTLSVCAGKSKKRMATGEEPTCLIDFWMHAFVTEIESGNPPPLHSEDEAIGGLLFDFLFAAQDASTSSLLWAVTFLESHPKVLSKVREEVAKIWSPQSGHLITADQLAEMKYTRAVAREVVRYRPPATMVPHIATNDFPLTESYTIPKGTIVFPSVFDASFQGFTEPNRFDPDRFSETRQEDQVFKRNYLAFGWGAHQCVGQRYALNHLVLFIAMFSSLFDFKRLQSDGCDDIIYCPTISPKDGCTVFLSKRIVTYPNL

SEQ ID NO: 28295 - DNA, 1662 bp, Heliothis zea
  CDS (32)..(1540)
ggcccgagggtttgctaggtcgctatcagatatgtggctgtacctttgcgctataataatatttttatgtgttctggacctgtgtctaaactataatgaacgagctcggatgatcaagaagttaccgggtcctcctgatgacttcatcgtgggaaatggactcaggattatcaaatcttcagtggatgtgatgaaggtgagaagagaatacgccaaaaaatggaatggaatctatcgtatttgggcgtacccgtttggtgcagtgctggtattcaatcctgaagatgttgagctgataatgtccagcatgaagtatggcgaaaagagtatcatctacacaattttaaagccctggctccaagatggattactgctcagtaatggtgcaaaatggcaggagcgaaggaagatcctgactcctgctttccacttcaacatcctgcgtcagttctgtgacatcatacaagagaacacgcaacgttttctggaaaaattggaacaaaccgctgggcaagatgtggatgttgtgcctatactgtctgaatatacacttaactccatctgcgaaactgcaatgggtacgcaattatctgaagatctgacaggcacagtccagtcatacaagcaagctatctatgatctcggatacgtattttgtcaaaggttcatcaggatctacctttatccagaaacagtattcaatttgacttcattaggacgtatgcaaaaacgaagcgtaaaaactgtaaaaaactttactgaagatgtgataaaacaaaggagagattacgtggaacaatatggtttccatacaataggagataataatgacagtgaagaagtttttgtttacaagaaaaagaagaagactgctatgttggatctgctcttgtctgctgagaaggaagggctgattgacaaaactggcatccaagaggaggtcgatacatttatgtttgaaggacatgacacaaccgcatctggactgaccttcatgttcatgctcctcgctcaccacaaagatatccaagataaaattgtagaagaactgaatgaaatattaggcgactcggaccgatggctcaccatggacgacttagccaagatgaagtacatggagcgttgcatcaaggagtcgctgcgaatctacccgccagtgcactttattagccgaaagttaaatgaaaccacagtactaagtggctaccaagtaccagctgatactctgtgccacattcccatttatgacatgcatcaccgtgaagatttgttcgaagacccggagcgttttgacccggacaggttcctgcctgagaacagcgtggggagacacccttatgcctacataccgttcagtgctggtcctagaaattgtataggtcaaaagtttgccatgctggagatgaaaatcgccgtcgcggaagtattacgcaagtttgaattgaagccagtgacgaaaccatcagaaattgaatttatagccgatcttgtgctaagaaacaatgggccagtgaaagtaaattttgttaaacgaaagtaattatgtaccaaaaacgttagtattttgtaagtttcagtacttggaggtacttaatattaagctacaaagaagcatccaaaagaggaataaaaattatttaatgtaaaaaaaaaaaaaaaaaa

SEQ ID NO: 28296 - protein, 502 aa, Heliothis zea
MWLYLCAIIIFLCVLDLCLNYNERARMIKKLPGPPDDFIVGNGLRIIKSSVDVMKVRREYAKKWNGIYRIWAYPFGAVLVFNPEDVELIMSSMKYGEKSIIYTILKPWLQDGLLLSNGAKWQERRKILTPAFHFNILRQFCDIIQENTQRFLEKLEQTAGQDVDVVPILSEYTLNSICETAMGTQLSEDLTGTVQSYKQAIYDLGYVFCQRFIRIYLYPETVFNLTSLGRMQKRSVKTVKNFTEDVIKQRRDYVEQYGFHTIGDNNDSEEVFVYKKKKKTAMLDLLLSAEKEGLIDKTGIQEEVDTFMFEGHDTTASGLTFMFMLLAHHKDIQDKIVEELNEILGDSDRWLTMDDLAKMKYMERCIKESLRIYPPVHFISRKLNETTVLSGYQVPADTLCHIPIYDMHHREDLFEDPERFDPDRFLPENSVGRHPYAYIPFSAGPRNCIGQKFAMLEMKIAVAEVLRKFELKPVTKPSEIEFIADLVLRNNGPVKVNFVKRK

SEQ ID NO: 28297 - DNA, 2050 bp, Symbiotaphrina kochii
  CDS (172)..(1776)
ggacgcagtgctccttctccattctccttatcctctctcctccttccctttggcgttgtgagcctgacctcaattccattccccatcgcctctccctgctccagctcctgggattgtgcagtcgttctctcttcctccaacacacccactggggagcactcttcaggcacaatggcggccgcggtggacgccagtttcacctccccagctgcaaacgcgcagtatcctctgacctccgacgatggcagcattggtctcatcgcctcacgcctcatccagggactctcgttctggaatgtcgtcggcacaatctttctgatgatggttatctacgatcaactcagctacatccgcaacaagggatcgattgccggaccactcatgaagatcccgttcatgggtccatttctacagtccatgaatccaaaattcgaggggtacaaggccaaatgggacagtggagctcttagctgtgtctcagtcttccacaagtttgtcgtcattgcctcaactcgggatatggctcgcaaaatcttcaactcgccaacctttgtccggccctgcgtggtcgatgtcgcaaccaaacttctccgtccgaccaattgggtatttcttgacgggaaggcccacgtggactaccgtaaaggcctcaacggtctcttcactcggaaagccctagagctttatttgccgggtcaggaagaggtctacgacaaatatcttgccaagttcgtagccatcactaagacgaacaacggaaaaccaattcccttcatgcctgaattccgagagctgaattgtgctatatcttgccgaacattcgtgggacattatatatccgacgaagctgtcaagaaaatcgcggacgattactataagattactgaggctctcgaactcgttaacttccccatcatcattcctttcaccaggacatggtacggtaaaaaggcagccgacatggtcctggaggagttcgcaaaatgcgcggccaagggcaaagtccgcatgaatgctggaggtagcatcacatgtatcatggacggctggatcaagtctatgatcgagtcaaaaatctatcaagaaagaatcgccaagggagaatctgtcgacccctccgaaaagcctgccatgatcatcagagaattcacggactatgagatcagtcaaactatcttcaccttcctgtttgcctctcaggacgcatctagcagtgcaactacatggctcttccaactcttggcggatcgtccagatgtgcttgctcgggttcgcgaagaaaatcttgccgtccgagatggcgacagggacaaacgcgtaacgatggacatcctagacaacatgacgtacacacgtgccgtggttaaggagacattgagataccggcctcctgtgctcatggtcccttacgtcgcgaagaaggacttccctatcagtgattcctacacggtcccaaaaggctccatggtgattcctacaacttatccagctctacatgatcccgaagcttaccccaaccctgagactttcaatcctgaccgctggattaccggtgatgcagaaagccagaccaagaattggctagtcttcggtactggacctcactactgcttgggtcaaatttatgcagtcaacaacttgatggcattgattggtaaggcaagtctgcatcttgactgggaccacaccgtaacccccaagtcagaggatatcaaggtattcgcaacaatctttccccaggatgattgccttcttgccttccagaatcggccatagattggcttggtcggttttagttctttcattgacaaataccattttcagcacggatggaaaaacggtgtgaccctcgttaataatcaggagtccagggcggatcaatgcacctgacccattcattggtgcgttgggcaggttaaccagtgcagcttgctttaggcatggggttttagacggtgcttctgtaaatattcggtgcttagacacgaacaactaattaatagaacgatgcacaagcaaatgagtacaaccctcatcgaaattcgttagc

SEQ ID NO: 28298 - protein, 534 aa, Symbiotaphrina kochii
MAAAVDASFTSPAANAQYPLTSDDGSIGLIASRLIQGLSFWNVVGTIFLMMVIYDQLSYIRNKGSIAGPLMKIPFMGPFLQSMNPKFEGYKAKWDSGALSCVSVFHKFVVIASTRDMARKIFNSPTFVRPCVVDVATKLLRPTNWVFLDGKAHVDYRKGLNGLFTRKALELYLPGQEEVYDKYLAKFVAITKTNNGKPIPFMPEFRELNCAISCRTFVGHYISDEAVKKIADDYYKITEALELVNFPIIIPFTRTWYGKKAADMVLEEFAKCAAKGKVRMNAGGSITCIMDGWIKSMIESKIYQERIAKGESVDPSEKPAMIIREFTDYEISQTIFTFLFASQDASSSATTWLFQLLADRPDVLARVREENLAVRDGDRDKRVTMDILDNMTYTRAVVKETLRYRPPVLMVPYVAKKDFPISDSYTVPKGSMVIPTTYPALHDPEAYPNPETFNPDRWITGDAESQTKNWLVFGTGPHYCLGQIYAVNNLMALIGKASLHLDWDHTVTPKSEDIKVFATIFPQDDCLLAFQNRP

SEQ ID NO: 28299 - DNA, 2194 bp, Symbiotaphrina buchneri
  CDS (306)..(1913)
agtctgccgtcactgaactgcccacgagcttgctcctgccctcctactctcctgcccactgtctctactcctctttctctagagtatacacttcatccacagtgtgtcattatctggaagacatcgctggctagctcaaggactgcaggagtgagcctcctttccagagcgaaaggtcgcatcctcgaccatcgacgacgttcgcttctgtcttctcgtcccggcattgagccctccgtggcttcttcctaaccacttgttcgagtttgagctactggcttcaatccccgtcttcacatctccgcatggccgccgcaatgaatgccagtttcacgtcacccgctgcgaacgcgcagtattctgcaagtgctcatgacgggcttgccggactggccatggcgcaagtccttgaaggcttgacggtttggaatgccattgggacagtcttgattatgttggttttgtacgatcagcttagttacatacgtaacaaaggccggatagcaggcccttttttcaagatcccctttatgggcccgttccttcagtcggtgaatcccaagttcgaagaatacaaggccaagtgggacagcggggcgcttagttgcgtgtcggttttccacaaattcgtggtcatagcttccgatcgtgacatggctcgcaaggtgttgaactcacccgcatatgtgaaaccttgtgtagtggatgtggcacataagctgcttcggccaaccaattgggtgttcctggacggaaaggctcacgttgattatcgaaaaggtctcaatggtctcttcacccgcaaggcgctggagctctaccttcccgggcaggaggaggtctatgacaagtactttgccagattcctagaggtttcgcaaaaggagaacaaaggcaatcctacccctttcatggccgaattccgagagataaattgtgccatatcctgtcggacattcgttgggcactatctctccgatgctgctgtaaagaagattgccgatgattattacaagatcaccgctgcgctcgagctcgtcaacttccccgtcatcatcccctatacaaagacgtggtacggcaagaaagcggccgacatggttctggatgaatttgcaaaatgtgcggccaaaagcaaaatcaggatgaatgctggaggcgagatcacctgcatcatggatggttggatcaaatctatgatcgactgccgcaaataccaagaaagaattgcaaaaggtgaaactgttgatgcctcggagaaaccggccatgatgctcagggaattcaccgacttcgaaatttcccagacgatattcacatttttattcgcttcacaggatgcttcaagcagtgcgaccacgtggctcttccagttgctcgccgatcgtcctgatgtgctggccaaggtccgggaggagaatcttgcagtgcgcgagggcgacaggaacaagagattgaccatggatatcttggacaagatgaactacacccgagccgtcgttaaagagacactgcgataccgtccgcccgtcctgatggttccgtatcttgtcaagaagaccttccccatcactgactcttatgcagtgccaaaaggttcaatgataatacctacaacataccccgctcttcatgatccggaggcgtatccgtcgccggacacgtttgacccggaacgctggatcacgggcgatgccgaaaaccagaccaagaactggctggtttttggaaccgggcctcattactgtcttggtcaaacctacgctcagctgaacttgatggctatgatcggcaaggcctctctacaccttgactggacgcatacagtcactcctgactcggagaagatcaaggtcttcgctacaatcttccctcaggacgactgcctgctgacattttcgccacgggcatgaactggtgggtactgaaagtgaagggaatcagcggcacacagcgacgcaaacgcacatcttcagtgcgctgtaccctggagagatgtgcatagaattctccgaccttgacacagtggtactggtgtccttgataggtctgctagcggcaacagcctccggtgttacaggaagtctctcaagggcgcccttggttgtatggttttctagatgggcgcttttgtacatatcgagttgataccttcgcgctcgacaaacgtaataatagatacagtaattcactc

SEQ ID NO: 28300 - protein, 535 aa, Symbiotaphrina buchneri
MAAAMNASFTSPAANAQYSASAHDGLAGLAMAQVLEGLTVWNAIGTVLIMLVLYDQLSYIRNKGRIAGPFFKIPFMGPFLQSVNPKFEEYKAKWDSGALSCVSVFHKFVVIASDRDMARKVLNSPAYVKPCVVDVAHKLLRPTNWVFLDGKAHVDYRKGLNGLFTRKALELYLPGQEEVYDKYFARFLEVSQKENKGNPTPFMAEFREINCAISCRTFVGHYLSDAAVKKIADDYYKITAALELVNFPVIIPYTKTWYGKKAADMVLDEFAKCAAKSKIRMNAGGEITCIMDGWIKSMIDCRKYQERIAKGETVDASEKPAMMLREFTDFEISQTIFTFLFASQDASSSATTWLFQLLADRPDVLAKVREENLAVREGDRNKRLTMDILDKMNYTRAVVKETLRYRPPVLMVPYLVKKTFPITDSYAVPKGSMIIPTTYPALHDPEAYPSPDTFDPERWITGDAENQTKNWLVFGTGPHYCLGQTYAQLNLMAMIGKASLHLDWTHTVTPDSEKIKVFATIFPQDDCLLTFSPRA

SEQ ID NO: 28301 - DNA, 2008 bp, Arabidopsis thaliana
  CDS (146)..(1549)
atcacaaacatttcttccattacattaaaactccaaaaaattcatttttgttttcttttagagttcacaagttcttcgttgttcagctactcccactgtcataacacgaagtgggtttttttctgatcaaagaacaaaaacaaaaatggatatctccgccttgtttctcactctcttcgccggaagtctcttcctttactttctccggtgtctaatctctcagcgccgctttggatcttccaaactcccactccctccgggaacaatgggttggccttacgtcggagaaactttccagctttactctcaagaccctaatgtctttttccaatcaaaacagaaaaggtatggatcggtgtttaagactcatgtattgggatgtccatgtgtgatgatctcgagtccagaggctgctaagttcgtgctggtgacgaaatctcatctctttaaaccaacttttccggcgagtaaagagaggatgttggggaaacaagccatcttcttccaccagggtgattatcacgctaaactcaggaagcttgttcttcgtgcttttatgcctgaatctatcagaaacatggttcctgatattgaatccatcgctcaagactctctccgaagttgggagggaacaatgatcaacacttaccaagaaatgaaaacatacaccttcaacgttgcgttgctatcgatcttcggaaaagacgaggttttatacagagaagatctaaaacgatgctactacattctcgagaaaggttacaattcgatgccagtgaatctccctggaacacttttccacaaatcaatgaaagctcggaaggaactctcacagatcctcgctagaatcttatcagagagaagacagaacggttcctcacacaacgatcttctcggatcattcatgggagacaaagaagagctaaccgacgaacagatcgccgacaacataatcggagtaatcttcgccgctagagacacgacggcgagtgtgatgtcgtggatcctcaagtacctagccgagaatcccaacgttctagaagccgttactgaagaacaaatggcaataaggaaagacaaagaagaaggagagtctctaacttggggagatacaaagaagatgccattaacttcaagagttattcaagaaacattaagagtcgcttcaatcttatctttcacattcagagaagctgtcgaagatgtcgaatacgaaggatatttgatacctaaaggatggaaagtgttacccctattcagaaacattcatcatagtgctgatattttttctaatccggggaaatttgatccatcaagattcgaggtggctccaaaacccaatacgttcatgccatttggcaatggaacccactcgtgtcctggaaatgaattagccaagcttgagatgtctattatgattcatcatctcaccaccaagtacagttggtcaattgttggagcgagcgacgggattcagtatgggccattcgcgcttccccaaaacggactgcccattgtgctggcccggaagccggagatcgaagtgtagaatgacagaattgcctttagcttttctatatttggaaagaggagactagagaagaagaataaataattctttctttctttatcaagaaaaaaagatagagatggaggaaaacaggttcaagattttggtagaaaaatattccccaaatgggatcaaggagaaaacaccaagtgtacaaaaacttcaattttatttttcttgactttctttagtttttttttttgagtttttaattttaatttaagatgggaaaagctagtaattgaatttaaaaaaacaggggaaaatgttagtacaagtctctcatgtattttttttttgtttttcctgaaaatatcttatggttatgttataactatttcctcctggattgagacttcccttgttttttgaataaattttttttgttatatttttatatatatatttaaaatatctgttttaaaaaaaaaaaaaaaa

SEQ ID NO: 28302 - protein, 467 aa, Arabidopsis thaliana
MDISALFLTLFAGSLFLYFLRCLISQRRFGSSKLPLPPGTMGWPYVGETFQLYSQDPNVFFQSKQKRYGSVFKTHVLGCPCVMISSPEAAKFVLVTKSHLFKPTFPASKERMLGKQAIFFHQGDYHAKLRKLVLRAFMPESIRNMVPDIESIAQDSLRSWEGTMINTYQEMKTYTFNVALLSIFGKDEVLYREDLKRCYYILEKGYNSMPVNLPGTLFHKSMKARKELSQILARILSERRQNGSSHNDLLGSFMGDKEELTDEQIADNIIGVIFAARDTTASVMSWILKYLAENPNVLEAVTEEQMAIRKDKEEGESLTWGDTKKMPLTSRVIQETLRVASILSFTFREAVEDVEYEGYLIPKGWKVLPLFRNIHHSADIFSNPGKFDPSRFEVAPKPNTFMPFGNGTHSCPGNELAKLEMSIMIHHLTTKYSWSIVGASDGIQYGPFALPQNGLPIVLARKPEIEV

SEQ ID NO: 28303 - DNA, 1767 bp, Musca domestica
  CDS (159)..(1661): n means a or g or c or t/u
ttgacgcccgttnggtaccgacctcggatccctagtaacggccgccagtgtgctggaattcggcttgttgacaccacggcatgatgtctacctgaaattggaggcgataagtcactccagtcggttgcattgcatcaaggctatttcacagttacattatggagacttcgggagttttgatatatctcatattggccattgcctcggccgtggtttatttgctgagaaggaatctgagctattggaagagattgggtataccccatgaggaacctacggccctgatgggcaacatgcacggtctgaggacccagcggtgtatgggtgatattttggccgattattataggaaatttaagggctgcggaccctttgcgggaattttcaatggtcagagacccggggtggtgctgctggacaaacaactaatcaaacaggtcctgatcaaggatttcacacaattcaccgatcgtggtctgtattacaatgagaaatcggatcctttgacaggacatctgttctttgtggatggtgataaatggcgtagcctgcgcaacaagctttcgcccacctttacctcgggcaaaatgaaatatatgtatccgacagtgttggaagtggccgagcgttttatggaagttttggcgcaaaaggtccgcgagaatcccattgtggatgtacgcgatatgctgggacgtttcaccgtggatgtgattgccagtgtggcttttggcattgaatgcaatagcctgaggaatgcggaggataaatttctgcagcttggcaggaaatccattgaagtacagcgacataatgccttgatcatgacattaattgatgggtttccccgcctatccagaatgctgggcatgcgcactttgccccaggatgtccatgagtttttcatgcagaccatccgggaaacggtggaatatcgtgagcggaataaaatccaaagaagtgatttcttgaatattctaattgagctgaagaatactgtggatgacaagttggggctgggcggaatggaactggaagagttggctgcccaggtatttgttttcttcttggctggctttgagacctcctcgtcgaccatggcctatgccttgtatgaattggcccaaaatcagcagatacaggagagattgcgggaggagatcaatgaggcatttgagggtgatacaaaaccaagctatgagaccataatgaatttgagttacctggatcaggtgatatcggaaactctacgcaaataccccattttacccttcttaaatcgccaggccttaaatgactatgtggtgcctggacaccccaaatttcgaatacccaagggaacacccatcttcatacccgtcatgggcatacaacatgacccagaattctatccccaacccgatgaatttgatccagaacgtttttcaccagatatggtgaagcaacgtgattccatcgaatggatgccctttggagatgggccccgaaactgtattggcgctcgatttgccaaaatgcaaacccgccttggcttggcatgtgttttgaaatattttcgggttgtagtttgcccaaagaccccattgcacttgacatttcaggcaaagcctttggtgttgacaccacggcatgatgtctacctgaaattggaggcgatttaggggtgggagattatctctctaaagtttaatataaattaggactgatttttttttttgttttatagttttgtagttttaaaataaataaatgtatttaataaaattt

SEQ ID NO: 28304 - protein, 500 aa, Musca domestica
METSGVLIYLILAIASAVVYLLRRNLSYWKRLGIPHEEPTALMGNMHGLRTQRCMGDILADYYRKFKGCGPFAGIFNGQRPGVVLLDKQLIKQVLIKDFTQFTDRGLYYNEKSDPLTGHLFFVDGDKWRSLRNKLSPTFTSGKMKYMYPTVLEVAERFMEVLAQKVRENPIVDVRDMLGRFTVDVIASVAFGIECNSLRNAEDKFLQLGRKSIEVQRHNALIMTLIDGFPRLSRMLGMRTLPQDVHEFFMQTIRETVEYRERNKIQRSDFLNILIELKNTVDDKLGLGGMELEELAAQVFVFFLAGFETSSSTMAYALYELAQNQQIQERLREEINEAFEGDTKPSYETIMNLSYLDQVISETLRKYPILPFLNRQALNDYVVPGHPKFRIPKGTPIFIPVMGIQHDPEFYPQPDEFDPERFSPDMVKQRDSIEWMPFGDGPRNCIGARFAKMQTRLGLACVLKYFRVVVCPKTPLHLTFQAKPLVLTPRHDVYLKLEAI

SEQ ID NO: 28305 - DNA, 1575 bp, Aspergillus fumigatus
  CDS (1)..(1575)
atgggtctcatcgcgttcattctcgacggcatctgcaagcattgctcaacgcagtcaacatgggtgcttgttggaataggactactatccatcctcgctgtatctgtcattatcaatgtgctgcagcagctactcttcaaaaatccccacgagcctcctgtggtcttccactggttccccttcattggtagcaccatcagttatggcatcgatccgtacaagttctttttcgactgccgcgcaaagtatggcgatatcttcacattcattctacttggcaaaaagacaacggtgtatcttggtacgaagggcaatgacttcatcctaaacggcaagctgcgagatgtttgcgctgaggaggtgtattctccactcactacgcctgtttttggtcgacatgttgtgtatgactgccctaatgctaagcttatggagcagaagaagttcgtcaaatacggtctcacctctgatgcgctccgatcttatgttcccttaattacggatgaagtagagagctttgtcaaaaattctccggcgttccagggacacaagggcgtcttcgatgtatgcaaaacaatcgctgaaatcaccatttacactgcttcgcgctcgcttcaaggaaaagaagttcgaagcaaatttgattccacattcgcagagttgtaccataaccttgacatgggcttcgctcctatcaacttcatgttaccctgggcccccctaccccacaaccgcaaaagggatgctgcgcagcgcaaattgaccgaaacttatatggaaattattaaggcacgtcgtcaggctggcagtaagaaggattccgaagacatggtctggaacctcatgtcctgcgtttacaagaacggcacgccggttcccgatgaggaaatcgctcatatgatgattgccttgttgatggcgggtcaacattcttcctcttctactgcttcctggattgttctgcgccttgcgacacggcctgatataatggaagagctatatcaggaacaaattcgtgttctcggatctgacttgcctccactcacgtatgacaatctgcagaagttggatttgcacgcgaaggtcatcaaggagactctacgcttgcatgcaccgattcactcgatcattcgagcagtgaagaatcccatggctgtggatggtacttcatatgtgatccctacatctcataatgttctctcttctccaggcgtcactgccaggtctgaggagcacttcccaaatccactcgaatggaaccctcaccgttgggatgagaacattgcagctagcgctgaggacgacgagaaagttgattatggctacgggttagttagcaagggcaccaatagcccgtacctcccgtttggcgctggacggcataggtgcattggcgagcaatttgcatatcttcagcttggcacaatcactgctgtacttgtgcggttattcagattccgtaatttgccaggtgtcgatggcatccccgacacagactactcttctctgttctccaaaccgcttggccgatcttttgtggagtttgaaaagcgcgagtccgctaccaaagcctga

SEQ ID NO: 28306 - protein, 524 aa, Aspergillus fumigatus
MGLIAFILDGICKHCSTQSTWVLVGIGLLSILAVSVIINVLQQLLFKNPHEPPVVFHWFPFIGSTISYGIDPYKFFFDCRAKYGDIFTFILLGKKTTVYLGTKGNDFILNGKLRDVCAEEVYSPLTTPVFGRHVVYDCPNAKLMEQKKFVKYGLTSDALRSYVPLITDEVESFVKNSPAFQGHKGVFDVCKTIAEITIYTASRSLQGKEVRSKFDSTFAELYHNLDMGFAPINFMLPWAPLPHNRKRDAAQRKLTETYMEIIKARRQAGSKKDSEDMVWNLMSCVYKNGTPVPDEEIAHMMIALLMAGQHSSSSTASWIVLRLATRPDIMEELYQEQIRVLGSDLPPLTYDNLQKLDLHAKVIKETLRLHAPIHSIIRAVKNPMAVDGTSYVIPTSHNVLSSPGVTARSEEHFPNPLEWNPHRWDENIAASAEDDEKVDYGYGLVSKGTNSPYLPFGAGRHRCIGEQFAYLQLGTITAVLVRLFRFRNLPGVDGIPDTDYSSLFSKPLGRSFVEFEKRESATKA

SEQ ID NO: 28307 - DNA, 1974 bp, Mus musculus
  CDS (86)..(1600)
aggcagaaaggaagccctacagagagtcacacatacatctggagggggaacactgaggagtaaaattgcagacagacaagcagggatgaacctattttcagctctctcactggatacattggtcctgctggcaatcatcctggtgctcctctaccgatatgggacccgtacacatggactttttaagaaacaggggattcctgggcccaaacctctgccatttttaggcactgtgctgaattattacacgggtatatggaaatttgacatggagtgctatgaaaagtatggaaaaacatgggggttgtttgatggtcaaacacctctccttgtcatcacggacccagagacgattaagaatgtgctagtgaaggattgtttatctgtcttcacaaaccggcgggaatttggcccagtggggataatgagtaaagctatctcaatatctaaggatgaggaatggaagagatatagagctttgctgtcccccacattcaccagtggaagactcaaggagatgttccctgtcattgaacagtatggagacattttggtaaagtacttgaggcaagaggcagagaaaggcatgcctgttgctatgaaagatgtgttaggtgcttacagcatggatgtgatcaccagcacatcatttggagtgaacgtggattccctcaacaacccagaggatccttttgtggaggaagccaaaaagtttttaagagttgacttttttgatcctttgctcttctcagtagtactttttccattactgacaccagtatatgagatgttaaatatctgcatgttcccaaatgattcaatagaatttttcaaaaaatttgtggacagaatgcaggaaagccgcctggattctaatcagaagcaccgagtggattttcttcagctgatgatgaattctcataataattccaaagacaaagactctcataaagccttttctaacatggagatcacagtccagtcaattatctttatttctgctgggtatgaaaccaccagtagcacactttccttcaccttgtattgtttggccactcaccctgatatccagaagaaactgcaggcagagatcgataaggctctgcccaataaggcaactcccacctgtgatactgtgatggagatggaatacctggatatggtgcttaatgaaaccctcagattatatcccattgttactagacttgagagagtctgtaagaaagatgttgaactcaatggtgtgtatatccccaaagggtcaatggtgatgattccatcttatgctcttcaccatgacccacagcactggccagaccctgaagaattccaacctgaaaggttcagcaaggagaacaagggcagcattgatccttacgtatatctgccctttggaattggacccaggaactgcattggcatgaggtttgctctcatgaatatgaaacttgctgtcactaaagttctgcagaacttttccttccagccttgtcaggaaacacagatacctctgaaattaagcagacaaggaattcttcaaccagaaaaacccattgttctaaaagttgtgccacgggatgcagttataactggagcatgacattccctcaaggagttcttctgagttcttcaggaaggcagtgtctaagaacatcagacactttagtttcatcatgagtaaaatccagatgaataatggacttaatagattgattttgattcatggttaaagattcagtacatccactgagctttctcagtgtctgtgcaagttaacatataatacgaaagagatgaataaatcagtgacagcaaaggaaatttgccttcaccgtttctcatgggatcatctctatccacatctcattgtctctgctaattccttttgagatctttagatagtaaccacgtgtttgtaatttgatcaagaatttttgatgaaaatgagagctattgtagcaaaaaaaaaaaaaa

SEQ ID NO: 28308 - protein, 504 aa, Mus musculus
MNLFSALSLDTLVLLAIILVLLYRYGTRTHGLFKKQGIPGPKPLPFLGTVLNYYTGIWKFDMECYEKYGKTWGLFDGQTPLLVITDPETIKNVLVKDCLSVFTNRREFGPVGIMSKAISISKDEEWKRYRALLSPTFTSGRLKEMFPVIEQYGDILVKYLRQEAEKGMPVAMKDVLGAYSMDVITSTSFGVNVDSLNNPEDPFVEEAKKFLRVDFFDPLLFSVVLFPLLTPVYEMLNICMFPNDSIEFFKKFVDRMQESRLDSNQKHRVDFLQLMMNSHNNSKDKDSHKAFSNMEITVQSIIFISAGYETTSSTLSFTLYCLATHPDIQKKLQAEIDKALPNKATPTCDTVMEMEYLDMVLNETLRLYPIVTRLERVCKKDVELNGVYIPKGSMVMIPSYALHHDPQHWPDPEEFQPERFSKENKGSIDPYVYLPFGIGPRNCIGMRFALMNMKLAVTKVLQNFSFQPCQETQIPLKLSRQGILQPEKPIVLKVVPRDAVITGA

SEQ ID NO: 28309 - DNA, 1814 bp, Arabidopsis thaliana
  CDS (73)..(1464)
caaaaaccaatccattagagagagaactcacaaaacatacttcgaattcccattgtttaaaagacgaagataatggatttctccggtttgtttctcactctctccgcggcggctctgtttctctgtttactccgatttatcgccggagtccgccgtagctcctccacgaaactccctcttcctccgggaacaatgggttatccttacgtcggcgaaacattccaactttactcacaagaccctaatgtgttctttgcagcaaaacagagaagatacggatcggtgttcaagactcatgtattgggatgtccatgtgtgatgatctcgagccctgaagcagcgaaattcgtattggttacaaagtctcatttgtttaaaccgacttttccggccagtaaagagaggatgcttggaaaacaagccatcttcttccatcaaggagattatcattccaaacttagaaagcttgttttaagagctttcatgcctgatgcaatcagaaacatggtccctcacattgaatcaattgctcaagaatcactcaattcttgggatggaactcaactcaacacttaccaggaaatgaaaacatacactttcaatgttgcgttaatctcaatactcggcaaagacgaagtttattaccgagaagatctaaaacgatgctactacattctagagaaaggttacaattcgatgccgattaatcttccaggaacattattccacaaagccatgaaagctcgcaaggagctagctcaaatcctcgctaacatcttatccaaaagaagacaaaacccatcatcacacacagatctcctcggatcattcatggaagacaaagcaggattaaccgacgaacaaatcgccgataacatcatcggagtaatcttcgccgcaagagacacgacggcgagtgttctgacgtggatcctcaagtacttagctgataatccaactgttctagaagctgtcactgaagagcaaatggcaataaggaaagataaaaaagaaggagagagtctcacttgggaagatacaaagaagatgccattaacttatagagtaatccaagagacattaagagctgctacaatcttatctttcacatttagagaagctgtcgaagatgtcgaatacgaaggatatttgataccaaagggatggaaagtactgccactattcagaaatattcatcacaatgctgatatattttcggatccggggaaattcgatccgtcgagattcgaagttgcgccgaaaccgaatacattcatgccttttggtagtgggattcattcttgtccaggcaatgagttagctaaacttgaaatctctgttctaatccatcatctcaccactaagtacagatggtcaatcgtagggcctagcgatggaattcagtatgggccgttcgctcttcctcagaatggattgcctattgccttggaacgaaaaccatagatgaattacgagaataccatttacctttcttaaattagaaagtgaggaattttttttcttatttaagaggaaaatctaattcttttttataatagaaatgaaaagaaagtagaagaaaaaaatcccaagtgggaccccccaagtgtatataagttttagtttataaaatgtagagaattaaattttcggagaaaaaagagaattagttatataaatgttccatgtgtatgtaacttggttcatgcctctatatctttatttttgtaattttctcaaattgtaaattcctttattacgaatgtaatgactgatggaatgctcatagagaatttcagaaaaaaaaaaaaaaa

SEQ ID NO: 28310 - protein, 463 aa, Arabidopsis thaliana
MDFSGLFLTLSAAALFLCLLRFIAGVRRSSSTKLPLPPGTMGYPYVGETFQLYSQDPNVFFAAKQRRYGSVFKTHVLGCPCVMISSPEAAKFVLVTKSHLFKPTFPASKERMLGKQAIFFHQGDYHSKLRKLVLRAFMPDAIRNMVPHIESIAQESLNSWDGTQLNTYQEMKTYTFNVALISILGKDEVYYREDLKRCYYILEKGYNSMPINLPGTLFHKAMKARKELAQILANILSKRRQNPSSHTDLLGSFMEDKAGLTDEQIADNIIGVIFAARDTTASVLTWILKYLADNPTVLEAVTEEQMAIRKDKKEGESLTWEDTKKMPLTYRVIQETLRAATILSFTFREAVEDVEYEGYLIPKGWKVLPLFRNIHHNADIFSDPGKFDPSRFEVAPKPNTFMPFGSGIHSCPGNELAKLEISVLIHHLTTKYRWSIVGPSDGIQYGPFALPQNGLPIALERKP

SEQ ID NO: 28311 - DNA, 1770 bp, Arabidopsis thaliana
  CDS (112)..(1509)
ctttctctctttctctggtctgtttcaaaacatagtacataataatagagacaacaagagaaagaaaaaacagagtgatctgttttaaaacagagcagaaaacagagtgagatgggagcaatgatggtgatgatgggtcttctcttgatcatcgtgtctctctgttccgctctccttcgatggaatcagatgcgatataccaagaatggtcttcctcctggaaccatgggctggccaatctttggcgaaaccaccgagtttctcaaacaaggccccaacttcatgagaaaccaaagactccgatacgggagtttcttcaaatctcatcttctaggttgtccaacgttaatctcaatggactcagaagtaaacagatacattttaaagaacgaatcaaaaggtttggttcctggttacccacaatcgatgcttgatatacttgggacttgtaacatggctgcggttcacggttcgagccaccggcttatgagaggctcgcttctgtctctcataagctcgaccatgatgagagatcatatcttgcctaaagttgatcacttcatgagaagctatcttgatcagtggaatgagcttgaggttattgatatccaagataagaccaaacatatggcatttttatcttcactgacacaaatcgctgggaacttaagaaaaccatttgttgaagaattcaaaactgcattcttcaagcttgttgttgggactttatccgttccgattgatcttccgggcacaaattatcgttgcggaatccaagcaagaaataacattgataggttgctaagagagctgatgcaagaacgtagagattctggagaaacattcacagacatgttaggttacttgatgaagaaggaaggtaaccgatacccgttaaccgatgaagagataagagaccaagttgtgacgattttgtattcgggttacgaaactgtctctacgacctcaatgatggctcttaagtaccttcatgatcacccaaaagctcttcaagaactaagagctgagcatttggcattcagggaaagaaaacgacaggacgaaccactcggtcttgaggacgtgaagtcaatgaagttcactcgagctgtgatttatgagacatcaagattggcaacgatcgttaatggggtcctaaggaaaactactcgtgacttggaaatcaacggttatttaatcccaaaaggatggagaatttatgtatacacgagggaaattaattacgatgcaaatctttatgaagacccattgatctttaatccatggagatggatgaagaagagcttggagtcacaaaactcatgctttgtgtttggaggtgggacaaggctttgtcctggtaaggaactagggattgtcgagatctcgagctttctccattactttgttacgagatacagatgggaggaaataggaggggatgaattaatggtgtttccgagagtttttgcaccaaaaggcttccatcttaggatttcaccctactaatttctaactttttaaataaaataatatagattttatgcacgcagaggatacagaagacgtatatgaagaaacaagagaagataattataaatttttttttttttttgacacatatttttgttctcatttaagagtcttctggtcatatgtacataaccataagcagcataatcttattatatatctatttctgtataactctatttgaacttgaagtatatctctggctatttcttgatgatgttctactatattaaaccc

SEQ ID NO: 28312 - protein, 465 aa, Arabidopsis thaliana
MGAMMVMMGLLLIIVSLCSALLRWNQMRYTKNGLPPGTMGWPIFGETTEFLKQGPNFMRNQRLRYGSFFKSHLLGCPTLISMDSEVNRYILKNESKGLVPGYPQSMLDILGTCNMAAVHGSSHRLMRGSLLSLISSTMMRDHILPKVDHFMRSYLDQWNELEVIDIQDKTKHMAFLSSLTQIAGNLRKPFVEEFKTAFFKLVVGTLSVPIDLPGTNYRCGIQARNNIDRLLRELMQERRDSGETFTDMLGYLMKKEGNRYPLTDEEIRDQVVTILYSGYETVSTTSMMALKYLHDHPKALQELRAEHLAFRERKRQDEPLGLEDVKSMKFTRAVIYETSRLATIVNGVLRKTTRDLEINGYLIPKGWRIYVYTREINYDANLYEDPLIFNPWRWMKKSLESQNSCFVFGGGTRLCPGKELGIVEISSFLHYFVTRYRWEEIGGDELMVFPRVFAPKGFHLRISPY

SEQ ID NO: 28313 - DNA, 1718 bp, Cucurbita maxima
  CDS (19)..(1509)
ggttgggttgaaaatttgatggagtcgacttgggctgtggccgcggtggtgacggcggtagtggcggtggcgacggtgttttcggtgttgaaatgggcggcgaagagtttgaatgagtggatatatgaggcgaaattgggtgaccggcggttggctttgccgccgggggatttgggatggcctttaattgggaatatgttgggtttccttagagccttcaagtctaagaaccctgaaactttcattgatggctatgtttccaggtatgggaaaaccggagtgtacaaggttcatttgtttggaaaccctagcgtggtcgtgacgacgccggagacatgccggaaagttttgacggacgacgaagcgttccagcctggctggccacgcgcggcggtagagctcattggagagaagtctttcattcaaatgccgcaagaagaacacaagcgtctccgccgcttaacctctgctccggtgaacgggttcgaggcgctgagcaattacattccttacatcgaaaagaatgtattggaatcgttggagaaatggtctaaaatggggcccatcgaattcttaactcaacttcgtaagcttactttcaccgttatcatgtacattttcctaagctctgagagcgaaccggtgatggagatgttggagaaggagtatactcggcttaactatggagttcgagacatgagaattaacctacctggatttgcttaccacaaagcactcaaggctcggaagaatcttgtggctgcgctgaaaggaattgtgactgagcgaagacggcaaaaattggacaaatgggcgccgaagaggaaggacatgatggaccaactgatcgatattgtagatgaaaatggccggaaattggacgacgaggagatcatcgatattctgattatgtacttgaatgcaggccatgaatcttcagggcacaccatgatgtgggcgactattttgttgaatcaacaccctgaagttctcaagaaagccagggaagaacaggaagcgattgtgaggaacaggcctgcaggtcaaacgggattaacattgaaagaatgccgggacatggaatatctctcaaaagttgttgatgagactcttcgctatgtatcattctcccttgttgttttcagagaggcacaaatggatgtcaacctcaatggttatctaattcccaagggttggaaagtgctggcttggtttagaagcattcactacgacagtgaagtttacccagacccaaagaaatttgaaccctcaagatgggatggatttgttccaaaagcaggagagtttcttccatttggagcaggaagcaggctatgcccaggaaacgatctagccaagttggagatctgcattttcgttcattattttctcctcaactacaatcttgaatggctgacccctgactgtgaaatcctgtatctgccccattcgaggcccaaggacaattgcatggctaaaatcactaagaagtccagcgtggctgcgtgatgggtgttctctactgttcatcaccacacaggaagaagtttagtttttatgtactatataatggtgttcttactatttaagcccacacagcaagaacaacatgtatgatatgacatgtcttgccttctccttgtgtcgtctgtagtcagttctgtactggaattctggttcaaataaattagaaggttctcttccttctccttctcgta

SEQ ID NO: 28314 - protein, 496 aa, Cucurbita maxima
MESTWAVAAVVTAVVAVATVFSVLKWAAKSLNEWIYEAKLGDRRLALPPGDLGWPLIGNMLGFLRAFKSKNPETFIDGYVSRYGKTGVYKVHLFGNPSVVVTTPETCRKVLTDDEAFQPGWPRAAVELIGEKSFIQMPQEEHKRLRRLTSAPVNGFEALSNYIPYIEKNVLESLEKWSKMGPIEFLTQLRKLTFTVIMYIFLSSESEPVMEMLEKEYTRLNYGVRDMRINLPGFAYHKALKARKNLVAALKGIVTERRRQKLDKWAPKRKDMMDQLIDIVDENGRKLDDEEIIDILIMYLNAGHESSGHTMMWATILLNQHPEVLKKAREEQEAIVRNRPAGQTGLTLKECRDMEYLSKVVDETLRYVSFSLVVFREAQMDVNLNGYLIPKGWKVLAWFRSIHYDSEVYPDPKKFEPSRWDGFVPKAGEFLPFGAGSRLCPGNDLAKLEICIFVHYFLLNYNLEWLTPDCEILYLPHSRPKDNCMAKITKKSSVAA

SEQ ID NO: 28315 - DNA, 2400 bp, Sus scrofa
  CDS (38)..(1552)
agtcagggacagtcagccatccagaagcccgtgcaccatgacggtccctgccctggccagtgtctctgggctcctgcaggtggcctccctgctcgggctgctgctgcttctcctcaaggcagcacagctctacctgcgcagacagtggctgctcaaagccctccagcagttcccgtcccctccttcccactggctctatggacacagcagggagtttcaagaggaaagcgagctgcaacccctcctgaaaagggtagagaaatacccaagtgcctgtgctcgctggctgtggggaacaagagccatggtactggtctatgaccctgactacatgaaggtggtcctggcgagatcagagcccaaggctcctgttctctacagattgctgatcccctggattggctgtggtttgctcctgttgaatgggcagatgtggttccagcgtcggcggatgctgaccccagctttccactatgacatcctgaagccctacgtaggtctcatggccaagtctgtccaagtgatgctggacaagtgggagcagctcgtcgcccaggacccacgtctggagatcgtgggacccgtctccttgatgaccctggacaccatcatgaagtgcgccttcagccaccagggcagcgcccagacagacggggattcccagtcctacatccaggccatttgggatctcaaaaatctcattttttcccgcttgaggagtgcctttctccagaatgacatcatctacaggctgagccctgaaggccgccagtgccagcgagcctgccagaaggtccatcaacacacagaccgagtgatccagctgaggaagactcaccttcagaaggagggagagatggaaaatgtgaagaagaagaggcacttggatttcctggacattctcctctttgccaggatggagaatgggaacagcttgtctgacaccgacgtccgtgccgaagtggacacgttcatggctgcaggtcacgactccacagccagtggcatctcctgggtcctctatgctctggcctccaaccctgagcatcagcagagatgtcgggaggagatccaaggcctcctgggggacggcacctccatcacctgggaccacctggaccagatgccctacaccaccatgtgcatcaaggaggccctgagactctatccgccagtaccaagcgtcggcagagagctcagcaagcccatcaccttccctgatggacgctccttacctgcaggaatcatcctctcgctctccatttacggccttcaccacaacccgcaggtgtggccgaacccagaggagtttgacccatcccggtttgcaccgggttctgctcgacacagccatgccttcatgcccttctcaggaggatccaggaactgcattgggaagcagtttgccatgaacgaaatgaaggtggttgtggccctgaccctgctccgctttgagctggcaccagatccctccaggattcccgttcctattcaaggaattgtgttgaagtccaaaaatgggatccacctgaacctcaggaagatcccataaccgctgtggggacaaggacaagctctgaaggcctcctgctggccaccctgtcttgctgtccctctcccctgtcccctgcctctttgcccccttctcttggaccacctgcaaggcgacttcatgccctgcctcctgcccatcggacattctgcccttctccctctcacctctctccaggctccctgtctgtgtatctgtccatctgtctctgaaccacccggatctctgagtgtccacatcaagagccaccacctgccgtcctccagtcggtctgccctctccctgtccttctgcctttctgcttttctgtctgtccatggattcatttccttttgctgctccaataagttccaacaagcttagtgactaaaacaacacaaaaccaccctctgatgggtctggaatcagacgtctgaaatgggtgtggctggaccacagcaacgatgtcggcaggactcctatgtagggatgggagagaaactctctctctctctctctctgccttgttgaggcttgagagctgcagtccttgcattccttggcgcctggaggctcctccacgttcaaatccagtgccatctctaaatggccctctaggtccatcttcacatcacctgcactttcgtaagggcattggtggactcacgggcccactcagagaaaacacagctactctgaggctccgagaatcccaggtggatgccttgggcagccattgctcagcctgccaaatcctgggtggctagcatcactctgggcccccatctgtcccgtgccttggggctctacatgtttgtccctcacgtggcctcccttctgtccgactccctgataaagttcgctgtgtt

SEQ ID NO: 28316 - protein, 504 aa, Sus scrofa
MTVPALASVSGLLQVASLLGLLLLLLKAAQLYLRRQWLLKALQQFPSPPSHWLYGHSREFQEESELQPLLKRVEKYPSACARWLWGTRAMVLVYDPDYMKVVLARSEPKAPVLYRLLIPWIGCGLLLLNGQMWFQRRRMLTPAFHYDILKPYVGLMAKSVQVMLDKWEQLVAQDPRLEIVGPVSLMTLDTIMKCAFSHQGSAQTDGDSQSYIQAIWDLKNLIFSRLRSAFLQNDIIYRLSPEGRQCQRACQKVHQHTDRVIQLRKTHLQKEGEMENVKKKRHLDFLDILLFARMENGNSLSDTDVRAEVDTFMAAGHDSTASGISWVLYALASNPEHQQRCREEIQGLLGDGTSITWDHLDQMPYTTMCIKEALRLYPPVPSVGRELSKPITFPDGRSLPAGIILSLSIYGLHHNPQVWPNPEEFDPSRFAPGSARHSHAFMPFSGGSRNCIGKQFAMNEMKVVVALTLLRFELAPDPSRIPVPIQGIVLKSKNGIHLNLRKIP

SEQ ID NO: 28317 - DNA, 1539 bp, Oryza sativa
  CDS (1)..(1539)
atggtggagtcatttcacggcctggtcgtggtagacctccgcacggcggcgccattgctggctacagctgtggcgttgtacatcctcatagagcagttgtcataccaccgcaagaaggggtccatgccagggccgccgctcgtcgtcgtgccattcctcggcagcgtcacgcacttgttccgcgacccggtcggattctgggacttgcaagcgacgcgtgctagcaagtccggcgctgggctcaccgcggactttctcttcggccggcttatggtcttcatccgtgactcggagctgtcccgccgcgtgttcgccaacgtccgcgccgacgccttccaccttgtcggacacccgttcggcaagaaactcttcggcgaccacaacctcatctacatggtcggaaaggagcacaaggacctgcgccgccggatcgcgcccaacttcacgccgcgcgcgctatccacctatgctgtcatccagcagcgtgtcatcctctcccacctccggcggtggatcgaccggagcgttgctaacggcggtaaggccgagcccatacgggtgccctgccgcgacatgaacctcgagacatcgcagacggtgttcgtcgggccgtacctcaccgtggagacgagggagaggttcgatagggattacaacctcttcaaccacggtttcataaccttgcccatcgacctgccagggtccgcgttccggcgcgcgaggcttgccgtaccgcggctgaagcatattctcgaggactgtgcacgtcagagcaagcagcgcatgcgcggcggcggcgagccggagtgccttgtggactacttgatgcaggagacggttcgtgagatcgacgaggccgcggcggcggggctgccgccgccaccgcacaccagtgacatggagaccgggaacctcttgtttgacttcctcttcgcggctcaggacgcgtccacctcctccctatgctgggccgtgtccgcgctggactcccacccggacgtgctcgcccgcgtccgagctgaggtggccgctctctggtcgccggagtcaggcgagcccatcactgccgagatgatgacggagatgaagtacacccaggcggtggcgcgcgaagttgtccggtactggcctccaggcccggtggtgccgcacatcgccggcgaggcgttccagctgacggagcagtacactatacccaagggcaccatagtgttcccgtcggtgtacgagtcgtcgttccaagggttccccgacgctggcacgttcgacccggagcgcttcttctcggaggcgcggagggaggacgtggtgtacaagcgcaacttcctcgcgttcggcgccggcccgcaccaatgcgtcgggcagcgctacgcgctcaaccacctcgtcattttcatggctctcttggcgtctctcatcgacttccggcgtgagaggacggagggctgcgacgtgccggtgtacatgccgaccatcgtgccgagagacggctgcgtcgtgcacctcaagcagcggtgcgccaagttaccatcgttctga

SEQ ID NO: 28318 - protein, 512 aa, Oryza sativa
MVESFHGLVVVDLRTAAPLLATAVALYILIEQLSYHRKKGSMPGPPLVVVPFLGSVTHLFRDPVGFWDLQATRASKSGAGLTADFLFGRLMVFIRDSELSRRVFANVRADAFHLVGHPFGKKLFGDHNLIYMVGKEHKDLRRRIAPNFTPRALSTYAVIQQRVILSHLRRWIDRSVANGGKAEPIRVPCRDMNLETSQTVFVGPYLTVETRERFDRDYNLFNHGFITLPIDLPGSAFRRARLAVPRLKHILEDCARQSKQRMRGGGEPECLVDYLMQETVREIDEAAAAGLPPPPHTSDMETGNLLFDFLFAAQDASTSSLCWAVSALDSHPDVLARVRAEVAALWSPESGEPITAEMMTEMKYTQAVAREVVRYWPPGPVVPHIAGEAFQLTEQYTIPKGTIVFPSVYESSFQGFPDAGTFDPERFFSEARREDVVYKRNFLAFGAGPHQCVGQRYALNHLVIFMALLASLIDFRRERTEGCDVPVYMPTIVPRDGCVVHLKQRCAKLPSF

SEQ ID NO: 28319 - DNA, 1515 bp, Oryza sativa
  CDS (1)..(1515)
atggtggactcgctgctatacgggctcctagacctgcgcatggcggcgccattgcttgcagctgccgtggcgttgtacgtccttgtcgagcagctgtcctaccaccgcaagaaagggtccctgccagggccgccgctcgtcgtgccgttcatcggcagcgccacgcacatgatccgcgacccgaccgggttctgggaaatgcaggctgctcgcgctagaaagtccggcgttgggttcaccgccgacttcctggccggcaagttcacgatcttcatccgcgactcggagttgtccaaccgcgtcttcgcgaacgtccgccccgacgccttcttcgtcatcggccacccgttcggcaagaagctcttcggcgaccacaacctcatctacctgttcggcgacgaccacaaggacctgcgccgccgtatggcgaccaacttcacgccgcgcgcgctctccacctacgccgccatccagcagcgcggcatcgtctcccacctccggcggtggctcgaccggagcgccgccaacggcggcaaggccgagccgatacgggtgccctgccgcgacatgaacctcgagacctcgcagacggtgttcgcggggccgtacctcaccgaggaggcgagggagaggttcaagagcgactacaatctcttcaatgtaggcctcttggccttccccgttgacctgccggggctcgcgttccggcgtgcgaggcaagccgtggcgaggctggtgcgcatgctccgcgattgcgcgagggagagcaaggcgcggatgcgcgccggcggtgagccagagtgcctcgtggactactggatgcaggagacggtgcgggagatcgacgaggccaaggcggcggggctgccgccgccggcgcacatctccgacgacgaggagatcgggggcttcctcttcgacttcctcttcgcggcgcaggacgcgtccacctcctccctctgctgggccgtgtccgcgctggactcccacccggacgtgctcgcccgcgtgcgcgccgaggtggcctccctctggtcccccgactccggcgagcccatcaccgccgataagatcgccgaaatgaagtacacaaaggctgttgctcgcgaggtggtccggcaccgcccaccggcgacgctgatgccacacatcgccttgcagaacttccagctgacggaatcgtacacgatccctaagggcaccctggtgctcccgtcgatgtacgagtcgtcgtttcaggggttccatgaccccgacgcgttcgacccggagcgcttcttctcggaggcgcggagggaggacgtggtgtacaagcgcaacttcctcgcgttcggcgccggcccgcaccagtgcgtcggtcagcggtacgcgctcaaccacctcgtcatcttcatggcgctcttcgtctccctcgtcgacttccggcgtgagaggacggagggctgcgacgtgccggtgtacatgccgaccatggtgccgagggacggctgcgtcgtctacctcaagcagcgctga

SEQ ID NO: 28320 - protein, 504 aa, Oryza sativa
MVDSLLYGLLDLRMAAPLLAAAVALYVLVEQLSYHRKKGSLPGPPLVVPFIGSATHMIRDPTGFWEMQAARARKSGVGFTADFLAGKFTIFIRDSELSNRVFANVRPDAFFVIGHPFGKKLFGDHNLIYLFGDDHKDLRRRMATNFTPRALSTYAAIQQRGIVSHLRRWLDRSAANGGKAEPIRVPCRDMNLETSQTVFAGPYLTEEARERFKSDYNLFNVGLLAFPVDLPGLAFRRARQAVARLVRMLRDCARESKARMRAGGEPECLVDYWMQETVREIDEAKAAGLPPPAHISDDEEIGGFLFDFLFAAQDASTSSLCWAVSALDSHPDVLARVRAEVASLWSPDSGEPITADKIAEMKYTKAVAREVVRHRPPATLMPHIALQNFQLTESYTIPKGTLVLPSMYESSFQGFHDPDAFDPERFFSEARREDVVYKRNFLAFGAGPHQCVGQRYALNHLVIFMALFVSLVDFRRERTEGCDVPVYMPTMVPRDGCVVYLKQR

SEQ ID NO: 28321 - DNA, 1527 bp, Oryza sativa
  CDS (1)..(1527)
atggcggcggtggtggacttcctggacctgcgggcggcggcgccgttcgtggtggccgcgctggcgttctacttcctggtcgagcagctgtcctaccaccgcaagaagggcccgctgcctggcccgccgctcgtcgtgccgttcgtcggcagcgtcgcgcatatgatccgcgacccgaccgggttctgggacgcgcaggcggcgcgcgccaggaagtccggcgcggggctcgccgccgacttcctgatcggccggttcgtcgttttcatccgcgactccgagctgtcccaccgggtcttcgccaacgttcgccccgacgcgttccacctcatcggccacccgttcggcaagaagctcttcggcgaccacaacctcatctacatgttcggcgaggaccacaaggacctccgccgccggatcgcgcccaacttcacgccgcgcgcgctctccacctacgccgccatccagcagcgcgtcatcctctcccacctccggcggtggctcgaccggagcgccgccaacggcggcaaggccgagccgattcgggtgccctgccgcgacatgaatctcgagacctcgcagacggtgttcgcggggccgtacctcaccaaggaggcgagggagaagttcgagagggactacaatttcttcaatgtcggcctcatggccctccccgttgacctgccggggttcgcattccggagcgcgaggctgggcgtggcgcggctggtgcgcacgctcggcgagtgcgcgcgggcgagcaaggcgcggatgcgcgccggcggcgaaccagagtgcctcgtcgacttctggatgcaggagacggtgcgggagatcgacgaggccaaggcagcggggaagccgcctccggcgcacaccgacgacgaggagctcgggggcttcctgttcgacttcctcttcgcggcgcaggacgcgtccacctcctccctctgctgggccgtgtccgcgctggactcccacccggacgtgctcgcaggcgtgcgcgccgaggtggcctccctctggtccccggagtccggcgagcccatcaccgccgagaagatcgcggagatgaagtacactcaggccgtagctcgcgaggtggtccggcaccggccaccggcgacgctggtgccgcacatcgccggcgaggagttccagctgacggagtggtacacgatccccaagggcaccatcgtgttcccgtcggtgtacgagtcgtcgttccaggggttccccgagccggacacgttcgacccggagcgcttcttctcggaggcacggagggaggacgtggtgtacaagcgcaacttcctcgcgttcggcgccgggccgcaccagtgcgtcgggcagcggtacgcgctcaaccacctcgtcctattcatggcgctcttcgtctccgtcgtggacttccggcgagaccggacggagggctgcgacgagccggtgtacatgccgaccatcgtgccgagggacagctgcaccgtgtacctcaagcagcgatgcgccaagttcccatctttctga

SEQ ID NO: 28322 - protein, 508 aa, Oryza sativa
MAAVVDFLDLRAAAPFVVAALAFYFLVEQLSYHRKKGPLPGPPLVVPFVGSVAHMIRDPTGFWDAQAARARKSGAGLAADFLIGRFVVFIRDSELSHRVFANVRPDAFHLIGHPFGKKLFGDHNLIYMFGEDHKDLRRRIAPNFTPRALSTYAAIQQRVILSHLRRWLDRSAANGGKAEPIRVPCRDMNLETSQTVFAGPYLTKEAREKFERDYNFFNVGLMALPVDLPGFAFRSARLGVARLVRTLGECARASKARMRAGGEPECLVDFWMQETVREIDEAKAAGKPPPAHTDDEELGGFLFDFLFAAQDASTSSLCWAVSALDSHPDVLAGVRAEVASLWSPESGEPITAEKIAEMKYTQAVAREVVRHRPPATLVPHIAGEEFQLTEWYTIPKGTIVFPSVYESSFQGFPEPDTFDPERFFSEARREDVVYKRNFLAFGAGPHQCVGQRYALNHLVLFMALFVSVVDFRRDRTEGCDEPVYMPTIVPRDSCTVYLKQRCAKFPSF

SEQ ID NO: 28323 - DNA, 1536 bp, Oryza sativa
  CDS (1)..(1536)
atgagaaccagcactgacccgtccggctcaatcgagtcgtttcacggcctcgtacacctccgcacggcggcgccattgctggctgcagctgtggcgttatacatgctcatagagcagctgtcataccaccgcaagaaggggtccatgccaggggcgccgctcgtcgtgccgttcctcggtagcgccgcgcatttgatccgcgacccggtcggattctgggacgtgcaagcggcgctcgctcgcaagtccggcgctgggctcgccgcggactttctcttcggccggttcacggtcttcatccgtgactcggagctgtcccaccgcgtgttcgccaacgtccgcgccgacgccttccacgtcgtcagccacccgttcggcaagaagctcttcggcgaacacaacctcgtctacctggtcggcgaggagcacaaggacctgcgccgccggatcgcgcccaacttcacgccgcgcgcgctctccacttatgccgtcatccagcagcgtgtcatcatctcccacctccggcggtggctcgaccggagtgcttccaacggcggcaaggccgagccgatacgggtgccctgccgcgacatgaacctggagacctcgcagacggtgttcgtggggccgtacctcaccgagaaggcgagggagaggttcgacagggattacaacctcttcaacgtcggtttcataaccttgcccgtggaccttccggggttcgcgttccgccgggcgaggctagccggggcacggctgatgcacactctcggggactgcgcacgtcagagcaggcaacgcatgcttggcggcggcgagccagagtgcctcctggactacttgatgcaggaaacggtgcgtgagatcgacgaggccacggcagcggggctgccgccaccaccgcacaccagcgacgtggaggtcggcgccctcctgttcggcttcctcttcgcggcgcaggacgcgtccacctcctctctctgctgggcggtgtccgcgctcgactcccatccgaacgtgctcgcccgcgtccgtgctgaggtggccgctctctggtcgccagagtccggcgaacccatcaccgccgagatgatgtcggcgatgaaatacacccaggcggtggcgcgcgaggttgtccggtaccatccaccggcgacgctggtgccgcacatcgccgtcgaggcgttccagctgacggcgcagtacactatacccaagggcaccatggtgttcccatcggtgtacgagtcgtcgttccaagggttccaagacgctgacgcgttcgacccggaccgcttcttctcggaggcgcggagggaggacgtggtgtacaagcgcaacttcctcgcgttcggcgccggcccgcaccagtgcgtcggtcagcggtacgcgctcaaccacctcgtcatcttcatggcgctcttcgtctccctcgtcgacttccggcgtgagaggacggagggctgcgacgtgccggtgtacatgccgaccatggtgccgagggacggctgcgtcgtctacctcaagcagcgctga

SEQ ID NO: 28324 - protein, 511 aa, Oryza sativa
MRTSTDPSGSIESFHGLVHLRTAAPLLAAAVALYMLIEQLSYHRKKGSMPGAPLVVPFLGSAAHLIRDPVGFWDVQAALARKSGAGLAADFLFGRFTVFIRDSELSHRVFANVRADAFHVVSHPFGKKLFGEHNLVYLVGEEHKDLRRRIAPNFTPRALSTYAVIQQRVIISHLRRWLDRSASNGGKAEPIRVPCRDMNLETSQTVFVGPYLTEKARERFDRDYNLFNVGFITLPVDLPGFAFRRARLAGARLMHTLGDCARQSRQRMLGGGEPECLLDYLMQETVREIDEATAAGLPPPPHTSDVEVGALLFGFLFAAQDASTSSLCWAVSALDSHPNVLARVRAEVAALWSPESGEPITAEMMSAMKYTQAVAREVVRYHPPATLVPHIAVEAFQLTAQYTIPKGTMVFPSVYESSFQGFQDADAFDPDRFFSEARREDVVYKRNFLAFGAGPHQCVGQRYALNHLVIFMALFVSLVDFRRERTEGCDVPVYMPTMVPRDGCVVYLKQR

SEQ ID NO: 28325 - DNA, 1398 bp, Arabidopsis thaliana
  CDS (1)..(1398)
atgggcataatgatgatgattttgggtcttcttgtgatcattgtttgtttatgtactgctcttctccgatggaaccagatgcgatattctaagaaaggtcttcctcctggaaccatgggctggccaatatttggtgaaacgactgagtttcttaaacaaggaccagatttcatgaaaaaccaaagactaagatatgggagtttcttcaagtctcacattcttggttgcccaacaatagtctcaatggacgcagagttaaacagatacattctaatgaatgaatcgaaaggacttgttgccggttacccgcaatctatgcttgatattctagggacatgcaacatagctgcggttcatggcccgagccaccggctaatgagaggctcgttgctttctttaataagcccaaccatgatgaaagaccatctcttgcctaagattgatgatttcatgagaaactatctttgtggttgggatgatcttgagacagttgatatccaagaaaagaccaaacatatggcatttttatcatcgttgttacaaatagctgagactttgaaaaaaccagaggttgaagaatatagaacagagtttttcaagcttgttgtgggaactctatcggtcccgatcgatatcccgggaacgaattaccgcagtggatttcaggcaagaaacaacatcgataggttattgacagaactgatgcaagaaagaaaagagtctggagaaactttcacagacatgttgggttacttgatgaagaaggaagataaccgatacttgttaaccgataaagagataagagatcaagtggtaacgatcttgtattccggttatgagactgtctctacaacctccatgatggctcttaagtatctccatgatcatccaaaagctcttgaagaactcagaagagaacatttggctataagggagagaaaacgacctgacgaaccgctcactctcgacgatattaaatcgatgaaattcactcgagctgtgatctttgagacatcaagattggcaacgattgttaatggtgtccttaggaaaactactcacgacttagaactcaacggttatttaatcccaaaaggttggagaatttacgtatacacaagagagattaactatgatacatctctttatgaagatccaatgatctttaacccatggagatggatggaaaagagcttagaatcaaagagctatttcttactctttggaggtggagttaggctttgccctggaaaggaactaggaatctcggaagtctcaagcttccttcactactttgttacaaaatatagatgggaagagaatggagaagacaaattaatggtctttccaagagtttctgcaccaaaaggataccatcttaagtgttcaccttactga

SEQ ID NO: 28326 - protein, 465 aa, Arabidopsis thaliana
MGIMMMILGLLVIIVCLCTALLRWNQMRYSKKGLPPGTMGWPIFGETTEFLKQGPDFMKNQRLRYGSFFKSHILGCPTIVSMDAELNRYILMNESKGLVAGYPQSMLDILGTCNIAAVHGPSHRLMRGSLLSLISPTMMKDHLLPKIDDFMRNYLCGWDDLETVDIQEKTKHMAFLSSLLQIAETLKKPEVEEYRTEFFKLVVGTLSVPIDIPGTNYRSGFQARNNIDRLLTELMQERKESGETFTDMLGYLMKKEDNRYLLTDKEIRDQVVTILYSGYETVSTTSMMALKYLHDHPKALEELRREHLAIRERKRPDEPLTLDDIKSMKFTRAVIFETSRLATIVNGVLRKTTHDLELNGYLIPKGWRIYVYTREINYDTSLYEDPMIFNPWRWMEKSLESKSYFLLFGGGVRLCPGKELGISEVSSFLHYFVTKYRWEENGEDKLMVFPRVSAPKGYHLKCSPY

SEQ ID NO: 28327 - DNA, 1437 bp, Arabidopsis thaliana
  CDS (1)..(1437)
atgtgggcattgctcatttgggtttctttgcttctcataagtatcacacattgggtttatagttggagaaatcctaaatgcagagggaaacttccacctggttccatgggtttccctttactcggcgagagtatccaattcttcaagccaaacaaaacttcagacatccctccttttatcaaagagagagttaagaagtatggcccaattttcaagaccaatctggtggggagaccagttattgtatcaacagatgctgatttgagttattttgtgtttaaccaagagggacgttgtttccagagttggtatccagacacttttacacacatctttgggaagaagaatgtgggttcattacatggtttcatgtacaagtaccttaaaaacatggttttgactctctttggccatgatggtctcaagaagatgcttcctcaagtagaaatgactgccaataagaggttggagctttggtcaaatcaagattcagtagaactcaaagatgcaaccgcaagcatgatatttgatctcaccgcgaagaagttgatcagccatgatccagacaagtcatcagagaatctaagggcaaactttgttgctttcatacagggattgatctctttcccttttgatatcccaggcacagcttatcacaaatgtctacagggtagggcaaaggcaatgaaaatgttgaggaatatgcttcaagagaggcgtgagaaccctcggaagaatccaagtgatttctttgattatgttattgaagagattcagaaagaagggacaattctgacagaagagattgcactggatttgatgtttgtcttgctatttgccagctttgaaacaacttctttggctctaactttagctatcaagtttctctcagatgaccctgaagtcctaaagcgtttaacggaagaacatgagacaattctgagaaaccgggaagatgcagactctggacttacatgggaagaatacaagtcaatgacttacacatttcagttcataaacgaaaccgcgagactagcaaatatagttcctgcaatcttcagaaaggcgttgagagatataaaattcaaagagtttgtcaatgatacagattatacgattccagccggctgggcggtgatggtctgtccaccagctgtacatttgaatcccgaaatgtataaagatcctttagtctttaatccatcaagatgggagggatcaaaagttacaaacgcatcaaagcacttcatggcgtttggtggaggtatgaggttctgcgttggaaccgacttcacaaaattgcagatggctgcgtttcttcacagcttggtaacaaaatacaggtgggaggagataaaaggagggaatataactcgaacgcctggattacagtttccaaatggttaccatgtcaaactccataagaagagagactag

SEQ ID NO: 28328 - protein, 478 aa, Arabidopsis thaliana
MWALLIWVSLLLISITHWVYSWRNPKCRGKLPPGSMGFPLLGESIQFFKPNKTSDIPPFIKERVKKYGPIFKTNLVGRPVIVSTDADLSYFVFNQEGRCFQSWYPDTFTHIFGKKNVGSLHGFMYKYLKNMVLTLFGHDGLKKMLPQVEMTANKRLELWSNQDSVELKDATASMIFDLTAKKLISHDPDKSSENLRANFVAFIQGLISFPFDIPGTAYHKCLQGRAKAMKMLRNMLQERRENPRKNPSDFFDYVIEEIQKEGTILTEEIALDLMFVLLFASFETTSLALTLAIKFLSDDPEVLKRLTEEHETILRNREDADSGLTWEEYKSMTYTFQFINETARLANIVPAIFRKALRDIKFKEFVNDTDYTIPAGWAVMVCPPAVHLNPEMYKDPLVFNPSRWEGSKVTNASKHFMAFGGGMRFCVGTDFTKLQMAAFLHSLVTKYRWEEIKGGNITRTPGLQFPNGYHVKLHKKRD

SEQ ID NO: 28329 - DNA, 1575 bp, Venturia inaequalis
  CDS (1)..(1575): n means a or g or c or t/u
atgggactcctctctcctttgctcgcctngttaccgggcagcgaccgcagttggttattttacactcttgcctccttcggcttcaccgttgcaatcgtcgccgccaaccttgtcaagcaactcttattctcaaacccaaacgaacctccagtagtcttccactggtttcccttcttcggcaacacggtcgtctacggcatcgatcctatcaagtttttcgccgagtgcaaggaaaagcatggcgatatctttaccttcattcttcttggcaggaaaacaacagtctacattggtacaaagggaaacgaattcattctcaatggcaaacagagccatgtcaacgcagaggaaatctatagccccctgacgacgcccgtcttcggctccgatgttgtctatgattgcccaaactcgaaattgatggagcaaaagaagttcgtcaagtacggtctcaccaccgaagctctcaaatcctatgtcaccctcatccaacaagaagtcgaagactataccaaacgctaccctcaattcaaaggcgaaaagggcagcttcgatgtttgcgcttccatggccgaaatcacaatcttcactgcttcccgctcactacaaggcaaggaggttcgcgacaagtttgacgccagctttgcagacctcttccacgatttggatatgggcttctctcctatcaacttcatgcttccctgggcccctcttccacacaatcgtcgccgagatgccgcgaacaaaaagatgacggagacatatttggaaattatccaatcgagaaaagcagagggcgtcaaaaaggattcagaggacatgatttggaatttgatgcagtgtgtatacaagaatggcactcccatcccggacaaagaaatcgcccacatgatgatcgcgctgctcatggccggccagcactcgtcctctagcacctcgtcctggattctacttcgactagctaccagacctgatatccaggaagaactataccaagaacaaattcgggtttgcggcgctgatcttccaccgttgcagtacgaagatcttgctcgcatgcctctccacaaccagattatcaaagaaactcttcgcatgcattcgccaattcacagcatcttgcgtgccgtcaaacagcctatgcctgtcgaaggaactccttacaccatccccacctcgcatgttctccttgctgctcccatcgcatctggaggctcgccaatgtactttccagctcctgagaagtgggagcctcaccgttgggacgaaggatcaggaggaaccaacatctcgggcggcgaaaacggtggcgaagagaaagaggattacggctatggactcatcacaaagggcgccagctcgccgtaccttccgttcggcgctggaagacataggtgtatcggcgaacaatttgcatatatgcagttgaacacggttctcgcgacgcaagttcgcgaattcaagttcagtttgagggaaggagagtcgttccccaagaccgacttctcttctctattttctggacctctacgccccgcgtggttgaactgggaacgtagagagaagtcctcatga

SEQ ID NO: 28330 - protein, 524 aa, Venturia inaequalis
  misc_feature (10)..(10): Xaa can be any amino acid
MGLLSPLLAXLPGSDRSWLFYTLASFGFTVAIVAANLVKQLLFSNPNEPPVVFHWFPFFGNTVVYGIDPIKFFAECKEKHGDIFTFILLGRKTTVYIGTKGNEFILNGKQSHVNAEEIYSPLTTPVFGSDVVYDCPNSKLMEQKKFVKYGLTTEALKSYVTLIQQEVEDYTKRYPQFKGEKGSFDVCASMAEITIFTASRSLQGKEVRDKFDASFADLFHDLDMGFSPINFMLPWAPLPHNRRRDAANKKMTETYLEIIQSRKAEGVKKDSEDMIWNLMQCVYKNGTPIPDKEIAHMMIALLMAGQHSSSSTSSWILLRLATRPDIQEELYQEQIRVCGADLPPLQYEDLARMPLHNQIIKETLRMHSPIHSILRAVKQPMPVEGTPYTIPTSHVLLAAPIASGGSPMYFPAPEKWEPHRWDEGSGGTNISGGENGGEEKEDYGYGLITKGASSPYLPFGAGRHRCIGEQFAYMQLNTVLATQVREFKFSLREGESFPKTDFSSLFSGPLRPAWLNWERREKSS

SEQ ID NO: 28331 - DNA, 2010 bp, Mus musculus
  CDS (77)..(1588)
ggcacgaggaggatccctgcaagactctcagctgggagggaaacttggaggcctgaactgctaaaggaaagctaagatggagctcatccccaacctttctatagaaacctgggtgctgctggttactagcctggtgctcttctacatatatgggacctattctcatggcttgtttaagaaactaggaattcctggaccaaaacctctaccgttacttggcaccattttcaactactatgatggcatgtggaaatttgatgaagattgctataaaaagtatgggaaaatatgggggttttatgagggcccacagcctatattggctatcatggatccagagatcatcaagattgtgctggtgaaagaatgttactcagtcttcacaaaccgtcggttttttgggccagtgggattcatgaaaaaggccattaccatatctgaggatgaagaatggaagagacttagaacactcctgtctccaaccttcaccagtggcaaactcaaggagatgttccccatcatgagacagtatggagatatattggtgagaaacttgagacgagaagaagagaaaggggagcccatcagcatgaaagacatctttggagcttatagcatggatgtgatcactggcacatcatttggcgtgaacgtcgattccctcaataatccacaggatccctttgtgcagaaagccaagaagatcttaaaatttaaagtttttgatccatttcttctgtctataattctgtttccatttcttactccaatatatgagatgttaaacttttccatttttccaagagattcaatgaactttttcaaaaaatttgtaaaaaggatgaagaaagaacgccttgcttcaaaccagaagaaccgagtggattttctacaactgatgatgaatactcagaactccaaaggccaagagtcacagaaagctctttctgatctagaaatggcagcacaagctgttatttttatcttcgggggctatgatgccacaagcacttccatttccctcataatgtatgaactggccactcaccctgatgtgcaaaaaaaacttcaggatgagattgacagaactctgcccaataaggcacctgtcacctatgacgccctgatggacatggagtacctggacatggtggtgaatgaaagtctaagattgtacccaattgctatcaggctagaaagggtctcaaaaaaagatgtggaaatcaatggagtgttcattcccaaagggaccgtagttatgataccaatctatcctcttcaccgaaatcctgagtactggccagagcctcaggaattctgccctgaaaggttcagcaaggagaacaagggcaacattgatccatatatatacatgccctttggaaatggacccaggaactgcataggcatgaggtttgctctcatcagcatcaaacttgctgtcataggagtcctgcagaacttcactgtccagccttgtgaagagacacagatccccctgaagatcagcagggaaccaattttccaaccagaaaaacccatcatcctaaaggttgtgtcaagagataaacccagaactggatcatgaatttccctcagaaaacatgttatattcttcaaggagactgtgtcatagaacacaagagaatttaattaactttagaacaacataatatgggcatactcaactttccttgatgattgaatattcagaaattcactgaacatgctcagtgactatgcagtgtatcatctattttgtgattcaaaggaaattattaactcaatggtagttgtggatgttcaccttctgattcttgtgggaatgtctacactaattccagttagttacatccattctgaattctaactgcagcaactatttctctatcattttattaatagaaacccttgtaatgatggttagtaaatgtgtatcaagttttctctttgttaaaatgtatgatattaagtgtatacataaatatatcttttaaaaaaaaaaaaaaa

SEQ ID NO: 28332 - protein, 503 aa, Mus musculus
MELIPNLSIETWVLLVTSLVLFYIYGTYSHGLFKKLGIPGPKPLPLLGTIFNYYDGMWKFDEDCYKKYGKIWGFYEGPQPILAIMDPEIIKIVLVKECYSVFTNRRFFGPVGFMKKAITISEDEEWKRLRTLLSPTFTSGKLKEMFPIMRQYGDILVRNLRREEEKGEPISMKDIFGAYSMDVITGTSFGVNVDSLNNPQDPFVQKAKKILKFKVFDPFLLSIILFPFLTPIYEMLNFSIFPRDSMNFFKKFVKRMKKERLASNQKNRVDFLQLMMNTQNSKGQESQKALSDLEMAAQAVIFIFGGYDATSTSISLIMYELATHPDVQKKLQDEIDRTLPNKAPVTYDALMDMEYLDMVVNESLRLYPIAIRLERVSKKDVEINGVFIPKGTVVMIPIYPLHRNPEYWPEPQEFCPERFSKENKGNIDPYIYMPFGNGPRNCIGMRFALISIKLAVIGVLQNFTVQPCEETQIPLKISREPIFQPEKPIILKVVSRDKPRTGS

SEQ ID NO: 28333 - DNA, 1597 bp, Drosophila melanogaster
  CDS (121)..(1512)
ctgtttctactggttgtgctgctcttcggagcgggctggatcattcatctgggccaggccgatcgtcggcggaaagtggccaatttgccgggacccatttgtccaccactcattggcgccatgcaactcatgctccgtttgaaccccaaaactttcataaaagtgggacgagagtacgtgctgaaatttggtcaccttcaacgagtgtggatctttaatcgcctgctgataatgagcggcgatgcggaattaaatgagcagctgctaagtagccaggagcatctggtgaagcatccggtgtacaaagtacttggccagtggctgggcaatggattgctcctcagcgatggtaaagtgtggcaccaacgacgcaagatcatcacacccacgttccacttctcgattctggagcagtttgtcgaggtattcgatcagcaatcgaacatttgtgtccaaagattggcacaaaaggccaatggaaatacgttcgatgtttatcggagcatttgtgcagcagcattggacataatagccgaaacagcaatgggcacaaaaatatatgcccaggccaacgagagtactccatacgctgaagcagtcaatgaatgcactgctctgctaagttggcgattcatgtcagtttatctgcaggtggagctgcttttcacactcacccatcctcacctgaaatggcgccaaacgcagctcattcgcacgatgcaggaattcaccatcaaggtgatcgagaagcggcgtcaggctttagaggatcaacaatccaaattgatggacactgccgatgaggatgtgggctccaagcggcgaatggccttgctggacgtcctgctgatgtccactgtggatggcagaccgctgaccaacgatgagattcgcgaggaggtggatacgttcatgttcgagggtcacgataccaccaccagtgctttgtccttctgcctgcacgagctttcgaggcatccagaggtgcaggcaaagatgctggaggagatcgttcaggtgctcggcaccgatcgaagcagaccggttagcattcgtgacctcggggagctcaagtacatggagtgcgtcatcaaggagtcgctgaggatgtatccaccagtgcccatcgtagggcgcaaattgcagaccgacttcaaatacacccattccgtgcatggagatggagtaattccggctggctcagagattataatcggaatctttggtgtacatcgccaaccagaaacctttcccaatccggacgaatttatccctgaacgacatgagaatggaagtcgcgtggctccatttaaaatgattccattcagtgcaggacccaggaactgtataggtcagaagttcgctcagctggagatgaagatgatgctggccaagattgtcagggaatacgaactgcttccgatgggtcaaagggttgagtgcattgttaatatcgttttgcgatcggaaacgggttttcagctgggaatgcggaagcgaaaacataactaagtacaccaactaactagtttaagtggtaaaatataaacgggttcatatagtattattctataaaaaaaaaaaaaaaaaaaaaaaa

SEQ ID NO: 28334 - protein, 463 aa, Drosophila melanogaster
MQLMLRLNPKTFIKVGREYVLKFGHLQRVWIFNRLLIMSGDAELNEQLLSSQEHLVKHPVYKVLGQWLGNGLLLSDGKVWHQRRKIITPTFHFSILEQFVEVFDQQSNICVQRLAQKANGNTFDVYRSICAAALDIIAETAMGTKIYAQANESTPYAEAVNECTALLSWRFMSVYLQVELLFTLTHPHLKWRQTQLIRTMQEFTIKVIEKRRQALEDQQSKLMDTADEDVGSKRRMALLDVLLMSTVDGRPLTNDEIREEVDTFMFEGHDTTTSALSFCLHELSRHPEVQAKMLEEIVQVLGTDRSRPVSIRDLGELKYMECVIKESLRMYPPVPIVGRKLQTDFKYTHSVHGDGVIPAGSEIIIGIFGVHRQPETFPNPDEFIPERHENGSRVAPFKMIPFSAGPRNCIGQKFAQLEMKMMLAKIVREYELLPMGQRVECIVNIVLRSETGFQLGMRKRKHN

SEQ ID NO: 28335 - DNA, 2321 bp, Cavia porcellus
  CDS (5)..(1516)
ggaaatggacctggtccccagcttttccttggaaacgtgggttctcctggcccttagcctggtgcttctgtatcgatatgcgacctattcccatggattttttaagaagcttggaattcctgggcctaaacctctgcctctgtttggaaatgttttgtcctacaggaagggtatgtggagttttgacatagagtgccgtaaaaagtatggaaatatgtgggggttgtatgatggtccacagcctgtgctggccatcacagaaccagacatgatcaaagcagttctagttaaagaatgttattctgtgttcacaaatcggcggtcgcttgttccagtaggatttatgaaaaaagctgtctccctatctgaggatgaggaatggaagagaatacgaacacagttgtctccaaacttcaccagtggaaaactcaaggaaatgttccccatcattaaacagtatggagatgtgttggtcaaaaacctgagacaagaagcagagaaaggcaaacctgttcaactgaaggaaatctttggggcctacagcatggatataatcgttgcaacagcatttggggtgaacgttgattccctcaacaacccacatgatccctttgtgtcaaaagccaggaagctcttcagatttgattttttgagtccatttcttctctcaatagtgatgtttccattcctcactcaactgtatgagatgttaagtatctctatttttccacgagattctttgaaatttttcacaaaatttgtaaaaaagacaaaagaaaatcatctggaatctaacaagaagcaacgagtggactttcttcagatgatgctaaactcccagaattttaaagacacagaatctcataaagctctgtctgatgtggagatcttggcccagtcaattatctttatttttgctggttatgagaccactagtagcactctttcttttattatgtattcattggccacccaccctgatgtgcagaagaaactgcagcaggagattgataaaactttgcccaataaggcatttcctacctatgatgtcatgatggagatggaatatctggatatggtggtgaatgaaactctcaggttatatccagttactaacagaattgagaggatgtccaaaaaagattttgaaatcaatggaatgtcctttcccaaagggacaggagtgatgataccaagttttgctcttcaccgagactcaaaatactggccagaacctgatgagttccgccctgaaaggttcagtaagaaaaacaaggagaatattgacccttacatatacatgccctttgggaatggacccaggaactgcattggcatgaggatggcactcatgaacttaaaacttgctctcatacgactcctgcagaacttctctttctatccctgtaaagaaacacagatccctctgaggttaggctcagaggctcttcttcagccggcaaaacccataattctgaaggttgtgtcaagggatgagaccataagaggagcttgatcatctatggacttctgctatgttctttatgaagactttaatttacttttgaataaaactcaaatgaagatgagcttcataaactgcccttgaagagttatgagggattcagtacacactttggcttgctccatatctgtacagtctatctgttataacaaaatgagtgtcagacttgtcagttcacattctctaattctcacaggactgtctctatccgtctctaagtggtaccatcaattgcatttgagctctgatcaagggaaacatttctcaacaattttaacaacaatttttaatgagaacaagaattatagctctgattgtagtaaaaatttgtatgaaatatttgtaatatataagaagtattatttgaaaattcaaataaatatatctcttgaaaaaaagtaatctttaaaaagtgcacattgtgagggaagctatttttggtcatcaaagtcactggccctggggcctttttctgatcccatttgtatgttaagattgataattattcctctgatttttatcagaggatgtagaattttttcagaggatgtagtttggaaactacatccatgatttaattctagccttttgaagcatatgcttttgtgtaactgaaatgaggtattcattactttattattaattttgatttagcatcatcttctgagatgtttctggaaaataggaaacatgcctttctttccttttttctgcctttttccactgggaatggagggtaggcacatgttaaataagcacttttaccactgatctacatcctcagccctaggaaaca

SEQ ID NO: 28336 - protein, 503 aa, Cavia porcellus
MDLVPSFSLETWVLLALSLVLLYRYATYSHGFFKKLGIPGPKPLPLFGNVLSYRKGMWSFDIECRKKYGNMWGLYDGPQPVLAITEPDMIKAVLVKECYSVFTNRRSLVPVGFMKKAVSLSEDEEWKRIRTQLSPNFTSGKLKEMFPIIKQYGDVLVKNLRQEAEKGKPVQLKEIFGAYSMDIIVATAFGVNVDSLNNPHDPFVSKARKLFRFDFLSPFLLSIVMFPFLTQLYEMLSISIFPRDSLKFFTKFVKKTKENHLESNKKQRVDFLQMMLNSQNFKDTESHKALSDVEILAQSIIFIFAGYETTSSTLSFIMYSLATHPDVQKKLQQEIDKTLPNKAFPTYDVMMEMEYLDMVVNETLRLYPVTNRIERMSKKDFEINGMSFPKGTGVMIPSFALHRDSKYWPEPDEFRPERFSKKNKENIDPYIYMPFGNGPRNCIGMRMALMNLKLALIRLLQNFSFYPCKETQIPLRLGSEALLQPAKPIILKVVSRDETIRGA

SEQ ID NO: 28337 - DNA, 1653 bp, Ovis aries
  CDS (87)..(1598)
cagaagcttcacactgagaggcaggcagagagcagcacacgcagctgaaaggaaactcagaggagggaatcgccaagaaagtggccatggagctgatcccaagtttttccctggaaacctgggttctcctggctatcagcctggtgctcctctatctatatggaacttattcacatggactgtttaagaagctgggagtttctgggccaagacctctgccttattttggaaatgttctgtcctaccgaaagggtgtttgtgaatttgatgaagaatgttttaaaaagtatgggaaaatgtggggggtttttgaaggtaaacagcctctgttggttatcacagatccagatgtgatcaaaacagtactagtgaaagaatgttattctgtcttcacaaaccggagggtttttggtccaatgggaattatgaaaaatgctgtttctgtggctgaggatgaacaatggaagagaatacggacattgctgtctccaaccttcaccagtgggaagctcaaagacatgttccctatcattgggaagtatggagatgtgttggtgaggaacctgaggaaggaagcagagaaaggcaagtccgtcaacatgaaagacatctttggggcctacagcatggatgtgattactagcacatcatttggagtgaatattgattcccttggcaacccacaggatccctttgtggagaatgccaagaagctcttaagatttaatatcctcgatccatttcttctctcagtagtactctttccattccttgtcccaatctttgaagtattaaatatcaccatgtttcccaaaagtgctgtggattttttgacaaaatctgtaaaaaggataaaagaaagtcgcctcaaagataatcaaaagccacgtgtggactttcttcagttgatgattaactctcagaattccaaagaaacagacaaccataaagctctctctgaccaagaactcatggcccaaagtgttatctttatttttgccggctatgagaccactagcaatacgctttccttccttttgtatattttggccactcaccctgatgtccagcagaagctgcaggaggagattgatgcgactttccccaataaggcacctccgacctacgatgtcctggcacagatggagtatcttgacatggtggtgaatgagactctcagaatgtttccaattgctgttagacttgataggctctgtaagaaggatgtggaaatccacggggtgtccattcccaaagggacagcggtgacggtgccaatctttgtgcttcacagagacccacagctctggccagagcctgaggagtttcgtcctgaaaggttcagtaagaagaacaaggacagcataaatccttatgtatacctgccttttggaactggaccccgaaattgcattggcatgaggtttgccatcatgaatatgaaacttgctattgtcagagtcctgcagaacttctccttcaaaccttgtaaagaaacacagatccccttgaagataaacagtcaaggactgataagaccagaaaaacccatttttctgaaggttgtgctcagagatgagaccataagtggagcctgacttctcttaaggacctgggctttgttcttcaaggaactgtgtcccacaatttcag

SEQ ID NO: 28338 - protein, 503 aa, Ovis aries
MELIPSFSLETWVLLAISLVLLYLYGTYSHGLFKKLGVSGPRPLPYFGNVLSYRKGVCEFDEECFKKYGKMWGVFEGKQPLLVITDPDVIKTVLVKECYSVFTNRRVFGPMGIMKNAVSVAEDEQWKRIRTLLSPTFTSGKLKDMFPIIGKYGDVLVRNLRKEAEKGKSVNMKDIFGAYSMDVITSTSFGVNIDSLGNPQDPFVENAKKLLRFNILDPFLLSVVLFPFLVPIFEVLNITMFPKSAVDFLTKSVKRIKESRLKDNQKPRVDFLQLMINSQNSKETDNHKALSDQELMAQSVIFIFAGYETTSNTLSFLLYILATHPDVQQKLQEEIDATFPNKAPPTYDVLAQMEYLDMVVNETLRMFPIAVRLDRLCKKDVEIHGVSIPKGTAVTVPIFVLHRDPQLWPEPEEFRPERFSKKNKDSINPYVYLPFGTGPRNCIGMRFAIMNMKLAIVRVLQNFSFKPCKETQIPLKINSQGLIRPEKPIFLKVVLRDETISGA

SEQ ID NO: 28339 - DNA, 26 bp, Primer
atgagttctgtcgcagaaaatataat

SEQ ID NO: 28340 - DNA, 26 bp, Primer
ttattcgaagacttctccagtaattg

SEQ ID NO: 28341 - DNA, 1728 bp, Saccharomyces cerevisiae; identical to SEQ ID NO: 13930
  CDS (660)..(1535)

SEQ ID NO: 28342 - protein, 291 aa, Saccharomyces cerevisiae; identical to SEQ ID NO: 13931

SEQ ID NO: 28343 - DNA, 2703 bp, Schizosaccharomyces pombe; identical to SEQ ID NO: 13932
  CDS (1)..(2703)

SEQ ID NO: 28344 - protein, 900 aa, Schizosaccharomyces pombe; identical to SEQ ID NO: 13933

SEQ ID NO: 28345 - DNA, 975 bp, Candida glabrata; identical to SEQ ID NO: 13934
  CDS (1)..(975)

SEQ ID NO: 28346 - protein, 324 aa, Candida glabrata; identical to SEQ ID NO: 13935

SEQ ID NO: 28347 - DNA, 1356 bp, Candida glabrata; identical to SEQ ID NO: 13936
  CDS (1)..(1356)

SEQ ID NO: 28348 - protein, 451 aa, Candida glabrata; identical to SEQ ID NO: 13937

SEQ ID NO: 28349 - DNA, 1017 bp, Candida glabrata; identical to SEQ ID NO: 13938
  CDS (1)..(1017)

SEQ ID NO: 28350 - protein, 338 aa, Candida glabrata; identical to SEQ ID NO: 13939

SEQ ID NO: 28351 - DNA, 729 bp, Candida glabrata; identical to SEQ ID NO: 13940
  CDS (1)..(729)

SEQ ID NO: 28352 - protein, 242 aa, Candida glabrata; identical to SEQ ID NO: 13941

SEQ ID NO: 28353 - DNA, 1104 bp, Neurospora crassa; identical to SEQ ID NO: 13942
  CDS (1)..(1104)

SEQ ID NO: 28354 - protein, 367 aa, Neurospora crassa; identical to SEQ ID NO: 13943

SEQ ID NO: 28355 - DNA, 780 bp, Ashbya gossypii; identical to SEQ ID NO: 13944
  CDS (1)..(780)

SEQ ID NO: 28356 - protein, 259 aa, Ashbya gossypii; identical to SEQ ID NO: 13945

SEQ ID NO: 28357 - DNA, 1123 bp, Kluyveromyces lactis; identical to SEQ ID NO: 13946
  CDS (219)..(1064)

SEQ ID NO: 28358 - protein, 281 aa, Kluyveromyces lactis; identical to SEQ ID NO: 13947

SEQ ID NO: 28359 - DNA, 1648 bp, Candida albicans; identical to SEQ ID NO: 13948
  CDS (520)..(1392)

SEQ ID NO: 28360 - protein, 290 aa, Candida albicans; identical to SEQ ID NO: 13949

SEQ ID NO: 28361 - DNA, 27 bp, Primer
atgaactctattttagacagaaatgtt

SEQ ID NO: 28362 - DNA, 27 bp, Primer
ttatttttggtcttgtttcaaagtgtc

SEQ ID NO: 28363 - DNA, 549 bp, Saccharomyces cerevisiae; identical to SEQ ID NO: 8303
  CDS (1)..(549)

SEQ ID NO: 28364 - protein, 182 aa, Saccharomyces cerevisiae; identical to SEQ ID NO: 8304

SEQ ID NO: 28365 - DNA, 651 bp, Ashbya gossypii; identical to SEQ ID NO: 8305
  CDS (1)..(651)

SEQ ID NO: 28366 - protein, 216 aa, Ashbya gossypii; identical to SEQ ID NO: 8306

SEQ ID NO: 28367 - DNA, 25 bp, Primer
atgttaaaaagacgctctaatgctc

SEQ ID NO: 28368 - DNA, 25 bp, Primer
tcaccaaaaccatctcctataccaa

SEQ ID NO: 28369 - DNA, 2643 bp, Saccharomyces cerevisiae; identical to SEQ ID NO: 9735
  CDS (4)..(2613)

SEQ ID NO: 28370 - protein, 869 aa, Saccharomyces cerevisiae; identical to SEQ ID NO: 9736

SEQ ID NO: 28371 - DNA, 4321 bp, Rattus norvegicus (Norway rat); identical to SEQ ID NO: 9737
  CDS (201)..(3998)

SEQ ID NO: 28372 - protein, 1265 aa, Rattus norvegicus (Norway rat); identical to SEQ ID NO: 9738

SEQ ID NO: 28373 - DNA, 5751 bp, Drosophila melanogaster; identical to SEQ ID NO: 9739
  CDS (563)..(4501)

SEQ ID NO: 28374 - protein, 1312 aa, Drosophila melanogaster; identical to SEQ ID NO: 9740

SEQ ID NO: 28375 - DNA, 4519 bp, Homo sapiens (man); identical to SEQ ID NO: 9741
  CDS (165)..(3710)

SEQ ID NO: 28376 - protein, 1181 aa, Homo sapiens (man); identical to SEQ ID NO: 9742

SEQ ID NO: 28377 - DNA, 2487 bp, Dictyostelium discoideum; identical to SEQ ID NO: 9743
  CDS (511)..(2487)

SEQ ID NO: 28378 - protein, 658 aa, Dictyostelium discoideum; identical to SEQ ID NO: 9744

SEQ ID NO: 28379 - DNA, 4721 bp, Xenopus laevis (African clawed frog); identical to SEQ ID NO: 9745
  CDS (83)..(3715)

SEQ ID NO: 28380 - protein, 1210 aa, Xenopus laevis (African clawed frog); identical to SEQ ID NO: 9746

SEQ ID NO: 28381 - DNA, 2627 bp, Homo sapiens (man); identical to SEQ ID NO: 9747
  CDS (95)..(2365)

SEQ ID NO: 28382 - protein, 756 aa, Homo sapiens (man); identical to SEQ ID NO: 9748

SEQ ID NO: 28383 - DNA, 3705 bp, Homo sapiens (man); identical to SEQ ID NO: 9749
  CDS (1)..(3705)

SEQ ID NO: 28384 - protein, 1234 aa, Homo sapiens (man); identical to SEQ ID NO: 9750

SEQ ID NO: 28385 - DNA, 4565 bp, Homo sapiens (man); identical to SEQ ID NO: 9751
  CDS (204)..(3197)

SEQ ID NO: 28386 - protein, 997 aa, Homo sapiens (man); identical to SEQ ID NO: 9752

SEQ ID NO: 28387 - DNA, 4344 bp, Bos primigenius taurus (cattle); identical to SEQ ID NO: 9753
  CDS (33)..(3908)

SEQ ID NO: 28388 - protein, 1291 aa, Bos primigenius taurus (cattle); identical to SEQ ID NO: 9754

SEQ ID NO: 28389 - DNA, 2700 bp, Schizosaccharomyces pombe; identical to SEQ ID NO: 9755
  CDS (1)..(2700)

SEQ ID NO: 28390 - protein, 899 aa, Schizosaccharomyces pombe; identical to SEQ ID NO: 9756

SEQ ID NO: 28391 - DNA, 5233 bp, Rattus norvegicus (Norway rat); identical to SEQ ID NO: 9757
  CDS (467)..(3757)

SEQ ID NO: 28392 - protein, 1096 aa, Rattus norvegicus (Norway rat); identical to SEQ ID NO: 9758

SEQ ID NO: 28393 - DNA, 3354 bp, Loligo forbesi (northern European squid); identical to SEQ ID NO: 9759
  CDS (585)..(3212)

SEQ ID NO: 28394 - protein, 875 aa, Loligo forbesi (northern European squid); identical to SEQ ID NO: 9760

SEQ ID NO: 28395 - DNA, 4819 bp, Meleagris gallopavo (common turkey); identical to SEQ ID NO: 9761
  CDS (362)..(3997)

SEQ ID NO: 28396 - protein, 1211 aa, Meleagris gallopavo (common turkey); identical to SEQ ID NO: 9762

SEQ ID NO: 28397 - DNA, 2164 bp, Arabidopsis thaliana (mouse-ear cress); identical to SEQ ID NO: 9763
  CDS (175)..(1920)

SEQ ID NO: 28398 - protein, 581 aa, Arabidopsis thaliana (mouse-ear cress); identical to SEQ ID NO: 9764

SEQ ID NO: 28399 - DNA, 1843 bp, Arabidopsis thaliana (mouse-ear cress); identical to SEQ ID NO: 9765
  CDS (111)..(1691)

SEQ ID NO: 28400 - protein, 526 aa, Arabidopsis thaliana (mouse-ear cress); identical to SEQ ID NO: 9766

SEQ ID NO: 28401 - DNA, 1894 bp, Glycine max (soybean); identical to SEQ ID NO: 9767
  CDS (76)..(1737)

SEQ ID NO: 28402 - protein, 553 aa, Glycine max (soybean); identical to SEQ ID NO: 9768

SEQ ID NO: 28403 - DNA, 2134 bp, Glycine max (soybean); identical to SEQ ID NO: 9769
  CDS (27)..(1829)

SEQ ID NO: 28404 - protein, 600 aa, Glycine max (soybean); identical to SEQ ID NO: 9770

SEQ ID NO: 28405 - DNA, 2170 bp, Glycine max (soybean); identical to SEQ ID NO: 9771
  CDS (92)..(1747)

SEQ ID NO: 28406 - protein, 551 aa, Glycine max (soybean); identical to SEQ ID NO: 9772

SEQ ID NO: 28407 - DNA, 1981 bp, Solanum tuberosum (potato); identical to SEQ ID NO: 9773
  CDS (56)..(1846)

SEQ ID NO: 28408 - protein, 596 aa, Solanum tuberosum (potato); identical to SEQ ID NO: 9774

SEQ ID NO: 28409 - DNA, 1940 bp, Solanum tuberosum (potato); identical to SEQ ID NO: 9775
  CDS (128)..(1825)

SEQ ID NO: 28410 - protein, 565 aa, Solanum tuberosum (potato); identical to SEQ ID NO: 9776

SEQ ID NO: 28411 - DNA, 2009 bp, Solanum tuberosum (potato); identical to SEQ ID NO: 9777
  CDS (23)..(1780)

SEQ ID NO: 28412 - protein, 585 aa, Solanum tuberosum (potato); identical to SEQ ID NO: 9778

SEQ ID NO: 28413 - DNA, 2006 bp, Vigna unguiculata (cowpea); identical to SEQ ID NO: 9779
  CDS (88)..(1737)

SEQ ID NO: 28414 - protein, 549 aa, Vigna unguiculata (cowpea); identical to SEQ ID NO: 9780

SEQ ID NO: 28415 - DNA, 3900 bp, Caenorhabditis elegans; identical to SEQ ID NO: 9781
  CDS (1)..(3900)

SEQ ID NO: 28416 - protein, 1299 aa, Caenorhabditis elegans; identical to SEQ ID NO: 9782

SEQ ID NO: 28417 - DNA, 2691 bp, Caenorhabditis elegans; identical to SEQ ID NO: 9783
  CDS (1)..(2691)

SEQ ID NO: 28418 - protein, 896 aa, Caenorhabditis elegans; identical to SEQ ID NO: 9784

SEQ ID NO: 28419 - DNA, 2256 bp, Caenorhabditis elegans; identical to SEQ ID NO: 9785
  CDS (1)..(2256)

SEQ ID NO: 28420 - protein, 751 aa, Caenorhabditis elegans; identical to SEQ ID NO: 9786

SEQ ID NO: 28421 - DNA, 1755 bp, Arabidopsis thaliana (mouse-ear cress); identical to SEQ ID NO: 9787
  CDS (1)..(1755)

SEQ ID NO: 28422 - protein, 584 aa, Arabidopsis thaliana (mouse-ear cress); identical to SEQ ID NO: 9788

SEQ ID NO: 28423 - DNA, 1746 bp, Brassica napus (rape); identical to SEQ ID NO: 9789
  CDS (1)..(1746)

SEQ ID NO: 28424 - protein, 581 aa, Brassica napus (rape); identical to SEQ ID NO: 9790

SEQ ID NO: 28425 - DNA, 2394 bp, Nicotiana tabacum (common tobacco); identical to SEQ ID NO: 9791
  CDS (21)..(1838)

SEQ ID NO: 28426 - protein, 605 aa, Nicotiana tabacum (common tobacco); identical to SEQ ID NO: 9792

SEQ ID NO: 28427 - DNA, 2098 bp, Nicotiana tabacum (common tobacco); identical to SEQ ID NO: 9793
  CDS (106)..(1866)

SEQ ID NO: 28428 - protein, 586 aa, Nicotiana tabacum (common tobacco); identical to SEQ ID NO: 9794

SEQ ID NO: 28429 - DNA, 4953 bp, Magnaporthe grisea; identical to SEQ ID NO: 9795
  CDS (1900)..(4440)

SEQ ID NO: 28430 - protein, 846 aa, Magnaporthe grisea; identical to SEQ ID NO: 9796

SEQ ID NO: 28431 - DNA, 4330 bp, Ephydatia fluviatilis; identical to SEQ ID NO: 9797
  CDS (68)..(4135)

SEQ ID NO: 28432 - protein, 1355 aa, Ephydatia fluviatilis; identical to SEQ ID NO: 9798

SEQ ID NO: 28433 - DNA, 4080 bp, Ephydatia fluviatilis; identical to SEQ ID NO: 9799
  CDS (119)..(3970)

SEQ ID NO: 28434 - protein, 1283 aa, Ephydatia fluviatilis; identical to SEQ ID NO: 9800

SEQ ID NO: 28435 - DNA, 3196 bp, Hydra magnipapillata; identical to SEQ ID NO: 9801
  CDS (117)..(3155)

SEQ ID NO: 28436 - protein, 1012 aa, Hydra magnipapillata; identical to SEQ ID NO: 9802

SEQ ID NO: 28437 - DNA, 4358 bp, Hydra magnipapillata; identical to SEQ ID NO: 9803
  CDS (192)..(4286)

SEQ ID NO: 28438 - protein, 1364 aa, Hydra magnipapillata; identical to SEQ ID NO: 9804

SEQ ID NO: 28439 - DNA, 2587 bp, Hydra magnipapillata; identical to SEQ ID NO: 9805
  CDS (157)..(2373)

SEQ ID NO: 28440 - protein, 738 aa, Hydra magnipapillata; identical to SEQ ID NO: 9806

SEQ ID NO: 28441 - DNA, 5312 bp, Botrytis cinerea; identical to SEQ ID NO: 9807
  CDS (1483)..(4467)

SEQ ID NO: 28442 - protein, 994 aa, Botrytis cinerea; identical to SEQ ID NO: 9808

SEQ ID NO: 28443 - DNA, 2066 bp, Nicotiana rustica; identical to SEQ ID NO: 9809
  CDS (77)..(1843)

SEQ ID NO: 28444 - protein, 588 aa, Nicotiana rustica; identical to SEQ ID NO: 9810

SEQ ID NO: 28445 - DNA, 1841 bp, Arabidopsis thaliana; identical to SEQ ID NO: 9811
  CDS (111)..(1712)

SEQ ID NO: 28446 - protein, 533 aa, Arabidopsis thaliana; identical to SEQ ID NO: 9812

SEQ ID NO: 28447 - DNA, 1961 bp, Arabidopsis thaliana; identical to SEQ ID NO: 9813
  CDS (50)..(1735)

SEQ ID NO: 28448 - protein, 561 aa, Arabidopsis thaliana; identical to SEQ ID NO: 9814

SEQ ID NO: 28449 - DNA, 2696 bp, Rattus norvegicus; identical to SEQ ID NO: 9815
  CDS (143)..(2461)

SEQ ID NO: 28450 - protein, 772 aa, Rattus norvegicus; identical to SEQ ID NO: 9816

SEQ ID NO: 28451 - DNA, 2541 bp, Plasmodium yoelii yoelii; identical to SEQ ID NO: 9817
  CDS (1)..(2541)

SEQ ID NO: 28452 - protein, 846 aa, Plasmodium yoelii yoelii; identical to SEQ ID NO: 9818

SEQ ID NO: 28453 - DNA, 4929 bp, Anopheles gambiae str; identical to SEQ ID NO: 9819
  CDS (1)..(4929)

SEQ ID NO: 28454 - protein, 1642 aa, Anopheles gambiae str; identical to SEQ ID NO: 9820

SEQ ID NO: 28455 - DNA, 3456 bp, Neurospora crassa; identical to SEQ ID NO: 9821
  CDS (1)..(3456)

SEQ ID NO: 28456 - protein, 1151 aa, Neurospora crassa; identical to SEQ ID NO: 9822

SEQ ID NO: 28457 - DNA, 2133 bp, Neurospora crassa; identical to SEQ ID NO: 9823
  CDS (1)..(2133)

SEQ ID NO: 28458 - protein, 710 aa, Neurospora crassa; identical to SEQ ID NO: 9824

SEQ ID NO: 28459 - DNA, 1797 bp, Neurospora crassa; identical to SEQ ID NO: 9825
  CDS (1)..(1797)

SEQ ID NO: 28460 - protein, 598 aa, Neurospora crassa; identical to SEQ ID NO: 9826

SEQ ID NO: 28461 - DNA, 3015 bp, Misgurnus mizolepis; identical to SEQ ID NO: 9827
  CDS (87)..(2411)

SEQ ID NO: 28462 - protein, 774 aa, Misgurnus mizolepis; identical to SEQ ID NO: 9828

SEQ ID NO: 28463 - DNA, 6299 bp, Mus musculus; identical to SEQ ID NO: 9829
  CDS (141)..(5063)

SEQ ID NO: 28464 - protein, 1640 aa, Mus musculus; identical to SEQ ID NO: 9830

SEQ ID NO: 28465 - DNA, 2131 bp, Sus scrofa; identical to SEQ ID NO: 9831
  CDS (177)..(2087)

SEQ ID NO: 28466 - protein, 636 aa, Sus scrofa; identical to SEQ ID NO: 9832

SEQ ID NO: 28467 - DNA, 3056 bp, Brachydanio rerio; identical to SEQ ID NO: 9833
  CDS (165)..(2414)

SEQ ID NO: 28468 - protein, 749 aa, Brachydanio rerio; identical to SEQ ID NO: 9834

SEQ ID NO: 28469 - DNA, 4103 bp, Brachydanio rerio; identical to SEQ ID NO: 9835
  CDS (16)..(3954)

SEQ ID NO: 28470 - protein, 1312 aa, Brachydanio rerio; identical to SEQ ID NO: 9836

SEQ ID NO: 28471 - DNA, 2630 bp, Rattus sp; identical to SEQ ID NO: 9837
  CDS (62)..(2332)

SEQ ID NO: 28472 - protein, 756 aa, Rattus sp; identical to SEQ ID NO: 9838

SEQ ID NO: 28473 - DNA, 3753 bp, Drosophila pseudoobscura; identical to SEQ ID NO: 9839
  CDS (1)..(3753)

SEQ ID NO: 28474 - protein, 1250 aa, Drosophila pseudoobscura; identical to SEQ ID NO: 9840

SEQ ID NO: 28475 - DNA, 3696 bp, Drosophila virilis; identical to SEQ ID NO: 9841
  CDS (1)..(3696)

SEQ ID NO: 28476 - protein, 1231 aa, Drosophila virilis; identical to SEQ ID NO: 9842

SEQ ID NO: 28477 - DNA, 2075 bp, Homo sapiens; identical to SEQ ID NO: 9843
  CDS (192)..(2018)

SEQ ID NO: 28478 - protein, 608 aa, Homo sapiens; identical to SEQ ID NO: 9844

SEQ ID NO: 28479 - DNA, 2452 bp, Mus musculus; identical to SEQ ID NO: 9845
  CDS (72)..(2111)

SEQ ID NO: 28480 - protein, 679 aa, Mus musculus; identical to SEQ ID NO: 9846

SEQ ID NO: 28481 - DNA, 1941 bp, Mus musculus; identical to SEQ ID NO: 9847
  CDS (1)..(1941)

SEQ ID NO: 28482 - protein, 646 aa, Mus musculus; identical to SEQ ID NO: 9848

SEQ ID NO: 28483 - DNA, 4227 bp, Mus musculus; identical to SEQ ID NO: 9849
  CDS (108)..(3812)

SEQ ID NO: 28484 - protein, 1234 aa, Mus musculus; identical to SEQ ID NO: 9850

SEQ ID NO: 28485 - DNA, 2134 bp, Arabidopsis thaliana; identical to SEQ ID NO: 9851
  CDS (276)..(1910)

SEQ ID NO: 28486 - protein, 544 aa, Arabidopsis thaliana; identical to SEQ ID NO: 9852

SEQ ID NO: 28487 - DNA, 4074 bp, Plasmodium falciparum; identical to SEQ ID NO: 9853
  CDS (1)..(4074)

SEQ ID NO: 28488 - protein, 1357 aa, Plasmodium falciparum; identical to SEQ ID NO: 9854

SEQ ID NO: 28489 - DNA, 2966 bp, Mus musculus; identical to SEQ ID NO: 9855
  CDS (73)..(2430)

SEQ ID NO: 28490 - protein, 785 aa, Mus musculus; identical to SEQ ID NO: 9856

SEQ ID NO: 28491 - DNA, 3715 bp, Mus musculus; identical to SEQ ID NO: 9857
  CDS (124)..(3510)

SEQ ID NO: 28492 - protein, 1128 aa, Mus musculus; identical to SEQ ID NO: 9858

SEQ ID NO: 28493 - DNA, 2187 bp, Mus musculus; identical to SEQ ID NO: 9859
  CDS (195)..(2138)

SEQ ID NO: 28494 - protein, 647 aa, Mus musculus; identical to SEQ ID NO: 9860

SEQ ID NO: 28495 - DNA, 1785 bp, Pisum sativum; identical to SEQ ID NO: 9861
  CDS (1)..(1785)

SEQ ID NO: 28496 - protein, 594 aa, Pisum sativum; identical to SEQ ID NO: 9862

SEQ ID NO: 28497 - DNA, 1667 bp, Homo sapiens; identical to SEQ ID NO: 9863
  CDS (26)..(1237)

SEQ ID NO: 28498 - protein, 403 aa, Homo sapiens; identical to SEQ ID NO: 9864

SEQ ID NO: 28499 - DNA, 3113 bp, Sus scrofa; identical to SEQ ID NO: 9865
  CDS (185)..(2503): n means a or g or c or t/u

SEQ ID NO: 28500 - protein, 772 aa, Sus scrofa; identical to SEQ ID NO: 9866

SEQ ID NO: 28501 - DNA, 3445 bp, Homo sapiens; identical to SEQ ID NO: 9867
  CDS (89)..(2458)

SEQ ID NO: 28502 - protein, 789 aa, Homo sapiens; identical to SEQ ID NO: 9868

SEQ ID NO: 28503 - DNA, 1782 bp, Medicago truncatula; identical to SEQ ID NO: 9869
  CDS (1)..(1782)

SEQ ID NO: 28504 - protein, 593 aa, Medicago truncatula; identical to SEQ ID NO: 9870

SEQ ID NO: 28505 - DNA, 1946 bp, Arabidopsis thaliana; identical to SEQ ID NO: 9871
  CDS (1)..(1794)

SEQ ID NO: 28506 - protein, 597 aa, Arabidopsis thaliana; identical to SEQ ID NO: 9872

SEQ ID NO: 28507 - DNA, 1985 bp, Arabidopsis thaliana; identical to SEQ ID NO: 9873
  CDS (102)..(1838)

SEQ ID NO: 28508 - protein, 578 aa, Arabidopsis thaliana; identical to SEQ ID NO: 9874

SEQ ID NO: 28509 - DNA, 5002 bp, Caenorhabditis elegans; identical to SEQ ID NO: 9875
  CDS (183)..(4478)

SEQ ID NO: 28510 - protein, 1431 aa, Caenorhabditis elegans; identical to SEQ ID NO: 9876

SEQ ID NO: 28511 - DNA, 8358 bp, Rattus norvegicus; identical to SEQ ID NO: 9877
  CDS (567)..(7412)

SEQ ID NO: 28512 - protein, 2281 aa, Rattus norvegicus; identical to SEQ ID NO: 9878

SEQ ID NO: 28513 - DNA, 2207 bp, Oryza sativa; identical to SEQ ID NO: 9879
  CDS (147)..(1946)

SEQ ID NO: 28514 - protein, 599 aa, Oryza sativa; identical to SEQ ID NO: 9880

SEQ ID NO: 28515 - DNA, 3107 bp, Homo sapiens; identical to SEQ ID NO: 9881
  CDS (196)..(2484)

SEQ ID NO: 28516 - protein, 762 aa, Homo sapiens; identical to SEQ ID NO: 9882

SEQ ID NO: 28517 - DNA, 2038 bp, Digitaria sanguinalis; identical to SEQ ID NO: 9883
  CDS (61)..(1953)

SEQ ID NO: 28518 - protein, 630 aa, Digitaria sanguinalis; identical to SEQ ID NO: 9884

SEQ ID NO: 28519 - DNA, 4729 bp, Watasenia scintillans; identical to SEQ ID NO: 9885
  CDS (426)..(3764)

SEQ ID NO: 28520 - protein, 1112 aa, Watasenia scintillans; identical to SEQ ID NO: 9886

SEQ ID NO: 28521 - DNA, 2416 bp, Homo sapiens; identical to SEQ ID NO: 9887
  CDS (81)..(2114)

SEQ ID NO: 28522 - protein, 677 aa, Homo sapiens; identical to SEQ ID NO: 9888

SEQ ID NO: 28523 - DNA, 7609 bp, Homo sapiens; identical to SEQ ID NO: 9889
  CDS (236)..(7147)

SEQ ID NO: 28524 - protein, 2303 aa, Homo sapiens; identical to SEQ ID NO: 9890

SEQ ID NO: 28525 - DNA, 3743 bp, Loligo pealeii; identical to SEQ ID NO: 9891
  CDS (158)..(3541)

SEQ ID NO: 28526 - protein, 1127 aa, Loligo pealeii; identical to SEQ ID NO: 9892

SEQ ID NO: 28527 - DNA, 2354 bp, Trypanosoma cruzi; identical to SEQ ID NO: 9893
  CDS (103)..(2280)

SEQ ID NO: 28528 - protein, 725 aa, Trypanosoma cruzi; identical to SEQ ID NO: 9894

SEQ ID NO: 28529 - DNA, 3351 bp, Homarus americanus; identical to SEQ ID NO: 9895
  CDS (1)..(3351)

SEQ ID NO: 28530 - protein, 1116 aa, Homarus americanus; identical to SEQ ID NO: 9896

SEQ ID NO: 28531 - DNA, 6705 bp, Homo sapiens; identical to SEQ ID NO: 9897
  CDS (4)..(3654)

SEQ ID NO: 28532 - protein, 1216 aa, Homo sapiens; identical to SEQ ID NO: 9898

SEQ ID NO: 28533 - DNA, 3797 bp, Mus musculus; identical to SEQ ID NO: 9899
  CDS (4)..(3654)

SEQ ID NO: 28534 - protein, 1216 aa, Mus musculus; identical to SEQ ID NO: 9900

SEQ ID NO: 28535 - DNA, 3999 bp, Rattus norvegicus; identical to SEQ ID NO: 9901
  CDS (98)..(3649)

SEQ ID NO: 28536 - protein, 1183 aa, Rattus norvegicus; identical to SEQ ID NO: 9902

SEQ ID NO: 28537 - DNA, 4258 bp, Homo sapiens; identical to SEQ ID NO: 9903
  CDS (148)..(3945)

SEQ ID NO: 28538 - protein, 1265 aa, Homo sapiens; identical to SEQ ID NO: 9904

SEQ ID NO: 28539 - DNA, 5751 bp, Drosophila melanogaster; identical to SEQ ID NO: 9905
  CDS (278)..(3988)

SEQ ID NO: 28540 - protein, 1236 aa, Drosophila melanogaster; identical to SEQ ID NO: 9906

SEQ ID NO: 28541 - DNA, 4487 bp, Mus musculus; identical to SEQ ID NO: 9907
  CDS (135)..(4043)

SEQ ID NO: 28542 - protein, 1302 aa, Mus musculus; identical to SEQ ID NO: 9908

SEQ ID NO: 28543 - DNA, 4862 bp, Xenopus laevis; identical to SEQ ID NO: 9909
  CDS (121)..(3945)

SEQ ID NO: 28544 - protein, 1274 aa, Xenopus laevis; identical to SEQ ID NO: 9910

SEQ ID NO: 28545 - DNA, 1776 bp, Vigna radiata; identical to SEQ ID NO: 9911
  CDS (1)..(1776)

SEQ ID NO: 28546 - protein, 591 aa, Vigna radiata; identical to SEQ ID NO: 9912

SEQ ID NO: 28547 - DNA, 2072 bp, Zea mays; identical to SEQ ID NO: 9913
  CDS (65)..(1825)

SEQ ID NO: 28548 - protein, 586 aa, Zea mays; identical to SEQ ID NO: 9914

SEQ ID NO: 28549 - DNA, 1596 bp, Arabidopsis thaliana; identical to SEQ ID NO: 9915
  CDS (1)..(1596)

SEQ ID NO: 28550 - protein, 531 aa, Arabidopsis thaliana; identical to SEQ ID NO: 9916

SEQ ID NO: 28551 - DNA, 2634 bp, Ashbya gossypii; identical to SEQ ID NO: 9917
  CDS (1)..(2634)

SEQ ID NO: 28552 - protein, 877 aa, Ashbya gossypii; identical to SEQ ID NO: 9918

SEQ ID NO: 28553 - DNA, 3468 bp, Lytechinus pictus; identical to SEQ ID NO: 9919
  CDS (1)..(3447)

SEQ ID NO: 28554 - protein, 1148 aa, Lytechinus pictus; identical to SEQ ID NO: 9920

SEQ ID NO: 28555 - DNA, 1797 bp, Oryza sativa; identical to SEQ ID NO: 9921
  CDS (1)..(1797)

SEQ ID NO: 28556 - protein, 598 aa, Oryza sativa; identical to SEQ ID NO: 9922

SEQ ID NO: 28557 - DNA, 2430 bp, Physcomitrella patens; identical to SEQ ID NO: 9923
  CDS (167)..(2071)

SEQ ID NO: 28558 - protein, 634 aa, Physcomitrella patens; identical to SEQ ID NO: 9924

SEQ ID NO: 28559 - DNA, 2423 bp, Physcomitrella patens; identical to SEQ ID NO: 9925
  CDS (208)..(2127)

SEQ ID NO: 28560 - protein, 639 aa, Physcomitrella patens; identical to SEQ ID NO: 9926

SEQ ID NO: 28561 - DNA, 3438 bp, Aspergillus fumigatus; identical to SEQ ID NO: 9927
  CDS (1)..(3438)

SEQ ID NO: 28562 - protein, 1145 aa, Aspergillus fumigatus; identical to SEQ ID NO: 9928

SEQ ID NO: 28563 - DNA, 25 bp, Primer
atgactgaaagtgctatagatgacc

SEQ ID NO: 28564 - DNA, 29 bp, Primer
ctataaaatttgtgtatgaataaataaag

SEQ ID NO: 28565 - protein, 45 aa, consensus
  MISC_FEATURE (1)..(45): consensus for the disclosure of xaa see table XV
XXFXXXXXXXAXAXXXXSGDXXAXXAAXXXXXXXAAXXXLXXXXX

SEQ ID NO: 28566 - protein, 38 aa, consensus
  MISC_FEATURE (1)..(38): consensus for the disclosure of xaa see table XV
XXXYXXDXXXRXXXDXXXXXXXXXXXXXXXXXXRXXXL

SEQ ID NO: 28567 - protein, 25 aa, consensus
  MISC_FEATURE (1)..(25): consensus for the disclosure of xaa see table XV
GXXXEXXAXVXKXXXXXDLXXXXXX

SEQ ID NO: 28568 - protein, 19 aa, consensus
  MISC_FEATURE (1)..(19): consensus for the disclosure of xaa see table XV
TXGXXXXXXXRLQPNXXXD

SEQ ID NO: 28569 - protein, 19 aa, consensus
  MISC_FEATURE (1)..(19): consensus for the disclosure of xaa see table XV
XGXXXGXGDAXXGXNPXXD

SEQ ID NO: 28570 - protein, 53 aa, consensus
  MISC_FEATURE (1)..(53): consensus for the disclosure of xaa see table XV
XXXPTQXCVLXHXXXXXXXXXXGXXXXXXFQSXXGXXXXXXXFGXXXXXXXXX

SEQ ID NO: 28571 - protein, 19 aa, consensus
  MISC_FEATURE (1)..(19): consensus for the disclosure of xaa see table XV
GXNXXYXETGQGXXLSXXX

SEQ ID NO: 28572 - protein, 71 aa, consensus
  MISC_FEATURE (1)..(71): consensus for the disclosure of xaa see table XV
DXXXXEXRXYXXAXXXXPXXVNXVVGFIGPEYLXXXXXXXRAXLEDXFXGKLXGXXXGXDXCYTNHXXXXX

SEQ ID NO: 28573 - protein, 17 aa, consensus
  MISC_FEATURE (1)..(17): consensus for the disclosure of xaa see table XV
PXXDDXMLXYQXXXXHX

SEQ ID NO: 28574 - protein, 438 aa, consensus
  MISC_FEATURE (1)..(438): Xaa in all positions is any amino acid
FXXXXXXXAKAXXXXSGDXLAGXAAXXXXXRVAAXXXLXXXXXXXXXXXXXXXYEXDXVTRXIXDXXXXXXXXXXXXXXXXXXRXXXLXXXXXXXXXXXXXXXXXGLTXEXXAAVXKXXXXXDLXXXAXKXXVXXXXXXTXGXXGXXXXRLQPNXXXDDXXXIXAXXXXGLXXGXGDAXIGXNPXXDXXXXXXXXLXXXXXXXXXXXIPTQXCVLXHVTTXXXXXXXGXPXXLXFQSIXGXEXXXXXFGXXXXXLXEXXXXXXXXXXXXXGXNXXYFETGQGSXLSXXAXXGXXXXXXDQXTXEXRXYXXAXXXXPXLVNTVVGFIGPEYLYXXXQXIRAGLEDHFXGKLXGXXMGXDXCYTNHXXADQXDXXXLXXLLXXAGXXXXXGXPXXDDXMLNYQXXXXHDXXXXRXXXXXXXXXEFXXWLXXXGXXXXXXG

SEQ ID NO: 28575 - protein, 406 aa, consensus
  MISC_FEATURE (1)..(406): Xaa in all positions is any amino acid
FXXXXXXXAXAXXXXSGDXXAXXAAXXXXXXXAAXXXLXXXXXXXXXXXXXXXYXXDXXXRXXXDXXXXXXXXXXXXXXXXXXRXXXLXXXXXXXXXXXXXXXXXGXXXEXXAXVXKXXXXXDLXXXXXXXXXXXXXXXTXGXXXXXXXRLQPNXXXDXXXXXXXXXXXGXXXGXGDAXXGXNPXXDXXXXXXXXXXXXXXXXXXXXXPTQXCVLXHXXXXXXXXXXGXXXXXXFQSXXGXXXXXXXFGXXXXXXXXXXXXXXXXXXXXXGXNXXYXETGQGXXLSXXXXXXXXXXXXDXXXXEXRXYXXAXXXXPXXVNXVVGFIGPEYLXXXXXXXRAXLEDXFXGKLXGXXXGXDXCYTNHXXXXXXXXXXXXXXLXXAXXXXXXXXPXXDDXMLXYQXXXXH

SEQ ID NO: 28576 - protein, 43 aa, consensus
  MISC_FEATURE (1)..(43): consensus for the disclosure of xaa see table XV
XXXGXXXXXXXXXXXXXXXXGXXXXXXXXXXXXXXXXXXXXXX

SEQ ID NO: 28577 - protein, 80 aa, consensus
  MISC_FEATURE (1)..(80): consensus for the disclosure of xaa see table XV
XXGGXXXXXXXXXXXXXXXXXXXXXXXXXXXXXXXXXXXXXXXXXXXXXXXXXXXXXXXXXXXXXXXXXXXXXXXXXXXX

SEQ ID NO: 28578 - protein, 515 aa, consensus
  MISC_FEATURE (1)..(515): Xaa in all positions is any amino acid
GXXXXKXXXXXXXXXXXXXXXXXXXXVXXXXXXXXGXGKXXXXXGLXXXXXXXXXXXXXXXXRXXXXGPXXGXKGGAXGGGXXXXXXXXXXNXXXXGDXXXXXXXXXXXXAXXXXXXXXXXXXXXXXXXXXXXXXXXXXXXXXXXXXXXXXXXXXXXXXXXXXXXXXXXXXXXXXXXXXXXXXXXXXXXRXXDXXDRXXRXXXXGXXXXXXXXXXXXXXXXXXXXXXXEXMXXXXLXXXXXDXXXXXXXXXXXXXXXXXXXXXXXXXXXGXXXXXXXXXXXPNXXQXXXXXXXXXHXGPFXNIXXGXXSXXXXXXXXXXXXXXXXXXXXXXXXXXXXXXXEXGFXXXXGXXXXXXXXXXXXXXXPXXXXXXXTXXXXXXXGXXXXXXXXXXXXXXXXXXXXXXXXXXXXXXXXXXXXXXXXXXXXXVXXXNXXXXDXXXXXXXXXXXXXXXGXXXXXXXXXXXXXXXXGXXXXXXXXXXXXXXXXXXXXXXXXXXXXXXXXXXXKXXXXXXXXXG

SEQ ID NO: 28579 - protein, 11 aa, consensus
  MISC_FEATURE (1)..(11): consensus for the disclosure of xaa see table XV
XXXXXXXXXXX

SEQ ID NO: 28580 - protein, 14 aa, consensus
  MISC_FEATURE (1)..(14): consensus for the disclosure of xaa see table XV
XXPXXXXXXXXXGX

SEQ ID NO: 28581 - protein, 80 aa, consensus; identical to SEQ ID NO: 7429
  MISC_FEATURE (1)..(80): Xaa in all positions is any amino acid.

SEQ ID NO: 28582 - protein, 27 aa, consensus
  MISC_FEATURE (1)..(27): consensus for the disclosure of xaa see table XV
PXXVNAKQXXXIXXRRXXRXXXEXXXX

SEQ ID NO: 28583 - protein, 26 aa, consensus
  MISC_FEATURE (1)..(26): consensus for the disclosure of xaa see table XV
XXXXXYXHESRHXHAXXRXRXXGGRF

SEQ ID NO: 28584 - protein, 56 aa, consensus
  MISC_FEATURE (1)..(56): consensus for the disclosure of xaa see table XV
PXXVNAKQXXXIXXRRXXRXXXEXXXXXXXXXXXXYXHESRHXHAXXRXRXXGGRF

SEQ ID NO: 28585 - protein, 60 aa, consensus; identical to SEQ ID NO: 1957
  MISC_FEATURE (1)..(60): xaa in position 2 till 12 is any amino acid, xaa in position 13 is any or no amino acid, Xaa in all other positions is any amino acid,
  for the disclosure of the amendment in position 16 see table XVI

SEQ ID NO: 28586 - protein, 569 aa, consensus; identical to SEQ ID NO: 5817
  MISC_FEATURE (1)..(569): Xaa in all position is any amino acid

SEQ ID NO: 28587 - protein, 71 aa, consensus; identical to SEQ ID NO: 15667
  MISC_FEATURE (1)..(71): consensus for the disclosure of xaa see table XV

SEQ ID NO: 28588 - protein, 19 aa, consensus
  MISC_FEATURE (1)..(19): Xaa in all positions is any amino acid.
PLXXXXYXXDSWXIXYNXL

SEQ ID NO: 28589 - protein, 47 aa, consensus; identical to SEQ ID NO: 15669
  MISC_FEATURE (1)..(47): consensus for the disclosure of xaa see table XV

SEQ ID NO: 28590 - protein, 345 aa, consensus; identical to SEQ ID NO: 15670
  MISC_FEATURE (1)..(345): Xaa in all positions is any amino acid.

SEQ ID NO: 28591 - protein, 40 aa, consensus
  MISC_FEATURE (1)..(40): consensus for the disclosure of xaa see table XV
XXXXXXXXXXXXXXXXXXXXXXXXXXXXXXXXXXXXXXXX

SEQ ID NO: 28592 - protein, 21 aa, consensus
  MISC_FEATURE (1)..(21): consensus for the disclosure of xaa see table XV
XXXXXXXXXXXXXXXXXEXXR

SEQ ID NO: 28593 - protein, 33 aa, consensus
  MISC_FEATURE (1)..(33): consensus for the disclosure of xaa see table XV
XPXXXXXXXXXXXXXXXXXXXXXXXXXXXPXRX

SEQ ID NO: 28594 - protein, 25 aa, consensus
  MISC_FEATURE (1)..(25): consensus for the disclosure of xaa see table XV
XXXFXXGXXXCXGXXXXXXXXXXXX

SEQ ID NO: 28595 - protein, 29 aa, consensus
  MISC_FEATURE (1)..(29): consensus for the disclosure of xaa see table XV
XXXHXXXEXXXRXXXXXXXXXLXXXXPXX

SEQ ID NO: 28596 - protein, 18 aa, consensus
  MISC_FEATURE (1)..(18): consensus for the disclosure of xaa see table XV
KXXXXXXXXKXXXXXXXX

SEQ ID NO: 28597 - protein, 110 aa, consensus; identical to SEQ ID NO: 15660
  MISC_FEATURE (1)..(110): Xaa in all positions is any amino acid.

SEQ ID NO: 28598 - protein, 23 aa, consensus
  MISC_FEATURE (1)..(23): Xaa in all positions is any amino acid.
LEXLAXLXSLXXVDXXXIRXLIN

SEQ ID NO: 28599 - protein, 36 aa, consensus; identical to SEQ ID NO: 8667
  MISC_FEATURE (1)..(36): Xaa in all positions is any amino acid.

SEQ ID NO: 28600 - protein, 179 aa, consensus; identical to SEQ ID NO: 8668
  MISC_FEATURE (1)..(179): Xaa in all positions is any amino acid.

SEQ ID NO: 28601 - protein, 50 aa, consensus; identical to SEQ ID NO: 10203
  MISC_FEATURE (1)..(50): consensus for the disclosure of xaa see table XV

SEQ ID NO: 28602 - protein, 47 aa, consensus; identical to SEQ ID NO: 10204
  MISC_FEATURE (1)..(47): consensus for the disclosure of xaa see table XV

SEQ ID NO: 28603 - protein, 15 aa, consensus
  MISC_FEATURE (1)..(15): consensus for the disclosure of xaa see table XV
XXXXXXXXXXXXXXX

SEQ ID NO: 28604 - protein, 49 aa, consensus; identical to SEQ ID NO: 10206
  MISC_FEATURE (1)..(49): consensus for the disclosure of xaa see table XV

SEQ ID NO: 28605 - protein, 1212 aa, consensus; identical to SEQ ID NO: 10207
  MISC_FEATURE (1)..(1212): Xaa in all postions is any amino acid.

SEQ ID NO: 28606 - DNA, 1167 bp, Escherichia coli; identical to SEQ ID NO: 13147
  CDS (1)..(1167)

SEQ ID NO: 28607 - protein, 388 aa, Escherichia coli; identical to SEQ ID NO: 13148

SEQ ID NO: 28608 - DNA, 1242 bp, Caulobacter crescentus; identical to SEQ ID NO: 13149
  CDS (1)..(1242)

SEQ ID NO: 28609 - protein, 413 aa, Caulobacter crescentus; identical to SEQ ID NO: 652

SEQ ID NO: 28610 - DNA, 1149 bp, Geobacter sulfurreducens; identical to SEQ ID NO: 729
  CDS (1)..(1149)

SEQ ID NO: 28611 - protein, 382 aa, Geobacter sulfurreducens; identical to SEQ ID NO: 730

SEQ ID NO: 28612 - DNA, 1167 bp, Salmonella enterica subsp. enterica serovar Typhi; identical to SEQ ID NO: 669
  CDS (1)..(1167)

SEQ ID NO: 28613 - protein, 388 aa, Salmonella enterica subsp. enterica serovar Typhi; identical to SEQ ID NO: 670

SEQ ID NO: 28614 - DNA, 1185 bp, Yersinia pestis; identical to SEQ ID NO: 663
  CDS (1)..(1185)

SEQ ID NO: 28615 - protein, 394 aa, Yersinia pestis; identical to SEQ ID NO: 664

SEQ ID NO: 28616 - DNA, 1350 bp, Helicobacter pylori; identical to SEQ ID NO: 13157
  CDS (34)..(1350)

SEQ ID NO: 28617 - protein, 438 aa, Helicobacter pylori; identical to SEQ ID NO: 656

SEQ ID NO: 28618 - DNA, 1149 bp, Vibrio cholerae; identical to SEQ ID NO: 653
  CDS (1)..(1149)

SEQ ID NO: 28619 - protein, 382 aa, Vibrio cholerae; identical to SEQ ID NO: 654

SEQ ID NO: 28620 - DNA, 1203 bp, Haemophilus influenzae; identical to SEQ ID NO: 647
  CDS (1)..(1203)

SEQ ID NO: 28621 - protein, 400 aa, Haemophilus influenzae; identical to SEQ ID NO: 648

SEQ ID NO: 28622 - DNA, 1314 bp, Sinorhizobium meliloti; identical to SEQ ID NO: 13163
  CDS (1)..(1314)

SEQ ID NO: 28623 - protein, 437 aa, Sinorhizobium meliloti; identical to SEQ ID NO: 662

SEQ ID NO: 28624 - DNA, 441 bp, Rickettsia conorii; identical to SEQ ID NO: 671
  CDS (1)..(441)

SEQ ID NO: 28625 - protein, 146 aa, Rickettsia conorii; identical to SEQ ID NO: 672

SEQ ID NO: 28626 - DNA, 1170 bp, Campylobacter jejuni; identical to SEQ ID NO: 665
  CDS (1)..(1170)

SEQ ID NO: 28627 - protein, 389 aa, Campylobacter jejuni; identical to SEQ ID NO: 666

SEQ ID NO: 28628 - DNA, 1149 bp, Campylobacter jejuni; identical to SEQ ID NO: 13169
  CDS (1)..(1149)

SEQ ID NO: 28629 - protein, 382 aa, Campylobacter jejuni; identical to SEQ ID NO: 668

SEQ ID NO: 28630 - DNA, 1317 bp, Helicobacter pylori; identical to SEQ ID NO: 13171
  CDS (1)..(1317)

SEQ ID NO: 28631 - protein, 438 aa, Helicobacter pylori; identical to SEQ ID NO: 650

SEQ ID NO: 28632 - DNA, 1152 bp, Vibrio parahaemolyticus; identical to SEQ ID NO: 13173
  CDS (1)..(1152)

SEQ ID NO: 28633 - protein, 383 aa, Vibrio parahaemolyticus; identical to SEQ ID NO: 646

SEQ ID NO: 28634 - DNA, 2295 bp, Vibrio alginolyticus; identical to SEQ ID NO: 13175
  CDS (605)..(1756)

SEQ ID NO: 28635 - protein, 383 aa, Vibrio alginolyticus; identical to SEQ ID NO: 13176

SEQ ID NO: 28636 - DNA, 1359 bp, Wolinella succinogenes; identical to SEQ ID NO: 727
  CDS (1)..(1359)

SEQ ID NO: 28637 - protein, 452 aa, Wolinella succinogenes; identical to SEQ ID NO: 728

SEQ ID NO: 28638 - DNA, 1359 bp, Porphyromonas gingivalis; identical to SEQ ID NO: 13179
  CDS (1)..(1359)

SEQ ID NO: 28639 - protein, 452 aa, Porphyromonas gingivalis; identical to SEQ ID NO: 726

SEQ ID NO: 28640 - DNA, 1167 bp, Photorhabdus luminescens; identical to SEQ ID NO: 13181
  CDS (1)..(1167)

SEQ ID NO: 28641 - protein, 388 aa, Photorhabdus luminescens; identical to SEQ ID NO: 724

SEQ ID NO: 28642 - DNA, 441 bp, Rickettsia sibirica; identical to SEQ ID NO: 677
  CDS (1)..(441)

SEQ ID NO: 28643 - protein, 146 aa, Rickettsia sibirica; identical to SEQ ID NO: 678

SEQ ID NO: 28644 - DNA, 1323 bp, Rhodopirellula baltica; identical to SEQ ID NO: 13185
  CDS (1)..(1323)

SEQ ID NO: 28645 - protein, 440 aa, Rhodopirellula baltica; identical to SEQ ID NO: 722

SEQ ID NO: 28646 - DNA, 1335 bp, Helicobacter hepaticus; identical to SEQ ID NO: 719
  CDS (1)..(1335)

SEQ ID NO: 28647 - protein, 444 aa, Helicobacter hepaticus; identical to SEQ ID NO: 720

SEQ ID NO: 28648 - DNA, 1383 bp, Helicobacter hepaticus; identical to SEQ ID NO: 13189
  CDS (1)..(1383)

SEQ ID NO: 28649 - protein, 460 aa, Helicobacter hepaticus; identical to SEQ ID NO: 718

SEQ ID NO: 28650 - DNA, 1185 bp, Haemophilus ducreyi; identical to SEQ ID NO: 715
  CDS (1)..(1185)

SEQ ID NO: 28651 - protein, 394 aa, Haemophilus ducreyi; identical to SEQ ID NO: 716

SEQ ID NO: 28652 - DNA, 1197 bp, Bordetella bronchiseptica; identical to SEQ ID NO: 13193
  CDS (1)..(1197)

SEQ ID NO: 28653 - protein, 398 aa, Bordetella bronchiseptica; identical to SEQ ID NO: 714

SEQ ID NO: 28654 - DNA, 1401 bp, Streptomyces avermitilis; identical to SEQ ID NO: 13195
  CDS (1)..(1401)

SEQ ID NO: 28655 - protein, 466 aa, Streptomyces avermitilis; identical to SEQ ID NO: 712

SEQ ID NO: 28656 - DNA, 1158 bp, Tropheryma whipplei; identical to SEQ ID NO: 13197
  CDS (1)..(1158)

SEQ ID NO: 28657 - protein, 385 aa, Tropheryma whipplei; identical to SEQ ID NO: 710

SEQ ID NO: 28658 - DNA, 1176 bp, Pseudomonas syringae; identical to SEQ ID NO: 13199
  CDS (1)..(1176)

SEQ ID NO: 28659 - protein, 391 aa, Pseudomonas syringae; identical to SEQ ID NO: 708

SEQ ID NO: 28660 - DNA, 1179 bp, Pseudomonas syringae; identical to SEQ ID NO: 13201
  CDS (1)..(1179)

SEQ ID NO: 28661 - protein, 392 aa, Pseudomonas syringae; identical to SEQ ID NO: 706

SEQ ID NO: 28662 - DNA, 1362 bp, Pseudomonas putida; identical to SEQ ID NO: 13203
  CDS (1)..(1362)

SEQ ID NO: 28663 - protein, 453 aa, Pseudomonas putida; identical to SEQ ID NO: 704

SEQ ID NO: 28664 - DNA, 1194 bp, Pseudomonas putida; identical to SEQ ID NO: 13205
  CDS (1)..(1194)

SEQ ID NO: 28665 - protein, 397 aa, Pseudomonas putida; identical to SEQ ID NO: 702

SEQ ID NO: 28666 - DNA, 1320 bp, Bacteroides thetaiotaomicron; identical to SEQ ID NO: 699
  CDS (1)..(1320)

SEQ ID NO: 28667 - protein, 439 aa, Bacteroides thetaiotaomicron; identical to SEQ ID NO: 700

SEQ ID NO: 28668 - DNA, 1191 bp, Wigglesworthia glossinidia brevipalpis; identical to SEQ ID NO: 697
  CDS (1)..(1191)

SEQ ID NO: 28669 - protein, 396 aa, Wigglesworthia glossinidia brevipalpis; identical to SEQ ID NO: 698

SEQ ID NO: 28670 - DNA, 1344 bp, Vibrio vulnificus; identical to SEQ ID NO: 695
  CDS (1)..(1344)

SEQ ID NO: 28671 - protein, 447 aa, Vibrio vulnificus; identical to SEQ ID NO: 696

SEQ ID NO: 28672 - DNA, 1170 bp, Vibrio vulnificus; identical to SEQ ID NO: 13213
  CDS (1)..(1170)

SEQ ID NO: 28673 - protein, 389 aa, Vibrio vulnificus; identical to SEQ ID NO: 694

SEQ ID NO: 28674 - DNA, 1170 bp, Shewanella oneidensis; identical to SEQ ID NO: 691
  CDS (1)..(1170)

SEQ ID NO: 28675 - protein, 389 aa, Shewanella oneidensis; identical to SEQ ID NO: 692

SEQ ID NO: 28676 - DNA, 1167 bp, Escherichia coli O6; identical to SEQ ID NO: 13217
  CDS (1)..(1167)

SEQ ID NO: 28677 - protein, 388 aa, Escherichia coli O6; identical to SEQ ID NO: 690

SEQ ID NO: 28678 - DNA, 1182 bp, Brucella suis; identical to SEQ ID NO: 687
  CDS (1)..(1182)

SEQ ID NO: 28679 - protein, 393 aa, Brucella suis; identical to SEQ ID NO: 688

SEQ ID NO: 28680 - DNA, 1419 bp, Bifidobacterium longum; identical to SEQ ID NO: 13221
  CDS (1)..(1419)

SEQ ID NO: 28681 - protein, 472 aa, Bifidobacterium longum; identical to SEQ ID NO: 686

SEQ ID NO: 28682 - DNA, 1167 bp, Salmonella typhimurium; identical to SEQ ID NO: 683
  CDS (1)..(1167)

SEQ ID NO: 28683 - protein, 388 aa, Salmonella typhimurium; identical to SEQ ID NO: 684

SEQ ID NO: 28684 - DNA, 1891 bp, Gamma proteobacterium Hot 75m4; identical to SEQ ID NO: 13225
  CDS (406)..(1590)

SEQ ID NO: 28685 - protein, 394 aa, Gamma proteobacterium Hot 75m4; identical to SEQ ID NO: 676

SEQ ID NO: 28686 - DNA, 1443 bp, Streptomyces antibioticus; identical to SEQ ID NO: 13227
  CDS (1)..(1443)

SEQ ID NO: 28687 - protein, 480 aa, Streptomyces antibioticus; identical to SEQ ID NO: 674

SEQ ID NO: 28688 - DNA, 1197 bp, Rhizobium loti; identical to SEQ ID NO: 13229
  CDS (1)..(1197)

SEQ ID NO: 28689 - protein, 398 aa, Rhizobium loti; identical to SEQ ID NO: 682

SEQ ID NO: 28690 - DNA, 1140 bp, Pasteurella multocida; identical to SEQ ID NO: 13231
  CDS (1)..(1140)

SEQ ID NO: 28691 - protein, 379 aa, Pasteurella multocida; identical to SEQ ID NO: 680

SEQ ID NO: 28692 - DNA, 1425 bp, Streptomyces coelicolor; identical to SEQ ID NO: 13233
  CDS (1)..(1425)

SEQ ID NO: 28693 - protein, 474 aa, Streptomyces coelicolor; identical to SEQ ID NO: 660

SEQ ID NO: 28694 - DNA, 1233 bp, Streptomyces coelicolor; identical to SEQ ID NO: 13235
  CDS (1)..(1233)

SEQ ID NO: 28695 - protein, 410 aa, Streptomyces coelicolor; identical to SEQ ID NO: 658

SEQ ID NO: 28696 - DNA, 26 bp, Primer
atgaaacatctgcatcgattctttag

SEQ ID NO: 28697 - DNA, 25 bp, Primer
ttaaactgatggacgcaaacgaacg

SEQ ID NO: 28698 - protein, 493 aa, consensus; identical to SEQ ID NO: 13777
  MISC_FEATURE (1)..(493): consensus for the disclosure of xaa see table XV

SEQ ID NO: 28699 - protein, 45 aa, consensus; identical to SEQ ID NO: 13776
  MISC_FEATURE (1)..(45): consensus for the disclosure of xaa see table XV

SEQ ID NO: 28700 - DNA, 612 bp, Escherichia coli (strain K-12)
  CDS (1)..(612)
atggaattcggtgtcagattcagtaactacaagggacgtcaaatgataaaaacaacgccacataaaatagtgatactgatgggaatattattatcaccctcagtatttgcaacggatattaatgtagagtttacagccactgtcaaagcgacaacctgtaacatcacacttactggtaataacgtcacgaatgatggcaataataactacacattgagaatccctaagatgggtctggataagatcgcgaataaaacgacagaatctcaggctgattttaaactggttgccagtgggtgcagcagtggcatcagttggattgataccactctgaccggaaatgcatcatcaagctcacctaagcttattataccgcagtctggtgattcatcttcgacgacaagtaatatcggtatgggtttcaaaaaacggactactgatgatgccactttccttaaacctaacagtgcggaaaagatacgctggagcacagacgagatgcagcccgataagggtcttgaaatgaccgttgcgctacgtgaaacagatgcagggcaaggcgtaccggggaattttcgtgcactggcgacgtttaatttcatctatcaataa

SEQ ID NO: 28701 - protein, 203 aa, Escherichia coli (strain K-12)
MEFGVRFSNYKGRQMIKTTPHKIVILMGILLSPSVFATDINVEFTATVKATTCNITLTGNNVTNDGNNNYTLRIPKMGLDKIANKTTESQADFKLVASGCSSGISWIDTTLTGNASSSSPKLIIPQSGDSSSTTSNIGMGFKKRTTDDATFLKPNSAEKIRWSTDEMQPDKGLEMTVALRETDAGQGVPGNFRALATFNFIYQ

SEQ ID NO: 28702 - DNA, 573 bp, Salmonella enterica subsp. enterica serovar Paratypi A str. ATCC
  CDS (1)..(573)
atgaaaagaaaccgcctcagtcttcccatcgcggcacttgccgtaatggcagcttctggaagcgcgcttgccgctaactccactaacctggatgttaatttcacggccacaattttagagacgacgtgtaacatgaaactggtcggtggtacaggctccgacacggtacaggaattaatcattggtaatagtagtggtgaagttcgtattgatgatgtaagagcgggaacagcaacggcagattttaaattagtgattgttgaatgcccggcatcgcttcaatcattaaagacatcaatcaacggaacgccatccgggtattcaacaaaaatattaacgaatggaacaaaaggctcagccgactatataggggtgtcagtagcgcgcgcatccaaaccagatgaaccttttgttattaactccaccgccgattcagaacgtctggtctggagtgaggtagaaattaacagtaaagaggttccgctgatcgccatcatgaaagagaccaaggcaaattcggctaccacaggggctttctcagccgttgcgactttcgtatttagctacgagtaa

SEQ ID NO: 28703 - protein, 190 aa, Salmonella enterica subsp. enterica serovar Paratypi A str. ATCC
MKRNRLSLPIAALAVMAASGSALAANSTNLDVNFTATILETTCNMKLVGGTGSDTVQELIIGNSSGEVRIDDVRAGTATADFKLVIVECPASLQSLKTSINGTPSGYSTKILTNGTKGSADYIGVSVARASKPDEPFVINSTADSERLVWSEVEINSKEVPLIAIMKETKANSATTGAFSAVATFVFSYE

SEQ ID NO: 28704 - DNA, 561 bp, Escherichia coli O157:H7
  CDS (1)..(561)
atggaaaattctatgaaaaggatactactaacatccgcgttaataggcctgggtttaccggcggttggctctgcaacagatcttaatgtcgattttacggccaccgtattagccaccacctgcacgataactatagtggaagatggtggtccagcagtgaccggtagtaacgatgaatacagcctgacaattcctgatgttggtctggataaagtcgctaccgctgcgcccgaagctcaggccaactttaaattaaaggcctccgattgcagcaatggttactcaaagatttttaccacacttacaggaacaacggtttccggtaagttaattgttaatgaagcaacctctggcgctgctggggtggggatggggattaagcgtagagataccgcagactcgactttcttcacacccaataatactgacaaatttgaatggagcgccgatgagaaagccagcggtgtgcctctgaccgtagcactgcgcgaaacaacggcgggagcaggacgcaccggtgcgtttcaggcaaaagccacctttaacttcacctacgaataa

SEQ ID NO: 28705 - protein, 186 aa, Escherichia coli O157:H7
MENSMKRILLTSALIGLGLPAVGSATDLNVDFTATVLATTCTITIVEDGGPAVTGSNDEYSLTIPDVGLDKVATAAPEAQANFKLKASDCSNGYSKIFTTLTGTTVSGKLIVNEATSGAAGVGMGIKRRDTADSTFFTPNNTDKFEWSADEKASGVPLTVALRETTAGAGRTGAFQAKATFNFTYE

SEQ ID NO: 28706 - DNA, 567 bp, Escherichia coli CFT073
  CDS (1)..(567)
atgataaaaatcacaccacataaaataacaatactcatgggactattgttatcgccttcggtatttgcaacggatgttaatgtcgattttaccgctaccgtgaaagcaacaacctgtaatattacacttaccggaactaatgtcactgataatggaaatgataagtacaccttagttattccctcgatgggaatggataaaatagccaataaaacagcacaatctgaagccaactttaaattggtagccaatggatgcagcagtggaattagctggattgatacaaccctgacaggaaatcaatcaggaagttcacccgcgctaattatccccctggccagtgatacaacctccactacaagctatatcggaatgggatttaaaaggaaagcgacctcaggcgatacatttctgaaacccaatagcacagaatacatacgctggagtgcatcagaaattagcaccgatggacttgagatgactgtcgcactgcgtgaaacaagtgtagggcaaggtgttccaggcaagtttcgcgcactggcaacttttaacttcagctatcaataa

SEQ ID NO: 28707 - protein, 188 aa, Escherichia coli CFT073
MIKITPHKITILMGLLLSPSVFATDVNVDFTATVKATTCNITLTGTNVTDNGNDKYTLVIPSMGMDKIANKTAQSEANFKLVANGCSSGISWIDTTLTGNQSGSSPALIIPLASDTTSTTSYIGMGFKRKATSGDTFLKPNSTEYIRWSASEISTDGLEMTVALRETSVGQGVPGKFRALATFNFSYQ

SEQ ID NO: 28708 - DNA, 567 bp, Salmonella enterica subsp. enterica serovar Typhi Ty2
  CDS (1)..(567)
atgaaaaggaataaataccttttagcagcctctgtgctcgccgtgatatttccgcttaccagtcaggcggaaaatatcaacgtcgactttaccgccaccgtgttagccacgacctgcagcatgtcaattgcggcgttagatggctcgaacttatcgggtgatgccaccagcggctatacgctgaacgtcggcgatgtcgggttggataaaattataaaaaaatcagcggaatcgcagaaaaactttaagtttgtcgcgaaggattgcagtgccgctctgaccaaaatcaccaccacgcttgccagctccacagatgccagcggcaattttatcaaaaaccaatcagcggcaagcggcgctgccaccaatgttggcatgggctttaagcgcaaaagcactaccgatgaaacctatttcacgcccggctcaggctcatttagctggacttccgacgagcgcgcagcaaacgaagtggaaatgacggtcgcgctgcgtgaactgaccgacggcgcgggtaccacaggtgctttcagctcaaccgctacgtttaacttcacttatcaataa

SEQ ID NO: 28709 - protein, 188 aa, Salmonella enterica subsp. enterica serovar Typhi Ty2
MKRNKYLLAASVLAVIFPLTSQAENINVDFTATVLATTCSMSIAALDGSNLSGDATSGYTLNVGDVGLDKIIKKSAESQKNFKFVAKDCSAALTKITTTLASSTDASGNFIKNQSAASGAATNVGMGFKRKSTTDETYFTPGSGSFSWTSDERAANEVEMTVALRELTDGAGTTGAFSSTATFNFTYQ

SEQ ID NO: 28710 - DNA, 585 bp, Salmonella dublin
  CDS (1)..(585)
atgaaacggaataaatctgtacttaccgcaccattattggggctgatattaccactagccagccagggggctgcgacccctaccgaaattaatgttgattttaccgcaacggtgattgagaccacctgtaattttattattgatactgccgtcagcccggctgttaaggaaaatacgcgtaatagtcagtatacattgactatacctaatgtttctttggataaaatcattagcgaagaccctgcggcgcagtctaattttacgctgaagactgataattgcagccctgggatttctgccattagcacaaaaatcaccagttccgcaggacgcactggcaacctgattaacaacagtctgtcaaacagtactgcggcaactaatatcggcatgggttttaaacgccagagcgatagcggtaataactttattactccggataacgccacgactatcacatggagttctgatgaaaggtcagcaggtttacccttgaccgttgccctgcgcatcgttaacagcagtggtacaacgtctaccggtgagtttgagtctaccgccaccttcaacttcacctataactaa

SEQ ID NO: 28711 - protein, 194 aa, Salmonella dublin
MKRNKSVLTAPLLGLILPLASQGAATPTEINVDFTATVIETTCNFIIDTAVSPAVKENTRNSQYTLTIPNVSLDKIISEDPAAQSNFTLKTDNCSPGISAISTKITSSAGRTGNLINNSLSNSTAATNIGMGFKRQSDSGNNFITPDNATTITWSSDERSAGLPLTVALRIVNSSGTTSTGEFESTATFNFTYN

SEQ ID NO: 28712 - DNA, 24 bp, Primer
atggaattcggtgtcagattcagt

SEQ ID NO: 28713 - DNA, 27 bp, Primer
ttattgatagatgaaattaaacgtcgc

SEQ ID NO: 28714 - protein, 198 aa, consensus
  MISC_FEATURE (1)..(198): consensus for the disclosure of xaa see table XV
MXXXXXXXXXXXXXXXXXXXXXXXXXXTXXNVXFTATVXXTTCXXXXXXXXXXXXXXXXXXXXYXLXXXXXXXDKXXXXXXXXXXXFKLXXXXCSXXXXXIXTXXXXXXXXXXXXXXXXXXXXXXXXXXXXGMGXKRXXXXXXXFXXPXXXXXXXWXXXEXXXXXXXXXXTVALREXXXXGXXXXGXFXXXATFNFXY

SEQ ID NO: 28715 - protein, 18 aa, consensus
  MISC_FEATURE (1)..(18): consensus for the disclosure of xaa see table XV
XXVXFTATXXXTTCXXXX

SEQ ID NO: 28716 - protein, 13 aa, consensus
  MISC_FEATURE (1)..(13): consensus for the disclosure of xaa see table XV
GXFXXXATFXFXY

SEQ ID NO: 28717 - DNA, 1425 bp, Escherichia coli K12
  CDS (1)..(1425)
atgaaaaaaaccacattagcactgagtgcactggctctgagtttaggtttggcgttatctccgctctctgcaacggcggctgagacttcttcagcaacgacagcccagcagatgccaagccttgcaccgatgctcgaaaaggtgatgccttcagtggtcagcattaacgtagaaggtagcacaaccgttaatacgccgcgtatgccgcgtaatttccagcagttcttcggtgatgattctccgttctgccaggaaggttctccgttccagagctctccgttctgccagggtggccagggcggtaatggtggcggccagcaacagaaattcatggcgctgggttccggcgtcatcattgatgccgataaaggctatgtcgtcaccaacaaccacgttgttgataacgcgacggtcattaaagttcaactgagcgatggccgtaagttcgacgcgaagatggttggcaaagatccgcgctctgatatcgcgctgatccaaatccagaacccgaaaaacctgaccgcaattaagatggcggattctgatgcactgcgcgtgggtgattacaccgtagcgattggtaacccgtttggtctgggcgagacggtaacttccgggattgtctctgcgctggggcgtagcggcctgaatgccgaaaactacgaaaacttcatccagaccgatgcagcgatcaaccgtggtaactccggtggtgcgctggttaacctgaacggcgaactgatcggtatcaacaccgcgatcctcgcaccggacggcggcaacatcggtatcggttttgctatcccgagtaacatggtgaaaaacctgacctcgcagatggtggaatacggccaggtgaaacgcggtgagctgggtattatggggactgagctgaactccgaactggcgaaagcgatgaaagttgacgcccagcgcggtgctttcgtaagccaggttctgcctaattcctccgctgcaaaagcgggcattaaagcgggtgatgtgatcacctcactgaacggtaagccgatcagcagctttgccgcactgcgtgctcaggtgggtactatgccggtaggcagcaaactgaccctgggcttactgcgcgacggtaagcaggttaacgtgaacctggaactgcagcagagcagccagaatcaggttgattccagctccatcttcaacggcattgaaggcgctgagatgagcaacaaaggcaaagatcagggcgtggtagtgaacaacgtgaaaacgggcactccggctgcgcagatcggcctgaagaaaggtgatgtgattattggcgcgaaccagcaggcagtgaaaaacatcgctgaactgcgtaaagttctcgacagcaaaccgtctgtgctggcactcaacattcagcgcggcgacagcaccatctacctgttaatgcagtaa

SEQ ID NO: 28718 - protein, 474 aa, Escherichia coli K12
MKKTTLALSALALSLGLALSPLSATAAETSSATTAQQMPSLAPMLEKVMPSVVSINVEGSTTVNTPRMPRNFQQFFGDDSPFCQEGSPFQSSPFCQGGQGGNGGGQQQKFMALGSGVIIDADKGYVVTNNHVVDNATVIKVQLSDGRKFDAKMVGKDPRSDIALIQIQNPKNLTAIKMADSDALRVGDYTVAIGNPFGLGETVTSGIVSALGRSGLNAENYENFIQTDAAINRGNSGGALVNLNGELIGINTAILAPDGGNIGIGFAIPSNMVKNLTSQMVEYGQVKRGELGIMGTELNSELAKAMKVDAQRGAFVSQVLPNSSAAKAGIKAGDVITSLNGKPISSFAALRAQVGTMPVGSKLTLGLLRDGKQVNVNLELQQSSQNQVDSSSIFNGIEGAEMSNKGKDQGVVVNNVKTGTPAAQIGLKKGDVIIGANQQAVKNIAELRKVLDSKPSVLALNIQRGDSTIYLLMQ

SEQ ID NO: 28719 - DNA, 1401 bp, Haemophilus influenzae
  CDS (1)..(1401)
atgaaaaaaacacgttttgtattaaatagtattgcacttggattaagtgtattaagcacatcatttgttgctcatgttgctcaagccactttgccaagttttgtttcagaacaaaacagtcttgcaccgatgttagaaaaagtacaacctgccgttgtcactctttccgttgaaggaaaagctaaagtagattctcgttctcctttcctagacgatattcctgaagaatttaaattcttctttggcgatcgttttgccgaacaatttggtgggcgtggagaatcaaagcgtaacttccgtggtttaggttctggtgtcattattaatgcaagcaaaggctatgttttaaccaataatcatgttattgatggagctgataaaattaccgtgcaattacaagatgggcgtgaatttaaagcaaaattagtgggtaaggatgaacaatcagatattgcattagtacagcttgaaaaaccaagtaatttaacagaaatcaaatttgctgattccgacaaattacgcgtaggcgatttcactgttgcaatcggtaatccatttggtttaggtcaaactgtgacatcaggtattgtttctgcattgggtcgttcaacaggttctgacagtggcacttatgaaaactatattcaaaccgatgcagcagtaaaccgaggtaattcgggtggtgcattagtcaatctaaatggcgaacttattggaattaataccgcaattatttctccaagcggtggcaatgcaggaattgcctttgcgattccaagtaatcaagcaagcaatttagtgcaacaaattttagaatttggtcaagtgcgtcgcggattgcttggtattaaagggggcgaactcaatgctgatttagccaaagcctttaatgtaagcgcgcaacaaggtgcatttgtaagtgaagttttaccgaaatctgctgctgaaaaagcaggacttaaagcgggcgatattatcacggcgatgaacggtcaaaaaatctcaagtttcgctgaaattcgtgcaaaaatcgcaaccactggtgcaggcaaagagattagcttgacttacttacgtgatggcaaatcccacgacgttaaaatgaaattacaagcggatgatagtagccaactttcctcaaaaactgagttgcctgcattagatggcgcaacattgaaagactacgatgctaaaggcgttaaaggaattgaaatcacaaaaattcaacctaattcgctagctgcacaacgtggtttaaaatcgggcgatattattattggtattaatcgtcaaatgatcgaaaacattcgtgaattaaataaagtgcttgaaactgaaccgtcagcagttgcacttaatattttacgaggtgacagtaatttctatttattagtgcaataa

SEQ ID NO: 28720 - protein, 466 aa, Haemophilus influenzae
MKKTRFVLNSIALGLSVLSTSFVAHVAQATLPSFVSEQNSLAPMLEKVQPAVVTLSVEGKAKVDSRSPFLDDIPEEFKFFFGDRFAEQFGGRGESKRNFRGLGSGVIINASKGYVLTNNHVIDGADKITVQLQDGREFKAKLVGKDEQSDIALVQLEKPSNLTEIKFADSDKLRVGDFTVAIGNPFGLGQTVTSGIVSALGRSTGSDSGTYENYIQTDAAVNRGNSGGALVNLNGELIGINTAIISPSGGNAGIAFAIPSNQASNLVQQILEFGQVRRGLLGIKGGELNADLAKAFNVSAQQGAFVSEVLPKSAAEKAGLKAGDIITAMNGQKISSFAEIRAKIATTGAGKEISLTYLRDGKSHDVKMKLQADDSSQLSSKTELPALDGATLKDYDAKGVKGIEITKIQPNSLAAQRGLKSGDIIIGINRQMIENIRELNKVLETEPSAVALNILRGDSNFYLLVQ

SEQ ID NO: 28721 - DNA, 1350 bp, Bacillus subtilis
  CDS (1)..(1350)
atggataactatcgtgatgaaaacagaacgaaaggtaatgagaatgaggtctttttaacgaaagagaacgatcagagcgcctcctactcggcccgcaatgtcattcatgatcaggagaagaaaaaacgaggattcggatggttcagaccgttgcttggcggagtgatcggcggcagtcttgctcttggcatttacacgtttacaccgcttggtaaccatgattctcaggacactgcaaaacaatcatccagccagcagcaaacgcaatctgttacagcaacaagcacctcctctgaatctaaaaaaagctcaagcagctcatctgcattcaagagcgaggactcttctaaaatctcagatatggtagaagacctttcaccagcgattgtcggtattacaaatcttcaggcacaatcaaacagctctttgttcggctctagttcttctgattccagcgaagatacagaaagcggttcagggtcaggtgtcattttcaaaaaagagaatggcaaggcttatatcattacaaataaccacgtcgtagaaggggcatcatcactgaaggtatctttatatgacggcactgaggttactgcaaagctggtaggcagtgactcgttaactgatttagccgtcctccaaatcagtgatgaccacgtcacaaaagtggcaaacttcggtgattcatctgatcttagaacaggcgagaccgttattgcgattggggatccgcttggaaaagacctgtcccgcacagtaacacaaggaattgtaagcggcgtggacagaacggtttcaatgtctacatcagccggcgaaacgagcattaacgtcattcagacagacgcagcaattaatccaggtaacagcggcggtcctttgttaaatacagacggcaaaattgtcggcattaacagtatgaaaatcagtgaggatgatgttgagggtatcggattcgccattccaagcaatgacgtaaaaccgattgctgaagaattgctgtctaaaggacaaattgaacgtccatatatcggtgtcagcatgcttgatctagagcaagtgccgcaaaattaccaagaaggcacactcggcctgttcggcagccagctgaataaaggcgtttacatccgtgaggtcgcttcaggctctcctgctgaaaaggccggattaaaagcggaggatattatcatcggcctaaaaggtaaagaaattgatacaggcagtgaattgcgcaatatcttatataaagacgcaaagatcggtgataccgttgaagtgaaaattctccgaaacggcaaagaaatgacgaaaaaaattaaactggatcaaaaagaagagaaaacttcgtaa

SEQ ID NO: 28722 - protein, 449 aa, Bacillus subtilis
MDNYRDENRTKGNENEVFLTKENDQSASYSARNVIHDQEKKKRGFGWFRPLLGGVIGGSLALGIYTFTPLGNHDSQDTAKQSSSQQQTQSVTATSTSSESKKSSSSSSAFKSEDSSKISDMVEDLSPAIVGITNLQAQSNSSLFGSSSSDSSEDTESGSGSGVIFKKENGKAYIITNNHVVEGASSLKVSLYDGTEVTAKLVGSDSLTDLAVLQISDDHVTKVANFGDSSDLRTGETVIAIGDPLGKDLSRTVTQGIVSGVDRTVSMSTSAGETSINVIQTDAAINPGNSGGPLLNTDGKIVGINSMKISEDDVEGIGFAIPSNDVKPIAEELLSKGQIERPYIGVSMLDLEQVPQNYQEGTLGLFGSQLNKGVYIREVASGSPAEKAGLKAEDIIIGLKGKEIDTGSELRNILYKDAKIGDTVEVKILRNGKEMTKKIKLDQKEEKTS

SEQ ID NO: 28723 - DNA, 1545 bp, Xylella fastidiosa
  CDS (1)..(1545)
atgaattcacgtatccatacacgatgcttcggcctactcgccatcaccttgccgttagctgcctgtggcgcgcaacacaacaacagccccactcccactgcaccctccacccccattgtgacccccagcaccaccccagcaccacagctcgtggctgggttgccagatttcacccaactggtcgaccaagtagggcctggcgtggtcaacattgaaaccgtcattacccgtaagaaagtcgggaaacgtcgcggcataccgcttgacaacgatatacccgagtttttccggcgtttctttggcccagatttccagatgccgaaccaacctcgtggcggccaggatgacgagggaggtatcgctggtcggggaatgggctctggcttcatcatttccaaagacggctacatactcaccaaccatcacgtcatcactggcgcgagcgaggtcacaatcaaattgactgatcgccgcgaattcaaagcaaaaatcatcggtagcgacgaacagtacgatgttgctttactcaaaatcgatgcaaaaaatctacccaccgtgcgtatcggcgactccagttcacttaaatcgggtcagtgggtcgttgcgatcggctcccccttcggattagatcactcagtcactgcagggatagtcagcgccctgggacgcagcaccagtgacgatcaacgctatgtcccatttatccaaaccgacgtacccattaaccagggaaattctggtggtccattgctgaatacccgaggtgaagtgattggtatcaactcgcaaatattttccgcctcaggcggctacatgggtattagctttgccattccaatcaatttggcaatcaacgctgccgaacaaatccgtaaaacaggcaaagtgcaacgcagtatgctcggtgtggaaatcggccctatcgacgcactcaaagctcaaggcctaggcttaccggacagccgaggcgcactggtcaataacattccaccccacagcccggccgccaaagcagggattgaagtcggtgacgtcatccgctcagtgaacggcaaagtaatcagtagcttcagcgatctgcctccactgatcggcatgatgccgccaggcaccaaagccaccctgggtattatccgtgacggcaaaccgcgcgagatcgtcgtcactctttcggcactcaatcaggatgcaacagccagcgaagatgaagacgacacagcaccttccaaaccagaaacctctgccaatgtcgaactgctcggccttcaagtcgaaaacctgagcgctgctgagcgcgaacgcctggcctcatcgcaaaacgcgaagggaggagtccgtatcacagcagtcacagcgccgtgggcacgcaacgccaacccgccattagtggaaggtttagttatcctaaggatcggccgcactccggttagcaatgtggcagaactgaaccgtgtcctaggaaattataagaagggagatgtcatcatgctgctggtgaccaacggccgtggcacgttctacagtgcgttgaaagcaggcggctaa

SEQ ID NO: 28724 - protein, 514 aa, Xylella fastidiosa
MNSRIHTRCFGLLAITLPLAACGAQHNNSPTPTAPSTPIVTPSTTPAPQLVAGLPDFTQLVDQVGPGVVNIETVITRKKVGKRRGIPLDNDIPEFFRRFFGPDFQMPNQPRGGQDDEGGIAGRGMGSGFIISKDGYILTNHHVITGASEVTIKLTDRREFKAKIIGSDEQYDVALLKIDAKNLPTVRIGDSSSLKSGQWVVAIGSPFGLDHSVTAGIVSALGRSTSDDQRYVPFIQTDVPINQGNSGGPLLNTRGEVIGINSQIFSASGGYMGISFAIPINLAINAAEQIRKTGKVQRSMLGVEIGPIDALKAQGLGLPDSRGALVNNIPPHSPAAKAGIEVGDVIRSVNGKVISSFSDLPPLIGMMPPGTKATLGIIRDGKPREIVVTLSALNQDATASEDEDDTAPSKPETSANVELLGLQVENLSAAERERLASSQNAKGGVRITAVTAPWARNANPPLVEGLVILRIGRTPVSNVAELNRVLGNYKKGDVIMLLVTNGRGTFYSALKAGG

SEQ ID NO: 28725 - DNA, 1251 bp, Nostoc sp. PCC 7120
  CDS (1)..(1251)
atgaagacatataatggcgaagcaaacaagattcatacttcgagtttgccccacaaggggggcagtagtgcgattttgatgctgctgggtggggtaacagctatgtttctaggaagctgctcctttctacccacaaggacaatacaatcccaagccaatcaatctcagccccagtctaatgataatagtccagcaattgtccctccagctattttttcatccaccggcgaccctaattttgtcgtcggagtagtacaaaaagtgggaggggctgtagttcggattgattctgccagaacagtaacttccagggttccaaatgaatttaatgatccttttttccgccgctttttcggagatggagtgccagcacaaccaagacagcgagtagaaaggggtagcggttcaggttttattattagttcctctggtcaaattttaactaatgcccatgttgttgatggtgctgatgaggtaacagttaccctcaaggatggtaggagttttgatggtaaggtacttggtgaagacccggtaacggatgtagccgtcattcaaataaacgctaataacttgccaactgtcgctgtcggtaattctgaagttttacaaccaggtgaagcagttattgcaattggtaatcctctaggcttgaataatagtgttacgtcaggaattatcagcgccacaggtcgttctggtagtgatattggcgcaagtgataagcgcgttgactatttgcaaacagacgcggcgattaatcctggtaactctggcggccccctgctcaatgctcgcggtcaggtaattggtatgaacacagctattatccaaggcgctcaaggtttgggatttgctattcctatcaacactgtgcagaaagtctctcaggaattaatcactcaaggtaaggtagatcatccctatttgggtgtacagatggcaaccctcacgccacaagttaaggaaagaattaacgaaagatttggcgatcgcatcaatattacagcagatagaggcgttttactagttcgtattgtccctggctctcccgccgccaatgctggacttagaccaggagatatcattcaaagcattaataatcaatctgtaacaaccgttgaacaagtccaaaaaattgtagaaaatagccaaattggccaacctttacaaattcaaatagaacgcaatggccaaacaacacaagtaaacgtcagtccagcacctttacctgcgcggagagaggggtag

SEQ ID NO: 28726 - protein, 416 aa, Nostoc sp. PCC 7120
MKTYNGEANKIHTSSLPHKGGSSAILMLLGGVTAMFLGSCSFLPTRTIQSQANQSQPQSNDNSPAIVPPAIFSSTGDPNFVVGVVQKVGGAVVRIDSARTVTSRVPNEFNDPFFRRFFGDGVPAQPRQRVERGSGSGFIISSSGQILTNAHVVDGADEVTVTLKDGRSFDGKVLGEDPVTDVAVIQINANNLPTVAVGNSEVLQPGEAVIAIGNPLGLNNSVTSGIISATGRSGSDIGASDKRVDYLQTDAAINPGNSGGPLLNARGQVIGMNTAIIQGAQGLGFAIPINTVQKVSQELITQGKVDHPYLGVQMATLTPQVKERINERFGDRINITADRGVLLVRIVPGSPAANAGLRPGDIIQSINNQSVTTVEQVQKIVENSQIGQPLQIQIERNGQTTQVNVSPAPLPARREG

SEQ ID NO: 28727 - DNA, 1428 bp, Salmonella enterica subsp. enterica serovar Typhi
  CDS (1)..(1428)
atgaaaaaaaccacattagcaatgagtgcactggctctgagtttaggtttggcattgtcgcctctgtctgccacggcggctgaaacgtcctcttcagcaatgactgcccagcagatgccaagcctggcaccgatgctcgaaaaagtgatgccatcggtggtcagtattaatgtagaaggtagcaccacggtgaatacgccgcgtatgccgcgtaatttccagcaattctttggcgatgactccccgttctgccaggacggttctccgttccagaattctccgttctgccagggcggcggtaacggcggcaacggcggtcaacaacagaaattcatggcgctgggctccggcgtaattattgacgccgcgaagggctacgtcgtcaccaacaaccacgtggttgataacgccagcgtgattaaagtacagcttagcgatgggcgtaaattcgatgctaaagtggtgggcaaagatccgcgttctgatatcgcgctgattcaaattcagaatccgaagaacctgacggcgattaagctggcggactccgacgcgctgcgcgtgggggattataccgtcgctattggtaacccgtttggtctgggcgaaacggtgacgtcaggtatcgtttcggcgctggggcgtagcggcctgaacgtagaaaattacgagaactttattcagaccgacgccgcgattaaccgcggtaactccggcggcgcgctggtgaacctgaacggtgagctgatcggtattaacaccgcgattctggcgccggacggcggcaacatcggtatcggcttcgctatccccagtaacatggtgaaaaacctgacgtcgcagatggtggaatacggccaggtgaaacgcggcgaactggggatcatggggactgagctgagctctgagctggcgaaagcgatgaaagtcgacgcccagcgtggcgcgttcgtcagccaggtgatgccgaattcgtccgcagcgaaagcgggtatcaaagccggggatgtcattacctcgctgaacggtaaaccgatcagcagctttgcggcgctgcgcgctcaggtcggcactatgccggtcggcagcaaaatcagcctcggtctgctgcgtgaaggtaaagcgattacggttaatctggaactgcagcagagcagccagagtcaggttgattccagcaccatcttcagcgggattgagggcgctgaaatgagtaataaaggccaggataaaggcgttgtggtgagcagcgtgaaagcgaactcacccgccgcgcaaattggcctcaaaaaaggcgatgtgattatcggcgctaaccagcagccggtgaaaaatatcgccgagctgcgtaagattctcgacagcaagccgtcggtgctggcgctgaatattcagcgtggtgatagttctatttatttgctgatgcagtaa

SEQ ID NO: 28728 - protein, 475 aa, Salmonella enterica subsp. enterica serovar Typhi
MKKTTLAMSALALSLGLALSPLSATAAETSSSAMTAQQMPSLAPMLEKVMPSVVSINVEGSTTVNTPRMPRNFQQFFGDDSPFCQDGSPFQNSPFCQGGGNGGNGGQQQKFMALGSGVIIDAAKGYVVTNNHVVDNASVIKVQLSDGRKFDAKVVGKDPRSDIALIQIQNPKNLTAIKLADSDALRVGDYTVAIGNPFGLGETVTSGIVSALGRSGLNVENYENFIQTDAAINRGNSGGALVNLNGELIGINTAILAPDGGNIGIGFAIPSNMVKNLTSQMVEYGQVKRGELGIMGTELSSELAKAMKVDAQRGAFVSQVMPNSSAAKAGIKAGDVITSLNGKPISSFAALRAQVGTMPVGSKISLGLLREGKAITVNLELQQSSQSQVDSSTIFSGIEGAEMSNKGQDKGVVVSSVKANSPAAQIGLKKGDVIIGANQQPVKNIAELRKILDSKPSVLALNIQRGDSSIYLLMQ

SEQ ID NO: 28729 - DNA, 1290 bp, Nostoc sp. PCC 7120
  CDS (1)..(1290)
atgctatctaaagtagtaataaacatagtttccttgctcacggccatgcaaaaccaagtacacgatgaatctcaaccgttaaatcctaaaaaccataatcatgcaccttggaaaaaagcggctgcatctctatcactagtactgctgggatctggtatgactttagctggtggatatttagcaggaaaccagcagcaattggcacaaaaagcatctgacttggcggtgagccgagtagatgcagcaccaccattaggaaataacacagaccccaactttgtgactcaagtggtgcaaagagttgggccggctgtggtgcggattgaagcgtctcggactgtcacatctcgattaccagccgagtttaacgacccatttttccgccgcttcttcggttctcaactacctcaacaacaagaaagagtacaacggggtactggttccggctttcttattagtgctgatggcagtattcttaccaatgctcacgttgttgatggtgcagatacagtgcgggtcatcctcaaagatgggcgcagttttcagggtaaagtattaggtacagataatttaacagatgtagctgttgtcaaaattcaggcaaataacttgccaaccttaacggtgggtaattctgaccaattacaaccaggacaatgggcgatcgctattggtaatcctttaggtttagataacaccgtcaccacaggtataattagtgcgactggacgtaccagcaatcaaattggcgcacctgataagcgcgtagaatatattcaaactgacgcggcaattaatccaggtaactctggtggccccttgctgaattatcgtggtgaagtgattgggatgaataccgccattattcaaggcgcacagggtctaggttttgccatccctatcaaaacagcacaacgtatttctaatcaacttatagctaccggtaaagtacagcatccttaccttggtattcaaatggtagggttaacaccgcaaatcaagcaaaacattaactctgaccccaatagcggtttaactgtagatagagacaagggtgttttagtggtcagagtcctgccaaactcgccagccgcaagagcagggctacgcgctggtgatgtcattcaaaagctgaatggccaagctgttacagatgctagcaatgtacagagagccgttgagaacgctcaagttggtggacaattgcagctagaattatggcgcaatggtcgaaatctcaacttagccgtacaagcaggcgctttcccgacccaacaacaggtgaaataa

SEQ ID NO: 28730 - protein, 429 aa, Nostoc sp. PCC 7120
MLSKVVINIVSLLTAMQNQVHDESQPLNPKNHNHAPWKKAAASLSLVLLGSGMTLAGGYLAGNQQQLAQKASDLAVSRVDAAPPLGNNTDPNFVTQVVQRVGPAVVRIEASRTVTSRLPAEFNDPFFRRFFGSQLPQQQERVQRGTGSGFLISADGSILTNAHVVDGADTVRVILKDGRSFQGKVLGTDNLTDVAVVKIQANNLPTLTVGNSDQLQPGQWAIAIGNPLGLDNTVTTGIISATGRTSNQIGAPDKRVEYIQTDAAINPGNSGGPLLNYRGEVIGMNTAIIQGAQGLGFAIPIKTAQRISNQLIATGKVQHPYLGIQMVGLTPQIKQNINSDPNSGLTVDRDKGVLVVRVLPNSPAARAGLRAGDVIQKLNGQAVTDASNVQRAVENAQVGGQLQLELWRNGRNLNLAVQAGAFPTQQQVK

SEQ ID NO: 28731 - DNA, 1206 bp, Nostoc sp. PCC 7120
  CDS (1)..(1206)
atgaatttatccctaaagcaactggccgtttatctgtctctactagtggttggtggtagtgcaggtttgttaggcagtcgctatctcctcccacaaaatcgctcgttccaacaactcaaaaatgtcacagtcggtttgccctcggagtctgtagcgcctaatgctgtaaaaggctctgcggcaaataatggaggggataatgtcaattttattgctagtgctgtgcagaaagttggcccggctgtagtgcgaattaatgccacccgtaaagtcgccaatcccatctctgatgttttaaagaatcctctattgcgtcgatttttcggtgaagatgaacagccaattccgcaagaacgaattgagaggggtacaggttcgggatttattttgagcgaagatgggcaattactcactaatgctcatgtagtagctgatacagacaccgtacaagtaactcttaaggatggccggacttttgaagggaaggtactgggagttgaccctattacagatgtagctgttgtcaaaatccccggaaaaaacttgccgacagtggatttggggaattcgcaaaatctcattccgggacaatgggcgatcgctattggcaatcctctcggtttagataatactgtgactatcggcattatcagcgctaccgaccgcaccagcgcccaagtcggtgttcctgataagcgagtcagtttcattcaaacagatgcagcaattaaccctggtaattctggcgggcctttgttaaacgctcaaggggaagtaattggagttaacactgctattcgtgcagatgctcaaggtcttggctttgctattcctatagaaacagccgcccgtgtcgctaatgagctttttactaaggggagtgtacaacatccgtttttagggattgaaatgacagacttgtcccctagcaaaaaacagcaaataaatattgaaaacaagttaaatattcgacaagacactggggtggtaattaaaagtgtcttggatgattccccagccaaaaaagcaggcttgctccctggtgatgtaattcaaaaaatcaatagtaaaacggtgaaaacatcagcccaggtacaaaaattggtcgaatccagcacagttggagatatcctagccgtcgaagttaatcgcagtggtgaaattctcaccttaaaggttcagtcgggagtttatcccaacagatag

SEQ ID NO: 28732 - protein, 401 aa, Nostoc sp. PCC 7120
MNLSLKQLAVYLSLLVVGGSAGLLGSRYLLPQNRSFQQLKNVTVGLPSESVAPNAVKGSAANNGGDNVNFIASAVQKVGPAVVRINATRKVANPISDVLKNPLLRRFFGEDEQPIPQERIERGTGSGFILSEDGQLLTNAHVVADTDTVQVTLKDGRTFEGKVLGVDPITDVAVVKIPGKNLPTVDLGNSQNLIPGQWAIAIGNPLGLDNTVTIGIISATDRTSAQVGVPDKRVSFIQTDAAINPGNSGGPLLNAQGEVIGVNTAIRADAQGLGFAIPIETAARVANELFTKGSVQHPFLGIEMTDLSPSKKQQINIENKLNIRQDTGVVIKSVLDDSPAKKAGLLPGDVIQKINSKTVKTSAQVQKLVESSTVGDILAVEVNRSGEILTLKVQSGVYPNR

SEQ ID NO: 28733 - DNA, 1545 bp, Agrobacterium tumefaciens
  CDS (1)..(1545)
atggccgtgacccttctttcgccttttcgcagcagcattgccgcagttgcgggcatcgcgcttgtggcgggcagcctttcggcgccggttgcggcaagagcgcagagccatgggccggaatcggtggctgatcttgccgagccgctgctcgatgcggtggtgaatatttccacgtcccagaacgtcaagaccgagggcaagggtccagttccgccgaagctgccggaaggttcgcccttccaggagttcttcaaggattatttcgacagccagaagccggaaggcggcgaaaaggtcaattcgctggggtcgggtttcgtgatcgatccggctggctatgtcgtgaccaacaaccacgtcatcgagggtgctgatgccatcgaggtgattttcccgaatggctcgaagctcaaggcgacgctggtcggtaccgataccaagaccgacctttcggtcctgaaggtggagccgaaaacaccgctgaaggccgtgaagttcggcgattcgcgcagcatgcgcatcggcgactgggtgatggctgtcggcaatccgttcgggcttggcggatcgctgaccgtgggcgtcatttccgcgcgcggccgcaatatcaatgccggcccctatgacaatttcatccagacggatgcggccatcaacaagggtaactccggtggcccgctcttcaacatgaagggtgaggtgatcggcatcaatacggcgatcatttcgccgagcggcggttcgatcggtattggtttcgccgtaccgacggagcttgcccagaatatcgtgcagcagctcatcgaattcggcgagacccgccgcggctggctcggcgttcgcgttcagcctgttactgatgatgtggctgcgagcctcggcatggacagcgccaagggcgcgctgatatcaggcgtggccaagggcggcccggtggagaacggcccgatccaggcgggtgatgtcgtgctgaagttcgacggcaaggatatcaatgaaatgcgcgacctcttgcgtatcgtggcggaaagccctgtcggcaaggaagtcgatgttgtcgtttatcgcgacggcaaggaagagaccgtcaaggtcaagctcgggcaattgcaggatacgaccgacgagaaggcctcgaccgacgacccgcagggtgaagacggtgatggcagcatggtcgcccccgacgataaagacggtggcgacgatcaggcgcaggaccagacacctgaagtgcgcgaagcaccgcagaccgtgctcggcatgaatctcgtggtgctgagcaatgagctgcgcacggaaaagggcattgccgaaagcgtggaaggcgtgcttgtcgcaagcgtcgatcccggttctcccgccgaacagaagggcatgaaggccggcgacgtcatcgtcgaggtcgggcaggatttcatggaagttcctggcgacgtgctggtacgtgtgaacggcctgaagtccgaaggccgcaagaacgcgcatatgatggtggcggatgctcagggcaatctgcgcgtggtggcgttgccgctggaataa

SEQ ID NO: 28734 - protein, 514 aa, Agrobacterium tumefaciens
MAVTLLSPFRSSIAAVAGIALVAGSLSAPVAARAQSHGPESVADLAEPLLDAVVNISTSQNVKTEGKGPVPPKLPEGSPFQEFFKDYFDSQKPEGGEKVNSLGSGFVIDPAGYVVTNNHVIEGADAIEVIFPNGSKLKATLVGTDTKTDLSVLKVEPKTPLKAVKFGDSRSMRIGDWVMAVGNPFGLGGSLTVGVISARGRNINAGPYDNFIQTDAAINKGNSGGPLFNMKGEVIGINTAIISPSGGSIGIGFAVPTELAQNIVQQLIEFGETRRGWLGVRVQPVTDDVAASLGMDSAKGALISGVAKGGPVENGPIQAGDVVLKFDGKDINEMRDLLRIVAESPVGKEVDVVVYRDGKEETVKVKLGQLQDTTDEKASTDDPQGEDGDGSMVAPDDKDGGDDQAQDQTPEVREAPQTVLGMNLVVLSNELRTEKGIAESVEGVLVASVDPGSPAEQKGMKAGDVIVEVGQDFMEVPGDVLVRVNGLKSEGRKNAHMMVADAQGNLRVVALPLE

SEQ ID NO: 28735 - DNA, 1446 bp, Yersinia pestis
  CDS (1)..(1446)
atgaaaaaaacaactttagtattaagtgcattggcattgagcattggtttcgccatgggcccggtttcttccgtcgttgcggcagagacggcagcatcgagtagccagcagctccctagcctggcgccaatgctagagaaagtaatgccttcagtggtcagtatcaacgttgaaggtagtgcgcctgtaagcagtgctggtgcacgcggtatgccaccacaattccagcagttttttggtgataactcgccattctgtcaggacggttcaccgttccaaggctcgccaatgtgtcaaggggatctgggcggactagggcagggaatgccaagtaagcgggaattccgttcgcttggttcaggtgtcattattgatgcgggcaaggggtatgtcgttaccaataaccacgtggtcgataatgcgaacaagatcagcgtaaaactgagcgatggccgcagttttgatgccaaggtgatcggtaaagatccacgtaccgatatcgcactgttacaactgaaagacgctaaaaatctgactgcgattaagattgccaattcggatcaactgcgtgtcggtgattataccgtcgctatcgggaacccgtatggcttgggtgaaaccgtgacatccggtattgtctctgctttagggcgcagtggtttgaatgtagaaaactatgaaaactttatccagactgatgcggcgattaaccgtggtaattccggcggcgcattaatcaacctgaacggtgagttgattggtattaacaccgctattctggcaccggatggcggtaacattggtattggctttgctatcccaagcaacatggtgaagaacctgacatcacagatggttgagtttggtcaggtaaaacgcggtgaactgggcattatggggaccgagctaaactctgaactggcaaaagccatgaaggttgatgcgcagaaaggtgcctttatcagccaggtcgtgcctaaatctgctgcggcaaaagcgggtatcaaagcgggcgatatcattgtcagtatgaatgggaaagccatcaatagttttgcagggttccgcgccgagatcggcacgttacctgttggcagcaaaatgaccttgggtctgctgcgtgatggcaaaccgatcaatgtggatgtcgtcctggagcagagcagccacagtcaggtggaatccggcaatctctacaccggtattgagggggctgaactgagtaacagcgacgttagcggcaagaaaggggtgaaagttgatagcgtaaaaccaggcactgctgcggcgcgtatcggcctgaaaaaaggtgatatcatcatggggattaaccagcaaccagtccagaacctaggtgagctgcggaaaatcctcgatgctaaaccaccggtattggcgttgaatattcaacgtggtgatacttcactctatttattgatgcagtaa

SEQ ID NO: 28736 - protein, 481 aa, Yersinia pestis
MKKTTLVLSALALSIGFAMGPVSSVVAAETAASSSQQLPSLAPMLEKVMPSVVSINVEGSAPVSSAGARGMPPQFQQFFGDNSPFCQDGSPFQGSPMCQGDLGGLGQGMPSKREFRSLGSGVIIDAGKGYVVTNNHVVDNANKISVKLSDGRSFDAKVIGKDPRTDIALLQLKDAKNLTAIKIANSDQLRVGDYTVAIGNPYGLGETVTSGIVSALGRSGLNVENYENFIQTDAAINRGNSGGALINLNGELIGINTAILAPDGGNIGIGFAIPSNMVKNLTSQMVEFGQVKRGELGIMGTELNSELAKAMKVDAQKGAFISQVVPKSAAAKAGIKAGDIIVSMNGKAINSFAGFRAEIGTLPVGSKMTLGLLRDGKPINVDVVLEQSSHSQVESGNLYTGIEGAELSNSDVSGKKGVKVDSVKPGTAAARIGLKKGDIIMGINQQPVQNLGELRKILDAKPPVLALNIQRGDTSLYLLMQ

SEQ ID NO: 28737 - DNA, 1572 bp, Agrobacterium tumefaciens
  CDS (1)..(1572)
atgtctcattcgcaaaacggccattcctcgctgaagacggcctcgctgaagacggccctgaaggccacgaccgttggcggcctcgcggcgctgatgctgtcgaccggtatcgccgcaccgatcctccactcctttgctgcccccgtcgaagtgaccgcaccgcaggttccgagcttcgccaatgtggttgatgccgtctcgcccgccgtcgtttccgttcgcgtgcagtcgaacgtgcagccggcttccgacgattccagcaacttctccttcaatttcggcggccgcggcctcgaccagctgccggatgatcacccgctgaagcgtttcttcaaggaattcggcggccagaaccaggatcgctccgaccgtggtccgaaccgccaccgtgacggcaagggtccgctgcgcccggtcgcgcaaggctccggcttcttcatctccgaagacggttatgtcgtcaccaacaatcacgtcgttgacgacggttccgcctatacggtcgtgatgaatgacggtaccgaactcgaagccaagcttgtcggccgcgatccgcgtaccgatctggcgctgctgaaggtcgatgtgaaccgcaagttcacctatgtgaaattcgccgatgacaccaagattcgcgtcggtgactgggtcgttgccgtcggtaaccccttcggcctcggcggtacggtgacgtcaggtatcatttcggcccgcggccgtgacatcggctcaggcccctatgacgactatctgcagatcgacgctgccgtgaaccgtggtaactcgggtggtcccgccttcaaccttaacggtgaagtggtgggcatcaacaccgccatcttctcgccctccggcggcaatgtcggtatcgccttcgccatcccgtcctcggtcgccaaggatgtgatcgccgacctgcaaaaggacggcaaggtcgaacgcggctggctcggcgtgcagatccagcccgtcagcaaggatatcgccgaatcgctcggccttgccgaagccaagggcgcgctggtcgtttcgccgcagtccggttctccgggcgacaaggccggcatcaagcagggtgacatcatcaccgccgtcaacggcgatccggtcaaggatgcccgcgatctgtcgcgccgcatcggcggcatggcgcccaacagcaaggttgaaatctcgctgtggcgtggcggcaagtcgcagtccgtgacggtgacgctcggtgatctcaccagcgatgaagcctccaaggcgacgccaagccagaacgatgacaagggcggcagccagtcctccagcgagaaggtgctgtccagcctcggcctgacggtttcgccttccgatgacggcaacggccttgccatcaccgatgtcgaccccgatagcgacgccgctgcccggggcctgaagacgggcgagaagatcacctcggtcaacaaccagcaggtggcttccgcagctgatatcgagaagatcctcgagcaggccaagaaggacggacgttccaaggcgctgttccagatccagacggatgacggcagccgcttcatcgcgctggatatcgaccagggttga

SEQ ID NO: 28738 - protein, 523 aa, Agrobacterium tumefaciens
MSHSQNGHSSLKTASLKTALKATTVGGLAALMLSTGIAAPILHSFAAPVEVTAPQVPSFANVVDAVSPAVVSVRVQSNVQPASDDSSNFSFNFGGRGLDQLPDDHPLKRFFKEFGGQNQDRSDRGPNRHRDGKGPLRPVAQGSGFFISEDGYVVTNNHVVDDGSAYTVVMNDGTELEAKLVGRDPRTDLALLKVDVNRKFTYVKFADDTKIRVGDWVVAVGNPFGLGGTVTSGIISARGRDIGSGPYDDYLQIDAAVNRGNSGGPAFNLNGEVVGINTAIFSPSGGNVGIAFAIPSSVAKDVIADLQKDGKVERGWLGVQIQPVSKDIAESLGLAEAKGALVVSPQSGSPGDKAGIKQGDIITAVNGDPVKDARDLSRRIGGMAPNSKVEISLWRGGKSQSVTVTLGDLTSDEASKATPSQNDDKGGSQSSSEKVLSSLGLTVSPSDDGNGLAITDVDPDSDAAARGLKTGEKITSVNNQQVASAADIEKILEQAKKDGRSKALFQIQTDDGSRFIALDIDQG

SEQ ID NO: 28739 - DNA, 1407 bp, Agrobacterium tumefaciens
  CDS (1)..(1407)
atgcgaggcgtgttgaagtatctgtccaccggctttcttgctgcgctcgttctcctgcccgtgggcgcaagagcgcaggacaacaagaccgtgccggcaagccacacggaaatgcagctctccttcgcgccgctggtgaagcgcaccgcaggtgctgtggtgaatgtctatgccgagcgcgtcgtgcagcggcgtgtttccccttttgccggtgatcccttcttcgagcagtttttcggccagcaaatgccgaaccgtacggaaaagcagtcatcgctcggttcgggcgtgatcgtaacggcgggcggcctcgtggtgacgaacaatcacgtcatcgacggcgctgatgacatcaaggtggcgctggcggatggtcgcgagttttcctccaaggtgctgatgaaggacgatcgggttgatctcgccgtgttgcagattgacgccaaggagcaattccccgtgctgtcgctcggcgattccgacaagatcgaggttggtgatctggtgctcgccatcggcaaccccttcggggtcggccagacggtgacgagcggcatcgtctccggtctagcgcgcaaccaggtgacgcagggtgatttcggcttcttcatccagaccgacgcctccatcaaccccggcaattccggcggtgcgctgatgaacatggcgggcgagctggtcggcatcaataccgcgatcttttccaagggcggcgggtcgaacggcatcggttttgccattcccgccaatctggttcgggttttcgtagcggccgcggagcgcggcgacgctaacttccagaggccctatatcggtgcaacgttcgatccggtgacgtcagatgtcgcggaagcgctcggcttgcatcgcgcgcgcggcgcgctcgtcgtcggcgtcaccaagggtggtccggcggagaaggctggtatcgagcccggacaggtggtgactgcggtcaatggcctggaagtggagcatcccgatgcgctgggttatcgcctgacgacggccggcatcggcaaatcggccgaattgacggtggtggaaaagggcaaagaaaagaagctgaccatcgctctcaatacggcacccgaaaccgcgccgcgtgacgagcggctgctcgaaggccgcaatcccttcgcaggtgctaccgtcgccaacctctcgccgaagcttgcggatgaattgcgcatgccttcgcaggtgacgggcgtcgtcatcaccgatgtgaagcgtggctcaccggcctatcgcgtcggtttccagccgaaggatgtcatcctgtcgctgaatggtgcggatatcggctccaccgctgcggttgaaaaggcgctggacgacaatcccggcttctggcgggtggaaatcctgcgcgacgggcagcgtatccggcagttcctgcgatga

SEQ ID NO: 28740 - protein, 468 aa, Agrobacterium tumefaciens
MRGVLKYLSTGFLAALVLLPVGARAQDNKTVPASHTEMQLSFAPLVKRTAGAVVNVYAERVVQRRVSPFAGDPFFEQFFGQQMPNRTEKQSSLGSGVIVTAGGLVVTNNHVIDGADDIKVALADGREFSSKVLMKDDRVDLAVLQIDAKEQFPVLSLGDSDKIEVGDLVLAIGNPFGVGQTVTSGIVSGLARNQVTQGDFGFFIQTDASINPGNSGGALMNMAGELVGINTAIFSKGGGSNGIGFAIPANLVRVFVAAAERGDANFQRPYIGATFDPVTSDVAEALGLHRARGALVVGVTKGGPAEKAGIEPGQVVTAVNGLEVEHPDALGYRLTTAGIGKSAELTVVEKGKEKKLTIALNTAPETAPRDERLLEGRNPFAGATVANLSPKLADELRMPSQVTGVVITDVKRGSPAYRVGFQPKDVILSLNGADIGSTAAVEKALDDNPGFWRVEILRDGQRIRQFLR

SEQ ID NO: 28741 - DNA, 1425 bp, Brucella melitensis
  CDS (1)..(1425)
atgaattggcggtgtttgggatttgcaggcgtcgttctggcttttttcagcctggcggcggggcctgtggcggcgcaggatagccccgcaaccgccgtaagacagataccgctcagccggggggatatgcagctttccttcgcgccgctcgtcaaggaaacggcgcccgccgtggtaaatgtttatgcggcgcggcaggtacaggcgcgctcgccttttgagggcgaccccttcttcgagcagttctttggcagccagtttggcgcaagcaagccgcgtatccagcagtcgctcggttccggtgtgatcgttgatcgctccggtattattgtgacgaataatcacgtcatcaaggatgcagacgaaatcaaggtcgcgctttccgacgggcgtgagtttgaaagcaggatactgctgcgcgacgagacgaccgatctcgcggtgctgaagatcgaggcgaagcagcaattccctgtgcttgctctgggaaattccgacgaggttgaggtgggtgatctggtgctcgccatcggcaatccattcggtgtcggccagacggttacgagcggcatcgtatcggcgcaatcacgtacgcaggtcggcatttcagattttgatttcttcatccagacagatgccgccatcaaccccggtaattccggcggcgcacttatcgatatgcgcgggcgtctgatcggcatcaatacggcgatctattcgcggtcgggcggctcggtcggtatcggctttgccattccctccaacatggtgcgcgctgtcgtggatgccgccttgcagggcagcacgcgtttcgagcggccctatatcggtgcaactttccaggggatcacgcccgatctggctgaaagcctcggcatggaaaaaccttatggtgcgctgataacggcggtcgtcaaggatggcccggccgaaactgcgggcctgaaggttggcgacgtggttctgtccgttcaaggtgtgcgtgtcgataatcaggatgtgctcggctaccgtctttcgacggcagggatcggaaagacaatttccgtcgaagtcatgcgcaatggcaagaacctttcgcttccggtgaagcttaccaaggcgcccaaggtcaagcaggccgagccgaaggtcattgaaggtgataacccctttgacggggctgccgtaggggatctgacagcttcgacggcggcgaagctgcggttgaagcgaggccagcaaggggttgcggtgtttgatgtctattccggctcgccggcggcgcgtcttggcttgcgtcccggcgatattatccgcagcatcaacggcaatcagattcgcaccgttgacgatatgaccgccgtgcttgaggccggacgtggtctggcatggcggctggaaattgaacgcaacggcgctttgctgcgccagttcgtgcgctag

SEQ ID NO: 28742 - protein, 474 aa, Brucella melitensis
MNWRCLGFAGVVLAFFSLAAGPVAAQDSPATAVRQIPLSRGDMQLSFAPLVKETAPAVVNVYAARQVQARSPFEGDPFFEQFFGSQFGASKPRIQQSLGSGVIVDRSGIIVTNNHVIKDADEIKVALSDGREFESRILLRDETTDLAVLKIEAKQQFPVLALGNSDEVEVGDLVLAIGNPFGVGQTVTSGIVSAQSRTQVGISDFDFFIQTDAAINPGNSGGALIDMRGRLIGINTAIYSRSGGSVGIGFAIPSNMVRAVVDAALQGSTRFERPYIGATFQGITPDLAESLGMEKPYGALITAVVKDGPAETAGLKVGDVVLSVQGVRVDNQDVLGYRLSTAGIGKTISVEVMRNGKNLSLPVKLTKAPKVKQAEPKVIEGDNPFDGAAVGDLTASTAAKLRLKRGQQGVAVFDVYSGSPAARLGLRPGDIIRSINGNQIRTVDDMTAVLEAGRGLAWRLEIERNGALLRQFVR

SEQ ID NO: 28743 - DNA, 1362 bp, Aquifex aeolicus
  CDS (1)..(1362)
atgagaaagttcttactccctttcctattgataatttcagtaactttttccagcaccctaaaagacctggaggaagatatagtaaaactcgtaaacaaggtagctccctcggtagtgacgatattcgttataaaggaagaaaagagtatattccccatgcctgagtttccctttgactttcccttcaggttcagagaaccttttacgagaaaggaacgttctctcggaagtggtgtaatcgtcaagtacgacgaagataaaaaagttgtatacatacttacaaacgcccacgttgtaaagaacggagtgaggatactcgtaaaactggacaggcacactgaaaagaagggggaaatagtagggatagacacgaaaaccgatatagccgtggtgaaaatttctacaagaggtataaacgatatagaggataggatcgcgaaactcggggattcggacaacttaaaggttgggcagatagtttttgccataggaaatccttacggtcttgaaaggacggtaacgatgggcgttatatccgcactaaggaggagcatagggataacccagtacgagagctttatacagacagatgcggctataaatccgggaaattcaggaggtccgctcataaacgttgagggagaagtcataggaataaacacggctataatagccggtgctcagggacttggttttgccatacccataaacctcgccaagtgggtaatggaacagataatagaacacggcaaagtaataaggggatggctcggtgttgttattcaggacataactcccgacatatccgaagcccttggtattaaggaaggtgtcctagttgcacaggtagttcccggcagtcccgcggacaaggctggcttaaaagtcggtgacgttatagtggaggtaaacggaaagaagatagaggacgcgagggatctccagttcacgattatgaagatgaaaccgggaacgaaagcggtactcaaagtaataaggaatggaaaagaaaaggaaattaccgtaataataggtcagtatcccgaagagggagtatccagagagggtaaggcgactcctgaaaacctcggactccttttaagggacctgacgttaaaggaaaaacaggaggcgggagttccctacggagtgctcgttgagggaatttatccagactcccccgcggagtacagcggactccaacccggggacataatacttaaggtaaacaaccgtcccgtaaggagcgtcagagaattttacgagataattaacagattaaaggaaatgggaaggtctaaggctctgctccttgtaaggaggggtgacagaaatatctttataactctggacttagagtga

SEQ ID NO: 28744 - protein, 453 aa, Aquifex aeolicus
MRKFLLPFLLIISVTFSSTLKDLEEDIVKLVNKVAPSVVTIFVIKEEKSIFPMPEFPFDFPFRFREPFTRKERSLGSGVIVKYDEDKKVVYILTNAHVVKNGVRILVKLDRHTEKKGEIVGIDTKTDIAVVKISTRGINDIEDRIAKLGDSDNLKVGQIVFAIGNPYGLERTVTMGVISALRRSIGITQYESFIQTDAAINPGNSGGPLINVEGEVIGINTAIIAGAQGLGFAIPINLAKWVMEQIIEHGKVIRGWLGVVIQDITPDISEALGIKEGVLVAQVVPGSPADKAGLKVGDVIVEVNGKKIEDARDLQFTIMKMKPGTKAVLKVIRNGKEKEITVIIGQYPEEGVSREGKATPENLGLLLRDLTLKEKQEAGVPYGVLVEGIYPDSPAEYSGLQPGDIILKVNNRPVRSVREFYEIINRLKEMGRSKALLLVRRGDRNIFITLDLE

SEQ ID NO: 28745 - DNA, 1500 bp, Neisseria meningitidis
  CDS (1)..(1500)
atgttcaaaaaataccaatacctcgctttggcagcactgtgtgccgcctcgctggcaggctgcgacaaagccggcagctttttcggtgcggacaaaaaagaagcatcctttgtagaacgcatcaaacacaccaaagacgacggcagcgtcagtatgctgctgcccgactttgtccaactggttcaaagcgaaggcccggcagtcgtcaatattcaggcagcccccgccccgcgcacccaaaacggcagcagcaatgccgaaaccgattccgacccgcttgccgacagcgacccgttctacgaatttttcaaacgcctcgtcccgaacatgcccgaaatcccccaagaagaagcagatgacggcggattgaacttcggttcgggcttcatcatcagcaaagacggctatattctgaccaatacgcacgtcgttaccggcatgggcagtatcaaagtcctgctcaacgacaagcgcgaatataccgccaaactcatcggttcggatgtccaatccgatgtcgcccttctgaaaatcgacgcaacggaagagctgcccgtcgtcaaaatcggcaatcccaaagatttgaaaccgggcgaatgggtcgccgccatcggcgcgcccttcggcttcgacaacagcgtgaccgccggcatcgtgtccgccaaaggcagaagcctgcccaacgaaagctacacacccttcatccaaaccgacgttgccatcaatccgggcaactccggcggcccgctgttcaacttaaaaggacaggtcgtcggcatcaactcgcaaatatacagccgcagcggcggattcatgggcatttccttcgccatcccgattgacgttgccatgaatgtcgccgaacagctgaaaaacaccggcaaagtccaacgcggacaactgggcgtgattattcaagaagtatcctacggtttggcacaatcgttcggtttggacaaagccggcggcgcactgattgccaaaatcctgcccggcagccccgcagaacgtgccggcctgcgggcgggcgacatcgtcctcagcctcgacggcggagaaatacgttcttccggcgaccttcccgttatggtcggcgccattacgccgggaaaagaagtcagcctcggcgtatggcgcaaaggcgaagaaatcacaatcaaagtcaagctgggcaacgccgccgagcatatcggcgcatcatccaaaacagatgaagccccctacaccgaacagcaatccggtacgttctcggtcgaatccgcaggcattacccttcagacacataccgacagcagcggcggacacctcgtcgtcgtacgggtttccgacgcggcagaacgcgcaggcttgaggcgcggcgacgaaattcttgccgtcgggcaagtccccgtcaatgacgaagccggtttccgcaaagctatggacaaggcaggcaaaaacgtccccctgctgatcatgcgccgtggcaacacgctgtttatcgcattaaacctgcaataa

SEQ ID NO: 28746 - protein, 499 aa, Neisseria meningitidis
MFKKYQYLALAALCAASLAGCDKAGSFFGADKKEASFVERIKHTKDDGSVSMLLPDFVQLVQSEGPAVVNIQAAPAPRTQNGSSNAETDSDPLADSDPFYEFFKRLVPNMPEIPQEEADDGGLNFGSGFIISKDGYILTNTHVVTGMGSIKVLLNDKREYTAKLIGSDVQSDVALLKIDATEELPVVKIGNPKDLKPGEWVAAIGAPFGFDNSVTAGIVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKAGGALIAKILPGSPAERAGLRAGDIVLSLDGGEIRSSGDLPVMVGAITPGKEVSLGVWRKGEEITIKVKLGNAAEHIGASSKTDEAPYTEQQSGTFSVESAGITLQTHTDSSGGHLVVVRVSDAAERAGLRRGDEILAVGQVPVNDEAGFRKAMDKAGKNVPLLIMRRGNTLFIALNLQ

SEQ ID NO: 28747 - DNA, 1170 bp, Pseudomonas aeruginosa
  CDS (1)..(1170)
atgcccaaggccctgcgtttcctcggctggcccgtgctggtcggcgtgctgctggccctgctgatcatccagcacaaccccgagctggtcggcctgccacgccaggaggtgcacgtcgagcaggcgcctctgctcagccgcctgcaggaaggcccggtgtcctatgccaacgcggtgagtcgagcggctccggcagtggccaacctgtacaccaccaagatggtcagcaagccctcccaccccctgttcgacgacccgatgttccgccgcttcttcggcgacaacctgccgcaacagaagcgcatggagtcgagcctcggctcggcggtgatcatgagcgcggaaggctacctgctgaccaacaaccacgtgaccgctggcgccgaccagatcatcgtggccttgcgcgacggccgcgaaaccatcgcccagttggtcggcagcgacccggaaaccgacctggccgtgctgaagatcgaccttaagaacctgccggcgatgaccctcggccgctccgacggcattcgcaccggcgacgtctgcctcgccatcggcaacccgttcggcgtcggccagaccgtgaccatgggcatcatcagcgccaccggacgcaaccagctcggcctgaacacctacgaagacttcatccagaccgacgcggcgatcaaccccggcaactccggcggcgcgctggtggacgctgccggcaacctgatcggcatcaacacggcgatcttctccaagtccggcggctcccagggtatcggcttcgccatcccgaccaagctggccctggaggtcatgcagtcgatcatcgagcacggccaggtgatccgcggctggctcggcgtcgaggtcaaggcgctgaccccggaactggcggagtcgctgggcctcggcgaaaccgccgggatcgtcgtcgccggcgtctatcgcgacggtccggcggcacgcggcggcctgctgccgggcgatgtgatcctgaccatcgacaagcaggaagccagcgacggccgccgctcgatgaaccaggtggcgcgcacccgtccgggacagaagatcagcatcgtggtgctgcgcaacggacagaaggtcaacctgaccgccgaggtcggcctgcgtccgccgccggcaccggctccacagcagaaacaggacggcggcgagtga

SEQ ID NO: 28748 - protein, 389 aa, Pseudomonas aeruginosa
MPKALRFLGWPVLVGVLLALLIIQHNPELVGLPRQEVHVEQAPLLSRLQEGPVSYANAVSRAAPAVANLYTTKMVSKPSHPLFDDPMFRRFFGDNLPQQKRMESSLGSAVIMSAEGYLLTNNHVTAGADQIIVALRDGRETIAQLVGSDPETDLAVLKIDLKNLPAMTLGRSDGIRTGDVCLAIGNPFGVGQTVTMGIISATGRNQLGLNTYEDFIQTDAAINPGNSGGALVDAAGNLIGINTAIFSKSGGSQGIGFAIPTKLALEVMQSIIEHGQVIRGWLGVEVKALTPELAESLGLGETAGIVVAGVYRDGPAARGGLLPGDVILTIDKQEASDGRRSMNQVARTRPGQKISIVVLRNGQKVNLTAEVGLRPPPAPAPQQKQDGGE

SEQ ID NO: 28749 - DNA, 1407 bp, Sinorhizobium meliloti
  CDS (1)..(1407)
atgtcgggatttgatgcgcgtcaatgcgtcggcgggcaaatccggttgaaatccagcatcaatccagggagtgcgacgatgctcaagatatcgaagctgctggtcttagctgctctattcgaccccttcggaggggccgccgaagcgaccggcatcgacgcaggcgtgtccgcaatgctggagcgggtgcagccggcggtcgtcagtatccgcaccatcagcagcgggatcttcagaaatgaaatgctcgaggatccgaatgtacggaaagtcctcggtcttcccgatgaggtattcatcgtccagacgggggcgaccgcgacaggatctggggtgatcatcgatcgggagggaggctacatcatcaccagccgtcatctggtcgccgatgccgatgatgtttccgtaacacttgcggatggacgggttttccacgccgacagggtaggggaggatgcaccgacagacctcgcggtcatcaagatcgacgcctcagaactagctgcactccagtggggaaattcatccgaactcaaggttggcgagtttgtggccgcgataggcagccctttcggcttggcgcagacggcgacgttcggcatcgtcagcggcttgggccgcgcgggcctaggtgccgatgaataccaggattacatccagaccgacgcggccatcaacccggggaattccggaggggccctcgtcaacgtttctggcaagttgatcggcattgcgcgcgggatcgctgcgccggatcagacgagtaccggcatcggctttgcgattccctcgaatatcgtggcgaagatcgtccgggaattgatatcccacggagaatacaagcgaggctggctcggcctctcggtgacggccgcagtggatgcgcaagacggtagtgccacgcaaccgacagggcttattgtgaacgaactcgcctgcaactcgccggcggaaaggcaaggggtacgcctcggagatgtgatcaccggcctggacgaccgcgccttctcgacggagcaggcgttcaggaacgcgatcagcctgcttccggcgaacgcccggatcactctcgatgttcgcaggggagaaacgtcgcagaagctgggcatgacgctttccgattcggtcgatcgtcccgacgtctcggaccagggctcagttatcgtcaagtttccatcggagagtggctcaccggcatgcgtgccggcgggtgctgtcctcgtcgatgttgcgccgggtagcgccgcttactctatcgggctgagaaccggcgactacctgacggccatcaacggcaaaccgcccgtctctgccgatcaaattggaagcgtcctggagagcgtggaaggcagcgcttctctcgatatcctgcgcgcaggaacggcataccgcattgatgttcaatag

SEQ ID NO: 28750 - protein, 468 aa, Sinorhizobium meliloti
MSGFDARQCVGGQIRLKSSINPGSATMLKISKLLVLAALFDPFGGAAEATGIDAGVSAMLERVQPAVVSIRTISSGIFRNEMLEDPNVRKVLGLPDEVFIVQTGATATGSGVIIDREGGYIITSRHLVADADDVSVTLADGRVFHADRVGEDAPTDLAVIKIDASELAALQWGNSSELKVGEFVAAIGSPFGLAQTATFGIVSGLGRAGLGADEYQDYIQTDAAINPGNSGGALVNVSGKLIGIARGIAAPDQTSTGIGFAIPSNIVAKIVRELISHGEYKRGWLGLSVTAAVDAQDGSATQPTGLIVNELACNSPAERQGVRLGDVITGLDDRAFSTEQAFRNAISLLPANARITLDVRRGETSQKLGMTLSDSVDRPDVSDQGSVIVKFPSESGSPACVPAGAVLVDVAPGSAAYSIGLRTGDYLTAINGKPPVSADQIGSVLESVEGSASLDILRAGTAYRIDVQ

SEQ ID NO: 28751 - DNA, 1332 bp, Helicobacter pylori
  CDS (1)..(1332)
atgtcccctctaaagacgatacggatctattcttaccacgattctattaaggactctattaaggcggtggtgaatatctccactgaaaagaagattaaaaacaattttataggtggcggtgtgtttaatgacccctttttccaacaattttttggggatttgggtggcatgattcctaaagaaagaatggaaagggctttaggcagcggcgtaatcatttctaaagacggctatattgtaactaataaccatgtgattgatggcgcggataagattaaagttaccattccagggagcaataaagaatattccgccactctagtaggcaccgattctgaaagcgatttagcggtgattcgcatcactaaagacaatctgcccacgatcaaattctctgattctaatgatatttcagtgggcgatttggtttttgcgattggtaacccttttggcgtgggcgaaagcgttacgcaaggcattgtttcagcgctcaataaaagcgggattgggatcaacagctatgagaatttcattcaaacagacgcttccatcaatcctggaaattccggcggcgctttaattgatagccgtggagggttagtggggattaataccgctattatctctaaaactgggggcaaccacggcattggctttgccatcccttctaacatggttaaagatactgtaacccaactcatcaaaaccggtaagattgaaagaggttacttgggcgtgggcttgcaagatttgagtggcgatttgcaaaattcttatgacaacaaagaaggggcggtagtcattagcgtagaaaaagactctccggctaaaaaagcagggattttggtgtgggatttgatcaccgaagtcaatgggaaaaaggttaaaaacacgaatgagttaagaaatctaatcggctccatgctacccaatcaaagagtaaccttaaaagtcattagagacaaaaaagaacgcgctttcaccctcactctagctgaaaggaaaaaccctaacaaaaaagaaaccatttctgctcaaaacggcgcgcaaggccaattgaacgggcttcaagtagaagatttaactcaagaaaccaaaaggtctatgcgtttgagcgatgatgttcaaggggttttagtctctcaagtgaatgaaaattccccagcagagcaagccggatttaggcaaggtaacattatcacaaaaattgaagaggttgaagttaaaagcgttgcggattttaaccatgctttagaaaagtataaaggcaaacccaaacgattcttagttttagacttgaatcaaggttataggatcattttggtgaaatga

SEQ ID NO: 28752 - protein, 443 aa, Helicobacter pylori
MSPLKTIRIYSYHDSIKDSIKAVVNISTEKKIKNNFIGGGVFNDPFFQQFFGDLGGMIPKERMERALGSGVIISKDGYIVTNNHVIDGADKIKVTIPGSNKEYSATLVGTDSESDLAVIRITKDNLPTIKFSDSNDISVGDLVFAIGNPFGVGESVTQGIVSALNKSGIGINSYENFIQTDASINPGNSGGALIDSRGGLVGINTAIISKTGGNHGIGFAIPSNMVKDTVTQLIKTGKIERGYLGVGLQDLSGDLQNSYDNKEGAVVISVEKDSPAKKAGILVWDLITEVNGKKVKNTNELRNLIGSMLPNQRVTLKVIRDKKERAFTLTLAERKNPNKKETISAQNGAQGQLNGLQVEDLTQETKRSMRLSDDVQGVLVSQVNENSPAEQAGFRQGNIITKIEEVEVKSVADFNHALEKYKGKPKRFLVLDLNQGYRIILVK

SEQ ID NO: 28753 - DNA, 1419 bp, Caulobacter crescentus
  CDS (1)..(1419)
atgaccaacatgcgcaagcttcgcgccctgctgcccgtcttcgtcctgctgaccgcctgctcgaacccggccggcccgtcgaacgcccagtcgatcccggacatgcctcagcccacgcgccaggttccggccgacgcggcctcgatgaagcagtcgttctcgcccgtcgtgaagaaggctgcgccggccgtggtcaatgtcgccagccgccgcctggtccagcgtcgcgtcgatccgttctgggacttcttcatgggcggcgggcagggcggctcgcaggtgcaaagctcgctgggatccggcgcgatcgtccgcgccgacggcgtgatcatcaccaatcaccacaatatcaacgggatgagcgacatcaccatccagttggccgaccggcgtgagttcccggcggtggtgctgctggatgacccgcgcgccgacctcgccgtgctgaagatcgacaccaagggcgagaagctgccggtcatggccatcgacgaccaggagcagctggaggtcggcgatctggtgctggccatgggcaatccgttcggcgtgggtcagaccgtcaccaacggcatcgtctcagccctggcgcggaccgatgtcggcgcggccgacttcggcagctacatccagaccgatgcggcgatcaatccgggcaattccggcggtccgctggtcgacatggacggcgatctggtcggcatcaacaccttcatcatttcgcgttcgggttcgtcgtcgggcgtcggcttcgccattccggcgcgcgtcgtgcgtcaggtggtcaacgccgcgctgggcggcgggcatagcattgtccggccctggctgggcgtgaagggccaggccgtcacgggcgacatcgccaagagcctgggcatgaccgccccgcgcggcgtgcttgtggcccagatctatccgggctcttcggccgagcgcgctggtctgaaggaaggcgacgtgatcctgtcgatcgacggccagccggtgaacgacgaaggcggcggcgcctttgcgattggaacccacaaggtcggcgaccgcgtgccgatgcaaatccgtcgcggcgaccgcgagctgaccatcacggtccgcgccgacgccgcgccggaaaccccggcccgcgacgagcgcaccctcagcggcaataacccgttcaacggcgcgacggtgatgaacctgtcgccggccgtcgcgcaggacctgggcgtggatccgttcgccgggcgcggcgcgctggtgaccaagatcggacccggctatgcgggcaactggatgcgtcctggcgacttcgtgcgcagcgtcaatggtcgccagatcaacacggtggctgacctcgcctcggccatcgccggtcggtctggccgttggagcgtcaccatcgagcgtggcggccagttgatccaggcgcagttctag

SEQ ID NO: 28754 - protein, 472 aa, Caulobacter crescentus
MTNMRKLRALLPVFVLLTACSNPAGPSNAQSIPDMPQPTRQVPADAASMKQSFSPVVKKAAPAVVNVASRRLVQRRVDPFWDFFMGGGQGGSQVQSSLGSGAIVRADGVIITNHHNINGMSDITIQLADRREFPAVVLLDDPRADLAVLKIDTKGEKLPVMAIDDQEQLEVGDLVLAMGNPFGVGQTVTNGIVSALARTDVGAADFGSYIQTDAAINPGNSGGPLVDMDGDLVGINTFIISRSGSSSGVGFAIPARVVRQVVNAALGGGHSIVRPWLGVKGQAVTGDIAKSLGMTAPRGVLVAQIYPGSSAERAGLKEGDVILSIDGQPVNDEGGGAFAIGTHKVGDRVPMQIRRGDRELTITVRADAAPETPARDERTLSGNNPFNGATVMNLSPAVAQDLGVDPFAGRGALVTKIGPGYAGNWMRPGDFVRSVNGRQINTVADLASAIAGRSGRWSVTIERGGQLIQAQF

SEQ ID NO: 28755 - DNA, 1446 bp, Xylella fastidiosa
  CDS (1)..(1446)
atgcgaccgctacctactttactgacgctatctatcgctgccgcattcggcggttttgccgccactgggatgaatgcttggcttgacaaccgggccgaagcggcatccaacaccaatgccatctcaccaatatcatcactgccaacgggcacggtgcctcaaaccacggctgccaaccagccgctaccatcgttagcacccatgctgcaacaagtgatgccagcagtggtcagcatcaacagtaaacaagtggtacgggtgcgcaatccatttttcgacgacccgatcctacgtcggctattcccagagatcccccaagaacgcattaatgagtcgctcggatctggggtgatcatcgacgcgcgcaatggctacgtacttaccaatcatcacgtgatcgaaaatgccgacgccgtgcaggtgacattagcagatgggcgcagcttcaaggccgagttcctcggttctgacgcagacaccgacatcgccttgatccggatcaaagcaaataaactgaccgaaatcaaactcgcagacagtaacaaattacgcgtgggcgacttcgtcgtagccattggtaacccgttcggctttacccaaacggtgacctcaggcatcgtttcggcggtaggtcgcagtggcatcctcggcctgggttaccaaaacttcatccagaccgacgcatcgatcaacccgggtaactcaggcggcgcactggtgaatcttcatggccagttggttggcatcaacacggccagcttcaacccacagggcagcatggctggcaacatcggcttaggcctggcgattccttcgaatctagcgcgcaacgtcgtcgagcaattggtcacgaaaggcgttgtggtacgcgggacaatcggcgtacaaacacagaatattgatgcacgaatggcacgaagcttaggcctgagtaatccacacggcgcattagtgacgcgcgtattacccaattccgctggtgccacagccggactgcaaccaggtgatgtgatcctggcagccaatgaccaaagggtggacaacgcggaaacattgcacaactacgaaggactacagcccgtcggtagctcagtaacactggaagtacaccgtggcggcaagccactcaaaatacgcctcacacttaaagaattgccacgcgcaatcgccggagaaacgctggattcacgactgtcgggcgccatcttcgttgacctgcccgagtccctccgtcaatcgggagtcggtggagtcatggtcaacaaagtcaaacacggcagccgcgctgcggccaatgggttggtagccggagatgtcatcattgccgcatccatcggtggattctctgatctggcgagctggcgggcaagcttttcccacccaccacaacggctgatactgcgtgtgctacgtgataacacccagtacgatgcgctgatgcgctga

SEQ ID NO: 28756 - protein, 481 aa, Xylella fastidiosa
MRPLPTLLTLSIAAAFGGFAATGMNAWLDNRAEAASNTNAISPISSLPTGTVPQTTAANQPLPSLAPMLQQVMPAVVSINSKQVVRVRNPFFDDPILRRLFPEIPQERINESLGSGVIIDARNGYVLTNHHVIENADAVQVTLADGRSFKAEFLGSDADTDIALIRIKANKLTEIKLADSNKLRVGDFVVAIGNPFGFTQTVTSGIVSAVGRSGILGLGYQNFIQTDASINPGNSGGALVNLHGQLVGINTASFNPQGSMAGNIGLGLAIPSNLARNVVEQLVTKGVVVRGTIGVQTQNIDARMARSLGLSNPHGALVTRVLPNSAGATAGLQPGDVILAANDQRVDNAETLHNYEGLQPVGSSVTLEVHRGGKPLKIRLTLKELPRAIAGETLDSRLSGAIFVDLPESLRQSGVGGVMVNKVKHGSRAAANGLVAGDVIIAASIGGFSDLASWRASFSHPPQRLILRVLRDNTQYDALMR

SEQ ID NO: 28757 - DNA, 1458 bp, Treponema pallidum subsp. pallidum (syphilis spirochete)
  CDS (1)..(1458)
atgccctctgcagacacgatagctcggcgcgttgccggagacagtgggaacgctggggggcggacattacttcctgtgggggtttcgcgtgaatcggtgcagctgttagaacggctgcaaaacgcgaaccgtcaggtaactgccgaagtgctgccttcagtagtgacgctggatgtggtggagaccagaaaggttcgggtacgtgatccgtttggcggttttccgtggtttttctttcgtggtcctgaaggtccgggtgcggggcctggcggtggttctggaaacaaaggggaagctgaggaacgggagtacaaaacggagggacttggttctggagtcattgtaaagaagacagggaagacgcattacgtgcttaccaactatcacgtggcgggtaaggctaatgagatagagattaaactgcacgatggcagaatcgtaaaaggtaaacttgtcggtggtgaccagcgcaaggacatcgcgctggtctcctttgaggacgcagacccaaatatccgtgttgccgtccttggtgactcggatgcagtacgggtaggagacattgtgttcgcagttggctctcctcttgggtacacttccactgtaacgcaggggattatcagtgcgctgggtcgctttgggggaccgggcaacaatattaatgattttattcaaacagatgcggccataaaccagggcaattccgggggaccaatggtcaatatttatggcgaagtgattgggattaacgcgtggattgcctcctcaagtgggggatcgcaagggattggtttttcaattcctatcaataatgtgaagtcggatatcgaatcatttatccagtacgggcaggtgaagtacgggtggttaggcgtgcagctggtggcaacggatgcggacaccgtagcatcgcttggtattgcaaagggtacaaaaggggtgcttgcggcggaaattttcttaggttctcctgcgcacaaggggggactgaaaccgggcgattactgtgtaaaactgaacggaaaagaagtaaaggatgtaaatcagtttgtgcgggatgtcggcgcgctgcgcattgggcaaacagcagtattcgatttaattcgcggtggtgtgccgatgacgctttcggtgcgcattacggagcgtgatgaaaaaatagtaaatgactactcaaagctttggcctgggttcatcccactgccgcttacggaggccgtgcgtaaacgtttggatttgaaagcgtcggtgcgtggtgtgctagttagcaacgcgcagagcaaaagccctgcggcgctgatgggattgaagtcggcggacatagtagtggcggtcaatgatcaaagagtctcgagcgtgcgtgagttttacgcggtgcttgcacgtcagacgagggaggtgtggtttgacgtgttgcgcgatgggcaaacgctttctaccgtgcgatttcggttttag

SEQ ID NO: 28758 - protein, 485 aa, Treponema pallidum subsp. pallidum (syphilis spirochete)
MPSADTIARRVAGDSGNAGGRTLLPVGVSRESVQLLERLQNANRQVTAEVLPSVVTLDVVETRKVRVRDPFGGFPWFFFRGPEGPGAGPGGGSGNKGEAEEREYKTEGLGSGVIVKKTGKTHYVLTNYHVAGKANEIEIKLHDGRIVKGKLVGGDQRKDIALVSFEDADPNIRVAVLGDSDAVRVGDIVFAVGSPLGYTSTVTQGIISALGRFGGPGNNINDFIQTDAAINQGNSGGPMVNIYGEVIGINAWIASSSGGSQGIGFSIPINNVKSDIESFIQYGQVKYGWLGVQLVATDADTVASLGIAKGTKGVLAAEIFLGSPAHKGGLKPGDYCVKLNGKEVKDVNQFVRDVGALRIGQTAVFDLIRGGVPMTLSVRITERDEKIVNDYSKLWPGFIPLPLTEAVRKRLDLKASVRGVLVSNAQSKSPAALMGLKSADIVVAVNDQRVSSVREFYAVLARQTREVWFDVLRDGQTLSTVRFRF

SEQ ID NO: 28759 - DNA, 1380 bp, Thermotoga maritima
  CDS (1)..(1380)
atgaagaaattctttctgaccatcgctgtggcactgatactcaccagcgtctttccatacgtcaaccccgactacgaaagtcccatcgttaatgtggtcgaagcgtgtgcaccggccgttgtgaagatagacgttgtgaagacggtgaagacttccttcttcgatccttattttgagcagttcttcaaaaagtggttcggtgaacttccacccggtttcgaaaggcaggttgccagcctcggatcgggcttcatcttcgacccagaaggttacatactcaccaactaccacgtggtaggtggagcggacaacatcactgtgaccatgctcgacggaagcaaatacgacgcggagtacataggaggagatgaagagctcgacatcgcggtcataaagatcaaagccagcgataagaaattcccctatctggaattcggtgattctgacaaagtgaagatcggtgaatgggcgatagccataggaaaccccctcggcttccagcacacggtgactgtgggagtggtcagcgctaccaacaggaggattccaaagccagatggaagtggttactacgtgggactcatccagaccgacgcggcgatcaacccgggaaacagtggaggaccccttttgaacatacacggtgaagtgataggcataaacaccgctatcgtcaatcctcaggaagctgtgaacctcggctttgccatcccgatcaacacggtgaagaagttccttgacaccatactcacccaaaagaaggttgaaaaagcctacctcggcgtgacggtcatgaccctcaccgaagaaacggcgaaagctctggggcttgaatctacgagtggtgctctgataacgagtgttcagaaaggatctcctgctgaaaaggccgggctcaaagaaggggacgtgatcctcaaggttgacgatcaggacgtgagaagtcacgaagaactggtctccatcatacacacttacaaaccgggagacactgccgttctcactatagagagaaagggaaagatcatgaaagttcaggtgacgttcggttcctcatctgaagaagagaaaacaacgactggtgaggaaaaaatcgatgcccttggtatcacagtgtcgaacatcacgccggccgacagggagacttattcgatcccggaagagataaacggggtcatagtgaaggagagcaccgggaagttcggtctacagaagggagacgtaatcaccacagtgtacgtgaacggcaaaaggtatgatataaactctgtaggggatctcaagaaagttacatccattgttaaaaatggtgactacatcgccctttacatttacaggaatggagcgaaagtcttcgtgagcttcatctatcagagatag

SEQ ID NO: 28760 - protein, 459 aa, Thermotoga maritima
MKKFFLTIAVALILTSVFPYVNPDYESPIVNVVEACAPAVVKIDVVKTVKTSFFDPYFEQFFKKWFGELPPGFERQVASLGSGFIFDPEGYILTNYHVVGGADNITVTMLDGSKYDAEYIGGDEELDIAVIKIKASDKKFPYLEFGDSDKVKIGEWAIAIGNPLGFQHTVTVGVVSATNRRIPKPDGSGYYVGLIQTDAAINPGNSGGPLLNIHGEVIGINTAIVNPQEAVNLGFAIPINTVKKFLDTILTQKKVEKAYLGVTVMTLTEETAKALGLESTSGALITSVQKGSPAEKAGLKEGDVILKVDDQDVRSHEELVSIIHTYKPGDTAVLTIERKGKIMKVQVTFGSSSEEEKTTTGEEKIDALGITVSNITPADRETYSIPEEINGVIVKESTGKFGLQKGDVITTVYVNGKRYDINSVGDLKKVTSIVKNGDYIALYIYRNGAKVFVSFIYQR

SEQ ID NO: 28761 - DNA, 1371 bp, Vibrio cholerae
  CDS (1)..(1371)
atgatgaaaaaacctttacttgttttaactgctctgtctcttagtttgagcgcgattctctcgcctttgcctgcaactgcagcgcttcctctctcagtcaatggagagcagattcctagcctagcccccatgcttgaaaaagtcacacccgccgtggtgagcattgctgtggaagggactcaagtttcaagacagcgtctgccggatcagtttcgttttttcttcggaccggattttccgaccgaacaactccaagagcgacctttccgtggcttaggttctggggtcatcattaacgctgataaagggtatgtcgtcactaactaccatgtcattaatggtgctgaaaaaattcgcgtcaaactgtatgacggtcgcgagtttgatgcagaacttgtcggtggtgatgagatgtctgatgtcgccttgctcaagctaaacaaagcgaaaaacctcactgagatccgtatcgcggactccgataaactgcgagtcggtgattttgcagtggccatcggtaacccatttggcttagggcaaactgtgacctctggcattgtctcagccttagggcgtagtggtttgaatatcgaaaactttgaaaacttcatccagaccgatgccgccatcaacagcggcaactcaggaggagctctggttaaccttaatggtgaactcatcggtatcaacaccgcgatccttggtccaaacggtggcaacgtcggtataggttttgccatcccatcgaatatgatgaaaaatctgaccgatcaaattcttgagtttggtgaagtgaaacgcggcatgctgggtgtacaaggcggtgaaatcacttccgaactggctgatgcgctcggctatgaatcctcaaaaggtgcttttgtcagccaagtggttcctgacagtgctgcggacaaagcgggcatcaaagcgggtgacatcattacgtcgctgaatggtaaaaaaatcgataccttctctgagctacgcgcgaaagtcgcgaccctaggcgcaggaaaaaccattacccttggagtgctgcgtgatggtaagaatcaaaatattgatgtaacgcttggggagcagcaaaatgccaagaccaaagcagaatcactgcatcaaggtttgagcggcgcggagttaagcaacaccactgacagcgatcctattcagggcgttaaggttactgaggttcaaaaaggctctgccgctgaatcttaccagctacaaaaagacgacattatcattggcgttaaccgtaagcgggtgaaaaatatcgccgagttgcgtgcgattatggaaaaatcaccgaatattttggcattaaatatccaacgtggagagagaacgctttacttggttgttcgttaa

SEQ ID NO: 28762 - protein, 456 aa, Vibrio cholerae
MMKKPLLVLTALSLSLSAILSPLPATAALPLSVNGEQIPSLAPMLEKVTPAVVSIAVEGTQVSRQRLPDQFRFFFGPDFPTEQLQERPFRGLGSGVIINADKGYVVTNYHVINGAEKIRVKLYDGREFDAELVGGDEMSDVALLKLNKAKNLTEIRIADSDKLRVGDFAVAIGNPFGLGQTVTSGIVSALGRSGLNIENFENFIQTDAAINSGNSGGALVNLNGELIGINTAILGPNGGNVGIGFAIPSNMMKNLTDQILEFGEVKRGMLGVQGGEITSELADALGYESSKGAFVSQVVPDSAADKAGIKAGDIITSLNGKKIDTFSELRAKVATLGAGKTITLGVLRDGKNQNIDVTLGEQQNAKTKAESLHQGLSGAELSNTTDSDPIQGVKVTEVQKGSAAESYQLQKDDIIIGVNRKRVKNIAELRAIMEKSPNILALNIQRGERTLYLVVR

SEQ ID NO: 28763 - DNA, 1961 bp, Pseudomonas aeruginosa
  CDS (496)..(1920)
atgatcgaggagcaggggcgagtggtggcgaccgagccgggagcggtatgggtcgagaccgtgcgccgcagtacctgctcgtcctgctcggccaatgccggttgcggccaggggctgatgcagcgcctgggcgtcggcgcggggcgtgcccgggtgcgcgcgttgagcgacctgagcctgcgggtcggcgatgcggtcgtcctaggaattcatgaagacctgttgttgcgcgcctccgtcctcttctatcttttccctctgctcggttttttcgtggcagcattgctggcgacccgggcgggccttgtcgaacctctgatcatcgtgtccgggctggcgggtttgctggcggcctggctattggtgcgtcggcatgctcgtcgtcatgccgatgatccagcctcgcagccggtggttctgcgagcgctgatttccgggccgtccgattcggcctgagtctttctcttccctcgaacatcacgggagctgtagtcgatgcataccctaaaacgctgtatggctgcgatggtggccttgctggccttgagcctggcgatgacggcccgggcagaactgccggacttcacgcctttggtcgaacaggcgtcgccggcggtggtgaatatcagtacgcggcagaagctgccggatcgcgccatggcgcgcgggcagctgtcgatccccgacctcgaagggctgccgccgatgttccgcgacttcctcgagcgcagcatcccgcaggttccgcgcaatccgcgcgggcagcagcgcgaggcgcaatcgctgggttccggcttcatcatctccaacgacggctacatcctcaccaacaatcacgtcgtggccgatgccgacgagatcctggtgcgcctgtccgaccgtagcgagcacaaggccaagttgatcggcgcggacccgcgcagcgacgtggcggtgctgaagatcgaggcgaagaacctgccgaccctgaaactgggcgattcgaacaagctgaaagtgggcgaatgggtcctggccatcggttcgccgttcggcttcgatcactcggtcaccgccggtatcgtcagtgccaagggtcgtagcctgccgaacgagagctacgtacccttcatccagaccgacgtggcgatcaacccgggtaactccggcggtccgctgctgaacctgcagggcgaagtggtcggcatcaactcgcagatcttcacccgttccggcggcttcatgggcctgtccttcgccattccgatcgatgtcgcgctgaacgtcgccgaccagttgaagaaagccggcaaggtcagtcgcggctggctgggcgtggtgatccaggaagtgaacaaggatctcgccgagtccttcggcctcgacaagccgtccggcgcgctggtggcgcaactggtggaagacggcccggcggccaagggtggcctgcaggtgggcgatgtgatcctcagcctgaacggccagtcgatcaacgagtccgccgacctgccgcacctggtgggcaacatgaagccgggcgacaagatcaacctggacgtgattcgcaacggccagcgcaagtccctgagcatggcggtaggcagccttccggacgacgacgaggaaatcgcctcgatgggcgctccgggcgccgagcgcagcagcaaccgcctgggcgtgaccgtcgccgacctgaccgccgagcagcgcaagagcctggatatccagggcggcgtggtgatcaaggaagtccaggacggtccggccgcggtcatcggcctgcgtccgggcgatgtcatcacccacctggacaacaaggcggtgacctcgaccaaggtcttcgccgacgtggccaaggccctgccgaagaaccgttcggtttcgatgcgggtgctgcgccagggacgcgccagcttcattaccttcaagctggccgaataagccggctggcgaaaaaagggcggtttccaccgcctttttca

SEQ ID NO: 28764 - protein, 474 aa, Pseudomonas aeruginosa
MHTLKRCMAAMVALLALSLAMTARAELPDFTPLVEQASPAVVNISTRQKLPDRAMARGQLSIPDLEGLPPMFRDFLERSIPQVPRNPRGQQREAQSLGSGFIISNDGYILTNNHVVADADEILVRLSDRSEHKAKLIGADPRSDVAVLKIEAKNLPTLKLGDSNKLKVGEWVLAIGSPFGFDHSVTAGIVSAKGRSLPNESYVPFIQTDVAINPGNSGGPLLNLQGEVVGINSQIFTRSGGFMGLSFAIPIDVALNVADQLKKAGKVSRGWLGVVIQEVNKDLAESFGLDKPSGALVAQLVEDGPAAKGGLQVGDVILSLNGQSINESADLPHLVGNMKPGDKINLDVIRNGQRKSLSMAVGSLPDDDEEIASMGAPGAERSSNRLGVTVADLTAEQRKSLDIQGGVVIKEVQDGPAAVIGLRPGDVITHLDNKAVTSTKVFADVAKALPKNRSVSMRVLRQGRASFITFKLAE

SEQ ID NO: 28765 - DNA, 1593 bp, Caulobacter crescentus
  CDS (1)..(1593)
atgaccgctaggaagtcgggtttcattgtgggcgccgtcgccggcgcgagcgtggcctgcgcggctctggccggaatgggcatgcggatggggacggccgacgcggcccaggccccggtcgtccgcgtgtccaccgccagcgcgccgaccttcgcgccgccgccgggcgcgccgatgtcgttcgccgacatcttcgagaaggtctcgcccgccgtcgtccagatcaatgtgacctccaaggcccaggcgccgtcgctgcgcatccctggcctggaaggcttcgacatcgtgccgcgcggtcagcgccgccccggtcagccggggcagcagggccagcaacaggaagacgacggcgacacgccggccacgcccaagcagcaatcggcgggctcgggcttcttcatctcggccgacggctacatcgtcaccaacaaccacgtcgtggccgacgctgacgacatccaagtggtgctgaaggacggccgcgagctgaaggccacgctggtcggccgcgacgagagcaccgacctggccgtgatcaaggtggtcgaccccaaggccaagggtaaggacttcaccttcgtcaacttcgagaaccaggccaagccgcgcgtcggcgactgggtgatcaccatcggcaacccgttcggtctgggcggcacggccacggccggcatcatctcggcctatgatcgcaatctgaacgacaccacctcgtcgttcgtgccgtacatccagatcgacgcgccgatcaaccgcggcaattcgggcggtcccagcttcgacatctatggccgggtgatcggcgtcaacagcgccatctactcgccgtcgggcggttcggtcggcatcggcttcgccattccggccgaggtcgccgagggcgtggccaagcagctgatcgaaaacggcaaggtcgtgcgcggctatatcggcgtgagcatcatggcctttaacgccgagatggctgaagccctgggcatgagcgatgtgaagggggcgatcgtcgcctctgtcgttccgggcggtcccgccgccaaggccggcctgctgccggacgacatcctggtggccgtcaacggcgtcaagatcagcgacagcagtgaactgacccgcgaggtctccaaggcccgtccgggcgagacgatcaaggtctcgatcatccgtgacggcaagccgcgcatcgtcgacgtcaagtcgggcacgcgtccctcggagagcagcctggcggtgacggatgacgagcagggccaggacggcgccgcgccgacgccggacaagccggccagccagaaggtcgacgccctgggcctgaccctggggccgatcgatgcggcttcgcgccagacctacaagatcgagccggacatcaagggtctgctgatcatcggcgtgaagggcgacagcgacgcgggcgagaagggcctggccaagggcgatgtcctgtccaacatcaacggcgcgccggtcaccagcgtcgccgacgtgacctctgcggtggagacggccaagaaggccggccgcgccagcgtgctggtcaagatcgtccgccagaaccgcccggtcttcatcccgctgaagatcgcgccgtaa

SEQ ID NO: 28766 - protein, 530 aa, Caulobacter crescentus
MTARKSGFIVGAVAGASVACAALAGMGMRMGTADAAQAPVVRVSTASAPTFAPPPGAPMSFADIFEKVSPAVVQINVTSKAQAPSLRIPGLEGFDIVPRGQRRPGQPGQQGQQQEDDGDTPATPKQQSAGSGFFISADGYIVTNNHVVADADDIQVVLKDGRELKATLVGRDESTDLAVIKVVDPKAKGKDFTFVNFENQAKPRVGDWVITIGNPFGLGGTATAGIISAYDRNLNDTTSSFVPYIQIDAPINRGNSGGPSFDIYGRVIGVNSAIYSPSGGSVGIGFAIPAEVAEGVAKQLIENGKVVRGYIGVSIMAFNAEMAEALGMSDVKGAIVASVVPGGPAAKAGLLPDDILVAVNGVKISDSSELTREVSKARPGETIKVSIIRDGKPRIVDVKSGTRPSESSLAVTDDEQGQDGAAPTPDKPASQKVDALGLTLGPIDAASRQTYKIEPDIKGLLIIGVKGDSDAGEKGLAKGDVLSNINGAPVTSVADVTSAVETAKKAGRASVLVKIVRQNRPVFIPLKIAP

SEQ ID NO: 28767 - DNA, 1536 bp, Rickettsia conorii
  CDS (1)..(1536)
atggagtatatggttaatctgaaaatagttattgttataatagttttaatatcaagtaacgttgttctagcaaaagaaaatagtaggtctttaaaagtagcagctcaagaagagaatgaatttacggaaataaattctgctcctttaaaagtaagtgaagccgctcgttatagctttgccgatatagttgaaccgttaattcctgcagtcgttaatatttcaacaatagaatatgttaatagtaaatcggaaaacgccgagaaagatcctctgcaagaaaaagttaatgattttttagaaaagcttaatataccgctgaatttggaagaggttgatcaaactccgaaaagtgtcccgcttggttcaggatttattattgaacctaacggcttaatagtgacaaactatcatgtaattgcaaatgttgataaaattaatataaaacttgcagataataccgaattatcggctaaattaataggtaacgatactaaaaccgatttagctctcttaaaaatagatagcgaggaacctctaccttttgttgagtttggagattcaaatgatgcaagagtaggagattgggttattgcgatcggtaatccgttcggtaatctaggcggtacggtgacaagtggtattatttcttctaaagggcgggatatcgatatagatacggacaatatagtcgataattttattcaaacggatgctgcaattaataacggtaattccggtggtcctatgtttaatttggatcagaaagtaatcggcgtaaatacggcaattttttcaccgctcggtactaatataggtatcggttttgcaataccgtcaaatactgcaaagcctataatcgaacgtcttaagaaagatggaaaagtaagtagagggcgccttggagtaacaatacaagatttaaccgaggacatttctgaagggctaggacttaaaaatactagaggggtgttagtagctaaagtacaagaagacggtccaggtgataaagcgggaattaaaacaggtgatataataatagagtttgcagatataccggttaaaaatactaaaaaattacgtgtaattattgcagatgctcctattgatcaggaagtaaaagtaaaaatacttcgcgataaaaaggagcttgagttacctattaaaattacttcggataatgaagaggttaccaaagattctacagaagagaccaataagaaagaaataacaaataaagaagaaaataatttatctattactaaaaataatattacttttggtaatttgactgaagaactaagacaaaaatatactattcctcaagataaaatgggaatagtgataaccaatattgatgaagaagaaagtagcttcaaaattggtgatctgataaccaatattaatcagaaaagcatagacgatataagtaagctagaagaattatatgaaaatgctaaaaaatcagataagaaaaatattttgctcttgattgaaagggggagtagtaatatgttcgtaccattgcaggttatgtag

SEQ ID NO: 28768 - protein, 511 aa, Rickettsia conorii
MEYMVNLKIVIVIIVLISSNVVLAKENSRSLKVAAQEENEFTEINSAPLKVSEAARYSFADIVEPLIPAVVNISTIEYVNSKSENAEKDPLQEKVNDFLEKLNIPLNLEEVDQTPKSVPLGSGFIIEPNGLIVTNYHVIANVDKINIKLADNTELSAKLIGNDTKTDLALLKIDSEEPLPFVEFGDSNDARVGDWVIAIGNPFGNLGGTVTSGIISSKGRDIDIDTDNIVDNFIQTDAAINNGNSGGPMFNLDQKVIGVNTAIFSPLGTNIGIGFAIPSNTAKPIIERLKKDGKVSRGRLGVTIQDLTEDISEGLGLKNTRGVLVAKVQEDGPGDKAGIKTGDIIIEFADIPVKNTKKLRVIIADAPIDQEVKVKILRDKKELELPIKITSDNEEVTKDSTEETNKKEITNKEENNLSITKNNITFGNLTEELRQKYTIPQDKMGIVITNIDEEESSFKIGDLITNINQKSIDDISKLEELYENAKKSDKKNILLLIERGSSNMFVPLQVM

SEQ ID NO: 28769 - DNA, 1452 bp, Borrelia burgdorferi (Lyme disease spirochete)
  CDS (1)..(1452)
atgagtaattatgtggaggttataaaagtggaaaaaaagtttttttctggatttcttcttagttttttggctttgagtattggattttttattgggatgcattatttagcttctaatagaagcaacattgtttttgcagaagaaaaggacaataccgtacgagccttacaagattcttttagagaggtttccaagaaaattttaccatcatctgtggaagttcatgcaacaggggtaatcaagcagagttttcctattccatttttcttttttgatatgccagaatttgattctgagagaaaaagcaattgggcggggtctggagtaataattggtagagattctcaaaaaaaatcattattttatgtggttacgaatagtcatgtggtagataaggcaactgaacttgaagttgtatcttatgataaaaaaaagcacaaggctaagttaattggcaaagatgaaaaaaaggatattgcccttattagctttgaaagtgatgacgcaactattaaagtagctgatcttggagatagtgataagcttgaaataggtgattgggttatggcagtgggcagcccttttcaatttagttttacagttacagcaggtattgtaagtggattgcaacgttctgcaaatcctaatttgcaatcaaggaatctgtttattcaaaccgatgctgcaatcaacaggggtaattcaggtggtcctcttgtaaatataaagggcgaggttattggaattaatgcttggatagcttcaaattctggcggaaatattgggttgggttttgcaattcctgttaacaatattaaaagcactgtagattttttccttaaaggtaaaaaaattgaatcggcttggcttggaatttctttttatccgctaaagacaagagattctgaggtgctaaaaagcttaggggttgaaagtaatgatgtttcagctgcaattattgcttctctttatccgggttcacccgctgttaaatcagggcttagggcaggggatattattatgaaggttaatggggtttccatgagcgtttttcaagatgttacatcatatattagtgatttttatgctggtgagaaagtaaatgtagaaatcttaagaggcaatgtcaaaaaaaatattgagattgttcttgctgttagacctaaggataaagagctttcttcttcaaagatgcttccaggctttgttgtgtatccattggttgaggatattaaagctcagcttaatttaagaaattggattaaaggtgttgttgttgattatattgataaaaatttagcatcaaatattaaaatgaaatcaggagatgtaattctttctgtaaattcaaaaagtgtttctaatttaagagaattttatgatgctcttgaggttggaaaaaatacttataaaattttgagaggaaacgattcttttaaaattacattttag

SEQ ID NO: 28770 - protein, 483 aa, Borrelia burgdorferi (Lyme disease spirochete)
MSNYVEVIKVEKKFFSGFLLSFLALSIGFFIGMHYLASNRSNIVFAEEKDNTVRALQDSFREVSKKILPSSVEVHATGVIKQSFPIPFFFFDMPEFDSERKSNWAGSGVIIGRDSQKKSLFYVVTNSHVVDKATELEVVSYDKKKHKAKLIGKDEKKDIALISFESDDATIKVADLGDSDKLEIGDWVMAVGSPFQFSFTVTAGIVSGLQRSANPNLQSRNLFIQTDAAINRGNSGGPLVNIKGEVIGINAWIASNSGGNIGLGFAIPVNNIKSTVDFFLKGKKIESAWLGISFYPLKTRDSEVLKSLGVESNDVSAAIIASLYPGSPAVKSGLRAGDIIMKVNGVSMSVFQDVTSYISDFYAGEKVNVEILRGNVKKNIEIVLAVRPKDKELSSSKMLPGFVVYPLVEDIKAQLNLRNWIKGVVVDYIDKNLASNIKMKSGDVILSVNSKSVSNLREFYDALEVGKNTYKILRGNDSFKITF

SEQ ID NO: 28771 - DNA, 1494 bp, Chlamydia trachomatis
  CDS (1)..(1494)
atgatgaaaagattattatgtgtgttgctatcgacatcagttttctcttcgccaatgctaggctatagtgcgtcaaagaaagattctaaggctgatatttgtcttgcagtatcctcaggagatcaagaggtttcacaagaagatctgctcaaagaagtatcccgaggattttctcgggtcgctgctaaggcaacgcctggagttgtatatatagaaaattttcctaaaacagggaaccaggctattgcttctccaggaaacaaaagaggctttcaagagaacccttttgattattttaatgacgaattttttaatcgattttttggattgccttcgcatagagagcagcagcgtccgcagcagcgtgatgctgtaagaggaactgggttcattgtttctgaagatggttatgttgttactaaccatcatgtagtcgaggatgcaggaaaaattcatgttactctccacgacggacaaaaatacacagctaagatcgtggggttagatccaaaaacagatcttgctgtgatcaaaattcaagcggagaaattaccatttttgacttttgggaattctgatcagctgcagataggtgactgggctattgctattggaaatccttttggattgcaagcaacggtcactgtcggggtcattagtgctaaaggaagaaatcagctacatattgtagatttcgaagactttattcaaacagatgctgccattaatcctgggaattcaggcggtccattgttaaacatcaatggtcaagttatcggggttaatactgccattgtcagtggtagcgggggatatattggaatagggtttgctattcctagcttgatggctaaacgagtcattgatcaattgattagtgatgggcaggtaacaagaggctttttgggagttaccttgcaaccgatagattctgaattggctacttgttacaaattggaaaaagtgtacggagctttggtgacggatgttgttaaaggttctccagcagaaaaagcagggctgcgccaagaagatgtcattgtggcttacaatggaaaagaagtagagtctttgagtgcgttgcgtaatgccatttccctaatgatgccagggactcgtgttgttttaaaaatcgttcgtgaagggaaaacaatcgagatacctgtgacggttacacagatcccaacagaggatggcgtttcagcgttgcagaagatgggagtccgtgttcagaacattactccagaaatttgtaagaaactcggattggcagcagatacccgagggattctggtagttgctgtggaggcaggctcgcctgcagcttctgcaggcgtcgctcctggacagcttatcttagcggtgaataggcagcgagtcgcttccgttgaagagttaaatcaggttttgaaaaactcgaaaggagagaatgttctccttatggtttctcaaggagatgtggtgcgattcatcgtcttgaaatcagacgagtag

SEQ ID NO: 28772 - protein, 497 aa, Chlamydia trachomatis
MMKRLLCVLLSTSVFSSPMLGYSASKKDSKADICLAVSSGDQEVSQEDLLKEVSRGFSRVAAKATPGVVYIENFPKTGNQAIASPGNKRGFQENPFDYFNDEFFNRFFGLPSHREQQRPQQRDAVRGTGFIVSEDGYVVTNHHVVEDAGKIHVTLHDGQKYTAKIVGLDPKTDLAVIKIQAEKLPFLTFGNSDQLQIGDWAIAIGNPFGLQATVTVGVISAKGRNQLHIVDFEDFIQTDAAINPGNSGGPLLNINGQVIGVNTAIVSGSGGYIGIGFAIPSLMAKRVIDQLISDGQVTRGFLGVTLQPIDSELATCYKLEKVYGALVTDVVKGSPAEKAGLRQEDVIVAYNGKEVESLSALRNAISLMMPGTRVVLKIVREGKTIEIPVTVTQIPTEDGVSALQKMGVRVQNITPEICKKLGLAADTRGILVVAVEAGSPAASAGVAPGQLILAVNRQRVASVEELNQVLKNSKGENVLLMVSQGDVVRFIVLKSDE

SEQ ID NO: 28773 - DNA, 1431 bp, Helicobacter pylori
  CDS (1)..(1431)
atgatgaaaaaaactttttttgtctctttggctttagcgttaagcttgaatgcgggcaatatccaaatccaaaacatgcccaaagtgaaagagcgaataagcgtcccctctaaagaggatacgatctattcttaccacgattctattaaggattctattaaagcggtggtgaatatctccactgaaaagaagattaaaaacaattttataggtggcggtgtgtttaatgacccctttttccaacaatttttcggggatttgggtggcatgatccctaaagaaagaatggaaagggctttaggcagcggcgtcatcatttctaaagatggctatatcgttacgaataaccatgtgattgatggcgcggataagattaaagtaaccattccagggagcaacaaagaatattccgccactttagtaggcacggattctgaaagcgatttagcggtgattcgcatcactaaagacaacttacccacgatcaaattctctgattctaatgatattttagtgggcgatttggtttttgccatcggtaacccttttggcgtgggtgaaagcgttacgcaaggcattgtttcagcgctcaataaaagcgggattgggatcaacagctatgaaaatttcattcaaacagacgcttccattaatcctggaaattccggcggcgctttaattgatagccgtggagggttagtggggatcaataccgctatcatttctaaaaccggcggtaaccacggtattggctttgccatcccttctaacatggttaaagatattgtaacccagctcatcaaaaccggtaagattgaaagaggttacttgggcgtgggcttgcaagatttgagcggcgatttgcaaaattcttatgacaataaagaaggggcggtggtcattagcgtagaaaaagactctccggctaaaaaagcagggattttggtgtgggatttgatcactgaagtcaatgggaaaaaggttaaaaacacgaatgagttaagaaacctaatcggctccatgctacccaatcaaagagtaaccttaaaagtcattagagacaaaaaagaacgcactttcaccctcactcttgctgaaaggaaaaaccctaacaaaaaagaaaccatttctgctcaaaacggtgtgcaaggtcagttgaacgggcttcaagtagaagatttaacccaaaaaaccaaaaggtctatgcgtttgagcgatgacgttcaaggggttttagtctctcaagtgaatgaaaattccccagcagagcaagccggcttcagacaaggcaacatcatcacaaaaattgaagaggttgaagttaaaagcgttgcggattttaaccatgctttagaaaaatataaaggcaaacccaaacgattcttagttttagacttgaaccaaggttatagaatcattttggtgaaatga

SEQ ID NO: 28774 - protein, 476 aa, Helicobacter pylori
MMKKTFFVSLALALSLNAGNIQIQNMPKVKERISVPSKEDTIYSYHDSIKDSIKAVVNISTEKKIKNNFIGGGVFNDPFFQQFFGDLGGMIPKERMERALGSGVIISKDGYIVTNNHVIDGADKIKVTIPGSNKEYSATLVGTDSESDLAVIRITKDNLPTIKFSDSNDILVGDLVFAIGNPFGVGESVTQGIVSALNKSGIGINSYENFIQTDASINPGNSGGALIDSRGGLVGINTAIISKTGGNHGIGFAIPSNMVKDIVTQLIKTGKIERGYLGVGLQDLSGDLQNSYDNKEGAVVISVEKDSPAKKAGILVWDLITEVNGKKVKNTNELRNLIGSMLPNQRVTLKVIRDKKERTFTLTLAERKNPNKKETISAQNGVQGQLNGLQVEDLTQKTKRSMRLSDDVQGVLVSQVNENSPAEQAGFRQGNIITKIEEVEVKSVADFNHALEKYKGKPKRFLVLDLNQGYRIILVK

SEQ ID NO: 28775 - DNA, 1302 bp, Clostridium acetobutylicum
  CDS (1)..(1302)
atgatggacgatttaaacaataataacgtgaataataatgatacagataatacaactgaaatgaataataataacaatgataataccgttaatatgaatatgccaattgaatataaaaaagaaagcaataaaaatagaaaacctttcaacaaaaaaatagcatcatatatagcagtaggtttaacctgcgctatacttggaggaggtatatcaacagcatcagccttatatcttcttcctaaatcaaactttttcaaaagtacaccattatacaaaactatggctaatggtggaagttcttctctaggctatattaatgcttcaccaacctcaacaaagacgtctagtgcaactggaagtggtttaactgtatcgcaaatagtaaaaaaagttagccctgcagtagttggtgtatcaacaaaaacgactgtaacccaaaacgattttgattccttctttggctcaagtaatggtaatggaagctctacacaggaaggaatgggatccggaataatattcaataatgatggttatatactaacaaattaccatgttataaaaggtgcagataaaatagcagtaatcctaaacaacaaaaaagaagtttcagctaaagttgtaaattatgatgaagctaatgatatagccgtaataaagatgacaggaagctttactgttcctggtgttgcagaacttggaagctcagcttcattaaatgttggtgattcagtcgttgcaattggaaatcctttaggaaaagaattcttaggaacagttacaactggagttgtcagtgctgttaatcgtgaagtagccgtaagcgaaggtcaaaaacaaacttatatccaaacagatgcagctataaatcctggaaacagcggaggtcctctagtaaattcattcggacaagtagttggtataaattctgctaagataagtgaaaacggcgtagaaggaataggcttctcaattccaattgatactgtaaaaagcaaaattcaaaatctttctaagcctatactaatgcttggaataagtggtgaagctgtagataaaagtaccgctgaacagcataatatacctcaaggtgtatatattgaacaaattcaagactttagttctgctcaaaaagcaggtatgcaggttggagatgtaataacaaagtttgatggtaaaaaagtaacttctactagcgatatcgattctataaagtcaaaacataactcaggtgatactgtacaagtagaagtttacagggacgatgcttataaaaccctttctttaaaactatcagacaaataa

SEQ ID NO: 28776 - protein, 433 aa, Clostridium acetobutylicum
MMDDLNNNNVNNNDTDNTTEMNNNNNDNTVNMNMPIEYKKESNKNRKPFNKKIASYIAVGLTCAILGGGISTASALYLLPKSNFFKSTPLYKTMANGGSSSLGYINASPTSTKTSSATGSGLTVSQIVKKVSPAVVGVSTKTTVTQNDFDSFFGSSNGNGSSTQEGMGSGIIFNNDGYILTNYHVIKGADKIAVILNNKKEVSAKVVNYDEANDIAVIKMTGSFTVPGVAELGSSASLNVGDSVVAIGNPLGKEFLGTVTTGVVSAVNREVAVSEGQKQTYIQTDAAINPGNSGGPLVNSFGQVVGINSAKISENGVEGIGFSIPIDTVKSKIQNLSKPILMLGISGEAVDKSTAEQHNIPQGVYIEQIQDFSSAQKAGMQVGDVITKFDGKKVTSTSDIDSIKSKHNSGDTVQVEVYRDDAYKTLSLKLSDK

SEQ ID NO: 28777 - DNA, 2009 bp, Brucella abortus
  CDS (275)..(1816)
tgttattattctcctgattggcggcggcgcgcttcttgttgctttccggcgtcggcgcgctgctggcacagccccacagcccctttccgaaagcgaaaaagcggaactttcccgcctgctcgacggaaaataggccaacaaaacctctggaaaccttacgaaactttcatcttgcggaaattgaacggtaaggtagctctaactatcttgctctcatagaaaattacgaggccagaaattcctggcccggattactgctcgcaaggagaaacagatgtccagagccaggatttccaactatcgcaaaggcgttgccgccgtcgcgctttccgcagcgcttgccggcgcattcgtcgtaaccggcccgcttggtgcgctgaacgaagcccgcgccgaagcggtgcatgtgacgccgccgccgcaggctggctttgccgatctggtggaaaaggttcgccctgcggtcgtcagcgtccgcgtcaagaaggacgtgcaggagacttccaaccgtggtccgcagttcttcggccctcccggcttcgaccagttgccggacggtcatccgctgaagcgatttttccgtgattttggtatggagccgcgtggcgattcacgctccgataaccgtcgcggcaaggccaacaagccgcgcccgggccatgaacgccctgttgcacaaggatcgggcttcgtcatttccgaagatggctatgtcgttaccaacaaccatgtcgtttccgatggcgatgcctataccgtcgtgctggacgacggcaccgaacttgatgccaagctgattggtgctgatccgcgcacggacctggccgtgttgaaaatcaacgctccgaagcgcaagttcgtctatgtcgcctttggcgacgataataaggtgcgcgtcggtgattgggttgtcgcagttggcaatccgttcggccttggtggcacggtgacttccggtatcgtttcggcccgtggccgagacatcggcgcaggcccctatgacgatttcatccagattgatgccgccgtgaacaagggcaattccggtggtccggctttcgacctttccggcgaagtcatcggcatcaacaccgccatcttctcgccatctggcggcagcgtgggcattgcttttgcaattccgtcctccaccgccaagcaggtcgtggaccagctcatcaagaagggttccgtcgagcgcggctggatcggcgtccagatacagcctgtgaccaaggatatcgccgcttcgctcggtcttgccgaggaaaagggtgcgatcgtggcctcgccgcaggatgatggcccggctgccaaggctggcatcaaggcgggcgatgtgattacggctgtcaatggcgaaacggttcaggacccgcgtgacctggcgcgcaaggttgccaatatcgcccctggtgaaaaggcggccctgaccgtctggcgcaagaacaaggccgaggaaatcaacgtcacgattgctgccatgcccaatgacaaggggaagagcggcagccagtccaacgacaatgacggcggacagggtgaaacgctcgactcctacggcttgaccgtcgttccgtctgaagacggtaagggcgtggtcgttaccgatgtggacccggacagcgatgcggctgaccgtggcatccgctccggcgatgtgatcgtgagcgtcaacaaccagacggtaaagaccgctggcgatatcaacaaggccatcacggcagccgaaaagtcaggccgtaaggcggtgctgctgcaattgcagagcaatgatcagagccgcttcgtggcgctgccgatcaatcaggaatgatcggcgcctcgcagggaaactgatcgaattccgatgccaggcgggtaactgcctggcatcgccttatcgctgaacggaacctatagtagcgccatcgaaaattctcgttatcgaagatgaccgcgaagccgttatctggaaaaggcctttgccgaggcagggcattcggccgatatcgcgggcgacggcgaaa

SEQ ID NO: 28778 - protein, 513 aa, Brucella abortus
MSRARISNYRKGVAAVALSAALAGAFVVTGPLGALNEARAEAVHVTPPPQAGFADLVEKVRPAVVSVRVKKDVQETSNRGPQFFGPPGFDQLPDGHPLKRFFRDFGMEPRGDSRSDNRRGKANKPRPGHERPVAQGSGFVISEDGYVVTNNHVVSDGDAYTVVLDDGTELDAKLIGADPRTDLAVLKINAPKRKFVYVAFGDDNKVRVGDWVVAVGNPFGLGGTVTSGIVSARGRDIGAGPYDDFIQIDAAVNKGNSGGPAFDLSGEVIGINTAIFSPSGGSVGIAFAIPSSTAKQVVDQLIKKGSVERGWIGVQIQPVTKDIAASLGLAEEKGAIVASPQDDGPAAKAGIKAGDVITAVNGETVQDPRDLARKVANIAPGEKAALTVWRKNKAEEINVTIAAMPNDKGKSGSQSNDNDGGQGETLDSYGLTVVPSEDGKGVVVTDVDPDSDAADRGIRSGDVIVSVNNQTVKTAGDINKAITAAEKSGRKAVLLQLQSNDQSRFVALPINQE

SEQ ID NO: 28779 - DNA, 1185 bp, Synechocystis sp
  CDS (1)..(1185)
atgaaatatcccacttggttacgccgcatcggcggttacttattggcttttgcagtgggcacggcttttggtatcgccaatttaccccatgcagtggcggcggcggacgatttgcccccggctcctgtgattaccgcccaggcatcggtacccttgacctcagaaagctttgtggcggcggccgtatcccgttctgggccagcggtggtgcgcatcgatacggagacagtggtaacccgtcgcactgaccccattttggacgacccattcttccaggaattttttggtagatccttccccgtacctccccgggaaagacgcattgccggccagggtagtggcttcattatcgacaacagtggcattattctcaccaacgcccatgtggtagatggtgccagtaaagtggtggtgactctccgggatggccgtactttcgacggccaggtgcggggcaccgatgaagtgacagatttggctgtggtgaaaattgagccccagggttctgccctaccagtggctccccttggcacttccagtaatctgcaggtgggagattgggcgatcgccgtgggtaatccggtggggttagataatacagttaccctaggaattattagcacattgggaagatccgccgcccaggccggtatccccgataagcgggtggaatttattcaaaccgatgccgccattaaccccggcaattccggtggcccgttgctcaatgcccggggagaagtgattggcattaacaccgccatccgagccgatgccactggcattggttttgccattccgatagatcaggccaaggcaattcaaaataccctcgctgcggggggaacagtgccccatccctacattggggtgcaaatgatgaatatcacggtggaccaagcccagcagaataatcgcaatcccaattctccctttatcattcctgaagtggatggcattttggtgatgcgggtcttgcccggaacccccgctgaaagggccggtatccgtcggggagatgtcattgtggcggtggacggtactcccattagcgatggtgcccgcctacagcgcatagtagaacaagccggtttgaacaaagctctcaaactcgacctactccggggcgatcgccgtttaagcctaaccgtacaaacggcccaacttcgtaatcccaccagttaa

SEQ ID NO: 28780 - protein, 394 aa, Synechocystis sp
MKYPTWLRRIGGYLLAFAVGTAFGIANLPHAVAAADDLPPAPVITAQASVPLTSESFVAAAVSRSGPAVVRIDTETVVTRRTDPILDDPFFQEFFGRSFPVPPRERRIAGQGSGFIIDNSGIILTNAHVVDGASKVVVTLRDGRTFDGQVRGTDEVTDLAVVKIEPQGSALPVAPLGTSSNLQVGDWAIAVGNPVGLDNTVTLGIISTLGRSAAQAGIPDKRVEFIQTDAAINPGNSGGPLLNARGEVIGINTAIRADATGIGFAIPIDQAKAIQNTLAAGGTVPHPYIGVQMMNITVDQAQQNNRNPNSPFIIPEVDGILVMRVLPGTPAERAGIRRGDVIVAVDGTPISDGARLQRIVEQAGLNKALKLDLLRGDRRLSLTVQTAQLRNPTS

SEQ ID NO: 28781 - DNA, 1251 bp, Synechocystis sp
  CDS (1)..(1251)
atggcaatccatctgaaggcatcacatttaggcgtggccgtgcttttactccttttcggtggggcgatcggtgccgctggggggggttatcttttgtcttcaggccaaaaccattcctcccccgactcccctgtcaacaccagtccccaaagtctgactcctgccccggtggagagcaattaccgcagtgccctccccctaactctgcctcgctctgcccaggatgatcaggagctaaatttcatcgcccgggctgtgcaaaaaattggccccgcagtggtcagaattgattcggaaaggactgctgtttcccagggcggccccatgggagaccaaccctttttccgtcgcttttttggtgaggaaatgccccctaaccccgacccaagggaacagggcactggctcgggttttattttgagttctgacggcgaagttttaaccaatgcccatgtggtggaaggggccagcacagttaaggtcacccttaaagatggctccgtcctcgaaggtaaggtgatgggaattgatacgatgaccgatgtggccgtagtgaaagttgaagcggaaaatttgcctgtggtggaaattggccaatccgatcgcctgcagcctggagaatgggccatcgctattggtaatcctttgggtttagataacaccgttaccgttggcattatcagtgccctgggccgctctagttccgaggtgggggtgccagataaacgggtgcgctttatccaaaccgatgccgccatcaatccaggcaattccggtggccccctgctcaatgccaaaggggaagtgattggagtcaacacagccatccgagccgatgcccagggattgggatttgccattcctattcaaacggcccaaaatgtagcggaaaatctgtttaccaagggcaaaatggagcatccctaccttggcatccacatggttaccctgaccccggaaatgactaaacaattgcggactagtggggagttaccggcaggggtgacagcggacacaggggttttaattattcaagtcagtccaggttccccggcggcccaggcagggttggccccaggggacatcattctcgaagtggggggcatgggggttaaaaccgccactgacgttcaagaacgggtggaagtgagtcaaattggggaacctttggcgatcgccgttaagcgtggacaaaaaccacaaatgatggcagtgcgaccagggccctttcccgaagatttgggtcaataa

SEQ ID NO: 28782 - protein, 416 aa, Synechocystis sp
MAIHLKASHLGVAVLLLLFGGAIGAAGGGYLLSSGQNHSSPDSPVNTSPQSLTPAPVESNYRSALPLTLPRSAQDDQELNFIARAVQKIGPAVVRIDSERTAVSQGGPMGDQPFFRRFFGEEMPPNPDPREQGTGSGFILSSDGEVLTNAHVVEGASTVKVTLKDGSVLEGKVMGIDTMTDVAVVKVEAENLPVVEIGQSDRLQPGEWAIAIGNPLGLDNTVTVGIISALGRSSSEVGVPDKRVRFIQTDAAINPGNSGGPLLNAKGEVIGVNTAIRADAQGLGFAIPIQTAQNVAENLFTKGKMEHPYLGIHMVTLTPEMTKQLRTSGELPAGVTADTGVLIIQVSPGSPAAQAGLAPGDIILEVGGMGVKTATDVQERVEVSQIGEPLAIAVKRGQKPQMMAVRPGPFPEDLGQ

SEQ ID NO: 28783 - DNA, 1359 bp, Synechocystis sp
  CDS (1)..(1359)
atgtcagcccaagccgttttcccaattgctcctcaccgggctgacttttttcccagatttgttttaagcaacagttcagcaaataagtgtcatcaagccatgaaagacgtttccctccattctcccaaacagaccccttctaaaatttccttggcctacctggggctagtcctggtgggtatgggcattggtgctggggggacatttgtcttaactaatccccaatgggcggatcatttaacaaataattctgttatttctcccttagtaactaatcaatccattgctcctgccaatgagagcttagcaacgaacttacaaagtcgtttatcccctagagagcccagcaattttgtcgtggacgtggtggaatccaccggccccgcggtggtgcgtatcaatgcccaaaaaacggttaaatcccaggtgccccaggcatttaatgatcccttcttgcaaagattttttggttcccagatgccccccatgcccaacgaacgggtgcaacggggaacgggctccggtttcattgttagtaatgatggcaagattttcaccaatgcccatgtggtggatggggccgatgaagtgacagtaactcttaaggatggtcgttcctttcccggtcgggtgatgggttctgatccctctacggatgtggcggtggtcaaaattgaagctggtgatttacctaccgtggccttaggggactccgatcacctgcaggtgggggaatgggcgatcgccattggtaatcctttaggattggacaatacggtcaccacagggattttgagtgccacaggccgccgcagtgcggatattggtgtgcccgacaaacgggtggaatttatccaaaccgatgcggccattaaccctggtaactctggtggtcctctcctcaatgcggatgggcaagtaattggtatgaacaccgccattattcaaaacgcccagggcattggttttgctatccccatcaacaaagcccaggaaattgctcaacagttaattgctacgggcaaagtggagcacgcctacctcggcattcaaatggtgaccatgaccccggaactacaaagccaaattcgccaagaaacgggtatgaacattcctgtggataagggtgtagtgattatgcaggttatgcccaactctccagcggcgatcgccaaactggaacaaggggatgtgctccaatctctccagggacaaccagtggaaaatgctgaacaggtacaatccctagtgggcaaactggcggtgggagacgaagtggaactaggcattctccgcaacggccaacagcaaaatttaaccgtcaccattggtgccctgcccagcgcccctccccaataa

SEQ ID NO: 28784 - protein, 452 aa, Synechocystis sp
MSAQAVFPIAPHRADFFPRFVLSNSSANKCHQAMKDVSLHSPKQTPSKISLAYLGLVLVGMGIGAGGTFVLTNPQWADHLTNNSVISPLVTNQSIAPANESLATNLQSRLSPREPSNFVVDVVESTGPAVVRINAQKTVKSQVPQAFNDPFLQRFFGSQMPPMPNERVQRGTGSGFIVSNDGKIFTNAHVVDGADEVTVTLKDGRSFPGRVMGSDPSTDVAVVKIEAGDLPTVALGDSDHLQVGEWAIAIGNPLGLDNTVTTGILSATGRRSADIGVPDKRVEFIQTDAAINPGNSGGPLLNADGQVIGMNTAIIQNAQGIGFAIPINKAQEIAQQLIATGKVEHAYLGIQMVTMTPELQSQIRQETGMNIPVDKGVVIMQVMPNSPAAIAKLEQGDVLQSLQGQPVENAEQVQSLVGKLAVGDEVELGILRNGQQQNLTVTIGALPSAPPQ

SEQ ID NO: 28785 - DNA, 1740 bp, Lactococcus lactis
  CDS (230)..(1456)
aaacaagatgaaaacatgatttatcaacatttttttacttttttccacttttctgtggaaaactttattaaaatatccacttatcctcattaatttttagattatccacaaaaatgtggagaaactatattagtttgatttttgttactattaaggtattattaagtgagagtagatataattacatcatagaaatgctacaaagattaataattgaaaggaattatttatggcaaaagctaatataggaaaattgctattaacaggtgtcgtgggcggagccatcgcacttggaggaagtgcaatctatcaaagcactacaaatcaatcggcaaataatagtcgttcaaatacaactagtacaaaggttagtaacgtttcggtaaatgtcaataccgatgttacctctgcaattgaaaaagtttcaaattctgtcgtttctgttatgaattatcaaaaagataactcacaaagtagtgacttcagttcaatttttggtggaaatagcggttcaagttcatcgactgatggcttacagctttctagtgaaggctctggtgtcatctacaaaaaatctggtggtgatgcctacgttgtaactaactaccacgttattgctggtaatagctcacttgatgttctgctttctggtggacaaaaagtcaaagattctgtggttggttatgatgaatacacagaccttgctgttcttaaaatcagttctgaacatgtcaaagatgtggcgacattcgctgattctagtaaattaacaattggtgaacctgccattgccgttggctcacctttaggtagtcaatttgcaaacaccgcaactgaaggaattttatctgcaacaagccgtcaagtgactttgacccaagaaaatggtcaaacaactaatatcaatgcaattcaaacagatgctgccattaaccctggtaactctggaggggctttgattaatattgaaggacaagttattggaattactcaaagtaaaattacaacaactgaagatggttctacttctgtcgaaggtttaggatttgcgattccttctaatgatgtcgtaaatatcattaataaacttgaagatgatggtaagatttcacgccctgctttaggtatccgaatggttgacctttcacaattatcaacaaatgacagttctcaattgaaattactaagcagtgtaacaggtggggttgttgtttactccgtccaatctggacttcctgctgcctcagctggtttgaaagctggagatgtaattacaaaggttggcgatacagcagtaacctcttcaacagacttgcaaagtgctctttactcacacaatatcaatgatacagtaaaagttacttattatcgtgatggtaaatcaaatacagcagatgttaaactttctaaatcaaccagtgacttagaaacaagcagtccatcttcttctaattaataacttaataatttaataaaagtcttctgtaaatagaaggcttttttcatactaaagtctgaaatttttaaaaataataaatttccatttttcttttattgatttatggtaaaataaagttaagcatgaaaattttactttacttagaagccgaacaatttttgagtcattcaggaattggtcgtgcaatgaaacatcaacaacgcgcccttgatttaatgggcattgactggacaaaaaatcctgaggatgattacgatatcctccatttaaatacttatggc

SEQ ID NO: 28786 - protein, 408 aa, Lactococcus lactis
MAKANIGKLLLTGVVGGAIALGGSAIYQSTTNQSANNSRSNTTSTKVSNVSVNVNTDVTSAIEKVSNSVVSVMNYQKDNSQSSDFSSIFGGNSGSSSSTDGLQLSSEGSGVIYKKSGGDAYVVTNYHVIAGNSSLDVLLSGGQKVKDSVVGYDEYTDLAVLKISSEHVKDVATFADSSKLTIGEPAIAVGSPLGSQFANTATEGILSATSRQVTLTQENGQTTNINAIQTDAAINPGNSGGALINIEGQVIGITQSKITTTEDGSTSVEGLGFAIPSNDVVNIINKLEDDGKISRPALGIRMVDLSQLSTNDSSQLKLLSSVTGGVVVYSVQSGLPAASAGLKAGDVITKVGDTAVTSSTDLQSALYSHNINDTVKVTYYRDGKSNTADVKLSKSTSDLETSSPSSSN

SEQ ID NO: 28787 - DNA, 1383 bp, Rhodobacter capsulatus
  CDS (1)..(1383)
atgtttgacagcttatcatcgataaggttcgccgatctggtcgtgcaggtgaaaccggcggtggtgatgatcaccacctcgaccacagtttccgaacccgccgggcgcatgccgggctttccgccgggctcgcccttcgaagagttcttcaaggaattcggcatgccgaacatgccgcagggcgggccgcagcggcaacaccacgccgatgcgctgggctcgggtttcgtgatctcggccgatggctacatcgtgacgaacaaccacgtcatcaagggcgaggatggcaacaccgtcgccgatgaaatctcgatcgaattcgccaatggcaagaagctggacgcgaagatcgtcggcaccgatccgaaaaccgacatcgcgcttttgaaggtcgaaagcaaggagcccctgccctttgtcagcttcggcgacagcgacacgatgcgcgagggcgactgggtgatggcgatgggcaacccgctgggtcagggcttctcgacctcggtcggtatcgtctcggcgcgcaaccgggaactgagcggcacctatgacgactgcatccagaccgatgccgcgatcaaccgcggcaactcgggcgggcccttgttcagcatggacggcaaggtgatcggggtgaacaccgcgattctctcgcccaatggcggctcgatcgggatcggcttttccatggcctcgaacgtggtctcgaaggtcgcgggccagctgcaggaattcggcgccacccggcgcggctggctgggcgtgaagatccaggacctgacccccgacatggccgaggcgatgagcctggccacgcccgaaggcgcgatggtgtcggaagtgcccgagggcccggccaaggtggcggggatgaaatcgggcgacgtgatcatcagctttgccggggcgccggtgaaggacacgaaatcgctgacccgccgcgtcgccgatgcgccggtgggccaggcggtcgatgtcgtggtgatgcgcgcgggcaagccggtgacgttgcaggtgacgctggggcagcgcgaactggccgaaagcagcgaggcggcggcgggcggcacggccccggcgctggcgggcggcgcggtgctgggcatggtgctctcgccgatcaccgatgcgatgcgggccgagcgcaacctgcccgaagatctgaccgggctgatggtgaccgatatcgacgcgaccggggcggcttttgacaaggggctgcgggcgggcgacgtgatcgtcgaggccgggcagcagccggtgacctcgcttgacgacctgaaggcccgggtggccgaggcgaaagagggcgggcgcaaatcggtgctgcttctgatccggcgcgagggcgagccgcgtttcgtcgcggtgccgctgcaataa

SEQ ID NO: 28788 - protein, 460 aa, Rhodobacter capsulatus
MFDSLSSIRFADLVVQVKPAVVMITTSTTVSEPAGRMPGFPPGSPFEEFFKEFGMPNMPQGGPQRQHHADALGSGFVISADGYIVTNNHVIKGEDGNTVADEISIEFANGKKLDAKIVGTDPKTDIALLKVESKEPLPFVSFGDSDTMREGDWVMAMGNPLGQGFSTSVGIVSARNRELSGTYDDCIQTDAAINRGNSGGPLFSMDGKVIGVNTAILSPNGGSIGIGFSMASNVVSKVAGQLQEFGATRRGWLGVKIQDLTPDMAEAMSLATPEGAMVSEVPEGPAKVAGMKSGDVIISFAGAPVKDTKSLTRRVADAPVGQAVDVVVMRAGKPVTLQVTLGQRELAESSEAAAGGTAPALAGGAVLGMVLSPITDAMRAERNLPEDLTGLMVTDIDATGAAFDKGLRAGDVIVEAGQQPVTSLDDLKARVAEAKEGGRKSVLLLIRREGEPRFVAVPLQ

SEQ ID NO: 28789 - DNA, 1392 bp, Haemophilus influenzae
  CDS (1)..(1392)
atgaaaaaaacacgttttgtactaaatagtattgcacttggattaagtgtattaagcacatcatttgttgctcaagccactttgccaagttttgtttcggaacaaaacagtcttgcaccaatgttagaaaaagtacaacctgccgttgtcactctttccgttgaaggaaaagctaaagtagattctcgttctcctttcctagacgatattcctgaagaatttaaattcttctttggcgatcgttttgccgaacaatttggtggacgtggagaatcaaagcgtaacttccgtggtttaggttctggtgtcattattaatgcaagcaaaggctatgttttaaccaataatcatgttattgatgaagctgataaaattaccgtgcaattacaagatgggcgtgaatttaaagcaaaattagtgggtaaagatgaactatcagatattgcattagtacagcttgaaaaaccaagtaatttaacagaaatcaaatttgctgattccgacaaattacgcgtaggcgatttcactgttgcaatcggtaatccatttggtttaggtcaaactgtgacatcaggtattgtttctgcattgggtcgttcaacaggttctgacagtggcacttatgaaaactatattcaaaccgatgcagcagtaaaccgcggtaattcgggtggagcgttagtaaacttaaatggcgaacttattggaattaataccgcaattatttctccaagcggtggcaatgcaggaattgcctttgcgattccaagtaatcaagcaagcaatttagtgcaacaaattttagaatttggtcaagtgcgtcgcggattgcttggtattaaaggtggcgaactcaatgctgatttagccaaagcctttaatgtaagcgcgcaacaaggcgcatttgtaagtgaagttttaccgaaatctgctgctgaaaaagcaggacttaaagcgggcgatattatcacggcgatgaacggtcaaaaaatctcaagtttcgctgaaattcgtgcaaaaatcgcaaccactggtgcaggcaaagagattagcttgacttacttacgtgatggcaaatcccacgacgttaaaatgaaattacaagcggatgatagtagccaactttcctcaaaaactgagttgcctgcattagatggtgcaacattgaaagactacgatgctaaaggcgttaaaggaattgaaatcacaaaaattcaacctaattcgctggctgcacaacgtggtttaaaatcgggcgatattattattggtattaatcgtcaaatgatcgaaaacattcgtgaattaaataaagtgcttgaaactgaaccgtcagcagttgcacttaatattttacgaggtgacagtaatttctatttattagtgcaataa

SEQ ID NO: 28790 - protein, 463 aa, Haemophilus influenzae
MKKTRFVLNSIALGLSVLSTSFVAQATLPSFVSEQNSLAPMLEKVQPAVVTLSVEGKAKVDSRSPFLDDIPEEFKFFFGDRFAEQFGGRGESKRNFRGLGSGVIINASKGYVLTNNHVIDEADKITVQLQDGREFKAKLVGKDELSDIALVQLEKPSNLTEIKFADSDKLRVGDFTVAIGNPFGLGQTVTSGIVSALGRSTGSDSGTYENYIQTDAAVNRGNSGGALVNLNGELIGINTAIISPSGGNAGIAFAIPSNQASNLVQQILEFGQVRRGLLGIKGGELNADLAKAFNVSAQQGAFVSEVLPKSAAEKAGLKAGDIITAMNGQKISSFAEIRAKIATTGAGKEISLTYLRDGKSHDVKMKLQADDSSQLSSKTELPALDGATLKDYDAKGVKGIEITKIQPNSLAAQRGLKSGDIIIGINRQMIENIRELNKVLETEPSAVALNILRGDSNFYLLVQ

SEQ ID NO: 28791 - DNA, 1800 bp, Yersinia enterocolitica
  CDS (244)..(1680)
aatattttttacttttctgattattggttctctgaacttcatcccccatatttaatcttactatgcaagacgactatatccttcttaacttgaattgctgcgttgcatccacccgattcactaaattgagttcgattatcgggttcatcagcttgatctgcggcaaggccaattattatgggataagtctgttatacaccatttattgactcattattaattgtatagcgagacgcagaatacatgaaaaaaacaactttagtgttaagtgcattggcattgagcatcggtttagccatggggccggtttcttctgtcgttgcggcagaaacggcctcttccagcagccagcagctccctagcctggcgccaatgctagagaaggtaatgccttcggttgtgagtatcaatgtggagggaagtgctcaggtaagtaatgccggcggcataccaccacagttccagcaattctttggtgatgattcgccattctgccaggacggttctccgttccaagggtcaccaatgtgtcagggggggcctggtagcagggggggagcacccagcaagcaggatttccgtgcgctgggttctggcgtaattattgatgctgctaaaggttatgtcgtcactaataaccacgtagtagataatgcaaccaaaatcaatgttaagctcagtgatggccgtagttatgaagcaaaagtgattggtaaagatccgcgtactgatattgcattattgcagctgaaagacgctaaaaatctgactgcgattaaaattgccgactccgatcaactgcgcgttggggattataccgtagctatcggtaacccatacggcctgggtgaaaccgtcacttccggtatcgtgtcggcgttgggccgcagtggtttgaatgtggaaaactacgaaaactttatccagactgacgcggcaattaaccgtggtaactccggtggtgcattgatcaatctgaacggtgaactgatcgggatcaacacggctattctggcacctgatggcggcaacatcggtatcggttttgctatcccaagtaacatggtgaaaaacctgacctcacagatggttgaatttggtcaggtgaaacgcggtgaactgggcattatgggtacagagctgaactctgagctggcgaaagcaatgaaggttgatgcgcagaaaggggcctttatcagtcaggtactgccaaaatctgctgcagctaaagcagggattaaagcgggtgatgtgattgtcagcatgaatggcaaagccatcaatagcttcgctggcttccgtgccgagattggtactttgcctgtgggcagcaaaatgaccttgggtctgttgcgcgacggtaagcctgtcaacgtggaagtgacattagagcaaagcagccaaactcaagttgattcaggcaatctctacactggtattgaaggggctgagctgagcaactctgatgtgaatggtaagaaaggtgtgaaagttgatagtgtgaaacctggcactgctgctgcgcgtataggcctgaaaaaaggcgatgtcatcatgggtgtcaaccagcaacccgttcagaatctgggtgagctgcggaaaatccttgataccaaaccatcggtattggcattgagcattcagcgtggtgatacttcactctatctgctgatgcagtaatcaccactgatgcagtaacaagtatttatgtagtaaaagtatagataccgccacaaagggcacaaccgcttatcgttgtgccctttctatttaggttttgtggcggccggtattaggctg

SEQ ID NO: 28792 - protein, 478 aa, Yersinia enterocolitica
MKKTTLVLSALALSIGLAMGPVSSVVAAETASSSSQQLPSLAPMLEKVMPSVVSINVEGSAQVSNAGGIPPQFQQFFGDDSPFCQDGSPFQGSPMCQGGPGSRGGAPSKQDFRALGSGVIIDAAKGYVVTNNHVVDNATKINVKLSDGRSYEAKVIGKDPRTDIALLQLKDAKNLTAIKIADSDQLRVGDYTVAIGNPYGLGETVTSGIVSALGRSGLNVENYENFIQTDAAINRGNSGGALINLNGELIGINTAILAPDGGNIGIGFAIPSNMVKNLTSQMVEFGQVKRGELGIMGTELNSELAKAMKVDAQKGAFISQVLPKSAAAKAGIKAGDVIVSMNGKAINSFAGFRAEIGTLPVGSKMTLGLLRDGKPVNVEVTLEQSSQTQVDSGNLYTGIEGAELSNSDVNGKKGVKVDSVKPGTAAARIGLKKGDVIMGVNQQPVQNLGELRKILDTKPSVLALSIQRGDTSLYLLMQ

SEQ ID NO: 28793 - DNA, 2027 bp, Azotobacter vinelandii
  CDS (483)..(1904)
atgatcgaggagccgggccgggtggtagcaatcgagcgtgaggctgtatggatcgaagccttggatgaagccgcctgtcctggctgtactgcaagcgtcggttgcggtcgctggtcgttcgactggctggagacaccgaggcggcgcaggcgtatccgtgccttgtcggtcatgccgcttcgagtcggcgacgccgtggtggtcggcatccgagaggacttcctgttacgcagcactcttgcgatctacctgttacccttgctggggctgtttgtctgcactattgccattcagcagctcggtttcggggagtcgttgatgatcccggccggttttctggggtttgtctctgtttgggccatggtgcgcagaataagccgacgccagatgaatgatccgacattgcagccagtggtgctgcgtgccttgcctggtgcttccgaaggacaagtcaggcaagcggctttttgagtggaggaagtatgtcaaaggttggttttaagtccttcgcctccgttttggcaggtgccctgctgctcgggcagtcgctcttcgtgcaggcgcaattaccggagttcacctcgctggtggaggaagcctcgccggcggtagtcaatatcagtacccggcaaaagcttcccgatcgctccacggttcagggattgcctgatctcgaggggcttccgccgcttttcagggagttcctggagcgcagcattccgcaacttccgcgtactccggataacgggcggcagcgtgaggcgcactccctgggctcgggtttcatcatttctccagatggctatgttctaaccaacaaccatgtggtggccgatgccgatgaaatcatcgtgcgtttgtccgatcgcagtgagctcgaggccgagctggtcggggccgatcctcttacccgatgtagctttgttgaaggtcaagggttcgaatctccccacagtcaaactgggacgtaccgaccaattgagagtcggggaatgggttctggccatcggttcccctttcggtttcgatcattccgtgactgcgggcatcatcagtgccacggggcgaagcctgccgaacgagagttagttcctttcatccagaccgatgtggccatcaatcccggtaactccggcgggccgctcttcgatctggatggacgggtcataggcatcaactcccagatattcacccggtcggggggcttcatgggcttgtctttcgcgattcccatcgaggttgccatgggcgtggccgatcagttgaaggccactggcaaggttgctcgcggttggttgggagtaatcattcaggaagtcaacaaggatctggctgagtcctttggtctggatcggccggccggagcgttggtcgcccaggtcttggaggatggaccggcggacaagggcggtttgcaggtcggcgatgtcattctcagcctagatggtcatcctattgtgatgtcggccgatctgccgcatctggttggggggctcaaacccggggctgcagccaatctcgaggtggtgcgtgacggcaagcggaggaacatcgctatcactgtcggggccttgccggaggaggggaatggggttcagccgagtatcgcgggcacggaacagagcagcaatcgccttggagtgacggtcaccgaactgacggctgagcagaagaaatcccttgatctcaagggtggtgtggtcattcgcgaagtgctgaacggtccggccgcattgatcggactgcggcctggcgatgtagttacccatttgaacaatcagccgatcgactcggcgaagacctttgccgaagtggccggtgcgttgccaaaaggccggtcggtatccatgagggtgctgcgccaggggcgtgccagtttcattactttcaaactggccgagtgaggctcccggacatgaaaagagggcggtgaaaccgctcttttcatgcctgtcaagagaggtaatgcgtgacgtggtaatgttgatcagttaaactctccggccattttgacgctagccgccgag

SEQ ID NO: 28794 - protein, 473 aa, Azotobacter vinelandii
MSKVGFKSFASVLAGALLLGQSLFVQAQLPEFTSLVEEASPAVVNISTRQKLPDRSTVQGLPDLEGLPPLFREFLERSIPQLPRTPDNGRQREAHSLGSGFIISPDGYVLTNNHVVADADEIIVRLSDRSELEAELVGADPLTRCSFVEGQGFESPHSQTGTYRPIESRGMGSGHRFPFRFRSFRDCGHHQCHGAKPAERELVPFIQTDVAINPGNSGGPLFDLDGRVIGINSQIFTRSGGFMGLSFAIPIEVAMGVADQLKATGKVARGWLGVIIQEVNKDLAESFGLDRPAGALVAQVLEDGPADKGGLQVGDVILSLDGHPIVMSADLPHLVGGLKPGAAANLEVVRDGKRRNIAITVGALPEEGNGVQPSIAGTEQSSNRLGVTVTELTAEQKKSLDLKGGVVIREVLNGPAALIGLRPGDVVTHLNNQPIDSAKTFAEVAGALPKGRSVSMRVLRQGRASFITFKLAE

SEQ ID NO: 28795 - DNA, 1905 bp, Brucella abortus
  CDS (333)..(1835)
aattcgttcttctcaaaccccgtttcaacgcgcagacggcgctgctttggggctttcctgttattattctcctgattggcggcggcgcgcttcttgttgctttccggcgtgcggcgcgctgctggcacagccccacagccccttccgaaagcgaaaaagcggaactttcccgcctgctcgacggaaaataggccaacaaaacctctggaaaccttacgaaactttcatcttgcggaaattgaacggtaaggtagctctaactatcttgctctcatagaaaattacgaggccagaaattcctggcccggattactgctcgcaaggagaaacagatgtccagagccaggatttccaactatcgcaaaggcgttgccgccgtcgcgctttccgcaagccttgccggcgcattcgtcgtaaccggcccgcttggtgcgctgaacgaagcccgcgccgaagcggtgcatgtgacgccgccgccgcaggctggctttgccgatctggtggaaaaggttcgccctgcggtcgtcagcgtccgcgtcaagaaggacgtgcaggagacttccaaccgtggtccgcagttcttcggccctcccggcttcgaccagttgccggacggtcatccgctgaagcgatttttccgtgattttggtatggagccgcgtggcgattcacgctccgataaccgtcgcggcaaggccaacaagccgcgcccgggccatgaacgccctgttgcacaaggatcgggcttcgtcatttccgaagatggctatgtcgttaccaacaaccatgtcgtttccgatggcgatgcctataccgtcgtgctggacgacggcaccgaacttgatgccaagctgattggtgctgatccgcgcacggacctggccgtgttgaaaatcaacgctccgaagcgcaagttcgtctattcgcctttggcgacgataataaggtgcgacgtcggtgattgggttgtcgcagttggcaatccgttcggccttggtggcacggtgacttccggtatcgtttcggcccgtggagccgacatcggcgcaggcccctatgacgatttcatccagattgatgccgccgtgaacaagggcaattccggtggtccggctttcgacctttccggcgaagtcatcggcatcaacaccgccatcttctcgccatctggcggcacggtgggcattgcttttgcaattccgtcctccaccgccaagcaggtcgtggaccagctcatcaagaagggttccgtcgagcgcggctggatcggcgtccagatacagcctgtgaccaaggatatcgccgcttcgctcggtcttgccgaggaaaagggtgcgatcgtggcctcgccgcaggatgatggcccggctgccaaggctggcatcaaggcgggcgatgtgattacggctgtcaatggcgaaacggttcaggacccgcgtgacctggcgcgcaaggttgccaatatcgcccctggtgaaaaggcggccctgaccgtctggcgcaagaacaaggccgaggaaatcaacgtcacgattgctgccatgcccaatgacaaggggaagagcggcagccagtccaacgacaatgacggcggacagggtgaaacgctcgactcctacggcttgaccgtcgttccgtctgaagacggtaagggcgtggtcgttaccgatgtggacccggacagcgatgcggctgaccgtggcatccgctccggcgatgtgatcgtgagcgtcaacaaccagacggtaaagaccgctggcgatatcaacaaggccatcacggcagccgaaaagtcaggccgtaacggagctgctgctgcaattgcagagcaatgatcagagccgcttcgtggcgctgccgatcaatcaggaatgatcggcgcctcgcagggaaactgatcgaatt

SEQ ID NO: 28796 - protein, 500 aa, Brucella abortus
MSRARISNYRKGVAAVALSASLAGAFVVTGPLGALNEARAEAVHVTPPPQAGFADLVEKVRPAVVSVRVKKDVQETSNRGPQFFGPPGFDQLPDGHPLKRFFRDFGMEPRGDSRSDNRRGKANKPRPGHERPVAQGSGFVISEDGYVVTNNHVVSDGDAYTVVLDDGTELDAKLIGADPRTDLAVLKINAPKRKFVYSPLATIIRCDVGDWVVAVGNPFGLGGTVTSGIVSARGADIGAGPYDDFIQIDAAVNKGNSGGPAFDLSGEVIGINTAIFSPSGGTVGIAFAIPSSTAKQVVDQLIKKGSVERGWIGVQIQPVTKDIAASLGLAEEKGAIVASPQDDGPAAKAGIKAGDVITAVNGETVQDPRDLARKVANIAPGEKAALTVWRKNKAEEINVTIAAMPNDKGKSGSQSNDNDGGQGETLDSYGLTVVPSEDGKGVVVTDVDPDSDAADRGIRSGDVIVSVNNQTVKTAGDINKAITAAEKSGRNGAAAAIAEQ

SEQ ID NO: 28797 - DNA, 1466 bp, Campylobacter jejuni
  CDS (48)..(1466)
aaaatattttacgagataatttatctttaagaacaaaaggaaatgaaatgaaaaagatttttttatcattaagtttagcaagtgctttatttgctgcaagtattaattttaacgaatcgactgcaacggctaatcgtgtgaatcctgctgctggaaatgcagtcctttcttatcatgattctattaaagatgcaaaaaaatcagtggttaatatttccacctcaaaaactattacaagagcaaatcgtccaagccctttggatgatttttttaatgatccttattttaaacaattttttgattttgattttcctcaaagaaaaggaaaaaatgataaagaagtggtgagttctttgggatcaggggtgattatttcaaaagatggttatatagtaacaaataatcacgttgtagatgatgctgatacgattacagtgaatttaccaggaagcgacatagaatataaagcaaaacttataggtaaagatccaaaaacagatttggctgttataaaaatagaggctaataatctttcagctattacttttacaaattctgatgatttaatggaaggagatgttgtttttgcacttggaaatccttttggagttggttttagtgttacaagtgggataatatctgctttaaataaagacaatataggtttaaatcaatatgaaaattttatacaaacagatgcttctatcaatccaggaaattcaggtggagctttggtggatagtcgcggatatttagtaggtattaattcagctattctttctcgtggtggtggaaataacggcataggttttgccataccttcaaatatggttaaagatatagctaaaaaacttattgaaaaaggcaagattgatagaggatttctaggtgcgtctattttagctttgcaaggtgatactaaaaaagcttacaaaaatcaagaaggagctttaatcactgatgttcaaaaaggttcaagtgctgatgaagcagggcttaagcgtggagatttagttactaaagttaatgataaggttataaaaagtcctattgatcttaaaaattatattggaactttagagattggtcaaaaaatttcattaagttacgaaagagatggagaaaataagcaagcaagttttattcttaaaggtgaaaaagaaaatcctaaaggcgtacaaagcgatttgattgatggtttgagtttgagaaatttagatccaagacttaaggatcgtttgcaaattccaaaagatgttaatggtgttttggttgatagtgttaaagaaaagagcaaagggaaaaattctggtttccaagagggtgatattatcataggtgttggacaaagtgaaattaaaaatttaaaagatttagaacaagctttaaaacaagttaataaaaaagaatttaccaaagtttgggtatatcgcaatggtttggcgactttgcttgtgcttaaataa

SEQ ID NO: 28798 - protein, 472 aa, Campylobacter jejuni
MKKIFLSLSLASALFAASINFNESTATANRVNPAAGNAVLSYHDSIKDAKKSVVNISTSKTITRANRPSPLDDFFNDPYFKQFFDFDFPQRKGKNDKEVVSSLGSGVIISKDGYIVTNNHVVDDADTITVNLPGSDIEYKAKLIGKDPKTDLAVIKIEANNLSAITFTNSDDLMEGDVVFALGNPFGVGFSVTSGIISALNKDNIGLNQYENFIQTDASINPGNSGGALVDSRGYLVGINSAILSRGGGNNGIGFAIPSNMVKDIAKKLIEKGKIDRGFLGASILALQGDTKKAYKNQEGALITDVQKGSSADEAGLKRGDLVTKVNDKVIKSPIDLKNYIGTLEIGQKISLSYERDGENKQASFILKGEKENPKGVQSDLIDGLSLRNLDPRLKDRLQIPKDVNGVLVDSVKEKSKGKNSGFQEGDIIIGVGQSEIKNLKDLEQALKQVNKKEFTKVWVYRNGLATLLVLK

SEQ ID NO: 28799 - DNA, 1191 bp, Pseudomonas aeruginosa
  CDS (14)..(1183)
aaggattttcccgatgcccaaggccctgcgtttcctcggctggcccgtgctggtcggcgtgctgctggccctgctgatcatccagcacaaccccgagctggtcggcctgccacgccaggaggtgcacgtcgagcaggcgcctctgctcagccgcctgcaggaaggcccggtgtcctatgccaacgcggtgagtcgagcggctccggcagtggccaacctgtacaccaccaagatggtcaggaagccctcccaccccctgttcgacgacccgatgttccgccgcttcttcggcgacaacctgccgcaacagaagcgcatggagtcgagcctcggctcggcggtgatcatgagcgcggaaggctacctgctgaccaacaaccacgtgaccgctggcgccgaccagatcatcgtggccttgcgcgacggccgcgaaaccatcgcccagttggtcggcagcgacccggaaaccgacctggccgtgctgaagatcgaccttaagaacctgccggcgatgaccctcggccgctccgacggcattcgcaccggcgacgtctgcctcgccatcggcaacccgttcggcgtcggccagacccgtgaccatgggcatcatcagcgccaccggacgcaaccagctcggcctgacacctacgaagacttcatccagaccgacgcggcgatcaaccccggcaactccggcggcgcgctggtggacgctgccggcaacctgatcggcatcaacacggcgatcttctccaagtccggcggctcccagggtatccgttcgccatcccgaccaagctggaccctggaggtcatgcagtcgatcatcgagcacggccaggtgatccgcggctggctcggcgtcgaggtcaaggcgctgaccccggaactggcggagtcgctgggcctcggcgaaaccgccgggatcgtcgtcgccgggcgtctatcgcgaggtccggcggcacgcggcggcctgctgccgggcgatgtgatcctgaccatcgacaagcaggaagccagcgacggccgccgctcgatgaaccaggtggcgcgcacccgtccgggacagaagatcagcatcgtggtgctgcgcaacggacagaaggtcaacctgaccgccgaggtcggcctgcgtccgccgccggcaccggctccacagcagaaacaggacggcggcgagtgatccccgtc

SEQ ID NO: 28800 - protein, 389 aa, Pseudomonas aeruginosa
MPKALRFLGWPVLVGVLLALLIIQHNPELVGLPRQEVHVEQAPLLSRLQEGPVSYANAVSRAAPAVANLYTTKMVRKPSHPLFDDPMFRRFFGDNLPQQKRMESSLGSAVIMSAEGYLLTNNHVTAGADQIIVALRDGRETIAQLVGSDPETDLAVLKIDLKNLPAMTLGRSDGIRTGDVCLAIGNPFGVGQTRDHGHHQRHRTQPARPDTYEDFIQTDAAINPGNSGGALVDAAGNLIGINTAIFSKSGGSQGIRSPSRPSWTLEVMQSIIEHGQVIRGWLGVEVKALTPELAESLGLGETAGIVVAGRLSRGPAARGGLLPGDVILTIDKQEASDGRRSMNQVARTRPGQKISIVVLRNGQKVNLTAEVGLRPPPAPAPQQKQDGGE

SEQ ID NO: 28801 - DNA, 1488 bp, Burkholderia mallei ATCC 23344
  CDS (1)..(1488)
atgactacccgaatccttgcacgtggcgcagttgccgtggctgtcgccgcggcgttgtcggcaggctatgtggcgggcacccgccgggcggagccgcagatcatcacgccggcggtcgccgcgctgatgccggccgaggcggccgcgaagacgggcattcccgatttttccgggctggtcgagacctacgggccggccgtcgtgaacatcagcgcgaagcacgtcgtgcagcgcgccgcgcagcgtcgcgcggcgccgcagttgccgatcgacccggacgatccgttctatcaattcttccgacatttctacgggcagattcccgggatgggcggcggccgccagccgcagccggacgaccagccgagcacgagcctcggctccggcttcatcatcagcgccgacgggtatatcctgactaacgcgcacgtgatcgacggtgcgaacgtcgtgaccgtgaagctcaccgacaagcgcgagtacaaggcgaaggtcgtcggcgccgacaagcagtccgacgtcgcggtgctgaagatcgacgcttcgggcctgccgatcgtgaagatcggcgatccggcgcagagcaaggtcggccagtgggtcgtcgcgatcggctcgccgtacgggttcgacaacacggtcacctcgggcatcatcagcgcgaagtcgcgtgcgttgcccgacgagaactacacgccgttcatccagaccgacgtgcccgtgaaccccggcaactcgggcggcccgctgttcaacctgaacggcgaggtgatcggcatcaactcgatgatctactcgcagacgggcggcttccaggggctgtcgttcgcgatcccgatcaacgaggcgatgaaggtgaaggacgagctcgtgaagacgggccacgtgagccgcggccggctcggcgtcgccgtgcaggggctcaatcagacgctcgcgagttcgttcggcttgcaaaagcccgacggcgcgctcgtcagctcggtcgatccgaaggggccggccgcgaaggccgggctgcagccgggcgacgtgatcctcgcggtcgacggcgtgccggttcaggattcgtcgacgctgcccgcgcagatcgcgggcatgaagccgggcacgaaggccgatctgcagatctggcgcgacaagtcgaggaagacggtatcggtgacgctcgcgtcgctcgccgacgatcaggcgaaggcgggcgccgacgagcccgtcgagcaggggcggctcggcgtcgcggtgcgcccgctgtcgccgcgcgagcgcaacggctcgtcgctcacgcacggcctggtcgtccagcaatcggcggggcctgccgcgagcgcgggcatccagcccggcgacgtgattctcgcggtgaacgggcggcccgtcacgagcgccgaacaattgcgcgacgcggtcaagcgcgcgggcaacagtcttgcgctgctgatccagcgtgacgatgcccagattttcgtgccggtcgatctgggctag

SEQ ID NO: 28802 - protein, 495 aa, Burkholderia mallei ATCC 23344
MTTRILARGAVAVAVAAALSAGYVAGTRRAEPQIITPAVAALMPAEAAAKTGIPDFSGLVETYGPAVVNISAKHVVQRAAQRRAAPQLPIDPDDPFYQFFRHFYGQIPGMGGGRQPQPDDQPSTSLGSGFIISADGYILTNAHVIDGANVVTVKLTDKREYKAKVVGADKQSDVAVLKIDASGLPIVKIGDPAQSKVGQWVVAIGSPYGFDNTVTSGIISAKSRALPDENYTPFIQTDVPVNPGNSGGPLFNLNGEVIGINSMIYSQTGGFQGLSFAIPINEAMKVKDELVKTGHVSRGRLGVAVQGLNQTLASSFGLQKPDGALVSSVDPKGPAAKAGLQPGDVILAVDGVPVQDSSTLPAQIAGMKPGTKADLQIWRDKSRKTVSVTLASLADDQAKAGADEPVEQGRLGVAVRPLSPRERNGSSLTHGLVVQQSAGPAASAGIQPGDVILAVNGRPVTSAEQLRDAVKRAGNSLALLIQRDDAQIFVPVDLG

SEQ ID NO: 28803 - DNA, 1209 bp, Burkholderia pseudomallei K96243
  CDS (1)..(1209)
atgcttagacgcttctggctgttcttcgcccaagcggtgacggtgctgctcgcactgatgttcatcgtggcgacgctcaagccgcaatggctccaacggcagggccagctcggcaagcagctcgcggcgccgatcgtcgcgctgcgggaagtcgcgcccggcgtcggcggcgcgcccgctcaatcctcgtatgcggacgccgcgcaaaaggcgatgcccgcggtcgtcaacgtgttctccagcaaggacggttcgctgccgcccgatccgcgcgcgaaggatccgctgtttcgctatttcttcggcgaccgcaacgcgcgccggcagcaggaggaacccgcggccaatctggggtcgggcgtcatcgtaagctcggagggttacattctaacgaaccagcacgtcgtcgacggcgcggaccagatcgaagtcgcgctcgccgacggccgcacggccaccgcgaaggtgatcggcagcgatccggaaaccgacctcgcggtgctcaagatcaacatgacgaacctgccgacgatcacgctcggccgctccgaccagtcgcgcgtgggcgacgtcgtgctcgcgatcggcaacccgttcggggtcggccagacggtcacgatggggatcatcagcgcgctcgggcgcaaccacctcggcatcaacacgttcgagaacttcatccagaccgacgcgccgatcaacccgggcaattcgggcggcgcgctcgtcgacgtaaacggcaacctgctcggcatcaatacggcgatctactcgcgctcgggcggctcgctcggcatcggcttcgcgatccccgtgtcgaccgcgcgcaacgtgctcgagagcatcatcacgacgggcaccgtcacgcgcggctggatcggcgtcgagccgcaggacgtgacgccggagatcgccgaatcgttcagccttgcgcaaaaatcgggcgcgatcgttgcgggcgtgctgcaaggcggcccggccgacaaggcgggcatcaagccgggcgatattctgatgtcgatcgacggcgaggacatcaccgatacgacgaagctgctgaacgtcgtcgcgcagatcaagcccggcacgccggcgaaggttcacgtggtgcgcaagggcaaggaactcgacgtcaccgtcgtgatcggcaagcggccgccgccgccgaagcaggcgctcgacgaccagaacagcgacgaggaggagtga

SEQ ID NO: 28804 - protein, 402 aa, Burkholderia pseudomallei K96243
MLRRFWLFFAQAVTVLLALMFIVATLKPQWLQRQGQLGKQLAAPIVALREVAPGVGGAPAQSSYADAAQKAMPAVVNVFSSKDGSLPPDPRAKDPLFRYFFGDRNARRQQEEPAANLGSGVIVSSEGYILTNQHVVDGADQIEVALADGRTATAKVIGSDPETDLAVLKINMTNLPTITLGRSDQSRVGDVVLAIGNPFGVGQTVTMGIISALGRNHLGINTFENFIQTDAPINPGNSGGALVDVNGNLLGINTAIYSRSGGSLGIGFAIPVSTARNVLESIITTGTVTRGWIGVEPQDVTPEIAESFSLAQKSGAIVAGVLQGGPADKAGIKPGDILMSIDGEDITDTTKLLNVVAQIKPGTPAKVHVVRKGKELDVTVVIGKRPPPPKQALDDQNSDEEE

SEQ ID NO: 28805 - DNA, 1458 bp, Burkholderia pseudomallei K96243
  CDS (1)..(1458)
atgacgccgcttgccgcgcaatcggcgacggcggctccgaatgtcacgaccacgcccgccgcaacgggcgccgtgcccgcggcgcgcgcgggcctgcccgatttcgcggacctcgtcgagcgggtcggcccggcggtcgtcaacatccggacgacggcgaacgtgccggccgatacgcgcggcgcgctgccgcccggcctcgacaacggcgacatgtcggaattcttccgccgcttcttcggcattccgttgccgcaggggccgggcgggcagaagaacgcgccgagcacgcccgatgcgcccgacaccgaacagaaccgcggcgtgggctcgggcttcatcctgtcgccggacggctatgtgatgacgaacgcgcacgtcgtcgacgacgcggacacgatctacgtgacgctcaccgacaagcgcgaattcaaggcaaagctcatcggcgtcgacgagcgcacggacgtcgcgatcgtgaagatcaacgcgtcgagcctgccgaccgtcgcgatcggcgattcgaaccgcgtgcgcgtcggcgaatgggtcgtcgcgatcggttcgccgttcggcctcgacaacaccgtcacggccggcatcgtcagcgcaaagggccgcaacaccggcgactatctgccgttcatccagacggacgtcgcggtcaaccccggcaactcgggcggcccgctcatcaacatgcagggcgaggtgatcggcatcaactcgcagatctacagccgcacgggcggcttcatgggcatttcgttcgcgattccgatcgacgaggcgatgcgcgtcgccgagcagctgaaggcatcgggcaaggtcacgcgcggcaggatcgcggtcgcgatcggcgaggtgacgaaggaagtggcggattcgatcggcctgccgaaggccgaaggcgcgctcgtcagcagcgtcgagccaggcggcccggccgacaaggcgggcctgcagccgggtgacatcatcctgaagttcaacggccgtccggtggaggcggcgtcggatctgccgcgcatggtcggcgacacgaagccgggcgcgaaggcgacggtgacggtgtggcgcaaggggcaatcgcgcgatctgccgatcacgatcgcggaattcccggccgacaaggccgcgaaggccgacagccgtcaggcgccgcagcagaagccgcgcagcagcgcgctcggcctgacggtcagcgacctgtcgcccgagcagttgaagacgctcaagctgcgcaacggcgtgcagatcgacgcggtcgacggcccggcctcgcgcgcggggctgcagcgcggcgacatcgtgctgcgcgtcggcgacgtcgacatcacgagcgcgaagcagttcgtcgacgtgacgtcgaagctcgatccgcagcgcgcggtcgcggtgctcgtgcggcgcggcgagaacacgcagttcatcccgatccggccgcgtcagaagtga

SEQ ID NO: 28806 - protein, 485 aa, Burkholderia pseudomallei K96243
MTPLAAQSATAAPNVTTTPAATGAVPAARAGLPDFADLVERVGPAVVNIRTTANVPADTRGALPPGLDNGDMSEFFRRFFGIPLPQGPGGQKNAPSTPDAPDTEQNRGVGSGFILSPDGYVMTNAHVVDDADTIYVTLTDKREFKAKLIGVDERTDVAIVKINASSLPTVAIGDSNRVRVGEWVVAIGSPFGLDNTVTAGIVSAKGRNTGDYLPFIQTDVAVNPGNSGGPLINMQGEVIGINSQIYSRTGGFMGISFAIPIDEAMRVAEQLKASGKVTRGRIAVAIGEVTKEVADSIGLPKAEGALVSSVEPGGPADKAGLQPGDIILKFNGRPVEAASDLPRMVGDTKPGAKATVTVWRKGQSRDLPITIAEFPADKAAKADSRQAPQQKPRSSALGLTVSDLSPEQLKTLKLRNGVQIDAVDGPASRAGLQRGDIVLRVGDVDITSAKQFVDVTSKLDPQRAVAVLVRRGENTQFIPIRPRQK

SEQ ID NO: 28807 - DNA, 1557 bp, Burkholderia pseudomallei K96243
  CDS (1)..(1557)
atgtctcgtcaaacgcttggccgcgccctgattcacgttgcagcgctcggggcggtgcttgccggcttcgcttgcctgcagccgacgccactcgccgcgggtacgctgcaatcgccggcgaaggcgaagcgaatcgcgcagatcggcgccgcggggccggtcgattttcccacgctcgtcgagcgatacgggcccgccgtcgtcagcgtgagcgtgcctgcgcaggatccgcagatgtcggcgtccggcctcgaggcgctcgatcccgacgatccgttcttcgcctacttcaaatccgccgccacgcagcccgcactgtcgccggagaacgggccgcgcgcgatggcgggcgccggatccggttttatcgtcggcgccgacgggatcatcctgacgaccgcgtacgtggtcgggcaggcgagcgaggcgacggttcgcctgatcgaccggcgcgaattcaaggcgcgggtgctggccgtcgatgattcgagcgatgtggccgtgttgcagatcgacgcgacgaagctgccgacggtgcggctcggcgattcgtcccgggtgcgcacgggcgagccggtgctgacgatcggcacgccggacggctcggcgaacacggtgacgacgggcatcgtcagcgcgacggcgcgcatgttgcccgacggcggccgctttccgttcttccagaccgacgtgaccggcaacctcgacaactcgggcggcccggtgttcaaccgcgcgggcgaggtgatcggcatcgacgtgcagatctacggcagcggcgagcgcaatccgggcgtgacgtttgcgattccgatcgacatggcgatgaaggtgcgtgcgcaggtgctgcaggcgcagcgccaggcgcggcagcaggcgcagccgccgatgcaacaggcgcaacaggcgcaacaagcgccgcccgcggcggcgcagaacgcgctgggcgtcgacgcgcaggacgtcggtccggggctcgcggcggcgttcggcctgccgcggccggcgggcgcgcttgtcaatgcagtggagccggggtcgccggcggcggcggtcgggctgaagccgggcgacgtgatcgtgcagatcggcgatcggccgctcggccgctcggcggaactggccggcgacctcgcggcgctgccgcccggggcgagcgcgccgatcacgctgatccgcaaccggatgccgatgacggtgatgctcagctccggcgcggccgcgagcgcgccgacaggcgcgaccgcatcgccgggcaatgcggccgccggccgcagcgagacgggcggcgcggaccgcctgggcctgacgatgcatccgctgacggacgacgagcggcgctcgacgggattgcccgtcggcatggtggtcgatgcggtgcgcgggccggcggcgaacgcggggattcggccgggcgacgtcgtgctggagctcgacgatacgctgatcgagacgccggacatggtgccggcgctggaggcgaaggcggggaaggtggtcgcggtgctgattcagcgggggagcgagcgcaggttcgtgtcggtgaaggcgcggtga

SEQ ID NO: 28808 - protein, 518 aa, Burkholderia pseudomallei K96243
MSRQTLGRALIHVAALGAVLAGFACLQPTPLAAGTLQSPAKAKRIAQIGAAGPVDFPTLVERYGPAVVSVSVPAQDPQMSASGLEALDPDDPFFAYFKSAATQPALSPENGPRAMAGAGSGFIVGADGIILTTAYVVGQASEATVRLIDRREFKARVLAVDDSSDVAVLQIDATKLPTVRLGDSSRVRTGEPVLTIGTPDGSANTVTTGIVSATARMLPDGGRFPFFQTDVTGNLDNSGGPVFNRAGEVIGIDVQIYGSGERNPGVTFAIPIDMAMKVRAQVLQAQRQARQQAQPPMQQAQQAQQAPPAAAQNALGVDAQDVGPGLAAAFGLPRPAGALVNAVEPGSPAAAVGLKPGDVIVQIGDRPLGRSAELAGDLAALPPGASAPITLIRNRMPMTVMLSSGAAASAPTGATASPGNAAAGRSETGGADRLGLTMHPLTDDERRSTGLPVGMVVDAVRGPAANAGIRPGDVVLELDDTLIETPDMVPALEAKAGKVVAVLIQRGSERRFVSVKAR

SEQ ID NO: 28809 - DNA, 1419 bp, Burkholderia pseudomallei K96243
  CDS (1)..(1419)
atggcgggcacccgccgggcggagccgcagatcatcacgccggcggtcgccgcgctgatgccggccgaggcggccgcgaagacgggcatccccgatttttccgggctggtcgagacctacgggccggccgtcgtgaacatcagcgcgaagcacgtcgtgcagcgcgccgcgcagcgtcgcgcggcgccgcagttgccgatcgacccggacgatccgttctatcaattcttccgacatttctacgggcagattcccgggatgggcggcggccgccagccgcagccggacgaccagccgagcacgagcctcggctccggcttcatcatcagcgccgacgggtatatcctgactaacgcgcacgtgatcgacggtgcgaacgtcgtgaccgtgaagctcaccgacaagcgcgagtacaaggcgaaggtcgtcggcgccgacaagcagtccgacgtcgcggtgctgaagatcgacgcttcgggcctgccgatcgtgaagatcggcgatccggcgcagagcaaggtcggccagtgggtcgtcgcgatcggctcgccgtacgggttcgacaacacggtcacctcgggcatcatcagcgcgaagtcgcgtgcgttgcccgacgagaactacacgccgttcatccagaccgacgtgcccgtgaaccccggcaactcgggcggcccgctgttcaacctgaacggcgaggtgatcggcatcaactcgatgatctactcgcagacgggcggcttccaggggctgtcgttcgcgatcccgatcaacgaggcgatgaaggtgaaggacgagctcgtgaagacgggccacgtgagccgcggccggctcggcgtcgccgtgcaggggctcaatcagacgctcgcgagttcgttcggcttgcaaaagcccgacggcgcgctcgtcagctcggtcgatccgaaggggccggccgcgaaggccgggctgcagccgggcgacgtgatcctcgcggtcgacggcgtgccggttcaggattcgtcgacgctgcccgcgcagatcgcgggcatgaagccgggcacgaaggccgatctgcagatctggcgcgacaagtcgaggaagacggtatcggtgacgctcgcgtcgctcgccgacgatcaggcgaaggcgggcgtcgacgagcccgtcgagcaggggcggctcggcgtcgcggtgcgcccgctgtcgccgcgcgagcgcaacggctcgtcgctcacgcacggcctggtcgtccagcaatcggcggggcccgccgcgagcgcgggcatccagcccggcgacgtgattctcgcggtgaacgggcggcccgtcacgagcgccgaacaattgcgcgacgcggtcaagcgcgcgggcaacagtcttgcgctgctgatccagcgtgacgatgcccagattttcgtgccggtcgatctgggctga

SEQ ID NO: 28810 - protein, 472 aa, Burkholderia pseudomallei K96243
MAGTRRAEPQIITPAVAALMPAEAAAKTGIPDFSGLVETYGPAVVNISAKHVVQRAAQRRAAPQLPIDPDDPFYQFFRHFYGQIPGMGGGRQPQPDDQPSTSLGSGFIISADGYILTNAHVIDGANVVTVKLTDKREYKAKVVGADKQSDVAVLKIDASGLPIVKIGDPAQSKVGQWVVAIGSPYGFDNTVTSGIISAKSRALPDENYTPFIQTDVPVNPGNSGGPLFNLNGEVIGINSMIYSQTGGFQGLSFAIPINEAMKVKDELVKTGHVSRGRLGVAVQGLNQTLASSFGLQKPDGALVSSVDPKGPAAKAGLQPGDVILAVDGVPVQDSSTLPAQIAGMKPGTKADLQIWRDKSRKTVSVTLASLADDQAKAGVDEPVEQGRLGVAVRPLSPRERNGSSLTHGLVVQQSAGPAASAGIQPGDVILAVNGRPVTSAEQLRDAVKRAGNSLALLIQRDDAQIFVPVDLG

SEQ ID NO: 28811 - DNA, 1566 bp, Bacteroides fragilis
  CDS (19)..(1566)
atgaataaaaagaatagtatgaaacagacaacaaaaaacattctcgggataggagcagtagttcttctcagtgcaggagttgccggagtgacaacctatacgatgttgaagccggagaacagagacagcctgtcgtttaatgaacagttccgtcagaatcccggtgctcgcttggctgcttatgacgccattaatgcccagcctgtagatctgacgcaggcggcggaaaattcgcttcatgctgtagtacatataaaatcgactcaacaggctaaagaacaaactgtgaccgtacgcgacccgtttgcagagatattcggggatatcttcggtaatggcggcagacagcagcgccgtgtacagacccagccgcgtgtcggcttcggttccggtgtcatcatttccaaagacggttacatcgtcaccaataatcacgtgatcgacggtgcggacgaaattatcgttaagctgaatgacaaccgcgagttcaaaggtcgcatgatcggtaccgacccgaattcggatttggctctggtcaagatcgagggagacgatttcccgaccatccccgtgggcgattctgatgccttgaaagtaggagagtgggtattggcggtaggtaacccgttcaatcttacctcgactgtaactgccggtatcgtcagtgccaaagcgcgtacgctcggtgtgtacggcatcgggggagtagaatcgttcatccagacagatgccgccatcaatcagggaaacagcggtggagctttggtgaatgcaaaaggtgaattggtaggtatcaatgccgtgctttcttcgcccacaggcgcttatgccggatacggttttgccattccgaccagtgtgatgaccaaagtggtcagcgacctgaaacaatacggaaccgtacaacgtgcgttgctgggtatcaagggtacttcgcttgcgggtgacggtgatatgatgtccgatcagccgatcgacaaatcgggagccacactgtccgataagcgcaaagagttcggcgtagtggatggcgtttgggtacgcgaaatcgtagatggaggttctgctgccggttccgatatcaaggtagatgatgtcatcatcggtatcgatggcaagaaagtgcagaactttgccgatctgcaggaagccattgcacagcatcgtccgggcgataaagtgaccgtgaaggtgatgcgtgacaagaaagaaaagaatatcaatataacattgaaaaacgaacaaggtacaacaaagattgtgaaggatgcgggtatggagattctgggcgctgccttcaaggagttgccggacgacttgaagaaacaactcaatctcggatacggcttgcaggttaccggagtcacttcgggcaagatggcggatgccggtgtgcggaagggcttcatcatcctgaaagccaacgatcagcctatgcgcaaagtcagcgaccttgaagaagtgatgaaagctgctgtgaagtcaccgaaccaggtactcttcctcacaggagtattcccttcaggaaaacgcggctattacgctgtagacttgactcaggagtag

SEQ ID NO: 28812 - protein, 515 aa, Bacteroides fragilis
MKQTTKNILGIGAVVLLSAGVAGVTTYTMLKPENRDSLSFNEQFRQNPGARLAAYDAINAQPVDLTQAAENSLHAVVHIKSTQQAKEQTVTVRDPFAEIFGDIFGNGGRQQRRVQTQPRVGFGSGVIISKDGYIVTNNHVIDGADEIIVKLNDNREFKGRMIGTDPNSDLALVKIEGDDFPTIPVGDSDALKVGEWVLAVGNPFNLTSTVTAGIVSAKARTLGVYGIGGVESFIQTDAAINQGNSGGALVNAKGELVGINAVLSSPTGAYAGYGFAIPTSVMTKVVSDLKQYGTVQRALLGIKGTSLAGDGDMMSDQPIDKSGATLSDKRKEFGVVDGVWVREIVDGGSAAGSDIKVDDVIIGIDGKKVQNFADLQEAIAQHRPGDKVTVKVMRDKKEKNINITLKNEQGTTKIVKDAGMEILGAAFKELPDDLKKQLNLGYGLQVTGVTSGKMADAGVRKGFIILKANDQPMRKVSDLEEVMKAAVKSPNQVLFLTGVFPSGKRGYYAVDLTQE

SEQ ID NO: 28813 - DNA, 2358 bp, Bacillus licheniformis DSM 13
  CDS (501)..(1871)
tgtcaatgtcggcatcgcgcgcagaaataaaaatgacggggacttccggatcttgattttttatttcttttattagcgtatacccgtcgatatctggtaacatgatatcgagaatccataaatgaggtgactggcctattttttgcctggcgctttcaccgtttagaaaagaagtgacgtgccagccttcactctctaagtattttgtcagcaattcatttaaattctcttcatcttcaactagataaatggagtatgacaagggcggttcacatcctttctacgtcattatactagttttaacataagtctggtcaattttcataatttcacatattcttttcatttttatcccacaatgttttcgtaacatattcatcagggaagaaagggaatgaaaacagagtgaacgatggccgggtctctttttttgtggatgttaaagctttaatgccatttgcgatagttgaagacaagaaaaataaaggaagtgtacgcttatggattttagacgcgatgacgaacaaaaacatgcaaatgaagagcagtttcacgaagaagcgcagacgccgcaaacggcaggttctgaggagcagcagtcagaacagccggcaaaggagcccgagctgattttaaagaaggatacagacgatcagtcagatcttacgaataaagaaaccgctgcagccctggaagatgccagggaaacgagagcggcaaaagaaaagcggcgcaaggcttcgtggctgagcccgattttgggcgggatcatcggaggcggcttggtgcttggaatctccccgtatctgccgggcgatcatccgagcgaaactgccggaaccggacagacagagccaaagcagtcgcagaatttcaccacaaaacctgtcacgaacgcagataacgtacctgatatggtggaagatttggagcctgcgatcgtcggagtttcaaatattcaaacgagcttcggcttctctgaagacgacgtggaggagagcggcacgggatcaggcgtcatctttaagaaagacggcggcaaggcctacattatcacaaacaaccatgtcgttgaaggcgcctcgaaggtgaccatctccttatacaacggaaagaccgcggatgccaagattatcggcagcgacgctttgactgatctggctgttttagagatcagcagcaaaggcgttgataaggttgcaagtttcggagactccgcaaaactgcgcgccggcgaaaaagtaattgcgatcgggaaccctctcggccttcaattttcaagaacggttacagaaggcatcatcagcggtgtcaaccggacgattgaagtctcaacatctgaagggaattgggatatgaacgtccttcagacagatgcggcgatcaaccctggaaacagcggcgggcctctgattaacagcagcgggcaggtcatcggcatcaacagcctgaagatcagccaaagcggtgttgaatcgcttggcttcgcgattccgagcaacgatgttcagccgatcgttgacgagcttttggaaaaagggaaagtggaacggcctttcctcggcgtgcaaatgatcgatatgcagcaggtgcctgaacagtaccagcaaaatacgctcggcctattcggagaccagcttaataaaggcgtgtacatcgataaagtatcgccgaaatcgcctgcggcagacgcgggtatgaaagccggcgacgtcatcaccaaaatgaacggcaaaaacgtcgaaaccacctcagacctcagaaaaattctttatacagaagcaaaagcaggagatactgtcacatttgaggtgctgagaaacggaaagcaaacaacaatgaaagcaaaacttgcgaaaagcaaatcataaataaaagccatggcaaacgccatggctttttcatattacttgtccaaaaatgaagaaagcatccaaatctgcttatcaatttcctctgtcagggcgatataaaggtcagcggtagaatgatctgatttatcttccgcaagttcgatggtatgctgaatttcatcgcggatttgacggtaatcgcttaccagtgcggaaaccatttcttcggccgttttttcggctccgttttcctcaattgtgccgtggtcaatgtattctttcattgtggcgagcggctgtccgccgatggccagcaagcgttccgcgatcacatctgctgtttctgacgcatggttgtatagctcttcaaatttttcatgtagggtaaagaactgcggcccttttacgtaccagtgaaaacggtgaagcttcgtgtaaaggatgaaccagtttgacaaattcgtattcattgagttttcaagtacaggatttgctgttttaattt

SEQ ID NO: 28814 - protein, 456 aa, Bacillus licheniformis DSM 13
MDFRRDDEQKHANEEQFHEEAQTPQTAGSEEQQSEQPAKEPELILKKDTDDQSDLTNKETAAALEDARETRAAKEKRRKASWLSPILGGIIGGGLVLGISPYLPGDHPSETAGTGQTEPKQSQNFTTKPVTNADNVPDMVEDLEPAIVGVSNIQTSFGFSEDDVEESGTGSGVIFKKDGGKAYIITNNHVVEGASKVTISLYNGKTADAKIIGSDALTDLAVLEISSKGVDKVASFGDSAKLRAGEKVIAIGNPLGLQFSRTVTEGIISGVNRTIEVSTSEGNWDMNVLQTDAAINPGNSGGPLINSSGQVIGINSLKISQSGVESLGFAIPSNDVQPIVDELLEKGKVERPFLGVQMIDMQQVPEQYQQNTLGLFGDQLNKGVYIDKVSPKSPAADAGMKAGDVITKMNGKNVETTSDLRKILYTEAKAGDTVTFEVLRNGKQTTMKAKLAKSKS

SEQ ID NO: 28815 - DNA, 1470 bp, Mannheimia succiniciproducens MBEL55E
  CDS (1)..(1470)
atgaaaaaaacaagttttacattgactgcaatcgcattaggattaagcgttcttgctgcgccaaccgtaagtgtcgcggatttcagttcgttttttggcggcgataaatccgaatccgcagagcaaacctccgcaaacaaagcggcatcaaacgtagcacaatctgccgtaaacagcccgtttatcaccaattcattagcgccaatgcttgaaaaagtgttgccggcggtggtttccattgctgtggaaggtaatcaaaaaatcgctaagcgttcatttgatattccggaagaatttaaatttttcttcggtgaggatttctttggtgataattcttcaaaatcatcctcaagaaaattccgcggtttaggttccggcgtgattattaatgcggaaaaaggctatgtattaacaaacaaccacgttatcgataacgcggataaaatcaccgtattattgcaggacggccgtgaatttaaaggaaaaatcttaggcaaagacagtcaatccgatattgccttagtacaattggaaaaccctaaaaacttaaccgaaattaaatttgccgacagcgataaactacgcgtgggtgatttcaccgtagcgatcggcaacccattcggtttagggcaaaccgtcacctccggtatcatttctgccttagggcgctccaccggttccgacagcggcgcttatgaaaactatattcaaacggatgccgccgtaaaccaaggtaactcgggcggaccgttaattaatttaaacggcgaacttatcggtattaataccgctattctttcacctagcggcgctaatgccgggattgcctttgcaattccttctaacatggcaaataacttagcgcagcaaatcggtgagttcggcgaagtgcgtcgcggtatgttgggaattaaaggcggcgaactaaatgcggatctggcgaaagccttccacgttgatgcgcaacaaggcgcttttgtcagcgaagtcttaccgggatccgccgccgataaagcgggcattaaagcgggcgatgtgattattgccatgaacggacaaaaagtgtcgagtttcgccgaaatgcgcgcgaaaatcgctacttccggcgcaggtaaagaaattgaattaacttatctgcgtgataacaaaaaagaaaatgtaaaagttactctgcaagccgacgaccaggcgcaatctaccgctaatgcggaagccgttattccggcattggaaggtgcggaattgacaaacttcaatgaaaacggcaaaaaaggcgtgaaactcagtaaagtagctgaaaattccccggcagctcaacgaggtttgaaaaccggcgatttaattatcggcgttaaccgtatcgccattgaagatttaacacagttacgcaaagccatggaaaacaaagattccgttatagcgttaaatattgaacgcggaaataataatttctatcttctgattcaataa

SEQ ID NO: 28816 - protein, 489 aa, Mannheimia succiniciproducens MBEL55E
MKKTSFTLTAIALGLSVLAAPTVSVADFSSFFGGDKSESAEQTSANKAASNVAQSAVNSPFITNSLAPMLEKVLPAVVSIAVEGNQKIAKRSFDIPEEFKFFFGEDFFGDNSSKSSSRKFRGLGSGVIINAEKGYVLTNNHVIDNADKITVLLQDGREFKGKILGKDSQSDIALVQLENPKNLTEIKFADSDKLRVGDFTVAIGNPFGLGQTVTSGIISALGRSTGSDSGAYENYIQTDAAVNQGNSGGPLINLNGELIGINTAILSPSGANAGIAFAIPSNMANNLAQQIGEFGEVRRGMLGIKGGELNADLAKAFHVDAQQGAFVSEVLPGSAADKAGIKAGDVIIAMNGQKVSSFAEMRAKIATSGAGKEIELTYLRDNKKENVKVTLQADDQAQSTANAEAVIPALEGAELTNFNENGKKGVKLSKVAENSPAAQRGLKTGDLIIGVNRIAIEDLTQLRKAMENKDSVIALNIERGNNNFYLLIQ

SEQ ID NO: 28817 - DNA, 1425 bp, Borrelia garinii PBi
  CDS (1)..(1425)
atggaaaaaaagtttttttctggatttattctcagttttttggctttaggtattggtttttttattggaatgcattacttagattctaatagaagcaatattgtttttgcagaagaaaaagacaatacagtacaagccttacaagattcttttagggaagtttccaagaaaattttatcatcgtccgtagaagttcatgcaaccggggtaattaaacagagttttcctattccatttttcttttttgatatgccagaatttgattctgagagaaaaagcaattgggcagggtctggagtaataattggtagggattctcaaaaaaaatcattattttatgtggttacaaatagtcatgtagtagataaggcaactgaacttgaagttgtgtcttatgataaaaaaaagcacaaggctaagttaattggcaaagatgaaaaaaaagatattgctcttattagctttgaaagtgatgatgcaactattaaagtagctgatcttggagatagtgataagcttgaaataggtgattgggttatggcagtaggtagtccttttcaatttagttttacagttacagcaggtattgtaagtggattacaacgctctgcaaatcctaatttacaatcaaggaatttatttattcaaactgatgctgcaatcaacagaggtaattcaggcggtcctcttgtaaatataaaaggtgaagttattggaattaatgcttggatagcttcaaattctggaggaaatattgggttaggttttgcaattcctgttaataatattaaaagtactgtagatttttttcttaaaggtaaaaaaattgaatcagcatggcttggaatttctttttatcctttaaagacaagagattctgaagtactaaaaagcttaggagttgaaggtaaggatgtttcagctgcaattattgcctctctttatccaggttcacctgccgttaagtcagggcttaaagcaggcgatattattgttaaggttaatggggtttctatgagtgtttttcaagatgttacatcatatattagcgatttttatgctggtgagaaagtaaatgtagaaattttaagaggtaatgtcaaaaaaaatattgagattgttcttgctgttagacctaaggataaagaactttcttcttccaaaatgcttccaggttttattgtgtatccattagttgaggatattaaagctcagcttaatttaagaaattggattaaaggcgttgttgttgattatattgataaaaatttagcatcaaatattaagatgaaatcaggagatgtgattctttctgtaaattcacaaagtgtttctaatttaagagaattttatgatgctcttaagattggaaaaaatacttataaaattttaagaggaaatgattcttttaaaatttcgttttag

SEQ ID NO: 28818 - protein, 474 aa, Borrelia garinii PBi
MEKKFFSGFILSFLALGIGFFIGMHYLDSNRSNIVFAEEKDNTVQALQDSFREVSKKILSSSVEVHATGVIKQSFPIPFFFFDMPEFDSERKSNWAGSGVIIGRDSQKKSLFYVVTNSHVVDKATELEVVSYDKKKHKAKLIGKDEKKDIALISFESDDATIKVADLGDSDKLEIGDWVMAVGSPFQFSFTVTAGIVSGLQRSANPNLQSRNLFIQTDAAINRGNSGGPLVNIKGEVIGINAWIASNSGGNIGLGFAIPVNNIKSTVDFFLKGKKIESAWLGISFYPLKTRDSEVLKSLGVEGKDVSAAIIASLYPGSPAVKSGLKAGDIIVKVNGVSMSVFQDVTSYISDFYAGEKVNVEILRGNVKKNIEIVLAVRPKDKELSSSKMLPGFIVYPLVEDIKAQLNLRNWIKGVVVDYIDKNLASNIKMKSGDVILSVNSQSVSNLREFYDALKIGKNTYKILRGNDSFKISF

SEQ ID NO: 28819 - DNA, 1224 bp, Lactococcus lactis
  CDS (1)..(1224)
atggcaaaagctaatataggaaaattgctattaaccggtgttgtgggtggagctatcgcactcggaggaagcgcaatttatcaaagcactacaaaccaactaggaaatgctaaccgctcaaatacaactagcacaaaggttagtaatgtttcggtaaatgtcaataccgatgtcacctctgcaattaaaaaagtttcaaattctgtcgtttctgttatgaattatcaaaaacagaattcacaaagtgattttagttcaatttttggtggaaatagcggctcaagttcagctaatgacagcttgcaactttccagtgagggttctggtgttatttataaaaaatctggtggagatgcttacgtggtcactaactatcacgttattgctggaaatagtttcctcgatgttttactttctggtgggcaaaaagttaaagccacagttgttggttatgatgaatacactgaccttgccgttcttaaaatcagctctgaccatgttaaagacgtggcaactttcgctgattcaagcaagttaactattggtgaaccagctattgcagtcggctcacctttaggtagccagtttgctaatactgcaaccgaaggaattctgtctgcaacaagtcgtcaagtcactttgactcaagaaaatggtcaaacaacaagtatcaatgcgattcaaacggatgctgccattaacccgggtaactcaggtggagccttgattaatattgaaggtcaagtgattggtattactcaaagtaaaatcacaacgaccgaagatggttctacctctgtggaaggtttaggttttgctatcccatctaatgatgtggtaaacatcattaataaacttgaaactgatggtaagatttcacgtcctgccttaggtattcgtatggttgacctatctcaattatcaacaaatgatagttctcaactgaaattacctagcagcgtaactggtggattggttgtctactctgttcaagcgggtcttcctgctgccacagctggtctgaaagctggcgatgtgataacgaaggtgggagataccgccgttacttcatcaacagacttacaaagtgctctttactcacacaatattaatgatactgtgaaagtcacctactaccgtgatggtaaatcagccacagcaaatgttaaactctctaaatcaacaagcgatttagaaacaaatagttcatcttcttctaattaa

SEQ ID NO: 28820 - protein, 407 aa, Lactococcus lactis
MAKANIGKLLLTGVVGGAIALGGSAIYQSTTNQLGNANRSNTTSTKVSNVSVNVNTDVTSAIKKVSNSVVSVMNYQKQNSQSDFSSIFGGNSGSSSANDSLQLSSEGSGVIYKKSGGDAYVVTNYHVIAGNSFLDVLLSGGQKVKATVVGYDEYTDLAVLKISSDHVKDVATFADSSKLTIGEPAIAVGSPLGSQFANTATEGILSATSRQVTLTQENGQTTSINAIQTDAAINPGNSGGALINIEGQVIGITQSKITTTEDGSTSVEGLGFAIPSNDVVNIINKLETDGKISRPALGIRMVDLSQLSTNDSSQLKLPSSVTGGLVVYSVQAGLPAATAGLKAGDVITKVGDTAVTSSTDLQSALYSHNINDTVKVTYYRDGKSATANVKLSKSTSDLETNSSSSSN

SEQ ID NO: 28821 - DNA, 1557 bp, Rickettsia typhi
  CDS (1)..(1557)
atggtaaatctaaaaatattttttattgtaatagttttaatgttcaataacattattctagcaaaagaaaatagcaatgctttaaaagtagtagatcaagaagtagtagagcaagaagagaatgaatttacttcaataaattctgttcctttgaaagtaagtgaagcagcgcgttatagctttgctgatatagtggagccgttaatacctgcagtcgttaatatttcaacaatagaatatgttaatgataagtccgaaaatgctgagaaagatcttttgcaagaaaacaagcatttaggtttcatgagtgatattttagaaaaatttaatataccgctgaatttagaagaggttgcaaaaattcctaaaagtattccactcggttcaggatttattattacacctaatggtttaatagtgacaaactatcatgtaattgctaatgtggagaaaattaatatcaaacttgcagataatacagaatttttagctaaattaataggcagtgatgctaaaactgatttagctctcttaaaaatagatagtgaagaaccactaccttttgttgagtttggagattcaaatgatgcaagagtaggtgactgggttattgcaatcggtaatcctttcggtaatttaggtggtacagtgacaagcggtattatatcctctaaagggcgtgatattgatgttgatacgaacaatatagtcgataattttattcaaactgatgctgcaattaataatggtaattccggtggccctatgtttaatcttgatcaaaaagtcattggcgtaaatacagcaattttttcaccacttggtactaatataggtatcggctttgctattccttcaaatactgcaaagcagataatagaacgtcttaaaaaagatggaaaagtaagtagaggtcggcttggagtaacaatacaagatttaactgaagaaatttctgaagtgctagggtttaaaggtactaatggtgttttagtatctaaagtacaagaaaatggtccaggttataaagcaggtattaaaaaaggtgatataataataaagtttggagataggctagttaaaaatactaaaaagttacgtgtaattatagcagatacgcctattaaccaagaagtaaaattaaaaatattacgtgatgcaaaagagcttgaattaccaattaaggttactgcagataatgcagaagttattaatgattctacagaagagattaataaagaagtaataataaataaacaagaaaataatctatctattactaaaaataatattacttttagtaatttaactgaagaattaagggaaaaatatgatattcctcaggataaaataggagtagttataattaatattgatgaagaagaaagtgaatttaagctcggtgatttaatcaccaatattaatcatgatagaatcgatgatataaggcagttagaagcattatatgatgatgctaaaaaattagaaaaacaaaatattttgctcttaattgaaaggggtaatacaagtgtgttcgttccgttatcggtttcatga

SEQ ID NO: 28822 - protein, 518 aa, Rickettsia typhi
MVNLKIFFIVIVLMFNNIILAKENSNALKVVDQEVVEQEENEFTSINSVPLKVSEAARYSFADIVEPLIPAVVNISTIEYVNDKSENAEKDLLQENKHLGFMSDILEKFNIPLNLEEVAKIPKSIPLGSGFIITPNGLIVTNYHVIANVEKINIKLADNTEFLAKLIGSDAKTDLALLKIDSEEPLPFVEFGDSNDARVGDWVIAIGNPFGNLGGTVTSGIISSKGRDIDVDTNNIVDNFIQTDAAINNGNSGGPMFNLDQKVIGVNTAIFSPLGTNIGIGFAIPSNTAKQIIERLKKDGKVSRGRLGVTIQDLTEEISEVLGFKGTNGVLVSKVQENGPGYKAGIKKGDIIIKFGDRLVKNTKKLRVIIADTPINQEVKLKILRDAKELELPIKVTADNAEVINDSTEEINKEVIINKQENNLSITKNNITFSNLTEELREKYDIPQDKIGVVIINIDEEESEFKLGDLITNINHDRIDDIRQLEALYDDAKKLEKQNILLLIERGNTSVFVPLSVS

SEQ ID NO: 28823 - DNA, 1485 bp, Onchocerca volvulus endobacterium
  CDS (1)..(1485)
atgaaaagtaaggttttatctatatttttatgttttttaatttcattctctttatatgctagggtatttaactggagcacagaaaaagctgcagatatcaatacttctatatataattgtaatcaagggcttgctgacctggtagaagaacttctccctgcattcgtaagtatttcgagcgagcaggttatcaagcaaggaaatagcaacagaactagagttcccttgccaagaaatgatttttttgacggttttagagaattctttgagtactttgatcagttttttatggataggggccctagtgttaacagagaggcagtgctacttgggtctgggtttattatagataaaagtggaattatagtaactaattaccatgttattaaagatgcccaacatatcacggtcactatgaacgatgatacttattttaaagcagaggttttaggctatgatgcaaaaactgatcttgctgtacttaagattaaggctgataaggacttctcttttgtaacactcggtaattctgatgaagcaagagttggtgatatggttatggcaataggcaacccatttggtttaggtggtcctgtaagtacaggaattatatctgcaaggtccagggacattagtattggcaccacgagtgagtttattcaaactgatgctgcaattaatagaggtaactctggaggtccattatttgatttaaatggaaaagttataggtattaacactgctatttattccccatctgagtctggcggcaatgtgggtataggctttgctataccatctaatctagctatatccattattgatacattaaaaagtggtaaaaaaataaaacacggttggcttggcgtacaagtccagcctataacaagagaatttgctgaatctttaggtttaaaagacgtaaaaggtgcactggttgcaaacatagtgaaggatagtcctgcagaaaaaggtggtattaaggtaggtgacatattattagaatttgatggtaaaaaaattgatagaatgacacactaccccaaatggtttcaaggactgaacctgggaaaaaaagtgcaaattaagttattgagaaaaggtaaagaagttaatgttaaagttgttatcgaagaatctgtaaatgcagcaaagatagcaatacagaagaaaaatagatcaatatctgactatataactggtttaactgtttcaaatctaccaaaagagccaaaagaaagtaaaaatggcccgcctataaaaggtgtgatagttaccaatgtagatagtaatagtaacgctacactgcgtggtatcaaaaaaggagatatcattattcaactagatggggttgatatagaaaatactgaaaattttcaaaaacaagttgatttagcaataaagaaaagcggtaaagattcaataatgttgcttatttaccgcaatggaaatcagttttttacttcgataaagttgaagaaatag

SEQ ID NO: 28824 - protein, 494 aa, Onchocerca volvulus endobacterium
MKSKVLSIFLCFLISFSLYARVFNWSTEKAADINTSIYNCNQGLADLVEELLPAFVSISSEQVIKQGNSNRTRVPLPRNDFFDGFREFFEYFDQFFMDRGPSVNREAVLLGSGFIIDKSGIIVTNYHVIKDAQHITVTMNDDTYFKAEVLGYDAKTDLAVLKIKADKDFSFVTLGNSDEARVGDMVMAIGNPFGLGGPVSTGIISARSRDISIGTTSEFIQTDAAINRGNSGGPLFDLNGKVIGINTAIYSPSESGGNVGIGFAIPSNLAISIIDTLKSGKKIKHGWLGVQVQPITREFAESLGLKDVKGALVANIVKDSPAEKGGIKVGDILLEFDGKKIDRMTHYPKWFQGLNLGKKVQIKLLRKGKEVNVKVVIEESVNAAKIAIQKKNRSISDYITGLTVSNLPKEPKESKNGPPIKGVIVTNVDSNSNATLRGIKKGDIIIQLDGVDIENTENFQKQVDLAIKKSGKDSIMLLIYRNGNQFFTSIKLKK

SEQ ID NO: 28825 - DNA, 1455 bp, Desulfotalea psychrophila
  CDS (1)..(1455)
atgaatagttggtccccagcccttacaaggggtatttgtctgcatcttctctgttcttttttctttgttaccagtcttgcctatgcctcggaaaatgatctggaaattttggaaaaatcgtccaaggcctttgcctctgttgcccggcaggcaaaacctgctgtcgttaatattcgagtggagaagacgattaagggtgggcagatggatggctggcaaatacccgatgagatgctagaacatccgttttttaagcaattttttggtccccagttacgtaaaaggcaaaatgtgcctccacgtctccaacaaggccaaggttccggctttatcgttagtgacgatggctatatcctcaccaataatcatgtggttgatggtgctgactctattacagtacgtcttaatgatgacagcagttatcaggcaaagcttattggtaccgatcccctctccgatgtcgcccttataaaaatagagagttcgaaaaaattaccaagtctggccatgggcagttctgctgctctggaggtgggtgagtgggtaattgccattggtaatccctttggcttgagccagactgtaacggtgggtattgtgagcgccaagggccggagtcaggtggggcttaatgagtatgaaaattttatccaaaccgatgcggctattaatccaggtaacagtggtggacccctccttaatataagaggtcaggtgattggtataaactcagccctcttctcccagacgggtggttatatgggcatcggttttgccattcccattgatatggtaaagtccattgaaagacagttgcaggcaacggggaaggtaagtcgcggctggcttggggtgatgattcaggatatagatgaaaacctggcccaatcctttggcctgaagagcagctctggtgtattgctgacaggtgttcagcctgattctcctgctgaaaaaggtggtttacttggtggtgatgttattatcgcaattgatggcagtgctgtgaaaaacgcctcggccctgcgtaacagggtggcactggtactgcccgggagcaaggtcgtcctgcaggtcattcgtaagggcaaaaaaagagatataggggtgctgattggtgagcggcccgtcggagccaatggactctcaattgaggaccatacggtccttaataataactttggtctctcctttgaaaaacttaccccggaaattgcgaaaaaattcggttatgcccagaaaaagggggttgtcatcagggaggtagccccccagagccctgccagcagggcaggacttaaggccggaatgctcattgaggaggtgaaccgaatggctataggtcaggttgccgatatcaaaaaggctttagctctgggaaaggatgccaggcatgtactcctgcgagtaggatttggccagggcagtcgctatatcgccttggttgcaaaataa

SEQ ID NO: 28826 - protein, 484 aa, Desulfotalea psychrophila
MNSWSPALTRGICLHLLCSFFFVTSLAYASENDLEILEKSSKAFASVARQAKPAVVNIRVEKTIKGGQMDGWQIPDEMLEHPFFKQFFGPQLRKRQNVPPRLQQGQGSGFIVSDDGYILTNNHVVDGADSITVRLNDDSSYQAKLIGTDPLSDVALIKIESSKKLPSLAMGSSAALEVGEWVIAIGNPFGLSQTVTVGIVSAKGRSQVGLNEYENFIQTDAAINPGNSGGPLLNIRGQVIGINSALFSQTGGYMGIGFAIPIDMVKSIERQLQATGKVSRGWLGVMIQDIDENLAQSFGLKSSSGVLLTGVQPDSPAEKGGLLGGDVIIAIDGSAVKNASALRNRVALVLPGSKVVLQVIRKGKKRDIGVLIGERPVGANGLSIEDHTVLNNNFGLSFEKLTPEIAKKFGYAQKKGVVIREVAPQSPASRAGLKAGMLIEEVNRMAIGQVADIKKALALGKDARHVLLRVGFGQGSRYIALVAK

SEQ ID NO: 28827 - DNA, 1467 bp, Erwinia carotovora
  CDS (1)..(1467)
atgaaaagaaaatcactggttctgagtgcgctggcgttaagtctggcgatggcgatgggctccactacggcaaatgcggctgagtcagcggcatctgctgcgtcatcaggtcaattacctagtctggcccctatgctggaaaatgttatgccttccgtggtgagcatctatgtggaagggcataccaccaatgcgggtaaagaaagcaatgcaggcaaagaaggtataccgccgcagcttcagccgttttttggtgaaaactcgccgttctgccaagagggatcgccgttccagtcgtcgccgatgtgtcagggcgatagtgacgacgatgacagcggccaaccgcaaccaaaacaggaaaacttccaggcgctgggcgcgggcgtagtgattaatgcggaaaaaggctacgtggtgaccaatagtcacgtggtggataacgccgataaaattcagattcgactcagtgatggccgcaagtatgacggtaaagtgctaggcaaagacccgcgttcagatatcgcgctggtgcagttgaaggactttaaaaatctgacggccattaaggttgcggattccgaccaactgcgggtcggtgattacaccgtagcgattggtaacccatatggcctgggggaaaccgcgacatcgggcattgtgtccgcgctgggacgcagcggcttgaatattgaaaactacgagaactttattcagaccgatgcggcgattaatcggggtaattccggcggggcgctggtgaacctgaatggggaattgattgggctgaataccgcgattcttgcgccagacggcggcaatatcgggatcggtttcgctatccccagcaatatggtgaaaagtgtcgtcgcacagattatcgaatttggcgaagtgaagcgtggcgaactgggcatcacgggtacggagttgaattccgaactggcgcaggcgatgaaggttgatgcacagcgcggcgcgtttgtgagtcaggtgcggccgaaatcggcggcagatgcggcgggtatcaaagcgggcgatgtgatcgtcacgctgaatggcaaagcggttagcagtttctccgcgctgcgtgcgcaggtcggttcgctgccggtgggcagcaaagtcgcactggggctgctgcgtgatggcaaaccgctgacggttgatgtgacgctgcaacagagcaatcaggctcaggtggcttccggtaatctctactccggcattgaaggtgctgaactgagtaatactcagattgacgataaaaaaggcgttaaggtggataacgttaaacccggttccgcggcggctaaagtggggctgaagaaggacgacattattctcggcgttaaccaacaggtggttcagaatatcggcgaattgcgtaaaattctggacagcaaaccggcagtcttggcgttgaacgttcgtcgaggtgacagcacgatttatctgctggctcagtaa

SEQ ID NO: 28828 - protein, 488 aa, Erwinia carotovora
MKRKSLVLSALALSLAMAMGSTTANAAESAASAASSGQLPSLAPMLENVMPSVVSIYVEGHTTNAGKESNAGKEGIPPQLQPFFGENSPFCQEGSPFQSSPMCQGDSDDDDSGQPQPKQENFQALGAGVVINAEKGYVVTNSHVVDNADKIQIRLSDGRKYDGKVLGKDPRSDIALVQLKDFKNLTAIKVADSDQLRVGDYTVAIGNPYGLGETATSGIVSALGRSGLNIENYENFIQTDAAINRGNSGGALVNLNGELIGLNTAILAPDGGNIGIGFAIPSNMVKSVVAQIIEFGEVKRGELGITGTELNSELAQAMKVDAQRGAFVSQVRPKSAADAAGIKAGDVIVTLNGKAVSSFSALRAQVGSLPVGSKVALGLLRDGKPLTVDVTLQQSNQAQVASGNLYSGIEGAELSNTQIDDKKGVKVDNVKPGSAAAKVGLKKDDIILGVNQQVVQNIGELRKILDSKPAVLALNVRRGDSTIYLLAQ

SEQ ID NO: 28829 - DNA, 1371 bp, Erwinia carotovora
  CDS (1)..(1371)
atgaaaaaaacgtcattattatttagtgcactggcaatgagtataggtttgaccctgtccacgcttcccgcagcgaatgctgcgctaccttccgtggttcaagggcaacaaacgccaagcctggccccaatgctggaaaaagtcttaccagctgtcgtcagcgtgcatgttgaaggtacacaggtacagcgccagcgcgtaccggaagagttcaagttcttctttgggccaaatttcccgacggacaaacaaaattctcgtccgtttgaagggctgggttccggcgtgattattgatgcagcaaaagggtatgtgctcaccaacaatcacgttatcaataatgccgacaaaattcgcgtccagcttaatgacgggcgtgaatatgatgcgaaactgattggtcgcgacgagcagaccgatattgccctgctacagctgaatgacgccaaaaacctagtatccgtaaaaatggcggattccgatcagttgcgcgtcggtgattttgccgttgccgtgggtaacccattcggcctcggccagaccgcgacatccggcattatctctgcactgggacgtagcggcctgaaccttgaagggctggaaaacttcatccagaccgatgcttctatcaaccgcggtaactccggcggtgcgctggttaacctcaacggcgaactgatcggtatcaacaccgcgattctggctccgggcggaggaaacatcggtatcggtttcgccatccccagcaacatggctcagaatctggcgcagcagttggttgaatttggtgaagttaaacgcgggctgctgggtattaaaggcagcgagatgacgtctgagatggcgaaagccttcaacgtcgatgcacagcgcggcgctttcgtcagcgaagtcttaccgaaatctgccgcgtccaaagcgggtatcaaggctggcgacgtgttgactactctggatggtaaaccgatcagcagctttgcagaactgagagccaaagtcggcaccaccgcgccgggcaagaccgtgaaaatcggcctgctgcgtgatggtaaaccacaggaggtttcggtggtgttggataacagcacatcggcatcgaccagcgccgaaacgctttcaccgtcattgcagggtgcatcgctgatcaatggtcaattgaaagatggcagcaaaggcgtgcagattgataacgtcgctaaggacacgcctgctgcgcaggttggtctgcaaaaaggcgatatcatcattggcgtaaaccgcgagcgcattgaaaacatcacgcaactgcgcaagctgctggaagcgaagccttccgttctggcactgaacatcgtccgtggcgaagaaacgatctatctgctgctacgttaa

SEQ ID NO: 28830 - protein, 456 aa, Erwinia carotovora
MKKTSLLFSALAMSIGLTLSTLPAANAALPSVVQGQQTPSLAPMLEKVLPAVVSVHVEGTQVQRQRVPEEFKFFFGPNFPTDKQNSRPFEGLGSGVIIDAAKGYVLTNNHVINNADKIRVQLNDGREYDAKLIGRDEQTDIALLQLNDAKNLVSVKMADSDQLRVGDFAVAVGNPFGLGQTATSGIISALGRSGLNLEGLENFIQTDASINRGNSGGALVNLNGELIGINTAILAPGGGNIGIGFAIPSNMAQNLAQQLVEFGEVKRGLLGIKGSEMTSEMAKAFNVDAQRGAFVSEVLPKSAASKAGIKAGDVLTTLDGKPISSFAELRAKVGTTAPGKTVKIGLLRDGKPQEVSVVLDNSTSASTSAETLSPSLQGASLINGQLKDGSKGVQIDNVAKDTPAAQVGLQKGDIIIGVNRERIENITQLRKLLEAKPSVLALNIVRGEETIYLLLR

SEQ ID NO: 28831 - DNA, 1404 bp, Acinetobacter sp
  CDS (1)..(1404)
atgtgcatgggtatggtttttatgaaaagcggttttctacaaaaagggatgtatgcggttgctttcaccatggtcactgtacaggccgaagcagcagcaccagttgacttttcaaatttggttgagcaggtgagtcctgcggtggtcagtgtcagtgttgtcaaaaaaatgacccaagaagaactattacagcagcaagttcctgaaatattacgtcgtttttttggcaatcaggttgtgattccacagcagcaagcacctcaagaaaaaacaggttatggcagtgccttctttattagtaaagatggatatttgctcaccaatcatcatgttgtagaagatgcttcacgtatcaccattactttaaatgaccgtcgcgaaatagatgctaaagttgtgggaagtgacgagcgtacagacgttgcattacttaaagtcgaaggaaacaattatcctgctttaaaaattggcaatgtggatcaattaaaagtcggacagcccgttttggcgattggttcgccttttggatttgactactctgcatcggctggaatcgtgagtgctaaatcaagaaatatgattggagaaacctcagttccttttattcaaactgatgttgctttaaacccaggtaattcgggggggccgttgtttaatcaacagggtgaagtggttggtgtgaattccagaatctttagtggtactggtgggtatatgggactttcgttttctatcccaatcgatgtggcaatggatgttgcgcaacagttaaaaactacgggtaaagtgacgcgttcgtatttgggtgtgatgctgcaagatattgatcgcaatttggcagatgcctacaacttaccgaaaccagaaggttcactgatcaatcaggtcgcgccaaactctccagcagccaaagctggtctaaaagcaggcgatattattatgaaatataatggtagcccaatttcaagaacatcacagttgttaaattatctaaatcgtaccatgccaaaacaggtgatacagctagaaatactgcgtgatggtaaaccatataatatttccgcaacattgaccacagcacctgatgacacaccagcgacaggtgaaaaagcatctgctgcaaatggcccgctgttgggtatggcaatccgtaatctgactgaaaccgaacaggcgcgcctggatgttcggggaggaatctttgtagaggatgtcacacgtggtggtttagctgcaatgtctaatatcatgcctagggatgtaatcacgcaagtaaatagtaccgcgattcttaacaccaatgatttttctaaagcagtggcgactttacccaaaaattcagtagctcgtatcgccttaattcgtcagggacaaagggcaatgctcggtttacgtatcaagtaa

SEQ ID NO: 28832 - protein, 467 aa, Acinetobacter sp
MCMGMVFMKSGFLQKGMYAVAFTMVTVQAEAAAPVDFSNLVEQVSPAVVSVSVVKKMTQEELLQQQVPEILRRFFGNQVVIPQQQAPQEKTGYGSAFFISKDGYLLTNHHVVEDASRITITLNDRREIDAKVVGSDERTDVALLKVEGNNYPALKIGNVDQLKVGQPVLAIGSPFGFDYSASAGIVSAKSRNMIGETSVPFIQTDVALNPGNSGGPLFNQQGEVVGVNSRIFSGTGGYMGLSFSIPIDVAMDVAQQLKTTGKVTRSYLGVMLQDIDRNLADAYNLPKPEGSLINQVAPNSPAAKAGLKAGDIIMKYNGSPISRTSQLLNYLNRTMPKQVIQLEILRDGKPYNISATLTTAPDDTPATGEKASAANGPLLGMAIRNLTETEQARLDVRGGIFVEDVTRGGLAAMSNIMPRDVITQVNSTAILNTNDFSKAVATLPKNSVARIALIRQGQRAMLGLRIK

SEQ ID NO: 28833 - DNA, 1518 bp, Bartonella quintana
  CDS (1)..(1518)
atgggtagagatgtcatagataaaaatacatctgtcaaatgctttttcataagaatttttatctgttttgttctgtttttatcaggatcagtcagtttttcttgggcgggaaaagaaaacaatacaccactttcgattcctgatttagctgctgagcttttggagacagttgtgaatatttccacagcacagacagttgatggaaccgaacaggacgagcatattttagtacccgttatcccagaagattctttgctaaaagaatattttagtgatttttttacaccaaaagatggtcaaaaagatagacagtttcaaaaggtccgttctttaggatctggatttgtgattgatgcgctaagagggctgatcgttacaaattatcatgttatcgttgatgctgatgagattgaagttaatttcaccgatggtacaaagctagaggcaaggttacttggaaaggatagcaagactgatctggcactgcttcaagtggatgcaggaagtaaaaagttaaaagccgtacgttttggtgactcagaaaaggcgcgtattggtgattgggttatggctattggtaacccttatggttttggtggaagtgtaacagttggtattatttctgcacgcaatcgtgatcttaatgctggtccttatgataattttattcagacggatgcagcgattaaccgaggcaattctggtggtcctttatttgatagaaatggtgaggtgattggaattaatacagcaattatttcgccctctggagggtctattggtattggttttgctataccatcggacatggccctttctgttatcaatcagttgcgtagttttggagaaatcaggcgtggttggttggctattcgtattcaaccagtgacagaggatattgcaaaaagtttaaaactagaaaacgctgtgggggcgttggttgcaggtaaaatggaacagaccggtgtagataatagccagttgcagattggggatatcattctttgctttgggaagaccaaaattaagcatgcacgtgatttgccgcgtttagtagcagaaagtccggcaggaaaagtggtggatattactgtttttcggaatgggcaagaaaaaacagtcaaggttaagcttggacgtttaattgagacagatgcaaatgaaaatatagtagaagaatccgatgatgaaaaaaatggtgctggatcgaaaagcgtaacaatgcaatttatgggaatgacattatctgaacttacagccgatttacgtcagcgttattcaattactgataaacttcagggattggtagtgacatctgttgcaaaaaatagtgcggcagataaaaagcgtattcgtactggtgaagtgattgttgatatcaatcaaagtgctgtcacaacaatttatgaggctaaaaaacgtgttcataaattacgtgaagccggacgcaaaaatgctttattcattgttgctcgttcagatggagagttacggtttgtaacgctctcaatggattaa

SEQ ID NO: 28834 - protein, 505 aa, Bartonella quintana
MGRDVIDKNTSVKCFFIRIFICFVLFLSGSVSFSWAGKENNTPLSIPDLAAELLETVVNISTAQTVDGTEQDEHILVPVIPEDSLLKEYFSDFFTPKDGQKDRQFQKVRSLGSGFVIDALRGLIVTNYHVIVDADEIEVNFTDGTKLEARLLGKDSKTDLALLQVDAGSKKLKAVRFGDSEKARIGDWVMAIGNPYGFGGSVTVGIISARNRDLNAGPYDNFIQTDAAINRGNSGGPLFDRNGEVIGINTAIISPSGGSIGIGFAIPSDMALSVINQLRSFGEIRRGWLAIRIQPVTEDIAKSLKLENAVGALVAGKMEQTGVDNSQLQIGDIILCFGKTKIKHARDLPRLVAESPAGKVVDITVFRNGQEKTVKVKLGRLIETDANENIVEESDDEKNGAGSKSVTMQFMGMTLSELTADLRQRYSITDKLQGLVVTSVAKNSAADKKRIRTGEVIVDINQSAVTTIYEAKKRVHKLREAGRKNALFIVARSDGELRFVTLSMD

SEQ ID NO: 28835 - DNA, 1395 bp, Bartonella quintana
  CDS (1)..(1395)
atgaggcatttttttgtggtgggacttttttttgcaattatggcacaaatatcgtttcattgtgtatatgcccaaattccgcaaacgcgaaaagaaatcactctttcatttgctcctttagttaaaaagactattccgtctgttgtaaatatttatgcagctcggcaaattagagcacgttcaccttttgagggagatccgttttttgaacaattttttggtcgttatcaaaataaccgacctttacgtacgcagtcgtcattggggtctggggtaattgttgatgcacgtggtttgatcgttacaaattaccatgtcattaaagatgcaaacgaaattaaagttgctctttctgacgggcgagagtttgagagtaaaatcatgctaaaagatgaagcaactgatattgcagtgcttgaaattgatgcaaagggtgctcaatttcctattcttcctttgggagattctgatacagttgaagttggtgatcttgttcttgcaattggtaatccttttggtgttggacaaacagttacaagtggtattgtttcagcgcaagcgcgtacacgtgttggtatttctgattttgacttttttattcaaacagatgctgccattaatccagggaattctggtggagctttgattgatatgaaaggacaattaatcgggattaatacagctatttattcgcgctcaggtggttctgtagggattggttttgctattccggcgaatcttgtgaaagtgatgcttgatactgtgagacgcggtgggaaatattttgtaccaccttatattggtgcgtctttccaaaatgttacacctgatattgcaggtggtttaggtttagaacgtccttatggtgctcttgttattgaaattatgaaagacagtccggctgcaaaagctggtttgaaagtaggcgatgttattttgggtgtgcaaggaatacgcgttgatagtccagacagtcttggatatcgcttgatgacagctggtattgggcacagtcttgttttagaatatttacgaagtggaaaaactttccaaacgaaaataaccgtttcatcaataccggaatctgcatttttaaaatctgaaaaaattattgatgaaggtcctctttctggtgctgaagtattggatttaacaccgcaaaatagtcgacgttttcatcttcctaaatctgcaaaaggtgttgtgattaccaatcttgatgaaatgagcaatgctgctgggatttttcgtcctggagatattttgcgtgttgtgaatggccataaaattctaacagtcaatcagttgaaaaaggtccttatgcaaggtcgttcgcgtatttggcaattggaatatgaacgtgatggtatgtacattcgccaatttattcgctga

SEQ ID NO: 28836 - protein, 464 aa, Bartonella quintana
MRHFFVVGLFFAIMAQISFHCVYAQIPQTRKEITLSFAPLVKKTIPSVVNIYAARQIRARSPFEGDPFFEQFFGRYQNNRPLRTQSSLGSGVIVDARGLIVTNYHVIKDANEIKVALSDGREFESKIMLKDEATDIAVLEIDAKGAQFPILPLGDSDTVEVGDLVLAIGNPFGVGQTVTSGIVSAQARTRVGISDFDFFIQTDAAINPGNSGGALIDMKGQLIGINTAIYSRSGGSVGIGFAIPANLVKVMLDTVRRGGKYFVPPYIGASFQNVTPDIAGGLGLERPYGALVIEIMKDSPAAKAGLKVGDVILGVQGIRVDSPDSLGYRLMTAGIGHSLVLEYLRSGKTFQTKITVSSIPESAFLKSEKIIDEGPLSGAEVLDLTPQNSRRFHLPKSAKGVVITNLDEMSNAAGIFRPGDILRVVNGHKILTVNQLKKVLMQGRSRIWQLEYERDGMYIRQFIR

SEQ ID NO: 28837 - DNA, 1512 bp, Bartonella quintana
  CDS (1)..(1512)
atggttaaaaaaactttcttcccaacattagccgcagtaggtttttctgctgctttagaaactgccctgttttttagtgggtgtggatcaagcttgtggatgaccgaagctcgtgcaaattctgtgtttgcttcgttagtgcaacagcagggatttgcaaatattgtttctcaagttaaacctgctgttgtttcagtgcaggtgaagagcaataaaaagaaaaaagagtggttctttagtgatttttttagttctccaggtcttgaccaattaccagatcaacatcccttgaagaagttttttcaagaattttatgatcgtggtaagcctagtaataagtctttgaaacgtccgcataggcttcgtcctatagcttttggatcgggcttttttatctcgtccgatggttatctggtgaccaataatcatgtgatttctgatggtacaagttacactgttgttcttgatgatggcacagaactgaatgcaaaactcattgggacagatgcgcgaaccgatcttgcggtattgaaagtagatgaaaaaagaacattttcgtatgttgattttggtgatgattcaaaacttcgcattggtgattgggtggttgctattggtaatccatttggccttggtggaactgtaacagcaggtattgtttcggcacgtggacgcgatatcggcactggcgtttatgatgattttattcagattgatgctgctgttaatcgaggaaattctggaggtccaacttttgatcttaacggaaaagttattggagttaatacagcaattttttctctttctgggggcaatgttgggattgcttttgctattccggcagcaatagcgaaacaggttgtgcaacaacttatcgagaaaggttcagttcagcgtggttggcttggggtgcagattcagcctgtgacgaaagaaatttctgattcaattggtttgaaagaggctaaaggcgctttgattactgatccgttaaagggtccagccgcgaaagctggtatcaaggcaggggatgtcattatttcggtaaacggtgaaaagattaatgatgtccgtgatctagcaaagcgtattgcaaatattaaaccaggagaaacagtaacattaggtgtttggaaatctggtaaggaggagaatatcaaggttaaacttgatacaatgcctgacgataaagttatgaaagaagactcaaaatattcaaatgggcgcaatgattcaaatgaaacattggaagattatggtttgattgttgctccttctgatgatgggatagggttggtcgtaactgatgtcgattcagattcagatgctgccgataaaggaatacgccctggtgatgtgattgttacagttaataataaatctgttaaaaaggtatctgatattactgacacaattaaaaatgcccaaaagttgggacgaaaagccatacttttacaagtgcgaacaaatgatcaaaaccgttttgtagctcttccaattttcaaaaaataa

SEQ ID NO: 28838 - protein, 503 aa, Bartonella quintana
MVKKTFFPTLAAVGFSAALETALFFSGCGSSLWMTEARANSVFASLVQQQGFANIVSQVKPAVVSVQVKSNKKKKEWFFSDFFSSPGLDQLPDQHPLKKFFQEFYDRGKPSNKSLKRPHRLRPIAFGSGFFISSDGYLVTNNHVISDGTSYTVVLDDGTELNAKLIGTDARTDLAVLKVDEKRTFSYVDFGDDSKLRIGDWVVAIGNPFGLGGTVTAGIVSARGRDIGTGVYDDFIQIDAAVNRGNSGGPTFDLNGKVIGVNTAIFSLSGGNVGIAFAIPAAIAKQVVQQLIEKGSVQRGWLGVQIQPVTKEISDSIGLKEAKGALITDPLKGPAAKAGIKAGDVIISVNGEKINDVRDLAKRIANIKPGETVTLGVWKSGKEENIKVKLDTMPDDKVMKEDSKYSNGRNDSNETLEDYGLIVAPSDDGIGLVVTDVDSDSDAADKGIRPGDVIVTVNNKSVKKVSDITDTIKNAQKLGRKAILLQVRTNDQNRFVALPIFKK

SEQ ID NO: 28839 - DNA, 1518 bp, Bartonella henselae
  CDS (1)..(1518)
atgggtagaaatgtcataggtaaaaatacgtctatgaagtgctttcttataagagcttttgtttgcgtgcttttatttttattaggatcaatgaattcttcttgggcggtggagacaaaaaatagatcgctttccgttcctgatctcgctgctcagcttttggagacagttgtaaatatttctacagcacagacagttgatgggaccgaacaggatgaacatacttcggtacccgttattccagaagattcattgttacaagaatattttactgattttttctctcctaaagatggtcaaaaagagagtcagtttcaaaaagtacgttctttggggtctggttttgtaattgatgcccaaaaagggcttatcgttacaaattatcatgttatcgttgatgctgatgatattgaagtgaattttaccgatggtacaaagctaaaggcaaaattacttggaaaggatagcaagactgatttggcactgcttcaagtggatgcaggaagtaaaaaattaaaggctgtacgttttggtgactcagaaaaggcccgtattggtgattgggtgatggctattggtaatccttatggttttggtggaagtgtaacggttggtattatttctgcacgtaatcgtgatctcaatgctggtccttatgataattttattcagacagatgcagcgattaaccgaggtaattctggtggtccgttatttgatagaaatggtgaggttattggaattaatacagcaattgtttcgccttctggagggtctattggtattggttttgctataccatcggatatggcgctttctgttatcaatcaattgcgtgattttggagaaataaggcgtggttggttggctattcgtattcagccggtgacagaggatattgcaaaaagtttaaaattagaaagtcctgtaggggcgttggttgcaggtaaaatggaacaaacagatgtagataatagtcagttgcagattggcgatatcattctttcctttggcaacgctaaaattaaacatgcacgtgacttgcctcgtttggtggcggaaagtctggaaggaaaggtagtggatattactgttttgcgcaatgggcaagaaaaaacagtaaaagttaagcttggacgtttaattgagacagatacaaatgagaatatggtagaagaatctgataatgaaagaagcggtcctatatcgaaaagcgggacaatgcaatttatgggaatgacattatctgagcttacagcggatttacgtcaacattattctattacggataaacttcagggattggtcgtgatatctgttgccaaaaatagtgcggcggataaaaagcgtattcgcactggtgaagtgattgttgatatcaatcaaagtactgtcacgacaattggtgaggctaaaaaacgtattcataaattacgtgaagccggacgcaaaaatgctctcttcatcattgctaggcctgatggagaattacgattcgtaacgattccaatggattga

SEQ ID NO: 28840 - protein, 505 aa, Bartonella henselae
MGRNVIGKNTSMKCFLIRAFVCVLLFLLGSMNSSWAVETKNRSLSVPDLAAQLLETVVNISTAQTVDGTEQDEHTSVPVIPEDSLLQEYFTDFFSPKDGQKESQFQKVRSLGSGFVIDAQKGLIVTNYHVIVDADDIEVNFTDGTKLKAKLLGKDSKTDLALLQVDAGSKKLKAVRFGDSEKARIGDWVMAIGNPYGFGGSVTVGIISARNRDLNAGPYDNFIQTDAAINRGNSGGPLFDRNGEVIGINTAIVSPSGGSIGIGFAIPSDMALSVINQLRDFGEIRRGWLAIRIQPVTEDIAKSLKLESPVGALVAGKMEQTDVDNSQLQIGDIILSFGNAKIKHARDLPRLVAESLEGKVVDITVLRNGQEKTVKVKLGRLIETDTNENMVEESDNERSGPISKSGTMQFMGMTLSELTADLRQHYSITDKLQGLVVISVAKNSAADKKRIRTGEVIVDINQSTVTTIGEAKKRIHKLREAGRKNALFIIARPDGELRFVTIPMD

SEQ ID NO: 28841 - DNA, 1392 bp, Bartonella henselae
  CDS (1)..(1392)
atgaggtattcttttgtagggtggtttttttgggcgattatggcacagatatcatttcattgtgcttatgctgaaattccacaaacacaaaaagaaatcactctttcatttgctcctttagttaaaaagactattccatctgttgtgaatatttatgcagctcgacaaattagagcacgttccccttttgaaggtgatccattttttgagcaattttttagtcgttttcaaaataatttgcctgtacgtaagcaatcttcattagggtctggagtgattgtagataagcgtggtttagttgttacgaattaccatgtcattaaggatgcaaacgaaattaaagttgctctttctgatgggagggaatttgaaagtaaggttatgctaaaagatgaggcaaccgatattgctgtgctggaaatagatgccaaggaggcgcagtttcctgttcttcctttgggagattctgatgcagttaaagtgggcgatcttgttttagcaattggtaatccttttggtgttggtcaaacggttacaagtggtattgtttcagcacaagcgcgtacacgtgttggtatttctgattttgacttttttattcaaacagatgcggccattaatccagggaattccggtggggctttgattgatatgaaaggacagttaattggaattaatacggctatttattcgcgttcaggtggttcggtagggattggctttgctattccagcaaatcttgtaaaagtgatgcttgatactgttagacgtggtggaaaatattttgtgcccccttatattggggcgtcttttcaaaatgttacccctgatattgctggtggcttaggcttagaacgcccttatggtgctcttgtcatcgaagttataaaagatagtcctgctaaaaaagctggtttaagagtaggtgatgttattttaagtgtgcaagggatacgggttgatagcccagatagtcttggatatcgtttgatgacagctggtattggagatagccttgttttagaatatttaagaagtggaaaaacttttcagacgaaaataactatttcatcaataccggatgcattttcaaaatctgaaaaaattattgatgaaggtcctctttctggtgctgaagtgttagatttaacaccgcaaaatagtcgacgttttcatctttctacatctgcaaaaggtgttgtgattagcaatcttgatgaaatgagcaatgctgctgggatttttcgtactggggatattttgcgggttattaatggtcataagattcaaacggtcagtcagttgaaaaagattcttatgcaagatcgtccgcgggtttggcaattggaatatgaacgtgatggtatgtatattcgccaatttattcgctga

SEQ ID NO: 28842 - protein, 463 aa, Bartonella henselae
MRYSFVGWFFWAIMAQISFHCAYAEIPQTQKEITLSFAPLVKKTIPSVVNIYAARQIRARSPFEGDPFFEQFFSRFQNNLPVRKQSSLGSGVIVDKRGLVVTNYHVIKDANEIKVALSDGREFESKVMLKDEATDIAVLEIDAKEAQFPVLPLGDSDAVKVGDLVLAIGNPFGVGQTVTSGIVSAQARTRVGISDFDFFIQTDAAINPGNSGGALIDMKGQLIGINTAIYSRSGGSVGIGFAIPANLVKVMLDTVRRGGKYFVPPYIGASFQNVTPDIAGGLGLERPYGALVIEVIKDSPAKKAGLRVGDVILSVQGIRVDSPDSLGYRLMTAGIGDSLVLEYLRSGKTFQTKITISSIPDAFSKSEKIIDEGPLSGAEVLDLTPQNSRRFHLSTSAKGVVISNLDEMSNAAGIFRTGDILRVINGHKIQTVSQLKKILMQDRPRVWQLEYERDGMYIRQFIR

SEQ ID NO: 28843 - DNA, 1368 bp, Photobacterium profundum
  CDS (1)..(1368)
atgaagaaacctttacttgttttaagtgctcttgcactgggtatcagctctgttatagcccctgtaacagcaactgcggccttacctgtatctgtcaataaccaacaactccctagcctagcacctatgctagaaaaagtgacacccgctgttgtcagtattgcagtcgaagggaagcacacatccacacaacgactacctgattcattccgattcttttttggccctgatttccccgaagaacaaattagagagcagccatttcgaggcttaggctctggcgttattgtcgatgcaggtaaaggctacatcgttaccaaccatcacgtcattgatggtgcagacaaaattatcgttcaattttatgatggcagagaactaacagccgagctgattggcagtgataaaatgtcggatattgctttattgcaagttaaagcccccaaagatcttgctgaaataaaaatagctgattctgatcaactgcgtgtgggggattatacggttgcgattggtaatccatttggtttaggtcaaacggtgacatctggcattgtttctgcgcttgggcgaagcggcttaaatattgaaaattttgaaaacttcattcaaaccgatgctgcaattaatagcggtaactctggtggtgcattagttaaccttaatggcgagctcattggcatcaataccgccattcttggccccaatggtggcaacgtcgggattggttttgccattccatccaatatggtcagaaaccttactgagcaaatattagaatttggcgaagtgaaacgtggcgttcttggcgtacaaggtggtgaattaaccgctgagttagcagaagcatttggctatgaaactaaccaaggtgcctttgttaaccaagtaatgcctgattcttcggcagaaaaagcggggctaaaagcgggagatatcatcgtttcgattaacggtaaaaacatccgcacctttggagaattacgcgccaaaattgccactcttggtgcgggtaaaaaagtcactctgggaatcatacgcgatagtaaggcacaggatttcacggtaacgttacaagaaatggttcaaaacaccgtgaaagctgataatttacaccccggattagtcggtgctgaatttgccaacacaagctctagcgataacaccaaaggggttaaagtcactaatgttgccgaaaaatctctcgcagctcgctatgggttactgaagggtgacatcatcatcgggctcaatcgtagcccaattaaaaacttaggcgaactgcgtaaagcacttgataaaaatccagcagtattagcgttagaagtgcaacgcaaagacgctgtactttatttgatcattcgctga

SEQ ID NO: 28844 - protein, 455 aa, Photobacterium profundum
MKKPLLVLSALALGISSVIAPVTATAALPVSVNNQQLPSLAPMLEKVTPAVVSIAVEGKHTSTQRLPDSFRFFFGPDFPEEQIREQPFRGLGSGVIVDAGKGYIVTNHHVIDGADKIIVQFYDGRELTAELIGSDKMSDIALLQVKAPKDLAEIKIADSDQLRVGDYTVAIGNPFGLGQTVTSGIVSALGRSGLNIENFENFIQTDAAINSGNSGGALVNLNGELIGINTAILGPNGGNVGIGFAIPSNMVRNLTEQILEFGEVKRGVLGVQGGELTAELAEAFGYETNQGAFVNQVMPDSSAEKAGLKAGDIIVSINGKNIRTFGELRAKIATLGAGKKVTLGIIRDSKAQDFTVTLQEMVQNTVKADNLHPGLVGAEFANTSSSDNTKGVKVTNVAEKSLAARYGLLKGDIIIGLNRSPIKNLGELRKALDKNPAVLALEVQRKDAVLYLIIR

SEQ ID NO: 28845 - DNA, 1455 bp, Parachlamydia sp
  CDS (1)..(1455)
atgaaacaactatcaatatttaccaaattgtgtttacttgccacaggagctgccttaataggctcttcttttacgaacccaaatttaatagaggcggcaactcaggaacagaatcgaactgaagatatcaaacgtttgcccggaaaggagaccgtcgttgattttagaggcgtcgcaaagaaagcgattcctgccgtcgtctctattaaggttaaaggacaaaaaaaaggacctttgtttggggatgaaaattctttagaagattattttggagaaaatggggatttttggaacttttttggattgccaaagagagattctcgtcaacaattgttatcgggtcaagcaacgggtgtgattgtgagtccagaagggtatattttaacaaatagccatgtcgttcatgacatgacaacaattgctgtgcagcttcatgatggaagagaacttgcagcgaaactgttaggagaagatcctagtagtgatttagcgctcattaaaattgacgcaaaagatcttccatatttgacacttggtaattcagacgatttagaagttggacaatgggttgccgcagttggaaatccttttggcttgcaagcgaccttaactgttggtgtcgtgagtgcaaaaagtcgcaataatttagatattgctcgctatgaagactttattcaaacggatgcttctatcaatcgaggaaattcaggcggtcctttgctcacattaaatggagaaattgtagggattaatacagcaattgcgactaatgcatcagcaggttacatcggaattggttttgcaatcccaagtaatatggctaaacatgtgatggatgaaattttatctcaaggaaaagtctctagaggatttttgggcgtttctttacagtcaattgattataatctggctcaatcttttggtttagataaagtagaaggagcattagtcacaaatattgttaaaaattctcctgctgaaaaagctggaattcaggtagaggatattattttaaaactaaatggtcgttcgattgagagcgcggctagtttacgtaacgcgatttatcggatgaaacctggtacaaaagtgaatttgacaattttgagaaaagaaaaacagattgacctttctcttactattggtgattttactgaagaaactgtcgcagcagcatcttctcacaaaagtcagctcggaattgaagtcgcaaatatcccttccgaaatgaaatcagatgaacaaggggtgatgattacaaaggtgtatccaggctcagttgctaactttgctgggttaaaaaaaggagccattattcttggcattaatcatcaaaaaatcgaaaatgtagagcaatttaataacgctttaaaaaatagttctgcagataagccaattcttttgcaagtaaaacaaggaaatgcttatctattcgtttcgcttcgctctgaatag

SEQ ID NO: 28846 - protein, 484 aa, Parachlamydia sp
MKQLSIFTKLCLLATGAALIGSSFTNPNLIEAATQEQNRTEDIKRLPGKETVVDFRGVAKKAIPAVVSIKVKGQKKGPLFGDENSLEDYFGENGDFWNFFGLPKRDSRQQLLSGQATGVIVSPEGYILTNSHVVHDMTTIAVQLHDGRELAAKLLGEDPSSDLALIKIDAKDLPYLTLGNSDDLEVGQWVAAVGNPFGLQATLTVGVVSAKSRNNLDIARYEDFIQTDASINRGNSGGPLLTLNGEIVGINTAIATNASAGYIGIGFAIPSNMAKHVMDEILSQGKVSRGFLGVSLQSIDYNLAQSFGLDKVEGALVTNIVKNSPAEKAGIQVEDIILKLNGRSIESAASLRNAIYRMKPGTKVNLTILRKEKQIDLSLTIGDFTEETVAAASSHKSQLGIEVANIPSEMKSDEQGVMITKVYPGSVANFAGLKKGAIILGINHQKIENVEQFNNALKNSSADKPILLQVKQGNAYLFVSLRSE

SEQ ID NO: 28847 - DNA, 1563 bp, Rhodopseudomonas palustris
  CDS (1)..(1563)
atggaaggcgaccatttcgaccacgtatcagctcaaaccgaggctcacatccgcaaggtgttgaggccgcggcgtctctcgctgttggcttccgctgccggcttgagcatggtggtggcgctcggcggcgccggctttctcacccgcgagatgccgtcgctgacgtcgtcggcctatgcggctgaaaacggcaagccggcgcccgccgggttcggagatctggtcgacaaggtcaagccggcggtgatttcggtgcgggtcaagatcgacgacgatcgccagaccacgccgctggtgcgtgacgatggtgacggcgatcagatgcagatgccgcggggccttgcgccgttccagcagttcgagcgtcagttcggcttccgcggtcctgaaggcatgccgaagcggcaccagatgatcaccggcgaaggctccggcttcttcatcaccgccgacggctacgcggtcaccaataatcacgtggtcgatcacgccaagtcggtgcaggtgacgaccgacgacggcactatctacaccgccaaggtcgtcggcaccgacgacaagaccgatctggcgctgatcaaggtcgacggcaagaccgattttccgcacgtcaacttcgccgattcaccggcgcgcgtcggcgattgggtgatcgctgtcggcaatccgttcggtctcggcggcacggtgacggccggtatcgtttcggcgcgtggccgtgacatcggctcgggcccctatgacgactacgtgcagatcgacgcgccgatcaacaagggcaattccggcggtccggcgttcgacaccaatggcaatgtgatcggcgtcaataccgcgatctattcgccatcgggcggctcggtcggcatcggcttcgatattccggcggcgaccgcgaagctggtggtgtcgcagctcaaggacaagggctacgtcacccgcggctggctcggcgtccaggtgcagccggtcacggcggagatcgccgacagtctcggcatgaagcaggcgcgcggcgctctggtcgatggtccgcaggacggcagcccggccgcgaaggcgggcatcaaggccggcgacgtgatcaccgcggtcgacggcaaggaggtcaaggactcccgcgccctcgcccgcaccatcagtacgctggcgccgggctcctcggtgaagctcgacgtgctgcacaacggccagtccaagacgatggatctgacgcttgccgaaatgcccggtgatcatcagaaggtcgccgacagcagcggcgatcgcgacgctacccgtccgtatctcggcctgcgcgtggcaccggccagcgaagtcgacggtgccggcaagaacggggtggtcgttaccggcgtcgatccggacgggccggccgccgacaagggcctgcgcacgggtgatgtcatcctcgacgtcggtggcaagtcggtgaccaacaccggcgacgtccgcaacgcgctaactgaagccagcaaggacggcaagaagaccgtgctgatgcgggtgaagacggcggattcggcggcgcgctttgtcgcggtgccgatcgcgaagggctga

SEQ ID NO: 28848 - protein, 520 aa, Rhodopseudomonas palustris
MEGDHFDHVSAQTEAHIRKVLRPRRLSLLASAAGLSMVVALGGAGFLTREMPSLTSSAYAAENGKPAPAGFGDLVDKVKPAVISVRVKIDDDRQTTPLVRDDGDGDQMQMPRGLAPFQQFERQFGFRGPEGMPKRHQMITGEGSGFFITADGYAVTNNHVVDHAKSVQVTTDDGTIYTAKVVGTDDKTDLALIKVDGKTDFPHVNFADSPARVGDWVIAVGNPFGLGGTVTAGIVSARGRDIGSGPYDDYVQIDAPINKGNSGGPAFDTNGNVIGVNTAIYSPSGGSVGIGFDIPAATAKLVVSQLKDKGYVTRGWLGVQVQPVTAEIADSLGMKQARGALVDGPQDGSPAAKAGIKAGDVITAVDGKEVKDSRALARTISTLAPGSSVKLDVLHNGQSKTMDLTLAEMPGDHQKVADSSGDRDATRPYLGLRVAPASEVDGAGKNGVVVTGVDPDGPAADKGLRTGDVILDVGGKSVTNTGDVRNALTEASKDGKKTVLMRVKTADSAARFVAVPIAKG

SEQ ID NO: 28849 - DNA, 1506 bp, Rhodopseudomonas palustris
  CDS (1)..(1506)
atgcccgctgcgatcgcctttagttcccggatcaggcccttgcggatcaggccgctgctcgccgcgctgtgcctcggcgcggctgtgatcgccggcccggcgccggcctccgcccgcggccccgaagggatcgccgacgtcgccgagaaggtgatcgatgcggtggtcaacatctccaccacccagacggtcgacgccaagggctcgggcgagagcaagggcggcgccgcgccgcaactgccgccgggctcgccgttcgaggagttcttcgaggacttcttcaagaaccgccgcggcgaaaagggcggcggcccgcggaagactaattcgctcggctccggcttcatcatcgatccggccggtgtcgtcgtgaccaacaatcacgtcatcgccgattccgacgagatcaacgtgatcctcaacgacggcaccaagatcaaggcggagctggtcggcgtcgacaagaagaccgacctcgcggtgctgaagttcaagccgccggcgggcaagacgctgaccgcggtgaagttcggcgacagcgacaagctgcggctgggcgaatgggtgatcgcgatcggcaacccgttctcgctcggcggcaccgtgaccgccggcatcgtctcggcgcgcaaccgcgacatcaactccggcccttatgacagctacatccagaccgacgccgcgatcaatcgcggcaactccggcggtccgctgttcaacctcgccggtgaagtgatcggcgtgaacactctgatcatctcgccgtcgggcggctcgatcggcattggcttcgcggtgccgtccaagaccgtggtgccggtggtcgatcagctgcgtcagttcggcgaactgcgccgcggctggctcggcgtccgcatccagcaggtcaccgacgagatcgccgagagtctgagcatcaagccggcgcgcggcgcactggtcgccggcgtcgacgacaagggcccggccaagccggccggcatcgagcccggcgacgtggtggtgaagttcgacggcaaggacatcaaggagccgaaggacctgtcgcgcatcgttgccgacaccgcggtcggcaagaccgtcgatgtcgtggtgatccgcaagggcaaggaagaaaccaagcaggtcacgctcggccggctcgacgacgatgccaagccgcaaccggcttcggcgaagtcgcagcccgaggcggacaagccggtgacccagaaggtgctcggtcttgatctcgccgcgctgtcgaaggatctgcgcggccggtacaagatcaaggacagcgtcaagggcgtgctggtgaccggcgtcgacgacggctccgacgccgccgagaagcggctgtcggccggcgacgtcatcgtcgaggtggcgcaggagtcggtcggcagcgccgccgacatcaagaagcgcgtcgaccagctcaagaaggacggcaagaagtctgtgctgctgctggtcgccaacgcttccggcgagctgcgcttcgtcgcgctcagcctacaatag

SEQ ID NO: 28850 - protein, 501 aa, Rhodopseudomonas palustris
MPAAIAFSSRIRPLRIRPLLAALCLGAAVIAGPAPASARGPEGIADVAEKVIDAVVNISTTQTVDAKGSGESKGGAAPQLPPGSPFEEFFEDFFKNRRGEKGGGPRKTNSLGSGFIIDPAGVVVTNNHVIADSDEINVILNDGTKIKAELVGVDKKTDLAVLKFKPPAGKTLTAVKFGDSDKLRLGEWVIAIGNPFSLGGTVTAGIVSARNRDINSGPYDSYIQTDAAINRGNSGGPLFNLAGEVIGVNTLIISPSGGSIGIGFAVPSKTVVPVVDQLRQFGELRRGWLGVRIQQVTDEIAESLSIKPARGALVAGVDDKGPAKPAGIEPGDVVVKFDGKDIKEPKDLSRIVADTAVGKTVDVVVIRKGKEETKQVTLGRLDDDAKPQPASAKSQPEADKPVTQKVLGLDLAALSKDLRGRYKIKDSVKGVLVTGVDDGSDAAEKRLSAGDVIVEVAQESVGSAADIKKRVDQLKKDGKKSVLLLVANASGELRFVALSLQ

SEQ ID NO: 28851 - DNA, 1200 bp, Rhodopseudomonas palustris
  CDS (1)..(1200)
atgacctcgctccccccgcatgctccgccgccgcccccgcgaccgcccggacttgatccgctcgccagtcagcaggcgcaggtccgaaggacgcagcgtaccgaccggttgctccggattgcgatcgtgtggctgctggtgctggcgacgctctgggtggcgcagccttatctcagcgcgctgtggttttccgcaacggggccgcgcactgtcacggcacgcggcgagctggcgccggccgaaaaggccaccgtcgatctgttcaagcaggtgtcgccgtcggtggtgcatgtgttcgcgcagggcagccagcgggtgtcgccattcgccgtccagcaagaggcgccggtgcagtccggctcgggcgtgatctgggatgccgccggccatgtcgtcactaacaaccatgtcatccagaacgccagccagctgggcgtccggctggcgtcgggcgaattcgtcactgcgcgggtggtgggcaccgcgccgaattacgacctcgcggtgctgcagctggagcgaccgcacacgccgctgcgcccgatcgcgatcggcagctcggaggatctgcaggtcgggcaggcgacgtttgcgatcggcaatccctacggcctcgaacagacgctgaccaccggcatcgtcagcgcgctgcggcggcggttgccgacagccgcggcacatgaagttcgtggcgtgatccagactgatgcggcgatcaatcccggcaattccggcggtccgctgctcgacagcgccgggcggctgatcggtatcaacaccgcgatcatttccggctccggcgcctcggccggcatcggctttgctatcccggtcgatgcggtcaatcgcgtcgtcaccgccctgatcaccaacggcagcgtgccggtgccgggcatcggcatcgtcgcggcgcgcgagaccgaaaccgcgcagctcggcatcgacggtgtggtgatcctgcgcacgctgccggattcgccggccgcgcaggccggcctcgaaggcgcgaccgacgacggctatgtccgcgacgttatcaccggtgcaaacggctcggacatccacagcatgtcggatcttgccgcagcgctggaggaggcggggatcggtcgcgacgtcaagctgacggtcgagcgcgacggacgcgcccggacggtgaccgtgaaggtgacggatatctcgcagcgtcgccggacctga

SEQ ID NO: 28852 - protein, 399 aa, Rhodopseudomonas palustris
MTSLPPHAPPPPPRPPGLDPLASQQAQVRRTQRTDRLLRIAIVWLLVLATLWVAQPYLSALWFSATGPRTVTARGELAPAEKATVDLFKQVSPSVVHVFAQGSQRVSPFAVQQEAPVQSGSGVIWDAAGHVVTNNHVIQNASQLGVRLASGEFVTARVVGTAPNYDLAVLQLERPHTPLRPIAIGSSEDLQVGQATFAIGNPYGLEQTLTTGIVSALRRRLPTAAAHEVRGVIQTDAAINPGNSGGPLLDSAGRLIGINTAIISGSGASAGIGFAIPVDAVNRVVTALITNGSVPVPGIGIVAARETETAQLGIDGVVILRTLPDSPAAQAGLEGATDDGYVRDVITGANGSDIHSMSDLAAALEEAGIGRDVKLTVERDGRARTVTVKVTDISQRRRT

SEQ ID NO: 28853 - DNA, 1392 bp, Rhodopseudomonas palustris
  CDS (1)..(1392)
atgaacccgatccgcacgttcgccgtcctctgtgtgtcactcgccctcaccacgccgctcgcggcgcaggaccggcgggtgccgtcgtcgccggcggagctgaagctgtcttacgcgccgatcgtgcagcatgtgcagccggcggtcgtgaacgtctatgccgccaaggtggtgcagaaccgaaatccgctgctggaagatccgatcttccgccggttcttcggcgtgcccggccagccggagcagatccagcgctcgctcggctcgggcgtgatggtcgatgcctcgggcctcgtcgtcaccaacaatcacgtcatcgagggcgccgatcaggtcaaggttgcgctcgccgacaagcgcgagttcgaagccgagatcgtgctgaaggacagccgcaccgatctggcggtgctgcggctcaaggacaccagcgagaaattccccacgctcgacttcgccaactccgacgacctgctggtcggcgacgtggtgctggcgatcggcaatccgttcggcgtcggccagaccgtcactcacggcatcgtctcggcgctggcgcgcactcaggtcggcatcaccgactatcagttcttcattcagaccgacgcggcgatcaacccgggcaattccggcggcgcgctggtcgacgtctcgggcaagctggttggtatcaacaccgcgatcttctcgcgctcgggcggctcgcaggggatcggcttcgcgatccccgccaacatggtgcgcgtcgtggtcgcctcggccaagagcggcggcaaggccgtgaagcggccgtggctcggcgcgcggctgcaggcggtgagcccggagattgccgagaccctcgggctgaagcggccgggcggtgcgctggtcgccagcgtcaccaagggcagcccggcggagcgggcagggctgaagctgtccgacctgatcgtgtcgatcgacggctttgcgatcgatgatcccaacgcgttcgattatcggtttgcgacccgtccgctcggcggtgccgcgcagctcgaagtgcagcgcagcggcaaggcggtgaagctgtcgatcccgctcgaaaccgcgccggactccggccgcgacgagctggtgatcacctcgcgctcgccgttccagggcgccaagatcgccaacatctcgccggcgatcgccgacgaaatgcggctcgatccgagcgtcgaaggcgtcgtggtcactgatcttcccgacgacagcaccgccgcgaatgtcggcttccagaagggtgacatcatcgtcgcggtcaacaacacccggatcggcaagacaagcgacctcgaacgcgtcgccggccagacggcgcggctgtggcgcatcatgctggtccgcggcggccagcagatccaagtcacgctcggcggatga

SEQ ID NO: 28854 - protein, 463 aa, Rhodopseudomonas palustris
MNPIRTFAVLCVSLALTTPLAAQDRRVPSSPAELKLSYAPIVQHVQPAVVNVYAAKVVQNRNPLLEDPIFRRFFGVPGQPEQIQRSLGSGVMVDASGLVVTNNHVIEGADQVKVALADKREFEAEIVLKDSRTDLAVLRLKDTSEKFPTLDFANSDDLLVGDVVLAIGNPFGVGQTVTHGIVSALARTQVGITDYQFFIQTDAAINPGNSGGALVDVSGKLVGINTAIFSRSGGSQGIGFAIPANMVRVVVASAKSGGKAVKRPWLGARLQAVSPEIAETLGLKRPGGALVASVTKGSPAERAGLKLSDLIVSIDGFAIDDPNAFDYRFATRPLGGAAQLEVQRSGKAVKLSIPLETAPDSGRDELVITSRSPFQGAKIANISPAIADEMRLDPSVEGVVVTDLPDDSTAANVGFQKGDIIVAVNNTRIGKTSDLERVAGQTARLWRIMLVRGGQQIQVTLGG

SEQ ID NO: 28855 - DNA, 1572 bp, Rhodopseudomonas palustris
  CDS (1)..(1572)
atgcacgatcgtcgccccgtcctgtccacgcagtcttcgcaccggccccagtcgaggtcgttgctgtcggcgcgcaagttcgcgctgatggcttcggtcgtcgccggtctcggcgcgggggctttcgggctcggcaacggttcggtcgatctgatcgccactccggcgcatgcgcaggaggtcagcgccaacgttcagccggcgcagcagccggtcggtttcgccgacatcgtcgacaaggtgaagccgtcggtgatctcggtgaaggtcaacatcgccgacaagatggccaagaacgaagaccgcgaggacttctcgttcccgcccggctcgccgatggagcgattcttccgccggttcggcggcgagatgcctcccggtctgcgcggccatcgcggcggcggcatgatcaccggccagggctcgggcttcttcatctcggccgacggctatgcggtgaccaacaatcacgtggtcgaaggcgccgacaaggtcgaagtcaccaccgacgacggcaagacctacaaggccaaggtgatcggcaacgatccgcgcaccgacttggcgctgatcaaggtcgagggcggttcgagcttcccttacgccaagctgtcggaaggcaagccgcggatcggcgactgggtgctggcggtcggcaatccgttcggcctcggcggcaccgtgacggccggcatcgtctcggcgatgggccgcgacatcggcaacggtccgtacgacgacttcatccagatcgacgcgccggtgaacaagggcaactccggtggcccggcgttcaacaccgcgggcgaagtggtcggcgtcaacaccgcgatctactcgccgtcgggtggcagcatcggcatcgcgttctcgatcccggccaacaccgtcaaggcggtggtcgaacagctcaaggatcgcggctcggtgagccgtggctggatcggcgtgcaggtgcagccggtgacgccggagatcgccgacagcctcggcctgaagaaggcggaaggcgcgctggtcgcagagccgcagtcgaacggtccggccgccaaggccggcatcgaatccggcgacgtgatcgttgcggtcgatggcacgtcggtgaaggacgctcgcgaactggcccgcaccatcggtgcgttcgcgccgggtcatgcggtcaagctcaccgtgttccacaagggcaaggagcgtgagctgacgctgacgctcggcgagctgccgaacaagatcgaagccagcaacaacaccgaccgcggtgatcgcggcggagccaaccagggcctcgacctacccaagctcggcctgacgctggctcccgccagctcggtcgccggtgccggcaaggatggcgtggtggtcaccgacgtcgatccgaagggtgccgctgccgaccgcggcttcaaggaaggcgacgtgatcctcgaggtcgccggcaagaatgtgtcgagcccggcggacgtccgcgacgtgctcgccacggcgaagaccgaaaacaaaaacagcgtgctggtccgggtacgcagcggcggcgcctcgcgcttcgtcgccctcccgatcgccaagggctga

SEQ ID NO: 28856 - protein, 523 aa, Rhodopseudomonas palustris
MHDRRPVLSTQSSHRPQSRSLLSARKFALMASVVAGLGAGAFGLGNGSVDLIATPAHAQEVSANVQPAQQPVGFADIVDKVKPSVISVKVNIADKMAKNEDREDFSFPPGSPMERFFRRFGGEMPPGLRGHRGGGMITGQGSGFFISADGYAVTNNHVVEGADKVEVTTDDGKTYKAKVIGNDPRTDLALIKVEGGSSFPYAKLSEGKPRIGDWVLAVGNPFGLGGTVTAGIVSAMGRDIGNGPYDDFIQIDAPVNKGNSGGPAFNTAGEVVGVNTAIYSPSGGSIGIAFSIPANTVKAVVEQLKDRGSVSRGWIGVQVQPVTPEIADSLGLKKAEGALVAEPQSNGPAAKAGIESGDVIVAVDGTSVKDARELARTIGAFAPGHAVKLTVFHKGKERELTLTLGELPNKIEASNNTDRGDRGGANQGLDLPKLGLTLAPASSVAGAGKDGVVVTDVDPKGAAADRGFKEGDVILEVAGKNVSSPADVRDVLATAKTENKNSVLVRVRSGGASRFVALPIAKG

SEQ ID NO: 28857 - DNA, 1401 bp, uncultured bacterium 580
  CDS (1)..(1401)
atgaaaataaattttcttagcaaattggttactacctttttattctttatgagtttttcatatgctgtatctttgcctgattttacggtacttgcagagcaacaaggcagcaaagtagttaatattagctctattaagaatgcggtaaatagaggaaaccagcagctatctcctcaagaagaacatatgcaagaatttttcaatcgttttggtatcccaatgcctccaggtatgggtccaaatgaccaacaacaaaaacaaatgagcgctacgggttcaggatttattttagaatcggatggttacattattaccaatgcccacgtcgtaggtgaggctgattctattatcgtcaagttagctgacaaacgagagtttcaggcaaaattattagggattgataaaagaacagatgtagctttacttaaaattgatgcaaaaaatttaccggcggtcaaacttggtaaccccaaaaatataaaagtaggtgaatgggtagcagctattggatctccatttggtttagaaaatacgatgactgttggtgtagtgagcgccaaaggaagagcgttaccgcaacaagaaaactatgttccgtttattcaaactgatgttgctatcaaccctggaaattctggcggcccattatttaatactaatggtgaagtaattgggattaattcacaaatttatagccgtaccggaggctacatgggattatcgtttgctattcccatcgatgttgcaatgaatgtcgcagatcaattaaaaaataacggcaaggtagttcgtggttggttagggattgctattcaagaagttacagatgagctaacagaagcattaggcttaaaagataaaagcggtgcacttgttgcagcagttaataaaggagctcctgcaggaaaagcaggtattgaagcaggtgatgtgattcttaaatttaataacaaggtgattaagacatcctccgatctcccaaaatatgtgaggcttaccaaacctaacaatatcgtgcctgttgagatttggagaaatggaaaagttaaaacgctaagagttaagattggtgaaatgcctgatgatagaatgcaggcttcaaataaaaagacaattaaagagagcgctaatagaataggattggttttaaaagaagccactactaaagataaaaaaatgcttgatggaaggaatggtctggttgttactaaagcctctggccctgctgtttcatcgcagataagggaaggagatatcattttggcactcaataacacacccgtgacttcggttagagcatttaatagagaaattaataaaacacctaaaggcaaaacgatagcgttacttatttatcgaaatggagatacattgtttgttccagtaaaggtcttaaactaa

SEQ ID NO: 28858 - protein, 466 aa, uncultured bacterium 580
MKINFLSKLVTTFLFFMSFSYAVSLPDFTVLAEQQGSKVVNISSIKNAVNRGNQQLSPQEEHMQEFFNRFGIPMPPGMGPNDQQQKQMSATGSGFILESDGYIITNAHVVGEADSIIVKLADKREFQAKLLGIDKRTDVALLKIDAKNLPAVKLGNPKNIKVGEWVAAIGSPFGLENTMTVGVVSAKGRALPQQENYVPFIQTDVAINPGNSGGPLFNTNGEVIGINSQIYSRTGGYMGLSFAIPIDVAMNVADQLKNNGKVVRGWLGIAIQEVTDELTEALGLKDKSGALVAAVNKGAPAGKAGIEAGDVILKFNNKVIKTSSDLPKYVRLTKPNNIVPVEIWRNGKVKTLRVKIGEMPDDRMQASNKKTIKESANRIGLVLKEATTKDKKMLDGRNGLVVTKASGPAVSSQIREGDIILALNNTPVTSVRAFNREINKTPKGKTIALLIYRNGDTLFVPVKVLN

SEQ ID NO: 28859 - DNA, 1476 bp, uncultured bacterium 106
  CDS (1)..(1476)
atgcaaaaatattacaagttgttcaccttgattatgataatggggtttttctgggttactcctgcctttacccaaacctctgatgacttggaacaaatgattcgtgcatctaaaacacgtgcagctcttgttcaaaatgttcaaaaagctgttgtccatatcaaagtcgaaaaaattatgcgtagtcctgatggccgtgctctcaacaatccaagagacctctacaacgatgaattttttcgacgttttttcccggaactccaacctccagataatcaacaaccaaaaaaacgagaacagccaaatcgtgaatttcgacaaaaaggaatgggttccggttcaataatagatgcagagggctacattttgaccaaccaccatgttgtcggcgaagcagacgagatattggttgtactatacaatggagatgaaaggaaggcaaagctcgttggaacagatcctgagtcggacattgcagttgtgaaaattgaaggtaatggacttccagtgcttccaatgggagattcagataaaatacttgttggtgaagatgtgattgcagtagggaacccattcggactaatccagactgtcacttacggaattgtcagtgccaaaggtcgatccaatgtaggcatcaatgaatatgaaaattttattcaaacagatgctgccatcaatcccggaaatagtggaggtcccttagtcagtctgcggggtgaaattatcggagtcaacagcgcaatttttagtcaaagcggcggctatcagggtattggttttgcggttccaataaatatggcccgcaaaatcatgcgggacttgatagataaaggcattgtttccaggggttggttgggagtaggaatccaggatgtcagtcatgatcttgctaaagcttttaagctgaaaagtaccaaaggcagcctgattactggaattatgcaggatactccggctcaaaaagctggcatgcgcaaaggagatgtcgtgatcagaatcaatgacaaactgatccaaaacagtaaccatctgcgcaacgaaattgcaaacgccggggctttcgctgaaattgaaatggaactgatccgggatggaaaaaccgttcttttgaaactgaagctggatgaacgtccaaagaaaattgggagaatgaaaaccttgccggagcctactcaaaccctcgaacaggtagaattgttgggcatgacagtagaagaactctctgaagaaaatgccaaccagcttggaattgaacctgggattggtgttgtgattcgtaatgttaaatccggaagcccggcagaaaaatctgggttgctccctggaatgattgtgcaggaagcagaacgtaaagctgtcagtaaccttgatactttcaaagaaattatcaatgggattgactcagaacaaggggttctcctgctgatcagaagcagtaacggatcacgatatatatttattcaagaaaactga

SEQ ID NO: 28860 - protein, 491 aa, uncultured bacterium 106
MQKYYKLFTLIMIMGFFWVTPAFTQTSDDLEQMIRASKTRAALVQNVQKAVVHIKVEKIMRSPDGRALNNPRDLYNDEFFRRFFPELQPPDNQQPKKREQPNREFRQKGMGSGSIIDAEGYILTNHHVVGEADEILVVLYNGDERKAKLVGTDPESDIAVVKIEGNGLPVLPMGDSDKILVGEDVIAVGNPFGLIQTVTYGIVSAKGRSNVGINEYENFIQTDAAINPGNSGGPLVSLRGEIIGVNSAIFSQSGGYQGIGFAVPINMARKIMRDLIDKGIVSRGWLGVGIQDVSHDLAKAFKLKSTKGSLITGIMQDTPAQKAGMRKGDVVIRINDKLIQNSNHLRNEIANAGAFAEIEMELIRDGKTVLLKLKLDERPKKIGRMKTLPEPTQTLEQVELLGMTVEELSEENANQLGIEPGIGVVIRNVKSGSPAEKSGLLPGMIVQEAERKAVSNLDTFKEIINGIDSEQGVLLLIRSSNGSRYIFIQEN

SEQ ID NO: 28861 - DNA, 1143 bp, uncultured bacterium 105
  CDS (1)..(1143)
atgctgaaacgtttatttgtaccattacttctattcgtctgcggattactagccggccttgttttaactggacgacttcgctacgcagaggaaacgacagcagaaaccgtcgccaccgtggcgtcacagcaagctgccacactcacgatcaccgcaaatgtaccagacttcacgggtattgctgcggcgcgcatcgagagcgtggttaatatctcgtcacaaacccttgagccgcgccaaatttcaccgttcggtggcgatccatttttccaatatttttttggtgacgaaccagatttattcggttgggaccgtcaagagagtctgggttctggagtcattgtctctcaaaacggctacatactcacaaacaaccacgttgtcggtaaccctgacgccgaggtaacagtcacactcgccgacaaacgagaatacgcagccgaagtaattggggtcgaccagtggacagatctcgcactgctaaaaatcaacgaagagaccctgcaacctgcgccttggggcgactcttcaggcttgaaagttgccgaatgggttcttgccatcggaaatccatttcaactgaatcagacagtcacgttgggtatcgtgagcgctgtcggtcgagcgaatctcgggattgcaacttatgaggattttatccaaacggacgccgctatcaatcaaggcaactcgggtggtgcactcattaacggtcgcggtgaactggtgggtattaacactgcaatctatagtcagagtggcggtgaccagggtgtcggtttcgcggtgcccagcaacctagcacgtcgtgtcatgaaagatttcatcgaattcggtgaagtacggcgcgggtcaatcgggtacatcgaaatcgcgccattaacaaaccggctagctacacagttgggtgtgccagatggtcgcggcgctcttatccagcgaatgcgacgagattcggcagcctacgatgctggattacggccgggtgacgtggtcataacatttgaagacacctccgtcgaggatgcatcacatctactccgcctgcttgccgacgcgaatatcggtaagaccgttaccctcggtgtcattcgggatggcgatttatttgagatcgaggtgcaaattgctcttgggcagtag

SEQ ID NO: 28862 - protein, 380 aa, uncultured bacterium 105
MLKRLFVPLLLFVCGLLAGLVLTGRLRYAEETTAETVATVASQQAATLTITANVPDFTGIAAARIESVVNISSQTLEPRQISPFGGDPFFQYFFGDEPDLFGWDRQESLGSGVIVSQNGYILTNNHVVGNPDAEVTVTLADKREYAAEVIGVDQWTDLALLKINEETLQPAPWGDSSGLKVAEWVLAIGNPFQLNQTVTLGIVSAVGRANLGIATYEDFIQTDAAINQGNSGGALINGRGELVGINTAIYSQSGGDQGVGFAVPSNLARRVMKDFIEFGEVRRGSIGYIEIAPLTNRLATQLGVPDGRGALIQRMRRDSAAYDAGLRPGDVVITFEDTSVEDASHLLRLLADANIGKTVTLGVIRDGDLFEIEVQIALGQ

SEQ ID NO: 28863 - DNA, 1395 bp, Rhizobium sp
  CDS (1)..(1395)
atggcccgcccgcctgcacgcaaggaggatctgaagaattcggggccaaaaatgaccgcgcgttcgtcgaaatatgttggcgtattcgccgcactcgtcctcatcctggttcctgggccgccaccggcggcgcagccgccgtcggcgatttcggcaagcactcaaccgtcgctcgctgatgtcctggagggcgtcacgccggcagtcgtcaacattgcggtgaggtcacgcgctcccgccgaaaccaatcctctctacaacgatcctttcttccgccgctatttcaacctgccggagcagcagcaacagcggctgagcgccggttccggcgtcatcgtcgacgccgacaaaggttatatcctcaccaatcaccacgtcgtcgcggccgccggcgagatcgccgtgactctaaaggaccgccgccgcttcaccgccgagctggtcggcagcgacgaggcaaccgatatggcgttgctgaagatcgacgctgacaagctgacggcgctttcgttcggcgattccggcgcgctgcgtgtcggcgactcggttgttgcgatcggcaatccgttcgggcttggtcagaccgtcacctccggcatcgtcagcgcccttggccgtggcggcatcaatgtcgagggctatgaggacttcatccagacggatgcctcgatcaatcccggcaactcgggaggcgcgctggtgacggcggacgggcgtttggtcggcatcaacaccgcaatcatcgcgccggctggtggcaatgtcggcatcggctttgcggttccgatcgcgatggcgtcggccgtgatggagcaactgatcgagcatggcgaagtgcggcgcggccggatcggcatctccgcccaggacctgacgcccgacctggccgaggcgctcggcatcgagcaaagctacggcgccgtcgtcggcggcgttgagcggaattcgccggcggcacatgcgggccttcgagctggcgatgtcatcatcgccgtcaacgatcgtaaaatcacgggctcggcagatctccgcaatcgcatcggcctggctccggtcggatcggaagtcgaaatcgaatatcggcgcgatcgggttcctaaaacggtaacaatgcgcgtcgagccggacgagacaattgccaatccaggctccatgccctcccgccttgacggcgctgagttccaggacgcggccggtaatgtgatcgtttccagtgttgaagatggaagtgctgcggcccgagccggtctgcgcatgggcgacgtcatcgttgcggccaatcgccggcccgtcgcgacagtggcggagctcgcggcggccttgaagaacgccggcggcacgatagcgctcgatctgtttcgcggcgggtcgaaacacttgctggtgatccggtag

SEQ ID NO: 28864 - protein, 464 aa, Rhizobium sp
MARPPARKEDLKNSGPKMTARSSKYVGVFAALVLILVPGPPPAAQPPSAISASTQPSLADVLEGVTPAVVNIAVRSRAPAETNPLYNDPFFRRYFNLPEQQQQRLSAGSGVIVDADKGYILTNHHVVAAAGEIAVTLKDRRRFTAELVGSDEATDMALLKIDADKLTALSFGDSGALRVGDSVVAIGNPFGLGQTVTSGIVSALGRGGINVEGYEDFIQTDASINPGNSGGALVTADGRLVGINTAIIAPAGGNVGIGFAVPIAMASAVMEQLIEHGEVRRGRIGISAQDLTPDLAEALGIEQSYGAVVGGVERNSPAAHAGLRAGDVIIAVNDRKITGSADLRNRIGLAPVGSEVEIEYRRDRVPKTVTMRVEPDETIANPGSMPSRLDGAEFQDAAGNVIVSSVEDGSAAARAGLRMGDVIVAANRRPVATVAELAAALKNAGGTIALDLFRGGSKHLLVIR

SEQ ID NO: 28865 - DNA, 1449 bp, Desulfovibrio vulgaris
  CDS (1)..(1449)
atggtacgtaccccccgctatttcgcattgctgctgctcatggtggcggtggtcctgtcatccaccgcacaggcggcaagtcttccggatttcagggaactggcgaagaacgccggtgccgctgtcgtcaacatcagcacggagaagaccgtgcaggccccggaaaacccgttcggagacatgctccgcaacgccccgcaagggacgcccttcgacaggttcttcgagcagttcgaaagattccacggaaagatgcgcccgcagaagcagcgttcgctcggttccggcttcatcctctcggcggacggctacatcgtcaccaacaaccacgtcatcgccgatgcggatgtcatccacgtcaacatcgagaacgagacgggcaagagtgcgtcctacgacgccaaggttatcggcactgacgaagagaccgacctcgccctgctcaagatcgacgccaagcggcaactgcccgtgctgcgcttcggcgactctgacagcctcgaagtgggtgaatggttgatggccatcggcaaccccttcggcctcgaccacagcgtgacggcgggcatcctcagtgccaaggggcgcgacatccgctccgggcccttcgacaacttcctccagaccgatgcctccatcaaccccggcaacagcggcggccccctcatcaacatgaagggtgaggtcatcggcatcaacacggccatcgtcgccagcggtcagggcatcggcttcgccatccccagcaacatggcagcccgcatcatcgaccagctcaagagcgacaagaaggtgcgccgtggctggataggcgtgaccattcaggatgtggacgagaacacggcccgtgcgctcggtctcggtgaaccgcgcggtgccctcgtcggttccgtgatgcccggagaacccgccgacaaggccggtatcaaggccggggacatcctgctcaaggtcgaaggtgaggacatagccgactccggtcgcctgctgcgccgcgtcgcggcactcaagcccggtgagacggccaagataaccctctggcgcaacggccagaccaagaccgtcaacctcaccctcggcgaacgcacggcggaacatctcgccgcacagggcggcacgccgcgccagacccctgaatcgaagcagcaggcgtcgagcagcctcggcctcaccgtacgcccgcccaacgccgaagaggcccgcgccctcaaactcgacaggccgcagggacttctggtcatcgccgtcgaagagggcaggcccgccgccgatgccgacatccgtgccggagacgtggtgctttccgccaacctgcaccccgtcaacagcaccgccgacctcgccaaggtcgtgcaggaggacgccaagcgcaggggtgccgtgatgttgcagattcagcgtcgcggtcagacgttcttccgcaccattcccatcgaagccgaaaagtag

SEQ ID NO: 28866 - protein, 482 aa, Desulfovibrio vulgaris
MVRTPRYFALLLLMVAVVLSSTAQAASLPDFRELAKNAGAAVVNISTEKTVQAPENPFGDMLRNAPQGTPFDRFFEQFERFHGKMRPQKQRSLGSGFILSADGYIVTNNHVIADADVIHVNIENETGKSASYDAKVIGTDEETDLALLKIDAKRQLPVLRFGDSDSLEVGEWLMAIGNPFGLDHSVTAGILSAKGRDIRSGPFDNFLQTDASINPGNSGGPLINMKGEVIGINTAIVASGQGIGFAIPSNMAARIIDQLKSDKKVRRGWIGVTIQDVDENTARALGLGEPRGALVGSVMPGEPADKAGIKAGDILLKVEGEDIADSGRLLRRVAALKPGETAKITLWRNGQTKTVNLTLGERTAEHLAAQGGTPRQTPESKQQASSSLGLTVRPPNAEEARALKLDRPQGLLVIAVEEGRPAADADIRAGDVVLSANLHPVNSTADLAKVVQEDAKRRGAVMLQIQRRGQTFFRTIPIEAEK

SEQ ID NO: 28867 - DNA, 1167 bp, Leptospira interrogans
  CDS (1)..(1167)
atgaaaaatacggaaaaattgaagtatgttgcaatcgtaagcatttctcttctacttggagcttttttatctcctgtgatgttttgtggaaccggtcagaatagtcctctctttctaagtgccaaaggtgataaggaaccgagccctgcaactcgtcaggcaattacaattcaacaagcatttgaagaagtgtatcaaaccgcttctccgagcgttgtttccatcgctacggaaagaattcaaaacgttccagctcatcccggacctttcggagatccgttctttgatcaattttttggtagaggtcaaggcggtggtggtagggtgatgaaacaaaaacaaaccggtctcggctctggaatcatcctcaatactcaaggatatattttaacaaacgaacacgtagttcgttctatggataaactcactgttcgtctaaaaactggtaaaacgtttactgcggagttgattggttccgatcctgttattgatttggctcttttgaaaatcaaaccggaaggagaaatcgttccgattgaactcggtgattcttctgcagtaaaagtaggggattgggcgattgcgattggtgctcctcttggttatgaacaatctttaaccgctgggattgtaagtgcagttggtaggaccggaatcgataatagcggggttcattatcttcaaacagacgcttctatcaatcaaggaaattcaggaggtcctcttttagatatcaacggtcgtgtgatcggtatcaatcgtatgattgcttctcaaagtggtggttcggttggaatcggatttgcgattccgattaacgaggctaaggcgatcatggaagaattaaaaaccaccggtaaagttaaacgtcctgcacaggcctggcttggagttggggtagattatcttcacgaagatgatgccaagaagttaaatctttcaggtggtgcggttgtggttcaaattatgaatgattctcccgctgaccgtgccgggattcaattgatggacgtgatcactgaaatttccggaaccaaaatcaattctcccgaggaagtggtcagtacagtcaaaaaaaataaggtaggggatagaattacggttaccgttgtacgtcaagggaacatttccagaatctctatccaacttaaggaaagaccgaactga

SEQ ID NO: 28868 - protein, 388 aa, Leptospira interrogans
MKNTEKLKYVAIVSISLLLGAFLSPVMFCGTGQNSPLFLSAKGDKEPSPATRQAITIQQAFEEVYQTASPSVVSIATERIQNVPAHPGPFGDPFFDQFFGRGQGGGGRVMKQKQTGLGSGIILNTQGYILTNEHVVRSMDKLTVRLKTGKTFTAELIGSDPVIDLALLKIKPEGEIVPIELGDSSAVKVGDWAIAIGAPLGYEQSLTAGIVSAVGRTGIDNSGVHYLQTDASINQGNSGGPLLDINGRVIGINRMIASQSGGSVGIGFAIPINEAKAIMEELKTTGKVKRPAQAWLGVGVDYLHEDDAKKLNLSGGAVVVQIMNDSPADRAGIQLMDVITEISGTKINSPEEVVSTVKKNKVGDRITVTVVRQGNISRISIQLKERPN

SEQ ID NO: 28869 - DNA, 1494 bp, Wolbachia pipientis wMel
  CDS (1)..(1494)
atgaaaagtaaggcatttattttatctatatttgcatattttctaattgcgttttcttcgtatgctaatatgtttgattggaatgcaaaaaaggtcgttgatgctagcactactgcatgcaactgtaatcaaggacttgccgatttagtggaagaactcattcctgcggttgtaaatatttcaagcgaacaaatcatcaaacaagaaaataacagcagaactagagttccatctatgccaggaaataatttttttgatgattttagagagttttttgagcattttgatcagttttttatggataggggccctagtgttaacaaagaggtggtgttgcttggttctgggtttattatagataaaggtggaactatagtaaccaattatcacgttattaaaaacgccaaagatatcacagttactatgaacgataatacttatttcaaagcagaagttttaggctatgatgcaagaactgatcttgctgtgcttaagattaattctgataaagatctttcttctgttgcatttggtgattctgataaagcaagggttggtgatacggttatggcaataggtaacccatttggtttgggtggctctgtaagcacaggaattatatctgcaaggtccagggacattagtattggcactatgaatgaatttattcaaactgatgctgcaattaataggggtaattctggaggaccgttatttgatttaaatggaaaagttataggtattaatactgctatctattctccatctgagtctggcggcaacgtgggtataggttttgccataccatctaatttagctatgtcaattattgacacattaaaaagtggcaaaaaaataaaacatggttggcttggtgtgcaagttcagcctataacgaaagaatttgctgagtccttgggtttaaaagatataaaaggcgcattggttgcaagtatagtaaaggatagtcctgcagaaaaaggtgggattaaagtaggtgatatattattagaatttgacggtaaaaaaatcgatagaatgacacaattacctcaaatggtttcaagagctggacctgagaaaaaagtgcaagttaagttacttagaaagagcaaagaggttaatattaaagttgtgatcggagaatctacaaatgatggccaagataacaatcaagaagaaaataaatcaacatctgattatgtaaccggtttaactgtttcaaatctgccaaaagaatcaaaagaaagtaaaaataatgtacctacaaaaggtgtgatagttaccaatgtagatagtaacagtaatgccacgttgcgtggtattaaaaaaggagacattattatccaattagatggaaccgatatagaaaatactaatgattttcaaaaacaagttgattcagcagtaaagaaaaacggtaaagattcaataatgttgctcatttaccgcaatggaaatcaattctttacttcgataaagttgaagaaatag

SEQ ID NO: 28870 - protein, 497 aa, Wolbachia pipientis wMel
MKSKAFILSIFAYFLIAFSSYANMFDWNAKKVVDASTTACNCNQGLADLVEELIPAVVNISSEQIIKQENNSRTRVPSMPGNNFFDDFREFFEHFDQFFMDRGPSVNKEVVLLGSGFIIDKGGTIVTNYHVIKNAKDITVTMNDNTYFKAEVLGYDARTDLAVLKINSDKDLSSVAFGDSDKARVGDTVMAIGNPFGLGGSVSTGIISARSRDISIGTMNEFIQTDAAINRGNSGGPLFDLNGKVIGINTAIYSPSESGGNVGIGFAIPSNLAMSIIDTLKSGKKIKHGWLGVQVQPITKEFAESLGLKDIKGALVASIVKDSPAEKGGIKVGDILLEFDGKKIDRMTQLPQMVSRAGPEKKVQVKLLRKSKEVNIKVVIGESTNDGQDNNQEENKSTSDYVTGLTVSNLPKESKESKNNVPTKGVIVTNVDSNSNATLRGIKKGDIIIQLDGTDIENTNDFQKQVDSAVKKNGKDSIMLLIYRNGNQFFTSIKLKK

SEQ ID NO: 28871 - DNA, 1482 bp, Treponema denticola
  CDS (1)..(1482)
atgcgtaaattaaaaaatccgctttcagcgatggccggaattttattgattatgcttgtttcggttgtttttctttcagcccgatgttcaagtaatcccgaaaatgcttctacagtgtatgccgatccggggttaaagaccgagctgagtaaagagtctgtttcggctcttgaatctcttcaaaaagcaaatcgagagcttacttccatgattttaccctcggtagttacccttgatgttgtagaaacaagaaaggttcaaaacaatatagacggttttccttggtttttctttaaccgccctcaagatcaaaaagacggtcagggggaaagggaatatgaagccgaaggtatgggctcaggtgttatcgtaagaaagacgggaaaaacatattatgttctgacaaaccagcatgttacaggcaatgccaagacaatttccgttatgctttataacggtgataaggttcaaggtaagttaatcggttctgatcagaggaaggacgttgcccttgtttccttcgattatgataaggatttaagggttgccgtgttgggagactcaaataccgtacaggtaggagaccttacatatgcaatcggtgctcctatgggttatgtgtctaccgttacaagcggtattgtaagtgcggtaggccgttcaggcggaccgaacagaaataatataaacgattttatccaaacggatgcagcgataaatcaaggcaactcaggcggtcccttggtcaatatctatggtgaggttataggcataaataactggattgtttcatcaagcggcgggtctcaaggtcttgccttttcgattcctataaacaacctcaaaaaagctatcgatgattttattacttcgggtgaaatcaaatacggttggcttggtgttcagcttcttgaaataaacgataagtttagagaaagcttaaacttaaaggatattgaaggtgcttttgcaggacaggtatttttaggttctcctgcggataagggcggtataaagcccggtgattatattaccgaggtaaattcgacaaaggttaaaagtgttgacgatatactgcgtgttatcgccgacttaaagccgggagaatcttcatcctttaagattttacgaaaaggaaaagaaatctccgcaaccgtaaaaatagaagaaagagatgaaaaaaatgtagccgattcttccaaactttggcccggttttgttccgtctcctttaactgaagaaattataaaacaactggagcttaaaaaaggtcaaaacggcgttttggtaacaagtttacaggctaagagccctgctgccgttatgagtttacagccgggcgaccttatagtaaaggttaacggaaaagatgtaaaagatgttttgagcttttatgatgagctttcaaacgcaaagggcgagatttggtttgactttataagagaaggccacaatttggttaccccaaagattaaaagataa

SEQ ID NO: 28872 - protein, 493 aa, Treponema denticola
MRKLKNPLSAMAGILLIMLVSVVFLSARCSSNPENASTVYADPGLKTELSKESVSALESLQKANRELTSMILPSVVTLDVVETRKVQNNIDGFPWFFFNRPQDQKDGQGEREYEAEGMGSGVIVRKTGKTYYVLTNQHVTGNAKTISVMLYNGDKVQGKLIGSDQRKDVALVSFDYDKDLRVAVLGDSNTVQVGDLTYAIGAPMGYVSTVTSGIVSAVGRSGGPNRNNINDFIQTDAAINQGNSGGPLVNIYGEVIGINNWIVSSSGGSQGLAFSIPINNLKKAIDDFITSGEIKYGWLGVQLLEINDKFRESLNLKDIEGAFAGQVFLGSPADKGGIKPGDYITEVNSTKVKSVDDILRVIADLKPGESSSFKILRKGKEISATVKIEERDEKNVADSSKLWPGFVPSPLTEEIIKQLELKKGQNGVLVTSLQAKSPAAVMSLQPGDLIVKVNGKDVKDVLSFYDELSNAKGEIWFDFIREGHNLVTPKIKR

SEQ ID NO: 28873 - DNA, 1395 bp, Geobacter sulfurreducens
  CDS (1)..(1395)
atgaaaatggtgtccttgcggttccttaagaccatgctcaccgttatctgcctgatggcgttgtcggcgggagaagtcccagccaaagtcatggctcccgattttgtcacacttgccgaaaagctgaagccaaccgtcgtcaacatcagtacatcaaagaatccggcccagacagctcgcccccgtcgccaaccctctcccttcaatgacccgttccatgatttcttcgatcgcttttttgacgaggcacctcgccgtcagcaacgggaacggagtctcggctccgggttcatcatcagtgatcagggctttatcatcaccaataaccatgtggttgccggtgccgacgagatcaaggtgcgcctctccgacggccgcgagttcaaggcggaattgaagggcgccgacgaaaaactcgacctggccctcatcaagattgagtccaaagatcaactccccgttgcgattctcggcaacagcgatgaaatcaaagtgggcgagtgggtgatggcgatcggcaatccgttcggccttgcccagaccgttaccgccggaatcgtcagcgccaccggtcgcgtcatcggcagcgggccctatgacgatttcatccagaccgatgcctccattaaccccggtaactcgggaggcccccttttcagcgccgaaggaaaagtcatcggcatcaataccgccatcatcgccggcggtcagggaatcgggtttgccatccccatcaacatggccaaagatgtcattccccagctcgaggaaaagggaaaggtcatccgcggctggcttggggtgacggttcagcccataactcccgatctggcccgctcgtttggccttgagggagagcggggtgcgctcatcgccgacgtggtgaaggatggccccgccgccaaggccggactcaagagcggggatatcgtgcttgaattcgacggtaagaaaatccgggaaatgaacgagctcccgcgtatcgtagccgccacccctgtggggaaggccgcattggtcaaggtgctgcgtgatggcaagatgcaggatgtcgaagtatctgtcgggcgcttggcggatacgggcgatgagtcagatcagaagaatggtgaagataaacttggcatggcagtcagggagctgacacgcgatcttgccgcgcggatggggcttaaggagactcagggcgtcgttgtcacgggtgtcaagtctggcagtctggccgaggaagcgggaatcctgccgggcgatatcgttcgggagataggagggcgttccattactactatggcggattacgaaacagcgatccgagccgtgaagaagggagacgtagtccgctttctgctgcgccgcggcggtggcaaccacttcctggcaatccgggtcgaatag

SEQ ID NO: 28874 - protein, 464 aa, Geobacter sulfurreducens
MKMVSLRFLKTMLTVICLMALSAGEVPAKVMAPDFVTLAEKLKPTVVNISTSKNPAQTARPRRQPSPFNDPFHDFFDRFFDEAPRRQQRERSLGSGFIISDQGFIITNNHVVAGADEIKVRLSDGREFKAELKGADEKLDLALIKIESKDQLPVAILGNSDEIKVGEWVMAIGNPFGLAQTVTAGIVSATGRVIGSGPYDDFIQTDASINPGNSGGPLFSAEGKVIGINTAIIAGGQGIGFAIPINMAKDVIPQLEEKGKVIRGWLGVTVQPITPDLARSFGLEGERGALIADVVKDGPAAKAGLKSGDIVLEFDGKKIREMNELPRIVAATPVGKAALVKVLRDGKMQDVEVSVGRLADTGDESDQKNGEDKLGMAVRELTRDLAARMGLKETQGVVVTGVKSGSLAEEAGILPGDIVREIGGRSITTMADYETAIRAVKKGDVVRFLLRRGGGNHFLAIRVE

SEQ ID NO: 28875 - DNA, 1416 bp, Geobacter sulfurreducens
  CDS (1)..(1416)
atgttcgtccgtcgtctgctactgatatcgttggtctttgtcacaactctcaccgcctgctcgaagaaggaagaaaagctcttctatgagtcgggccgtgccgacgcgccggtcaaggaggttcccagagacatccttgccacccagcaggccttcgtcgagctggtcaagaaggttactccgtcggtcgtgaacatctccaccgtcagccggagaaagatcgagcagcccttcttcgagttttcccccttcttcaatgatttcttcgacaatcgcccccggttccggcgggaacagagcctcggctctggcttcatcatcaaccgggaagggtacatcgtcaccaatgaccatgtggtgcgcgacgccgaaagcatcaaggtcaaactctccaatgagaacgtctacgacggccacatcgtcggcagcgaccccaagaccgacatcgcggtcatcaagatcgactcgcgggaggaactccccgtggcggtcctggccgattcggacaagcttcaagtggggcagtgggcggtggccatcggcaaccccttcggcctggaccggaccgtgaccgtcggcgtggtgtcggccaccggccggtccaacatgggaatcgagacctatgaagatttcatccagaccgacgcctccatcaacccgggcaattcgggggggccgctgctgaacgtccacggcgaggtgatcggcatcaacaccgccatcgtggccgccggtcaggggatcggctttgccatcccggtcaacatggcaaagcagatcgtaactcagctcatcaccaagggcaaggtcacccgcggctggctcggcgttaccattcaaccggtcaccgacgatcttgccaaggaattcggcctgaaaaaggcccagggcgtcctggtgagtgatgtggttaaggggagccccgctgccggcgccggtatccggcagggggacatcatcctcaggttcgccggcaaggagatcaaggatgcccagcacctccagcgggtggtgggcgacacggcgccggggacaaaggtgccggtggtggtcttccgagaagggaaagaggttcaactctccctggcgacggccagttccgacagtgcccaggcacgccaggcgcgccctcagggaggggcgcccgacacccttggcctcgccgtggaggaactaccccgcgaataccgtcaggaaggtttcaccggcgtcctggtggtccaggtggatgatgggagcgccgccggcgaggcgggcatccgggagggggacgtgatcgtggcggtgaaccggcggcccgtggcgaacctggcagagtacgaccgcgtcatgcgcgaggcggcccggcgcggttcggtagtgcttctggtgcgacgaggcgaggcgagcatctatttctccctcaggctcaggtag

SEQ ID NO: 28876 - protein, 471 aa, Geobacter sulfurreducens
MFVRRLLLISLVFVTTLTACSKKEEKLFYESGRADAPVKEVPRDILATQQAFVELVKKVTPSVVNISTVSRRKIEQPFFEFSPFFNDFFDNRPRFRREQSLGSGFIINREGYIVTNDHVVRDAESIKVKLSNENVYDGHIVGSDPKTDIAVIKIDSREELPVAVLADSDKLQVGQWAVAIGNPFGLDRTVTVGVVSATGRSNMGIETYEDFIQTDASINPGNSGGPLLNVHGEVIGINTAIVAAGQGIGFAIPVNMAKQIVTQLITKGKVTRGWLGVTIQPVTDDLAKEFGLKKAQGVLVSDVVKGSPAAGAGIRQGDIILRFAGKEIKDAQHLQRVVGDTAPGTKVPVVVFREGKEVQLSLATASSDSAQARQARPQGGAPDTLGLAVEELPREYRQEGFTGVLVVQVDDGSAAGEAGIREGDVIVAVNRRPVANLAEYDRVMREAARRGSVVLLVRRGEASIYFSLRLR

SEQ ID NO: 28877 - DNA, 1221 bp, Lactobacillus johnsonii
  CDS (1)..(1221)
atggcagaaaataatactaagaactctaataaacataatgctcttattaaaactggtattgtgggagtagttgcaggattactcggtggtggagtagcttatgcagggttgtctcaagttaatggacagaatgctccacaaactactgttgctccaacagctaaggttgaaaagtctaacagtaaaaatagcagtcagatgactaatgcctttaatacggtaaagaattctgttgtttctgttgtaaacttgaagagacaaagttcttcttcaactagtgacccatttggcatttttgggtctgatagttctagttcttcaaagaagaattctaaatcagatttagaaacttacagtgaaggttctggagttatttacatgaagtctaatggtaaaggctacatcgtaactaataatcacgtggtttctggaagtgatgaaattcaagttattttaagtgacggtaaaaaggtaacagctaaaaaagtcggaactgatgcagaaacagacttggctgtcttaactattgatggtaaatatgttactcaaactgcccaatttggttcttctaagaacttagagccaggtcaacaagtaattgctgttgggtctccacttgggagcgaatatgcaactagtgtaacccaaggtattatttctgctaagaatagaacagtagatgtaactaattcatctggccaagtaactaaccaggcaaccgttattcagactgatgcagctattaaccctggtaattcaggtggtccattagttaatatgtctggtcaagtaataggtattaactcaatgaaattgtcctcttctagtgatgggactgctgttgaaggaatgggctttgcaattccgagtgatgaagttgtttcaatcattaatcaattggttaagaatggtaaaattacgcgtcctaaattaggtgtaagaattgtatcagttgatgaattaacagaatatggccgcaagaaacttggtttgcctgatagtgttaaatctggtgtctatgttgctagtgtgactaagaatggtagtgcagataaggccggcattaaggctcgtgatgtgattactaagattgatggcaaagatgtggatagcgttgtttcactacatacagctctttatgcacataagattggcgatacagtaacccttcaagtggttagagatggaaaatcacaggatatcaaagttaccttaagttaa

SEQ ID NO: 28878 - protein, 406 aa, Lactobacillus johnsonii
MAENNTKNSNKHNALIKTGIVGVVAGLLGGGVAYAGLSQVNGQNAPQTTVAPTAKVEKSNSKNSSQMTNAFNTVKNSVVSVVNLKRQSSSSTSDPFGIFGSDSSSSSKKNSKSDLETYSEGSGVIYMKSNGKGYIVTNNHVVSGSDEIQVILSDGKKVTAKKVGTDAETDLAVLTIDGKYVTQTAQFGSSKNLEPGQQVIAVGSPLGSEYATSVTQGIISAKNRTVDVTNSSGQVTNQATVIQTDAAINPGNSGGPLVNMSGQVIGINSMKLSSSSDGTAVEGMGFAIPSDEVVSIINQLVKNGKITRPKLGVRIVSVDELTEYGRKKLGLPDSVKSGVYVASVTKNGSADKAGIKARDVITKIDGKDVDSVVSLHTALYAHKIGDTVTLQVVRDGKSQDIKVTLS

SEQ ID NO: 28879 - DNA, 1425 bp, Wolinella succinogenes
  CDS (1)..(1425)
atgaatctcagactcttctgtttaggctccctcttcatgacctatgctctagcctttagcgtgagcgaagcccctgcaatcgagcggcgtgtagctcccgatgtatcgagcggcgtggtctactcctactatgattccatcaaagacgctaaacgcggtgttgtgaatatctccactcaaaaaaaagtcaaaggcgcctcaggaatcgacccctcacaccccctcttcaatgaccccttcttcaaacagttttttggtgatatgtttgggcaggtcatccccaaagatcgaatcgaacgctccttgggtagtggggtcatcatctccaaggatggctacatcctcaccaacaaccatgtgatcgatggggcggataaagtgatcgtctccctgcctgataacagtaaagagtatgaggccaaagtgattggcaaagacccaaggagcgatctagcggtcattaaaatcgaaggcaaagatttcccctttgtcatttttggctctagcaatgatttgcgcgtgggcgatgtggtatttgcgattggaaatccctttggcgtgggcgaaacggtgacacagggaatcgtttcagccctcaataagagcggaattggaatcaacgactatgaaaacttcatccaaaccgatgcctccatcaaccccggaaactctggaggggcactggtggatagccgaggggcactggtgggaatcaacacggccatcctttctcgcacgggagggaatcatggcgtaggctttgctatcccctcggacatggccaaaaaaatcgccatcaccctcattgacaaaggagtgattgagcgaggctatatgggagtctctatccaagatgtcacccaagatttgcgcgatctctatggggacaaagagggggcagtcatcatctccaccgaatcaagctctccagccgccaaagcgggtctaaaggtgtgggatttaatcactaaaatcgatgaaaagcccgtgaaaaatgccgccgatttaaaaaatatcatcggatcttactctcccaatgataaggtcaaggtgacctacatccgggacaaaaaagaatccaccgccactctcaagctcatcgaagccccaagcaatgccaaaacaagtggtgctggggtgagcaacagtgcgattgatgggctgatgctaagcgcgattgatgatcgtatacgacagcgctatagacttgccattgatacgagtggcgtgctagtcattggcgtgcaggcaggaagttatgccgaggagatcggctttagcgagggagatatcatccttcagattgagaactatcccatcaaagacattgcctctttcaacgaagcgatgaaacaacacaaaggtaaagccaagcgactccttgtgagccgtggcggaaccatcttcagcgtggttgtaaaataa

SEQ ID NO: 28880 - protein, 474 aa, Wolinella succinogenes
MNLRLFCLGSLFMTYALAFSVSEAPAIERRVAPDVSSGVVYSYYDSIKDAKRGVVNISTQKKVKGASGIDPSHPLFNDPFFKQFFGDMFGQVIPKDRIERSLGSGVIISKDGYILTNNHVIDGADKVIVSLPDNSKEYEAKVIGKDPRSDLAVIKIEGKDFPFVIFGSSNDLRVGDVVFAIGNPFGVGETVTQGIVSALNKSGIGINDYENFIQTDASINPGNSGGALVDSRGALVGINTAILSRTGGNHGVGFAIPSDMAKKIAITLIDKGVIERGYMGVSIQDVTQDLRDLYGDKEGAVIISTESSSPAAKAGLKVWDLITKIDEKPVKNAADLKNIIGSYSPNDKVKVTYIRDKKESTATLKLIEAPSNAKTSGAGVSNSAIDGLMLSAIDDRIRQRYRLAIDTSGVLVIGVQAGSYAEEIGFSEGDIILQIENYPIKDIASFNEAMKQHKGKAKRLLVSRGGTIFSVVVK

SEQ ID NO: 28881 - DNA, 1368 bp, Vibrio vulnificus
  CDS (1)..(1368)
atgaaaaaacctttgcttgttttgactgcattgtctttgagcttaagctcagcccttgcccctcttccagcaaccgccgcactgccttttagcgtcagtggacaggagttgccgagcttagcgccaatgctcgaacgtgttactccagcggtcgtcagtatcgcggttgaaggtaaacaggtagaacgctcgcgtattcccgatcaatttcagttcttttttggccctgatttcccaacagaacaagttcgtgaacgtccattccgtggtttaggttctggtgtcatcattaatgccaataaaggctatatcgtgacgaactaccacgtcatcaaaggggcagatgagatacgaattcagcttcacgatggtcgtgaatacgatgccgagttaattggtggcgatgagatgtccgatgtcgctctgctcaaagtcgatggcgctaaagacttaaccgagattaagctcgccgattccgacaagttacgtgtgggtgatttcagcgtcgccattggtaacccatttggtttaggacagacagtgacgtccggcattgtttcagccttaggtcgcagtggtttgaacattgaaaacttcgaaaactttattcaaaccgacgcggcaattaacagcggcaactccggtggtgcactcgtcaacctcaatggtgagctcatcggcatcaatacggcgattctcggccctaatggcggcaacgtcggtattggcttcgccattccatcgaatatgatgaagaacttaactgaccaaatcttggaatttggtgaagtaaaacgtggcatgttaggcgttcaaggtggcgaaatcacctctgaactggctgaagcgctgggctataactcgagcaaaggcgcatttgtcagccaagtggttcctgactcagcagcagataaagccggcatcaaggcgggcgacatcattgtgtctctcaatggaaagaaaatcgataccttctctgagctaagagccaaaattgcaacactcggggctggcaaagaaatcgagcttggcgtggtgcgtgatggtaaggataagcgctttgatgtcactttgggtgaatcacagcagaccaaagcgaaagccgataagatgcacgaaggccttgccggtgctgagttggcgaatactacgtcagacgatcgcattgctggggttaaagtgatcaacgtggcagataactcgccagcggcacaataccagttacaaaaagacgacatcattatcggcgttaaccgtcagcgagtgaagaatctcgccgatttccgtgccattgttgaaaaacaaactggtgtgcttgcgctcaatatccaacgtggtgagcgcactatctacttagtcattcgctaa

SEQ ID NO: 28882 - protein, 455 aa, Vibrio vulnificus
MKKPLLVLTALSLSLSSALAPLPATAALPFSVSGQELPSLAPMLERVTPAVVSIAVEGKQVERSRIPDQFQFFFGPDFPTEQVRERPFRGLGSGVIINANKGYIVTNYHVIKGADEIRIQLHDGREYDAELIGGDEMSDVALLKVDGAKDLTEIKLADSDKLRVGDFSVAIGNPFGLGQTVTSGIVSALGRSGLNIENFENFIQTDAAINSGNSGGALVNLNGELIGINTAILGPNGGNVGIGFAIPSNMMKNLTDQILEFGEVKRGMLGVQGGEITSELAEALGYNSSKGAFVSQVVPDSAADKAGIKAGDIIVSLNGKKIDTFSELRAKIATLGAGKEIELGVVRDGKDKRFDVTLGESQQTKAKADKMHEGLAGAELANTTSDDRIAGVKVINVADNSPAAQYQLQKDDIIIGVNRQRVKNLADFRAIVEKQTGVLALNIQRGERTIYLVIR

SEQ ID NO: 28883 - DNA, 1497 bp, Porphyromonas gingivalis
  CDS (1)..(1497)
atgaacaaagtgtggaaatacgtgacgggagcctttggcatagcagccgtcagcgcagtagcatcggtggcaacagtggctgctttgggacactaccgaggtgaatctttcataaccgatggtacggaaaacgaattcggattcaagcagacatcttacacaacgacatccggagcctccgccgctctgcccaatttggtcggagctgcagaagcatcggtacacgccgtagtacacatcaaagtggagtccgagcagcgaatggactctcagcagtacttcgatccgttcgaattcttcttcggaggcgaatccagaaacttccagcgtccccaaacacggcaggtagtaggctacggttcgggggtgatcatcagcacagacggatatatcatcacgaataatcatgtagtaaagggagccaaagaaatgacggtaacgctcaatgacaatcgtaccttcaaggccaaactgatcggtagcgatgccacgaccgacatagccttgctgaaagtagatgccaaggggctgccgacaattcctttcggcgactctgacaagcttcgtgtgggagagtgggtattggccgtaggcaatccttttaatcttacttccacggtaacggccggcatcgtcagcgcaaaaggtcgctccactcagcaggtggccagaggcggttcgctccagatagaatcttttattcagacggatgctgccgtcaattcaggcaacagcggcggtgcgttggtgaatgatcgtggcgaactgatcggtatcaatacgatgatctacagccaaacgggcaactatgccggctactcatttgccgtacctatttccatagcggcgaaagtggtagccgacatcaagcagtacggtaccgtacagcgcgccgtgctgggcattgccggcggagatatatcggacgaagcagtcaaagaatacgatctgaaggtgcgcgagggtgctctcgtagcagactttgccgaagtcagtgcagctatctctgccggtatgcagaagggggatgtgatcaccgccgtagaaggcaaacagataaagagtttcccacaactgcaagaagccatcagccgctacagaccgggagacaaagtgaagctgaccatcaatcgtaagggagcgaccaaggaactgaccgtcacgctcaagaacaatgaaggaagtacttcggtaatcaccggcgaatcgaccggaaatgtattgggagcatcattcaaagacctcagtgccgaacaaatgcgatcctatggtgtttcttatggtgtagaggtaacctctgtaagctcggggaaattcaaggatgcaggtatcaagaaaggattcatcatcctttcgatcaaccgccaaccggtaagctcgggtgccgatgtcagcgacatcgttcgtgaggccggacagagccgatcgggtcgcttgatcatcgtgcgtgggttttatccggacggtaatatccggaccttcgaagtagaactataa

SEQ ID NO: 28884 - protein, 498 aa, Porphyromonas gingivalis
MNKVWKYVTGAFGIAAVSAVASVATVAALGHYRGESFITDGTENEFGFKQTSYTTTSGASAALPNLVGAAEASVHAVVHIKVESEQRMDSQQYFDPFEFFFGGESRNFQRPQTRQVVGYGSGVIISTDGYIITNNHVVKGAKEMTVTLNDNRTFKAKLIGSDATTDIALLKVDAKGLPTIPFGDSDKLRVGEWVLAVGNPFNLTSTVTAGIVSAKGRSTQQVARGGSLQIESFIQTDAAVNSGNSGGALVNDRGELIGINTMIYSQTGNYAGYSFAVPISIAAKVVADIKQYGTVQRAVLGIAGGDISDEAVKEYDLKVREGALVADFAEVSAAISAGMQKGDVITAVEGKQIKSFPQLQEAISRYRPGDKVKLTINRKGATKELTVTLKNNEGSTSVITGESTGNVLGASFKDLSAEQMRSYGVSYGVEVTSVSSGKFKDAGIKKGFIILSINRQPVSSGADVSDIVREAGQSRSGRLIIVRGFYPDGNIRTFEVEL

SEQ ID NO: 28885 - DNA, 1320 bp, Gloeobacter violaceus
  CDS (1)..(1320)
atgcgagcggcccccgggcgcggtgctaggatagccgttgagcgatttgtccgcgaacttacgaggattgctggaagtatgctgagccattggaaaaaaagacttgtacagcttgctgttgtcggagcggtggcgggcggcagcttttcactgggtacctttgcggtgcgccaggttgcgggtgttcccctggcggcggctccggccccgcaggcgagcctgaccagcagcgattcggtgccgcttccggctctatcgagtgccgaaggtccgcagcgggcctccgcggccacgactttcttgggtcccaacttcatcgccgatgcggccgaaaaggcttctccagccgtggtacgcatcaacaccgagcgggtgcgcgaggtgggtggccgcacgccgctggagcaattttttcctgaattcacaccgcgccggggcggcatgccccgcctggagcagggggcgggttcaggctttatcctgagcggtgacggcaccgtggtcaccaacgcccatgtcgtcgaaaaggccgacaaagtctacgtcaccctgggcgacggccgcaaaaccaccggcaaggtgatcggcgccgacccgctcaccgacattgccgtaatcaaaatcgacgcgggcattgacttgccgaccgccccgttgggcgactcggacaggttgcgcgccggtgaatgggtgattgccgtgggtaatccgctgggcctcgatcacaccgtcaccgccggcatcatcagtgccctcaagcgctccagcaacgaagtcggtgtgcgcgaggaccggcggctcgactttatccagaccgacgccgccatcaatccgggcaattccggcggcccgctggtcaacatctacggtcaggtggtgggcatcaacacggccattcgcgccgacggccagggtatcggctttgccatcccgatcaacaaagtcaaagagatcacggcgagtttattgagggacggccgggtgattcgcccctacatcggcatctcgatggtgagcattacccccgaactgctgcgcgaactcaaagagaaccccgacgtcgccaagctgccccaggccgaaaaaggcgtctggatccgcgaggtgatcaaaggctcccccgccgccacagccgggttgcgcgccgacgacattattgtcgaagtcgacggcaaagcggtttctgaggccaggcaggtgcaggaactgattggagcgcgcaaggtgggcgacaccgtctcggtcagtgtccaacgcaacagcaagctctcgacttttgaagtgcgcacggtggaattgagccagacaccgctcagctaa

SEQ ID NO: 28886 - protein, 439 aa, Gloeobacter violaceus
MRAAPGRGARIAVERFVRELTRIAGSMLSHWKKRLVQLAVVGAVAGGSFSLGTFAVRQVAGVPLAAAPAPQASLTSSDSVPLPALSSAEGPQRASAATTFLGPNFIADAAEKASPAVVRINTERVREVGGRTPLEQFFPEFTPRRGGMPRLEQGAGSGFILSGDGTVVTNAHVVEKADKVYVTLGDGRKTTGKVIGADPLTDIAVIKIDAGIDLPTAPLGDSDRLRAGEWVIAVGNPLGLDHTVTAGIISALKRSSNEVGVREDRRLDFIQTDAAINPGNSGGPLVNIYGQVVGINTAIRADGQGIGFAIPINKVKEITASLLRDGRVIRPYIGISMVSITPELLRELKENPDVAKLPQAEKGVWIREVIKGSPAATAGLRADDIIVEVDGKAVSEARQVQELIGARKVGDTVSVSVQRNSKLSTFEVRTVELSQTPLS

SEQ ID NO: 28887 - DNA, 1467 bp, Chromobacterium violaceum
  CDS (1)..(1467)
atggccggcgccctgctcgcggcgtcgttactgtccggctgcgacaggatcgagcagtttgtcaaaggcagcaaccagccagcccccgtcgccattcctgcccagcaggacggccgcgtagccatgctgctgcccgacttcactcagctggtcagccgggacggcccggccgtggtcaatatccaggccacccgcgaaggcggcggagccgcgccgcagcaaagcggcaacatgcccttcccggtgccggaagacgacccgctgtacgacttcttccgccgcttcatgcccaaccagccgccgcaacaggagcagggcccggaggaaagcgtgtcctacggttccggcttcatcatcagcagcgacggcttcatcctgaccaacgcccacgtggtggccgacggcggccagatccgcgtcacgctgaccgacaagcgcgaactgcgcgccaagctggtgggcctggacaagcgcagcgacgtggccttgctcaaggtggccgcggccgacctgccggtggccaagatcggcaatccggccgacctgaaggtcggcgaatgggtggccgccatcggcgcgccgttcggcttcgacaacaccgtcaccgccggcatcgtatcggccaagggccgcagcctgcccgacgagaccctggtgcccttcatccagaccgacgtggcgatcaacccaggcaactccggcggcccgctgttcaacctgcgcggcgaggtggtcggcatcaactcgcagatctacagccgttcaggcggcttcatgggcatctccttcgccatcccgatcgacctggcgatgcaagtggccgaccagctgaagaccaagggcaaggtcagccgcggccagctgggcgtcaacatccaggaagtgacccaggagctggcgcaatcgttcggcctgcagcggccctccggcgcgctggtggtgcgcgtcgaccccaagggccccgccgccagggcgggcctgcaggctggcgacatcatcctgaagctcaacaaccagtccatcgacagctccaaggatctgccgatgctggtgggctcgctgggccccggcaccaagatcaagctggtggtgtggcgcaagggtttcgagaagacgatggaagccacactggtggaacaggcacaggaacccggcagcaacacgaaaccggccagcgacaactcgccgcaaggctaccagttcggcaagctgggcctgacgctgtccgagctgacggcggagcagcgcggcgacctcggcatccgcggcggcctgctgatccagaagtcgcaaggcccggccgcgcgctccggcctgatgccgggcgacatcatcctgggactgaaccagaacgacatcaccagcatcagcgccttcgagaaagcgctggccagcgccggcggccacgccgcgctgctggtgcgccgcggcgaggcggtgctctacatcgcgctgcgcaccgactga

SEQ ID NO: 28888 - protein, 488 aa, Chromobacterium violaceum
MAGALLAASLLSGCDRIEQFVKGSNQPAPVAIPAQQDGRVAMLLPDFTQLVSRDGPAVVNIQATREGGGAAPQQSGNMPFPVPEDDPLYDFFRRFMPNQPPQQEQGPEESVSYGSGFIISSDGFILTNAHVVADGGQIRVTLTDKRELRAKLVGLDKRSDVALLKVAAADLPVAKIGNPADLKVGEWVAAIGAPFGFDNTVTAGIVSAKGRSLPDETLVPFIQTDVAINPGNSGGPLFNLRGEVVGINSQIYSRSGGFMGISFAIPIDLAMQVADQLKTKGKVSRGQLGVNIQEVTQELAQSFGLQRPSGALVVRVDPKGPAARAGLQAGDIILKLNNQSIDSSKDLPMLVGSLGPGTKIKLVVWRKGFEKTMEATLVEQAQEPGSNTKPASDNSPQGYQFGKLGLTLSELTAEQRGDLGIRGGLLIQKSQGPAARSGLMPGDIILGLNQNDITSISAFEKALASAGGHAALLVRRGEAVLYIALRTD

SEQ ID NO: 28889 - DNA, 1413 bp, Chromobacterium violaceum
  CDS (1)..(1413)
atgtcggtcaaaaaactgattgtttctgcaatgctggcggcatctgtcctgactgccgcggcgcctgccgcgatggcggcggacctgccggatttcgcccagatcgtcgaggccgaaggcaaggcggtggtcaatatcagcaccacctccacggtcaaggagatggtttccggcctgccggagggcatggagggggatccgttcttcgagttcttccgccgcttcgcgccgccgcagcagcgcgagcatcaggaaagctcgctgggttccggcttcatcatttcgcgggacggctatgtgctgaccaatgcgcatgtggtggcccgcgcggacaagattaccgtcaagctgaacgacaagcgcgaattccaggcgcgggtgatcggttccgacgcccgttccgacgtggcgctgctgaagatcgatgcccagaacctgccggtggtgcggatgggcgatccgaaaagcctgaaggtggggcagtgggtgctggccatcggctcgcccttcggttttgagaacaccgcgacttccggcatcgtgtccggcaagaaccgcatgctgccggatgagagcgccgtgcagttcatccagaccgacgccgcggtgaatcccggcaattccggcggcccgctgttcaatctgaagggcgaggtggtcggcgtcaattcgcagatctacagccgttccggcggcttcatgggcatttccttcgccattccgatcgataccgcgatgaatgtcgccgaccagttgaaggccaagggcaaggtcacccgcagccgcatcggcgtggtggtgcaggagctgagcaaggagttggcggcgtccttcggcctggccaagcccagcggcgtgctgatcaacgcgctcgatcccaaggggccggcacagaaggccggcctgaaggcgggcgacatcgtgctgcgcatcaatggccaggcggtggagaacggcggcgacatgcagcgcctgatcagcgacctgccgccgggcaaggcgatcacgctggatgtctggcgcagccgcgcgcagaccagcgtccgcgtggtgccggacgaactggtggaggaggatgcccgcgtcgccaagcgcgaataccgcaagcccggcgccgaggctgagcagaacctggcccagatcggcttgcgcctgcaggagctgagccccgtccagctgcagcgcgccggcatcgattacggcttgctggtgcgcggcgccaacggcgcggcgatgcgcgccggcatccagccgggcgacatcatcgtcggcatcggcagcgatccgctgaagaacttcgcccagctgaagaatgcgctgaaccaggccaagaaaggcggcgccgtggccttgcaggtgatgcgtcagggcgtgaccatgttcgtgccgctgaccgtggacgaagccaagtga

SEQ ID NO: 28890 - protein, 470 aa, Chromobacterium violaceum
MSVKKLIVSAMLAASVLTAAAPAAMAADLPDFAQIVEAEGKAVVNISTTSTVKEMVSGLPEGMEGDPFFEFFRRFAPPQQREHQESSLGSGFIISRDGYVLTNAHVVARADKITVKLNDKREFQARVIGSDARSDVALLKIDAQNLPVVRMGDPKSLKVGQWVLAIGSPFGFENTATSGIVSGKNRMLPDESAVQFIQTDAAVNPGNSGGPLFNLKGEVVGVNSQIYSRSGGFMGISFAIPIDTAMNVADQLKAKGKVTRSRIGVVVQELSKELAASFGLAKPSGVLINALDPKGPAQKAGLKAGDIVLRINGQAVENGGDMQRLISDLPPGKAITLDVWRSRAQTSVRVVPDELVEEDARVAKREYRKPGAEAEQNLAQIGLRLQELSPVQLQRAGIDYGLLVRGANGAAMRAGIQPGDIIVGIGSDPLKNFAQLKNALNQAKKGGAVALQVMRQGVTMFVPLTVDEAK

SEQ ID NO: 28891 - DNA, 1158 bp, Prochlorococcus marinus
  CDS (1)..(1158)
atgatctctttcagattgttgctgcaacagggttgcattgttttgaagcgcttttggggattgtttttgatgtccgtgctgttccctcttgctgcagggggtcagcctgtttgggctttgtctggtttagatggcacgactagccataacttcgttgctgatgcggtaagtcaggtggcgcctgcagtggttcgcattgataccgaacgcactgtgcaacgtcagccttttgatcccaccttgattgatcccttgctcagagatctcttgggcgagccaggaattgggccagagcgtgagcgcggtcagggttcgggtgtcgtgatcgatgaccaggggttggtgctgaccaatgcccacgtggttgaacgggtggatgcggtcagcgtcacccttgccgatggagatcaacacgatggttcggttgtcgggacggatcctgttactgatcttgctcttgtgagactggatgggggcacacgtcctgaggccgcccctctcggagattctgatgcccttgaggtaggcgattgggcgatcgctcttggtaccccctatggccttgaacgcaccgtcacccttggcattgttagcagcctgcatcgcaatatcagcagccttggcttctctgataaacgtttggatttgattcagaccgatgccgcgattaaccctggcaattccggtggtccactcgtgaatggtcgtggtgaggtgatcggtatcaacacactggttcgttctggtccaggcgctggtttgggatttgctatcccgatcaatttggctcggcatgtttctgagcagcttttgaccagtggggaggtggttcatccttatttgggtgtccaattggtgccgctgacagctcgtattgccagggagcacaatcgtgatccgaattcgctggtggaattacccgaacgctttggggcgcttgtgcagagtgttttgccggatagcccggcggaacgcgctggtttgcggcgtggtgatcttgtgattgcggcagctgaaacatcagtctctgatccacaaactctgcttaaacaggttgatcaggctgagatcggtgtccccttgtcattaaggatcatgcgcaatggtcaagagatgagcctttcggttaatccagccgcattacctggccttagttga

SEQ ID NO: 28892 - protein, 385 aa, Prochlorococcus marinus
MISFRLLLQQGCIVLKRFWGLFLMSVLFPLAAGGQPVWALSGLDGTTSHNFVADAVSQVAPAVVRIDTERTVQRQPFDPTLIDPLLRDLLGEPGIGPERERGQGSGVVIDDQGLVLTNAHVVERVDAVSVTLADGDQHDGSVVGTDPVTDLALVRLDGGTRPEAAPLGDSDALEVGDWAIALGTPYGLERTVTLGIVSSLHRNISSLGFSDKRLDLIQTDAAINPGNSGGPLVNGRGEVIGINTLVRSGPGAGLGFAIPINLARHVSEQLLTSGEVVHPYLGVQLVPLTARIAREHNRDPNSLVELPERFGALVQSVLPDSPAERAGLRRGDLVIAAAETSVSDPQTLLKQVDQAEIGVPLSLRIMRNGQEMSLSVNPAALPGLS

SEQ ID NO: 28893 - DNA, 1125 bp, Synechococcus sp
  CDS (1)..(1125)
atgacatccgtgacgtcgattccccctgccaagaccatgtccgcctttgcctcgttgctgctcgggggagctgttcttggtgctgtgactgttcagggatggctgcctttggcatcacgcgcccagtccatatccgccccttcaggcttgtcccgccagtccttcgttgcggcggctgtggagcgcagcggtccggcggtggtcacgctggaaacggctcgaacggttaccagttcaggcatgacgggcctgccgaagggactgctgatggatccactcttccgccatttctttggtgtgcctggggcttcagccccacgttccagggtgcaacgcggtcaggggagcggtgtgatcttcgatgccgaggggctgctgctcaccaatgcccacgtcgtggagggggctgacacgcttcaggtggagctcaccgacgggcggagcgttgaagccaaggtgatcggaaaggacagtctcacggacctggccgtggtgcggctggagggcaaggggccttggcctatcgccgccctgggggattccgatcgattgaaggtcggagactgggcgattgccgttggcaatccctacggattggaaaacactgtgaccatgggcatcatcagcaatctcaaccggaatgtggcccagctggggatttccggaaagcgcttggatctgatccagaccgatgccgcgatcaaccccggcaactccggcggtccgctgctcaatgcggagggtgaggtgatcggcatcaacaccctggtccgctcggggcccggggctggcctcggctttgccattccgatcaaccgggcccgcagcatcgcccagcaactggtcaacaaggggcgagccagtcatcccgtgatcggcgttggcttggcagctggccctctgggcccggtgatccgttccgttcagcccggtgctcccgcggccggcgctggcctgaagccgggtgacgtgatcactgccatcaatggtgtggccacagccagccccacccaggtggtggccaccgtcgaacgcaatggtgttggacggcagctgaccctgtcgatcaagcggggcgagacaacgctcacggtgtcgctgacgcccatggatctcgccgcttaa

SEQ ID NO: 28894 - protein, 374 aa, Synechococcus sp
MTSVTSIPPAKTMSAFASLLLGGAVLGAVTVQGWLPLASRAQSISAPSGLSRQSFVAAAVERSGPAVVTLETARTVTSSGMTGLPKGLLMDPLFRHFFGVPGASAPRSRVQRGQGSGVIFDAEGLLLTNAHVVEGADTLQVELTDGRSVEAKVIGKDSLTDLAVVRLEGKGPWPIAALGDSDRLKVGDWAIAVGNPYGLENTVTMGIISNLNRNVAQLGISGKRLDLIQTDAAINPGNSGGPLLNAEGEVIGINTLVRSGPGAGLGFAIPINRARSIAQQLVNKGRASHPVIGVGLAAGPLGPVIRSVQPGAPAAGAGLKPGDVITAINGVATASPTQVVATVERNGVGRQLTLSIKRGETTLTVSLTPMDLAA

SEQ ID NO: 28895 - DNA, 1299 bp, Synechococcus sp
  CDS (1)..(1299)
atgtcttggatgattcgggttgtccggtgcaggctgaaaggagggctagagctcttaaagcacagacggcgccaacgcgcatggaaacaatgccactggattttcttagcgaccaaacgcaagctgcactgttttttgaataactgccgtccgatccggaccatcgctcgattcctttacaacggggtaacgaatgacgtgccgctgatgttgaaacgatggtgccgagtgctgtgcatcgggttgatgctgttgatcggcgttcaaccggctgtggcagtggagcacagctttgtggccgatgccgttaaaaaagttgccccagctgtcgtgcggatcgacaccgaacgcacagtggagcggcaaccttttgatccgaccctgatcgacccgttgctgcgcgatctgctcggcgatcagccggttggtcaggagcgcgagcgagggcagggttccggcgtggtgatcgatcccgatggcctggtgctgaccaatgcccacgtggtggatcgggtggaaaccgtgagcgtcacgctggcggatggtgaccagctggatgggcgtgtggtgggcacggatcctgtgaccgacctcgccctggttcgcctcgacacaagcgctctgccaccgcaggcgcccctcggagactccgaagcgatgcaggtgggcgactgggccattgccctcggcactccctacggcctggaacgcacagtgaccttgggcatcgtcagcagcctgcaccgcaatatcaacagtctcggcttctccgacaaacggcttgatctgatccagacagatgccgctattaacccaggcaattccggcggaccgttggtgaatggtgacggcgaggtgatcggtatcaacacactggtgcgctcaggccccggcgctggtctcggctttgcgatcccgatcaacctggcgcgtcgggtcgctgatcagctgcttcaggatggtgaggtggtgcatccctacatcggactgcagctggtgggactgaccgctcgcattgcccgtgagcacaaccgcgatcccaacgccctggttcaacttcccgaacgcaatggtgcccttgttcagagcgtcctgccggacggaccctccgacaaagcgggcctgcgtcgcggtgatctggtgattgctgttgatgaactgcccgtcgaggatcctcaggccttgctggaggtcatcgatgcggcccgggttggcagccccctccccttgaaactgctgcgcaatggccgcgagatcagtctgtcagtgaagccggcccccttaccgggtctggcctga

SEQ ID NO: 28896 - protein, 432 aa, Synechococcus sp
MSWMIRVVRCRLKGGLELLKHRRRQRAWKQCHWIFLATKRKLHCFLNNCRPIRTIARFLYNGVTNDVPLMLKRWCRVLCIGLMLLIGVQPAVAVEHSFVADAVKKVAPAVVRIDTERTVERQPFDPTLIDPLLRDLLGDQPVGQERERGQGSGVVIDPDGLVLTNAHVVDRVETVSVTLADGDQLDGRVVGTDPVTDLALVRLDTSALPPQAPLGDSEAMQVGDWAIALGTPYGLERTVTLGIVSSLHRNINSLGFSDKRLDLIQTDAAINPGNSGGPLVNGDGEVIGINTLVRSGPGAGLGFAIPINLARRVADQLLQDGEVVHPYIGLQLVGLTARIAREHNRDPNALVQLPERNGALVQSVLPDGPSDKAGLRRGDLVIAVDELPVEDPQALLEVIDAARVGSPLPLKLLRNGREISLSVKPAPLPGLA

SEQ ID NO: 28897 - DNA, 1527 bp, Rhodopirellula baltica
  CDS (1)..(1527)
atgcgtgagtgcggggattgcatgcgttggtttctaaaacattcgcctacacgtcacggcgtgtcggcgcatcgttccccatccatgggtgtgttgctgtcgatggggttgctggcgggattgaccgttggtaccggcggtgatgaatcggtgcgagccgatgatttgcaaagcgtaacggcgaccagcttccgcagcagcgaagccagtgtgcgtgacacacgatcgaccggtcggtcatcgcgttcgttgcgtgaaacgcctacggtgaccgcgattcgtcgtgcatcaccatcggtggtgaacttgcacggtcaaaagacgatccgaacgaccgcagccagcatggcgggcggggcaccggattcgttccgtcaagtcaatggcatgggcacgggggttgtcatcgatcctcgcggctatgtgatcacgaactatcacgtggtcgaagatgtcagcgaactcaacgtgacgttgcacaacggcgaagccacccgggcggacttgatcgcatcggatccgcaaagcgatttagcgttggtgaaactgcgtggccaaggcccgttcccgaccattcctcgcggacacagcgacgatttgatgatcggtgaaacggtcatcgcaattgggaacgcgtttggttatgtgcacaccagcaccgaaggcatcatcagtgccctgcaccgtgatgtgccggtcaatgagacacaacagtatcgcgatctgattcaaaccagtgctggcatcaatcccgggaactccggcggcccgttgttgaacatcgacggcgaaatgattggcgtcaacgttgccgttcgtgttggtgcccagcagatcgcatttgcgattccaatcgatcaagttctcgaaaccgtcaccgagatgatcaaccgtcacaacaaccgccgaatggtgattgggatggacggatccgccgtttctcgcggtggcgtgcaagtgacccgtttgtccgaaggcgggtcggctcaccaagccggtttgcagacgggcgatcgcttggtgcgaatcaatcaacaaaacattgctgatccactgaactacgaattgtccgtgttggaactcggcccgggcgatccgatgcaagtggaatttgaacgcgacggtgagttctttcaaactcaattggcgaccgcggtgacgtcgcaagagttcggtgacccggccgcggcacttgcttggcaagtcgtgggtgtgtcggtgcgaccggcgggcgagtcgtttgttcgccgcatgaattctcgactgcgaaccaactaccgcggcggtttgattgtcaccgatgtccgtgccggttccgctgccagcgaacaaggcatcacggctggcgatgttctgctgggtatccatgtttggcaaaccgccggactggaagatttggccgagatcctcgaccaacccaacattcgacgcggttccaaggccaagttctacctcgttcggaaggaccagactctatatggccatcttcaattagcttctcaaggaaaccaactgacgcgacgctag

SEQ ID NO: 28898 - protein, 508 aa, Rhodopirellula baltica
MRECGDCMRWFLKHSPTRHGVSAHRSPSMGVLLSMGLLAGLTVGTGGDESVRADDLQSVTATSFRSSEASVRDTRSTGRSSRSLRETPTVTAIRRASPSVVNLHGQKTIRTTAASMAGGAPDSFRQVNGMGTGVVIDPRGYVITNYHVVEDVSELNVTLHNGEATRADLIASDPQSDLALVKLRGQGPFPTIPRGHSDDLMIGETVIAIGNAFGYVHTSTEGIISALHRDVPVNETQQYRDLIQTSAGINPGNSGGPLLNIDGEMIGVNVAVRVGAQQIAFAIPIDQVLETVTEMINRHNNRRMVIGMDGSAVSRGGVQVTRLSEGGSAHQAGLQTGDRLVRINQQNIADPLNYELSVLELGPGDPMQVEFERDGEFFQTQLATAVTSQEFGDPAAALAWQVVGVSVRPAGESFVRRMNSRLRTNYRGGLIVTDVRAGSAASEQGITAGDVLLGIHVWQTAGLEDLAEILDQPNIRRGSKAKFYLVRKDQTLYGHLQLASQGNQLTRR

SEQ ID NO: 28899 - DNA, 1530 bp, Rhodopirellula baltica
  CDS (1)..(1530)
atgcgtcttccttttggaaatgtggccatgcgaaccgacaaaccctccgacgaaccgatgtcgctcgatgggatcactcccatccccgtgccctcggttttttcatctgacaaagacgccgaggccgccatgctgaatgcggccaaagatggaatgggtacggagtggttcggatccgcggaagacggtgattcggaaaaccgtgacacgcaggaccatgaggctctgaattcgagtcgatcggactcggccagtcgtgaattgctgtcggcgaatttgcgtcaggatgaaaaaccagaaggaccaccgccaccgatctccaagccacctgtttcggaccggtgctcggattcggatcgcaaccagaatgctgggcagcctcacccgatcctgcaaagcctgacgttgctggccacgatggcgttgatgttgttgctggctcgttacagcgttccacacattgtcgaagagattcgctacgcctggcaccgcggtgaaatgcgagcggaaaacgaaaccggcgtcgaaggtcttcgcaatgtttcgttggattcgctcagccgagcttacgaaatggtcacgtccgcggtcggacccaccgtggtccacatcgatgtggaacgttcggtttcagaagaagatcgcaatctgcaacgtttgctcggcgaagatagctacacgttgtcggatcaaggcagcggtgtggtgatcgacaaagacggctacatcctgaccaaccggcacgtgattgccgatggtatcgcgatcagcgtgacgctcagtgatggtcgtcggctgcccgccgctttggtcggcagcgatatgcccaccgatttggctgttttgaaagtggacgcggacggattgatcccaattgcgtggggggacagcgatgctttgcgtgtcggttcacccgtgtgggccgtcggcagtccgtttggtctggatcgtacgatcacgtttggaattttgagtggcaagcaccgtgtcgtgcgggctggtgttcagcatggttccagtgctcgatatcaagacttcatgcaaagtgatgtggccgtcaatccgggcaacagtggcggaccgctcgtcgacgcccgcggacgcttgatcggtatcaacaccgcgatcgtgggtgacacgtatcaaggcgtcagcttttcgatccccagcaacgtgactcgccagatctacgaccgcattcgtgagacgggcaaggtcgaacgaggatggttgggagtgctgttgtcggaagttcctgattctatgcaccgtggcgatgacctgcgtgtccgaggcgcgttgatctccggagtgacgggggaagattctcctgccgccattgctggattggaaatcggcgacatccttttgaaaatcgatggcgttcgagtcagcgacgttggtcacctgatgcgtctgatcgcgaatctcgggcagggaacgttgttgaacgttgagctgacccgtgatggcgaaccgatgaccgtcgaggtgaggctgaagaaacgacccgataatctggatcgctaa

SEQ ID NO: 28900 - protein, 509 aa, Rhodopirellula baltica
MRLPFGNVAMRTDKPSDEPMSLDGITPIPVPSVFSSDKDAEAAMLNAAKDGMGTEWFGSAEDGDSENRDTQDHEALNSSRSDSASRELLSANLRQDEKPEGPPPPISKPPVSDRCSDSDRNQNAGQPHPILQSLTLLATMALMLLLARYSVPHIVEEIRYAWHRGEMRAENETGVEGLRNVSLDSLSRAYEMVTSAVGPTVVHIDVERSVSEEDRNLQRLLGEDSYTLSDQGSGVVIDKDGYILTNRHVIADGIAISVTLSDGRRLPAALVGSDMPTDLAVLKVDADGLIPIAWGDSDALRVGSPVWAVGSPFGLDRTITFGILSGKHRVVRAGVQHGSSARYQDFMQSDVAVNPGNSGGPLVDARGRLIGINTAIVGDTYQGVSFSIPSNVTRQIYDRIRETGKVERGWLGVLLSEVPDSMHRGDDLRVRGALISGVTGEDSPAAIAGLEIGDILLKIDGVRVSDVGHLMRLIANLGQGTLLNVELTRDGEPMTVEVRLKKRPDNLDR

SEQ ID NO: 28901 - DNA, 1890 bp, Rhodopirellula baltica
  CDS (1)..(1890)
atgacattggtgctctcgttgtctgcacagcagctaactggtccgccgccgagcgctccgcgtggacgactggtacgtggacgactcgtttcatcagtgatccagtcccagcacatctcggaccagatcagatcactggactggcggcgtgcggaagctggattgctggcgtgggaaacgttttcgacaacttgtctccggttcaaagtgaaccaaatgggcaccggtcgcagtagtactgcttctcgaaaactcatgggtgcgtccgcgattcggaggcgtgcaactcatggcaattgtttggacgaggtcgcgaaacattgcgttgacttcgccacggtacgagcgaaatatcactcacccgcccatccccctttggagaacactctcacgatgcgtaatcaatggaaaccaatcagttttgctttgggaagtttgtgggtcgccacgctgaccgccgccgtggtggttagcctgccggatgggttgcgatcagacgcgatggcagatcaaacgacccagcgagccggtgcgatcgatccgggccaaggattgaacacggctcaagacttgtctgcgtcgtttcgaacggtcgccgaagcgatgcgacccagcgttgtcagcgtcagttcaaagaccagcgcgaaggccgttgcaagtcggttgccgccaggactgcgaagccagttgccgccaggatttgagaagtactttgaggatccgtctcagggtggccgtcaaatgcctgaacgagaaggccaaggcagcggcgtgatcgtacgagaagacggttacattctgaccaacaaccatgtggtcgaagacgctgacgaagtttacgtcgaactgagcgatgatcggcggttggaagcggaagtggttggaaccgatcctgaaaccgatttggccgttttgaagatcgaagctgacaacctgcgagcgatcgcgtttggcgattccgatgccattcaggtcggcgattgggtgctggcgattggcagtcccttcggtttggatcaaaccgtcaccgcgggcatcatcagtggaaagaatcggaaccgccgcattgttaacaacggcaacgggttcgaagacttcttgcagactgatgcggcgatcaatccgggcaactccggcggcccgttggtcaatttgcgaggtgaattggtcgggatcaacaccgcgattctgtcacgaagtggtgcgagtgccgggattggattcgcgattccggtctcgttggctcgtcccgttctgacatcgatcatcgagtatggccaagtgcgtcgtggtttcttgggtgcccaagttcgtgacgtgacacctgagttggtcgccgagatgggtttgaaggttgacgacggtgctttgattcaaggtgtgttggacaagcagcccgctgccaacgccaatctgcaaccaggtgacgtcgttgtcagtgttgatggaaagaaagtccgcagcagttcgcaattggtcaactacatcgccagtcgtccgcctggggcgagcgttgcgatggtgatcaaccgcgatggcgaaacgttgaccaagaccgtcaacttgcaggaacgaaccagcgaagcgatggcgatgttcaacggtggtagcgtcttgggcgcaaagcttgaacccatcacgcccgagtccgcacaacgctacggatactcagggatggattcgggcctgatcgttctcagtgtggaggacggaggcattgcggatgagtcgggattgatggcgggcgatgtgatcgagagtgccggtggcaacgcggtcagctccgtcacggctttgcaagcgatcatcacagaagcgaaacggcagggcattcctttgcgattgatcattcgccgtgggaacacacgcatgattgtgccgctgcagtga

SEQ ID NO: 28902 - protein, 629 aa, Rhodopirellula baltica
MTLVLSLSAQQLTGPPPSAPRGRLVRGRLVSSVIQSQHISDQIRSLDWRRAEAGLLAWETFSTTCLRFKVNQMGTGRSSTASRKLMGASAIRRRATHGNCLDEVAKHCVDFATVRAKYHSPAHPPLENTLTMRNQWKPISFALGSLWVATLTAAVVVSLPDGLRSDAMADQTTQRAGAIDPGQGLNTAQDLSASFRTVAEAMRPSVVSVSSKTSAKAVASRLPPGLRSQLPPGFEKYFEDPSQGGRQMPEREGQGSGVIVREDGYILTNNHVVEDADEVYVELSDDRRLEAEVVGTDPETDLAVLKIEADNLRAIAFGDSDAIQVGDWVLAIGSPFGLDQTVTAGIISGKNRNRRIVNNGNGFEDFLQTDAAINPGNSGGPLVNLRGELVGINTAILSRSGASAGIGFAIPVSLARPVLTSIIEYGQVRRGFLGAQVRDVTPELVAEMGLKVDDGALIQGVLDKQPAANANLQPGDVVVSVDGKKVRSSSQLVNYIASRPPGASVAMVINRDGETLTKTVNLQERTSEAMAMFNGGSVLGAKLEPITPESAQRYGYSGMDSGLIVLSVEDGGIADESGLMAGDVIESAGGNAVSSVTALQAIITEAKRQGIPLRLIIRRGNTRMIVPLQ

SEQ ID NO: 28903 - DNA, 1188 bp, Prochlorococcus marinus
  CDS (1)..(1188)
atgtctgcgttagttgaggaatcctccgcagagctgcggttatccagccaatcttctggtttgagcagggttttccgtggtggtcttctgcttggcactggattggtttgtctgcctgtgttgtcgggtctttcccctcaaccgctgcaggcggcatcagccgcgacagccttatccaagcagtcgtttgtagcggatgccgtggctcgcagcggccctgctgtggtgactcttgagacgagtcggacggtccgttctatgggcatggctggtctgcctcaggggctattagccgacccgctgttccaacatttctttggtttgcctggcagagtcgctccccgctcgcggatagaacgagggcagggaagtggtgtgattttttcggcggaaggattggttctcaccaatgctcatgtcgtggagaagaccgatcagctgatggtgggattgccagatggtcgaagggtgcctgggcgactggttggtcaggacaagattacggatctggctgtagtgcagttggatggctcggggccttggcccacagccccattgggagactcggaccagcttcgggtcggggattgggccatagctgttggcaacccctttggccttgaaaatacggtgacgttgggaatcgtcagcaacctcaaccgcaacgtctctcagctagggatctctggcaagcggttggatttaattcagaccgatgctgctatcaatccaggtaactcaggaggaccgctgttgaattctgagggcaatgtggtgggtatcaatacactcgttcgctctggaccaggagctgggctgggttttgctattcctattaatcgggctaggaccatcgcccagcagctggtggagcgaggacgggccagtcatccgatggtgggtgtaggtctctcgccggtgccatctgctcgttctggggaagccaactctcctggtgctgtgattcgttccgtggtgccggatgggcctgcagcgcgtgccgggttgaaggttgatgatgtgatcatttcggtggaagggttaccgattgatgggcctgctgaggtcgtgagcgcgattgatcgtcatggagttgggcgaccaatcacttttggattaatccggggcgacagtcggattgagttggcggttacaccagtggagctgacggcgatgcaggcgccttga

SEQ ID NO: 28904 - protein, 395 aa, Prochlorococcus marinus
MSALVEESSAELRLSSQSSGLSRVFRGGLLLGTGLVCLPVLSGLSPQPLQAASAATALSKQSFVADAVARSGPAVVTLETSRTVRSMGMAGLPQGLLADPLFQHFFGLPGRVAPRSRIERGQGSGVIFSAEGLVLTNAHVVEKTDQLMVGLPDGRRVPGRLVGQDKITDLAVVQLDGSGPWPTAPLGDSDQLRVGDWAIAVGNPFGLENTVTLGIVSNLNRNVSQLGISGKRLDLIQTDAAINPGNSGGPLLNSEGNVVGINTLVRSGPGAGLGFAIPINRARTIAQQLVERGRASHPMVGVGLSPVPSARSGEANSPGAVIRSVVPDGPAARAGLKVDDVIISVEGLPIDGPAEVVSAIDRHGVGRPITFGLIRGDSRIELAVTPVELTAMQAP

SEQ ID NO: 28905 - DNA, 1176 bp, Prochlorococcus marinus
  CDS (1)..(1176)
atgaatacaaaaaataaaatgaccattaaattaacctcaaaaactatttctgagttgatgaagaaatacaaacctatatatggttatgccttaagtctattaattctagggacaaatacctcagcaagaacagcatttatagttcctttaactagtcaaattgaacgcaaacaatttcaactaattgcaaacaaatcgtttgtatctgaagcattaaaaaaaagtggccctgctgtagttactatagaaactcaacggaaagtatttactaataacagaaatatattccctccaaatttattgattgacccaaattttgaaagattctttgctaatccaaatcgacaatatcaaagaccaagaattgaacgagggcaaggaagtggcgttatttttgcttcggaaggacttgttcttactaatgcacatgtagtagaaaacagcgaagagcttatggtcgggctctctgatggaagaagaattccaggtcgggtagtgggacaagactacctgacggatctagcggtggtaagacttaaaggcttaggaccttggccaaaggcttatttaggtaattctgaggaaattgaagttggcgattgggcaatagcagttgggaacccgtatggattagaaaaaacagtaaccttaggtattattagcaatctaaatcgcaatgtatctcaactaggtatatctgataagcgattaaatttaattcaaactgatgctgcaattaatcctggtaattctggcggcccattacttaattctcaaggtgaagtaattggaatcaatacactggttcgttctggtcctggagcaggtttaggatttgctattccaatcaataaagcaatagaaattgcaaatcaattagcatcacgaggtagagctattcatccaatgataggagttaatttatctcctacaaatggaaaaggagctttaattatatatgttttaccaggtggacctgcagaaaaaaggggtctaaaagtaaatgatgttatcatttccatcaacaacaaagatgttaaaaaccctcaagatgtcgttaatactataaatagtaatggaataagtaagaaaatgaaatttttaattttaagaaataatattacaatcaaaattgatattaagcctatagatataagagggttcagaagtctatag

SEQ ID NO: 28906 - protein, 391 aa, Prochlorococcus marinus
MNTKNKMTIKLTSKTISELMKKYKPIYGYALSLLILGTNTSARTAFIVPLTSQIERKQFQLIANKSFVSEALKKSGPAVVTIETQRKVFTNNRNIFPPNLLIDPNFERFFANPNRQYQRPRIERGQGSGVIFASEGLVLTNAHVVENSEELMVGLSDGRRIPGRVVGQDYLTDLAVVRLKGLGPWPKAYLGNSEEIEVGDWAIAVGNPYGLEKTVTLGIISNLNRNVSQLGISDKRLNLIQTDAAINPGNSGGPLLNSQGEVIGINTLVRSGPGAGLGFAIPINKAIEIANQLASRGRAIHPMIGVNLSPTNGKGALIIYVLPGGPAEKRGLKVNDVIISINNKDVKNPQDVVNTINSNGISKKMKFLILRNNITIKIDIKPIDIRGFRSL

SEQ ID NO: 28907 - DNA, 1434 bp, Helicobacter hepaticus
  CDS (1)..(1434)
atgaagtatgcaagtatatatttctttgtcagtgcgctatttatgactcatattttagctattgaatttcaagaagcgcccacaatccaaaaacgtgttaatcctcaacaaaatagcgatacactctactcttttaactcctccatagaaagtgcaaaaaaagctgttgtaaatatttctacacaaaaaaatgtcagcaatcaacttcctaatcatccgatgtttaatgacccattttttaagcaattttttggtgatatttatggacagattcccaaagaacgtgtagaacgtagtttgggaagtggcgtaattatttcaaatgatggatacattattacaaacaatcacgtgattgaagacgccgacaaagtgcttgtttcactttctgatagcacaaaagaatacactgctaaagtcattggcacagatgcacgaagcgatttggcggtgattaaaattgaacaaaaaaacctatctcctatcacttttgcccaaagtagcaatgttcttataggcgatgtagtgtttgctattgggaatccttttggcgtaggtgaaacaattacacaaggtattgtctctgcactcaataaaagtggtattggcatcaatgattatgaaaattttatccaaactgatgcctcaatcaatccgggtaattcaggtggagcattagtggattctcggggagcgctcattgggattaatacggctatcctctcgcgcacaggaggtaatcacggtgtaggttttgcaataccttcagatatggcaaaaaaaatcgccaaagaactcattgaaaaaggtgggattaaacgtggattcttaggcgtaggaatccaagatattaataatgatattaaagaaagttatggagataatagtggtgcagtggttattagcctagagcctcagtctccagcagcaaaagcagggcttatggtgtgggatttaatcactcacgttaatggcaaaaaaatctcaaatgcagccgaacttaaaaatcttatcggtatgctctctcctaatgaaaaagttgttgtgaagtttatccgtgataaacaagagcgtgtaactcaaatcacacttggcgaattacccgatacaaaatcaaatcaaacttcttcacaaaatacgccaaatggttctgcctcaagtgtagaaggcttaagtgtagaatcgctcaatcaagctcaacgccaacgttatagagtgccaaataatattgatggcgtagtagttactcgagtcaatcctaattcaaaagctcaacaagcaggatttgaagtgggcgatattattgcacaagttgaaaatatagctattaaaaagccaacagacttaaccaatgcatttacacgctttaagggcaaaaacaagagaatcttagtttatagcgctaatggcacaaaaacaattatgatgaaataa

SEQ ID NO: 28908 - protein, 477 aa, Helicobacter hepaticus
MKYASIYFFVSALFMTHILAIEFQEAPTIQKRVNPQQNSDTLYSFNSSIESAKKAVVNISTQKNVSNQLPNHPMFNDPFFKQFFGDIYGQIPKERVERSLGSGVIISNDGYIITNNHVIEDADKVLVSLSDSTKEYTAKVIGTDARSDLAVIKIEQKNLSPITFAQSSNVLIGDVVFAIGNPFGVGETITQGIVSALNKSGIGINDYENFIQTDASINPGNSGGALVDSRGALIGINTAILSRTGGNHGVGFAIPSDMAKKIAKELIEKGGIKRGFLGVGIQDINNDIKESYGDNSGAVVISLEPQSPAAKAGLMVWDLITHVNGKKISNAAELKNLIGMLSPNEKVVVKFIRDKQERVTQITLGELPDTKSNQTSSQNTPNGSASSVEGLSVESLNQAQRQRYRVPNNIDGVVVTRVNPNSKAQQAGFEVGDIIAQVENIAIKKPTDLTNAFTRFKGKNKRILVYSANGTKTIMMK

SEQ ID NO: 28909 - DNA, 1419 bp, Haemophilus ducreyi
  CDS (1)..(1419)
atgaaaaaatcaattttatcttcattagtcttaggtttaagtgtactttcagtacctgctatgagccaagcggtattaccaacaatattaggcggtcaagcattaccaagtttagcatctatgattgaaaaggttcgcccggcagtagtcagtattgctattgaaggtaaaactaaagttgaaaatgcacaatataaacgtgaacttccggaagaacttcaatttttctttggcccagatatttttggtgagcgttttgctgaacgctttggctttggttttggtgaacaacgtaatgtgccacgtaatttccgaggtcaaggatcaggcgcaattattaatgctgaaaaaggctatgtgattactaataatcacgttattaaagatgcagaaaagatcaccattaaattagaagatgggcgagagtttaaagcgaaattaatcggttcagatgcgttatcggatgttgcgctagtgcaaattgagaatcctaaaaatttaacggaacttaaatttgcggattctgataaattacgtgtaggtgattatagtgttgcaattggtaatccttttggtttagggcaaacggtgacatctggtattatttccgcattaggccgttcgaccggcaattctgatgaaagttatgaaaatttcattcaaacagatgctgcggttaaccaaggtaattcaggtggtccattacttgatctaaatggtgaattaatcggtattaatacggctattatttcaccaagtggtggtaatgcagggatcgcttttgctattccatcaaatatggcaaatagtttagtacaacaaattattgaacatggcgaagtgcaacgtggtatgttgggcattaaaggcggtgagttaaattctgatttagccaaagaatttaaaattgatgctcaacaaggtgcctttgtgagtgaagtgttaactgattctgcggcagcaaaagcgggcttaaaagcaggtgatgtgattatcggcttgaatggtaaacgtattaatggctttggtgaattacgcgcaaaagttgctacttcaggtgtaggcaaagagattgaattgacttacttacgcgatggtaaagaacaaaaagccaaagtaatgttagaagcagacaacagtggtaaaaatggcaaaaataaagatttaattgccggtttaaaaggtgctgagtttgctaatatcaataaaaatggcgtcaaaggtgttgaaatcgtcaaaattcaaaaaggatcaatggcagaataccgtggcttggcagaaggtgacgtgattgttggcgttaaccgagtattgattgaaaacattaaacaattgcgtgaagtgttggataagaaacctgcagttattgcattaaatattatgcgtggtggttctaatttctaccttatcatacaataa

SEQ ID NO: 28910 - protein, 472 aa, Haemophilus ducreyi
MKKSILSSLVLGLSVLSVPAMSQAVLPTILGGQALPSLASMIEKVRPAVVSIAIEGKTKVENAQYKRELPEELQFFFGPDIFGERFAERFGFGFGEQRNVPRNFRGQGSGAIINAEKGYVITNNHVIKDAEKITIKLEDGREFKAKLIGSDALSDVALVQIENPKNLTELKFADSDKLRVGDYSVAIGNPFGLGQTVTSGIISALGRSTGNSDESYENFIQTDAAVNQGNSGGPLLDLNGELIGINTAIISPSGGNAGIAFAIPSNMANSLVQQIIEHGEVQRGMLGIKGGELNSDLAKEFKIDAQQGAFVSEVLTDSAAAKAGLKAGDVIIGLNGKRINGFGELRAKVATSGVGKEIELTYLRDGKEQKAKVMLEADNSGKNGKNKDLIAGLKGAEFANINKNGVKGVEIVKIQKGSMAEYRGLAEGDVIVGVNRVLIENIKQLREVLDKKPAVIALNIMRGGSNFYLIIQ

SEQ ID NO: 28911 - DNA, 1386 bp, Candidatus Blochmannia floridanus
  CDS (1)..(1386)
atgaaaatagtaaatccaattattacaatcagcataatatttgcattaatatgcataaataacctacaaacttctaataattattatactgcattaggatcagaaactccatatttatcaatgcctaccagtttagcgccaatgctagataacgttctaccaacagtagtgagtatacacgtagagggaacacaaccttccaaaagacttactttacctaaagaatttagatatttttttggaccagaccttcccaatggaaattttggcaatagaccatttgaaggtttaggatctggagttattatcaattccaataaaggatatattattaccaataatcatgttgttcatggggcagataaaatcaccatacaactaaatgatggtcgcgaatataatgctaaaattattggtcatgatgaacaaactgatttagctttacttcaaatattaaaatttaaaaatctttctgaaattaaaattgcagattccgataccttaaaagttggagattttgccgtcgctataggtaatccatttggattgggccaaactgcaacatcaggtatcatttcagctttaggaaggagcggattaaatcttgaaggattagaaaattttatacaaactgacgcatcaataaatcgaggtaattcagggggagcattagtcaatttaaatggagaactaatcggaataaatactgccattttagctccaggaggaggtaatattggaattgggtttgccattcctagcaatatcgttaaaaatctaagtcaacaattaatcgattttggtgaagtaaaaagaggacaattaggtataaaaggtacagaattaactgctgatattgccaaagcatttaacattgatatacaacgaggtgcatttgtcagtgaagttttaccaggatctgcagctgcaaaagctcgaattaaagctggagatgttattatatctgtagaaggaaaaccaataaaaaactttgctgaattacgagtaaaagttggcaccactgccccaggtaaaatcatcaagataggtttattaagagatggaaaaacacatatagtttccgttctactagatgatagcacttgtgttagtaccagcgaagaaaatttaatcccggcactacaaggtgcaacattaagtaacaattatctaaaagatggcacaccaggagtacaagtagaagaaataaacaaagattctcctgctgcttctataggattacaaaaaggagatatgatcataggtttaaaccgtaccagaataagtaacctatcgcaactacgaaaaatactcaaagaaaatccaacagttatggctctcaatattatacgaggaggtactaatatttttatattgctacgttaa

SEQ ID NO: 28912 - protein, 461 aa, Candidatus Blochmannia floridanus
MKIVNPIITISIIFALICINNLQTSNNYYTALGSETPYLSMPTSLAPMLDNVLPTVVSIHVEGTQPSKRLTLPKEFRYFFGPDLPNGNFGNRPFEGLGSGVIINSNKGYIITNNHVVHGADKITIQLNDGREYNAKIIGHDEQTDLALLQILKFKNLSEIKIADSDTLKVGDFAVAIGNPFGLGQTATSGIISALGRSGLNLEGLENFIQTDASINRGNSGGALVNLNGELIGINTAILAPGGGNIGIGFAIPSNIVKNLSQQLIDFGEVKRGQLGIKGTELTADIAKAFNIDIQRGAFVSEVLPGSAAAKARIKAGDVIISVEGKPIKNFAELRVKVGTTAPGKIIKIGLLRDGKTHIVSVLLDDSTCVSTSEENLIPALQGATLSNNYLKDGTPGVQVEEINKDSPAASIGLQKGDMIIGLNRTRISNLSQLRKILKENPTVMALNIIRGGTNIFILLR

SEQ ID NO: 28913 - DNA, 1137 bp, Bordetella pertussis
  CDS (1)..(1137)
atgacagtcagtctggccattttattcgtcgtcatcaccctgcgccccgattggctgcggctgtcgggtccggcgccggccacgcgcgcgcccgcggcggccgcgtccggccaggcaggggcgtcgtatgccgacgcggtggcgcgcgccgcgccggcggtggtcaacgtatacaccaccaagcatgtcaacgtgccgctggtgccgctgcccgacgatcccgtgctgcgccagctgttcggccaggtgcccggcctgagccgccgcgaggcgtccaccagcctgggctcgggggtgatcgtcagcgccgagggctatgtgctaaccaactatcacgtcgtcgaagccgccgacgccatcgaggtggccctggccgacgggcgccaggcggcggccaaggtggtgggcgcggatccggagaccgacctggcggtgctcaagctggcgggcaagctgggcgagctgccggtcgcgaccttcgccgacaagcgcgcgccgcgggtgggcgacgtggtgctggccatcggcaaccccttcggcgtgggccagaccactacgcagggcatcgtgtcggcgctggggcgcaatggcctgggtatcaatacctatgagaatttcatccagaccgacgcggcgatcaatcccggcaattcgggcggtgcgctgatcgacgcccatggcgacctggtcggcatcaatacggccatttactccgagaccggcggctcgctgggcataggcttcgccatcccggtcgacagcgcgcgccgcgtgatggaagacatcgtgcgcacgggcgccgtgcggcgtggctggttcggcatcgagccgcaggacatgacgcccgaactggcgcgggccttccagctgccgcgcgaggcgcgcggcgtgattatcgcgggcgtcatgcgcgacgggccggcgggcaaggccggcatgcgggtgggcgacatcgtgcaggcgctcaacggcgcgccggtgatcgacacgcgtggcctgctgggccagattgcgtcgctgcagcccggccagcaggcggtggccagcgtgctgcgcgccggcaagccggcggatcgactgttgcccgcatgcatgccgcttcgctgcccgccctggccagccatcaggcccggctag

SEQ ID NO: 28914 - protein, 378 aa, Bordetella pertussis
MTVSLAILFVVITLRPDWLRLSGPAPATRAPAAAASGQAGASYADAVARAAPAVVNVYTTKHVNVPLVPLPDDPVLRQLFGQVPGLSRREASTSLGSGVIVSAEGYVLTNYHVVEAADAIEVALADGRQAAAKVVGADPETDLAVLKLAGKLGELPVATFADKRAPRVGDVVLAIGNPFGVGQTTTQGIVSALGRNGLGINTYENFIQTDAAINPGNSGGALIDAHGDLVGINTAIYSETGGSLGIGFAIPVDSARRVMEDIVRTGAVRRGWFGIEPQDMTPELARAFQLPREARGVIIAGVMRDGPAGKAGMRVGDIVQALNGAPVIDTRGLLGQIASLQPGQQAVASVLRAGKPADRLLPACMPLRCPPWPAIRPG

SEQ ID NO: 28915 - DNA, 1116 bp, Bordetella parapertussis
  CDS (1)..(1116)
atgacagtcagtctggccattttattcgtcgtcaccaccctgcgccccgattggctgcggctgtcgggtccggcgccggccacgcgcgcgcccgcggcggccgcgtccggccaggcaggggcgtcgtatgccgacgcggtggcgcgcgccgcgccggcggtggtcaacgtatacaccaccaagcatgtcaacgtgccgctggtgccgctgcccgacgatcccgtgctgcgccagctgttcggccaggtgcccggcctgagccgccgcgaggcgtccaccagcctgggctcgggggtgatcgtcagcgccgagggctatgtgctgaccaactatcacgtcgtcgaagccgccgacgccatcgaggtggccctggccgacgggcgccaggcggcggccaaggtggtgggcgcggatccggagaccgacctggcggtgctcaagctggcgggcaagctgggcgagctgccggtcgcgacctttgccgacaagcgcgcgccgcgggtgggcgacgtggtgctggccatcggcaacccgttcggcgtgggccagaccactacgcagggcatcgtgtcggcgctggggcgcaatggcctgggtatcaatacctatgagaatttcatccagaccgacgcggcgatcaatcccggcaattcgggcggcgcgctgatcgacgcccatggcgacctggtcggcatcaatacggccatttactccgagaccggcggctcgctgggcataggcttcgccatcccggtcgacagcgcgcgccgcgtgatggaagacatcgtgcgcacgggcgccgtgcggcgcggctggttcggcatcgagccgcaggacatgacgcccgaactggcgcgggccttccagctgccgcgcgaggcgcgcggcgtgattatcgcgggcgtcatgcgcgacgggccggcgggcaaggccggcatgcgggtgggcgacatcgtgcaggcgctcaacggcgcgccggtgatcgacacgcgtggcctgctgggccagattgcgtcgctgcagcccggccagcaggcggtggccagcgtgctgcgcgccggcaagccggtggagctgaaggtgacggtaggcgtgcgtcccagccggccacgctga

SEQ ID NO: 28916 - protein, 371 aa, Bordetella parapertussis
MTVSLAILFVVTTLRPDWLRLSGPAPATRAPAAAASGQAGASYADAVARAAPAVVNVYTTKHVNVPLVPLPDDPVLRQLFGQVPGLSRREASTSLGSGVIVSAEGYVLTNYHVVEAADAIEVALADGRQAAAKVVGADPETDLAVLKLAGKLGELPVATFADKRAPRVGDVVLAIGNPFGVGQTTTQGIVSALGRNGLGINTYENFIQTDAAINPGNSGGALIDAHGDLVGINTAIYSETGGSLGIGFAIPVDSARRVMEDIVRTGAVRRGWFGIEPQDMTPELARAFQLPREARGVIIAGVMRDGPAGKAGMRVGDIVQALNGAPVIDTRGLLGQIASLQPGQQAVASVLRAGKPVELKVTVGVRPSRPR

SEQ ID NO: 28917 - DNA, 1488 bp, Bordetella parapertussis
  CDS (1)..(1488)
atgaaagcaattacagtgtcgaacctttttttccggcgcttcggcgcggccgcgctggtcgcgttcatggcagtaactgccgcgggcacgcaagtccaggcgcagacgcaggtcgccccccccgcggtggcgttacccgatttcaccgggatcgtcgagaaagtcgagcccgccgttgtcaacatccgtaccacggccaccgtgccggtgcgcggcggcccgggcggcggcaacgatccgtacgaattgttccgctggttcttcggccccgatttccagccgcccggcccggcgcccggccagcgtcgcaagcagccgcagccccagcctgaagagcgcaccattccgcgcggcgtggggtcgggcttcttcatctcggccgatggctacatcctgaccaacaaccacgtgatcagcgatgccaccgacatctacgtcaccctgaccgacgggcgcgagttcaaggccaaggtgatcggttcggacgaccgcaccgacgtggccctgatcaagatcgacgccaaggacatgacgccgctgaccatcggcgaccccaagacgctgaagaaggggcagtgggtgctggccatcggttcgccgttcggcctggactccaccgtcaccgcgggcatcgtcagcgccatcggccgcgataccggcgaatacctgcccttcatccagaccgacgtggccgtcaacccgggcaactcgggcgggccgctgctgaacctgcagggcgaggccgtgggcatcaactcgcagatcatttcgcgcagcggcggcttcatgggcatttcgctggccattcccatcgatgaggccatgcgcgtggtcgaccagttgcgtgccaccggcaaggtgacgcgcggccgtatcggcgtgcagatcggcgaggtcggcaaggacgtggccgacgccatcggcctgccgcgcgccgaaggcgcgctggtcagcagcgtcgaggccgaaggcccggccgagtcggccggcgtgcagcccggcgacgtgatcctgaagttcaacggcgagcccatcaagcgctggtccgatctgccgcgcatcgtgggcgagaccaagccgggcaccagcgccaagatggacgtctggcgcaagggccgcaacgtgaccctgtcggtcaaggtggccgagctgaagtccgatcgcagcgccgcgaccgcggacgagggcaagcaggccgagccgacggccgagaaccacctgggcctgggcgtcgtcgacgtgccgtccgatacgcagcgcaagctgcgcatcaagggcggggcgcaggtgcgcgtggccgagggcgcggccgcgcaggcaggcctgcaggaaggcgacatcgtgctggcggtcaacgacaccgacgtcacggacgcggcccagttcaacaagctggtgtcgcgcctggacaagaaaaaggccgccggcctgctggtacgccgcggcgaccagacccaatgggtcgcggtgcagcccgccagcaaatag

SEQ ID NO: 28918 - protein, 495 aa, Bordetella parapertussis
MKAITVSNLFFRRFGAAALVAFMAVTAAGTQVQAQTQVAPPAVALPDFTGIVEKVEPAVVNIRTTATVPVRGGPGGGNDPYELFRWFFGPDFQPPGPAPGQRRKQPQPQPEERTIPRGVGSGFFISADGYILTNNHVISDATDIYVTLTDGREFKAKVIGSDDRTDVALIKIDAKDMTPLTIGDPKTLKKGQWVLAIGSPFGLDSTVTAGIVSAIGRDTGEYLPFIQTDVAVNPGNSGGPLLNLQGEAVGINSQIISRSGGFMGISLAIPIDEAMRVVDQLRATGKVTRGRIGVQIGEVGKDVADAIGLPRAEGALVSSVEAEGPAESAGVQPGDVILKFNGEPIKRWSDLPRIVGETKPGTSAKMDVWRKGRNVTLSVKVAELKSDRSAATADEGKQAEPTAENHLGLGVVDVPSDTQRKLRIKGGAQVRVAEGAAAQAGLQEGDIVLAVNDTDVTDAAQFNKLVSRLDKKKAAGLLVRRGDQTQWVAVQPASK

SEQ ID NO: 28919 - DNA, 1467 bp, Chlamydophila caviae
  CDS (1)..(1467)
atgacgaagaagccattatatttattattagccacagcgatgtttttaagtgttcctacgctttctccttcaggatttgctgctgtgaaaaaagatgcacggatagcagaggtgcctcaagaggtgcttttaaaggagatttccggaggattttctaaggttgctgaactggcaaccccaggagttgtttatatcgagagctttcctaaatgtaatcgtccagtagctcctgctccaggacgtcgcggaccttatgataacccttttgactatttcaacgatgagttctttaatcgtttctttggtttgcctacgcaaaaagaacgtccggtctctaaagaagctgttcgtggtacagggttcatagtttcttcagatggttatgtagttaccaataatcatgtggttgaagacgcagggaaaattcatgttaccttacatgacggtcaaaaatatcctgctaaggttataggcttagatcctaaaacagatttagcagttattaaaattaatgctgataagctgcctcatcttacttttggaaattctgatcatttgaaagtaggggattgggccatagctattgggaatccttttggtttgcaagctacggttactgtaggggtaattagcgcaaaaggtagaaatcagctgcacattgcagattttgaagattttatacagacggatgctgctatcaatccaggaaactccggaggcccccttcttgacatcgatggaaaggttataggggtaaacactgctattgtcagtggtagcggaggctacattggtattggttttgctattcctagtttgatggctaagagaatcatcgatcagctaattagtgatggccaggtaattcgtggatttttaggagttactttacaacctatagatgctgagctagcagcctgttataaactagataaagtttacggagctttagttacagatgttgtcaagggatctccagcacataaagcaggattaaagcaagaagatgttatcattgcctacaacggtagggaagtagagtctctcagcggattccgtaatgcgatttctttaatgaatcctgatacgcgtgtattacttaaagtggttcgtgaaggtcaggttatagaaattcctgtcattgtttctcaggctcctcaagatgatggtgtctccgctttaaatcgtgtaggcatacgcgtgcaaaatcttaatccagaaactgctaagaaattaggcatggctcccgatagtaaaggggtgcttattgttgctgttgaagcaggttctgtagcaggatcttcgggagtcgccccaggacaacttatcttagctgtaaatagacagaaagtatctacagtagaagagctgaattctgttttaaaagatggaaataacgaaaatatcctccttatggtttcacaaggagaggtgattcgctttattgtattaaaaccagaagaataa

SEQ ID NO: 28920 - protein, 488 aa, Chlamydophila caviae
MTKKPLYLLLATAMFLSVPTLSPSGFAAVKKDARIAEVPQEVLLKEISGGFSKVAELATPGVVYIESFPKCNRPVAPAPGRRGPYDNPFDYFNDEFFNRFFGLPTQKERPVSKEAVRGTGFIVSSDGYVVTNNHVVEDAGKIHVTLHDGQKYPAKVIGLDPKTDLAVIKINADKLPHLTFGNSDHLKVGDWAIAIGNPFGLQATVTVGVISAKGRNQLHIADFEDFIQTDAAINPGNSGGPLLDIDGKVIGVNTAIVSGSGGYIGIGFAIPSLMAKRIIDQLISDGQVIRGFLGVTLQPIDAELAACYKLDKVYGALVTDVVKGSPAHKAGLKQEDVIIAYNGREVESLSGFRNAISLMNPDTRVLLKVVREGQVIEIPVIVSQAPQDDGVSALNRVGIRVQNLNPETAKKLGMAPDSKGVLIVAVEAGSVAGSSGVAPGQLILAVNRQKVSTVEELNSVLKDGNNENILLMVSQGEVIRFIVLKPEE

SEQ ID NO: 28921 - DNA, 1419 bp, Streptomyces avermitilis
  CDS (1)..(1419)
atgagcaccgagaacgagggcaccgcggtacccccggccccgtcagcacctcccgtgccggtggaaactcccgctcccgtgcagagcgccgcgcctgtcggtgccgctccgtcggcgagcgcccccggacagggtttcggtgagccgcccgcacatcagggcttcgcccagcacgctccgggcgccgccgaggcgggctggccgcctcccccgcccgcgacgcccgcgtacgccgacggtggcggcgcgggcgccgaatggggctcctcgtaccagcagcccgcgccgaagccgaaggccggccgcggcggactgctcgccgcgatcctcgtggccgcgctggtcgcgggcggagtcggcggcggcatcggctacacgctggccaaggacaacgacggatcgagcggctcgacgacggtctccgcctccgacagcggcggctccgtcaagcgggacgcgggcacggtcgcgggcgtggcagccaaggcgctgccgagcacggtcaccatcgaggcccagagcagcagcggagagggcggcaccggcaccggcttcgtcttcgacaagcagggccacatcgtcaccaacaaccacgtggtggcggaggcggtcgacggcggcaagctcaccgcgaccttccccgacggcaagaagtacaacgccgaggtggtcggtcacgcgcagggctacgacgtcgcggtcgtcaagctcaagaacgcgccgtcggacctgcagccgctgaccctgggcgactccgacaaggtggctgtcggcgactcgacgatcgcgatcggcgcgcccttcggcctttcgaacacggtgacgacgggcatcatcagcgccaagaaccggccggtggcctccagcgacggcagctccagcagcaaggcgtcgtacatgagcgcgctgcagacggacgcgtcgatcaacccgggcaactcgggcggtccgctgctggacgcgcagggctcggtcatcggcatcaactccgcgatccagtcctccagcagtggcggtctgggcagctcgggccagtccggttcgatcggcctgggcttcgcgatcccgatcaaccaggcgaagtacgtcgcccaggagctgatcaagacgggcaagccggtctacccggtgatcggcgcctcggtctccctcgaagagggcacgggcggcgcgaagatcactgagcagggtgccagcggctcggacgcgatcaccccgaacggccccgcggccaaggccggcctcaagccgggcgacgtcatcaccaagctcgacgacatggtgatcgacagtggcccgaccctgatcggcgagatctggacccaccgccccggcgccacggtgaagctcacgtacacccgggacggcaaggcccgcacgacggacgtcacgctgggagagcgcgtgggcgacagctga

SEQ ID NO: 28922 - protein, 472 aa, Streptomyces avermitilis
MSTENEGTAVPPAPSAPPVPVETPAPVQSAAPVGAAPSASAPGQGFGEPPAHQGFAQHAPGAAEAGWPPPPPATPAYADGGGAGAEWGSSYQQPAPKPKAGRGGLLAAILVAALVAGGVGGGIGYTLAKDNDGSSGSTTVSASDSGGSVKRDAGTVAGVAAKALPSTVTIEAQSSSGEGGTGTGFVFDKQGHIVTNNHVVAEAVDGGKLTATFPDGKKYNAEVVGHAQGYDVAVVKLKNAPSDLQPLTLGDSDKVAVGDSTIAIGAPFGLSNTVTTGIISAKNRPVASSDGSSSSKASYMSALQTDASINPGNSGGPLLDAQGSVIGINSAIQSSSSGGLGSSGQSGSIGLGFAIPINQAKYVAQELIKTGKPVYPVIGASVSLEEGTGGAKITEQGASGSDAITPNGPAAKAGLKPGDVITKLDDMVIDSGPTLIGEIWTHRPGATVKLTYTRDGKARTTDVTLGERVGDS

SEQ ID NO: 28923 - DNA, 1491 bp, Nitrosomonas europaea
  CDS (1)..(1491)
atggctgacataatctcccggaataatttccattcaggtataggatccaggtttttgataaatacggttacagttgcggatatatggcgcaagggtatttttgcgatttgtcttttggtagcagcgtttatgttgtctgcctcattgcatgcgaaggatttaccggattttactgacctggtggaaaagcatgggcaagcagttgtcaatattagtaccgtacaaacgcagcagatagatgcgaaccatttctttccgggaattcccaacatccccgaagattctcctttttacgagttttttcgccggcatatgcaacctttttccggcccgagaaaatatgaatcccgttcactgggctcaggtttcatcatcagtaaggatggttatattctgaccaatgcacatgtagtcgaatcagccaatgaaatcacggtcagactgaccgataagcgtgagtttggtgcgaaagtgatagggaccgatcgaaaaacggatatagctctgttaaaaattgatgcggatgatttgccggtagtcacccagggtagccctgatcagcttaaagttggcgaatgggtgatcgccattggtgccccttttggttttgagaatacagttacagcagggatcgtgagtgcgaaagggcgatcgcttgcccaggaaaattatgttccttttattcagactgacgtggcaatcaatccaggcaactctggtgggccactgttcaatatgaaaggagaagtcgtagggattaactcccagatttacagccgtacgggtggcttcatggggctttcttttgctattccgatcgatgtggcaatggaaattaccagtcagctcaaggcttacggcaaagtctcacgaggaaaaatcggtgtcatgatccaggaaatgacagatgagctggcggaatctttcaatctggataagtcacgtggcgcgctggttgtttctgtggagaaagacgggccggctgacaaggcaggcatcaagataagggatgtgattctgagattcgatggtaaaggtatcgatacttcaagtgatttaccccgcatagtcggaaatacgaaaccggatgccagggtatctgttgaagtatggcgtaatggctcagtcaagaaactgactgttacagtaggggaaatgcctggagatgacagtagtactactgtccagaaacaaagtaaatcaggagatgccaccagcaggttagggcttgctctgagagaactttctgcaagccagaagaatgagcttggaattgatagcggtctgctggtcgaagaggtctatgacggaattgccagcagtgcaggcattcgtcccggagatgtcattctggggttcaataaccaggatataaaatctatccagcagttcaataaactattggatgatgccaaaaaaggccggaatatcgctctgctgataaaaaggggagatattacgacctttattactataaagataaatgggtaa

SEQ ID NO: 28924 - protein, 496 aa, Nitrosomonas europaea
MADIISRNNFHSGIGSRFLINTVTVADIWRKGIFAICLLVAAFMLSASLHAKDLPDFTDLVEKHGQAVVNISTVQTQQIDANHFFPGIPNIPEDSPFYEFFRRHMQPFSGPRKYESRSLGSGFIISKDGYILTNAHVVESANEITVRLTDKREFGAKVIGTDRKTDIALLKIDADDLPVVTQGSPDQLKVGEWVIAIGAPFGFENTVTAGIVSAKGRSLAQENYVPFIQTDVAINPGNSGGPLFNMKGEVVGINSQIYSRTGGFMGLSFAIPIDVAMEITSQLKAYGKVSRGKIGVMIQEMTDELAESFNLDKSRGALVVSVEKDGPADKAGIKIRDVILRFDGKGIDTSSDLPRIVGNTKPDARVSVEVWRNGSVKKLTVTVGEMPGDDSSTTVQKQSKSGDATSRLGLALRELSASQKNELGIDSGLLVEEVYDGIASSAGIRPGDVILGFNNQDIKSIQQFNKLLDDAKKGRNIALLIKRGDITTFITIKING

SEQ ID NO: 28925 - DNA, 1323 bp, Enterococcus faecalis
  CDS (25)..(1323)
atgcacttattgggaggttattttatgcaacgaaaagatgttacacctaattcagataaaaaaagtttattgcaaaaatttgggattggtttagctggcggcttacttggtggcgcccttattctaggaggcgcttattctgggattattcccacacccaacggcggaaataatgcggcgacgacgacatccactaatcacggcgacacaaaagtcagcaatgtaagttacaatgtgtctagcgatgtcacaaaagccgtgaaaaaagttcaaaattctgtggtttctgtcattaatatgcaaagtgctagcaacaattcttcggcagatgatccttttgggggattgttcggtgggaatgaaggtactcaagactcttccggcaacaatggtaacgatttagaagcagccagtgaaggtagtggggttatttataagaaagatggtaaaacggcttatgtcgtgacaaataaccacgtcgtagataaagcgcaaggattggaagttgttttatctgatggtaccaaagtgaaaggcgaattagtcggaaccgatgcttacacggatttagccgtgattaaaatttcttccgacaaagttgatcaagtcgctgagtttggaaattctagtaaaatcacagtcggtgagcctgctattgcaattggttcccctctaggctctgattatgctaactctgtcacacaaggaatcatctcttctgtgaatagaaatattaccaataaaaacgagtctggtgaaaccatcaatattaatgctattcaaaccgatgctgccatcaatccaggaaactctggtggtccactaatcaatattgaaggacaagtcattggaattaactcagtaaaaattgtgcaatcaactagtcaagtgagcgttgaagggatgggctttgccattccaagtaatgacgtagtcaacattatcaaccaattagaaaaagatggtaaagtgacgcggccagctctcgggattacgatgtctgatttaacaggtatctcttcacaacaacaagaacaaattttaaaaattccaacttctgtaaaaactggcgtagtggttcgtggtgttgaagcagcgacccctgctgaaaaggctggattggaaaaatacgatgttatcacgaaagttgacggccaagacgtaagctctactacagatttacaaagcgcgctttacaagaaaaaagttggcgacaaaatggaagtgacttattatcgtggttctaaagaaatgaaagcaactatcgatttaaccattgataaatcagctttaacacaacaaaataatcgcagcaatcaatag

SEQ ID NO: 28926 - protein, 432 aa, Enterococcus faecalis
MQRKDVTPNSDKKSLLQKFGIGLAGGLLGGALILGGAYSGIIPTPNGGNNAATTTSTNHGDTKVSNVSYNVSSDVTKAVKKVQNSVVSVINMQSASNNSSADDPFGGLFGGNEGTQDSSGNNGNDLEAASEGSGVIYKKDGKTAYVVTNNHVVDKAQGLEVVLSDGTKVKGELVGTDAYTDLAVIKISSDKVDQVAEFGNSSKITVGEPAIAIGSPLGSDYANSVTQGIISSVNRNITNKNESGETININAIQTDAAINPGNSGGPLINIEGQVIGINSVKIVQSTSQVSVEGMGFAIPSNDVVNIINQLEKDGKVTRPALGITMSDLTGISSQQQEQILKIPTSVKTGVVVRGVEAATPAEKAGLEKYDVITKVDGQDVSSTTDLQSALYKKKVGDKMEVTYYRGSKEMKATIDLTIDKSALTQQNNRSNQ

SEQ ID NO: 28927 - DNA, 1356 bp, Coxiella burnetii
  CDS (1)..(1356)
atgaaaaaattatccaaaattattctcagcagtatttttgcggggctcccattactcctgcccgtcagtagttacgctcacttaccctccgctgtcgaaggaaaaacaatacccagccttgcaccaatgttgaataagaccacaccgagcgtcgtcaacattgccgtggaaaagctgattcctcaaacgccaaaccccttacaacccgaaatggatcaaaacacagcaccaacgaaagtcttaggcgtaggctcgggtgtaatcatagacgccaaaaaaggctatatcgtaacaaatgctcatgtcgtcaaagaccaaaaaatcatggtggtgacgcttaaagatggtcgccgttatcgagcgaaagtcatcggaaaagatgaagggtttgatctggctgtgattcaaattcacgcgaaccatttgaccgcacttcccatcggaaattcagatcaattaaaagtgggtgatttcgtcgtcgccgtgggaagcccttttggcttaactcaaacagtcacttccggcgtcattagcgccttgaatcgccaagaaccgcgtatcgataattttcaaagctttattcaaaccgacgcgccgattaatcccggcaattccggcggggctttaatcgatttagagggcaaattaattggtattaatacagcgattgtcaccccgtccgcgggaaatatcggcatcggctttgccattcccagcgacatggtcaaaagcgtggccgaacaattaattaaatatggaaaagtcgaacgcggcatgctcggcgtaacggctcaaaatattaccccggaattagcggacgccctaaatttaaaacataacaaaggagcgctggtaaccaaagtggttgctgaaagtccagcggctaaagccggggttgaggtgcaggatattattgaatctgtcaacggtattcggattcatagttcagcacaactccacaacatgctcgggctggtgcgtccaggaactaagattgaactaaccgtattgcgcgaccataaggttctgcctataaaaacggaagtagccgatcctaaaaaagtgctattgcaacgcgaactgcccttcctcggcggcatgcgtatgcagaaattcaacgacctagagcccgatggcactattttgcaaggtgttttagttaccggcgtggacgatagcagcgatggagcgctcggcgggttagagcccggcgatatcattatcagtgctaatggccaattaacgcccacggtcgatgagctaatgaaaatcgctgaaggcaagccaaaggagttgttactgaaagtggcgcggggcgcgggacaattatttttagttatccaacaatcacaataa

SEQ ID NO: 28928 - protein, 451 aa, Coxiella burnetii
MKKLSKIILSSIFAGLPLLLPVSSYAHLPSAVEGKTIPSLAPMLNKTTPSVVNIAVEKLIPQTPNPLQPEMDQNTAPTKVLGVGSGVIIDAKKGYIVTNAHVVKDQKIMVVTLKDGRRYRAKVIGKDEGFDLAVIQIHANHLTALPIGNSDQLKVGDFVVAVGSPFGLTQTVTSGVISALNRQEPRIDNFQSFIQTDAPINPGNSGGALIDLEGKLIGINTAIVTPSAGNIGIGFAIPSDMVKSVAEQLIKYGKVERGMLGVTAQNITPELADALNLKHNKGALVTKVVAESPAAKAGVEVQDIIESVNGIRIHSSAQLHNMLGLVRPGTKIELTVLRDHKVLPIKTEVADPKKVLLQRELPFLGGMRMQKFNDLEPDGTILQGVLVTGVDDSSDGALGGLEPGDIIISANGQLTPTVDELMKIAEGKPKELLLKVARGAGQLFLVIQQSQ

SEQ ID NO: 28929 - DNA, 1368 bp, Enterobacter cloacae
  CDS (1)..(1368)
atgaagaaaaaaaaccagctgttgagcgctatcgcgttaagtgtcgggttatctctctcggcgtccgtccctgtatttgccgccattccctcccaggtgcctggccaggcggccattccaagcctcgcgcctatgctggaaaaagtgttgccggcggtcgtcagcgttcaggttgagggcaccgcagtacaaagccaacgcgtccctgaagaactgaaaaaatattttggcgatgagtctcccgaccagcaggctcagccttttgaaggcctgggttctggcgtcattattgatgcggcaaaaggctatatcctgaccaacaaccacgtcatcagccaggccgataaaatcagcgtccagctgaacgatggccgcgaatttgatgccaaactgatcggcggcgatgaccagagcgacatcgcgctgctgcaggtgcaaaacccaagcaacctgacccagattgccatcgcggattccgacaaactgcgcgtcggcgattttgccgtcgccgtgggcaacccctttggtttagggcagaccgccacctccgggatcgtctcggcgctcgggcgcagcggcctcaatctggaagggctggaaaactttatccagaccgatgcctcaatcaaccgtggtaactccggcggagcattgctcaaccttaacggcgagctgattgggattaacacggcgattctggccccgggcggcggcagcatcgggatcggttttgctatccccagcaatatggccaaaaccctggcgcagcaattgatccagttcggtgaaatcaaacgcgggctgctgggtattaaaggtatggagatgagcgcggatatcgcaaaagcgttcaatatcaacgtacagcgcggggcgtttgtcagtgaagtgctgccaaactccggctcggcaaaagcgggcgtgaaatcgggagatgtgatcgtcagcctgaacgacaaaccgctgaatagctttgcagaactgcgctcacggattgccacgacggaacctggcgccaaagtgaagctgggcctgatccgtgacggtaagccgcttgacgttgaagtgacgctggataagagcacttcatcctcggccagcgcggagcttatcgccccggcgctacagggggctacgttgagcgacgggcagctgaaggacggtacgaaaggcatcagcatcgacaccgtcgagaagagcagccctgccgcacaggccggattgcatcaggatgacgtgattatcggtgtcaaccgcaaccgcgtgcagtctattgccgaactgcgcaaggtgctggaaagcaaaccagcggttattgccctgcaggtcatgcgtggcaatgagtccatctatattctgttgcgctaa

SEQ ID NO: 28930 - protein, 455 aa, Enterobacter cloacae
MKKKNQLLSAIALSVGLSLSASVPVFAAIPSQVPGQAAIPSLAPMLEKVLPAVVSVQVEGTAVQSQRVPEELKKYFGDESPDQQAQPFEGLGSGVIIDAAKGYILTNNHVISQADKISVQLNDGREFDAKLIGGDDQSDIALLQVQNPSNLTQIAIADSDKLRVGDFAVAVGNPFGLGQTATSGIVSALGRSGLNLEGLENFIQTDASINRGNSGGALLNLNGELIGINTAILAPGGGSIGIGFAIPSNMAKTLAQQLIQFGEIKRGLLGIKGMEMSADIAKAFNINVQRGAFVSEVLPNSGSAKAGVKSGDVIVSLNDKPLNSFAELRSRIATTEPGAKVKLGLIRDGKPLDVEVTLDKSTSSSASAELIAPALQGATLSDGQLKDGTKGISIDTVEKSSPAAQAGLHQDDVIIGVNRNRVQSIAELRKVLESKPAVIALQVMRGNESIYILLR

SEQ ID NO: 28931 - DNA, 1545 bp, Xylella fastidiosa
  CDS (1)..(1545)
atgaattcacgtatccatacacgatgcttcggcctactcgccatcaccttgccgttagctgcctgtggcgcgcaacacaacaacagccccactcccactgcacactccacccccattgtgacccccagcaccaccccagcaccacagctcgtggctgggttgccagatttcacccaactggtcgaccaagtagggcctggtgtggtcaacattgaaaccgtcattacccgtaagaaagtcggcaaacgtcgcggtataccgcttgacaacgatatacccgagtttttccggcgtttctttggcccagatttccagatgccgaaccaacctcgtggcggccaggatgacgagggaggtatcgctggtcggggaatgggctctggcttcatcatttccaaagacggctacatactcaccaaccatcacgtcatcactggcgcaagcgaggtcacaatcaaattgactgatcgccgcgaattcaaagcaaaagtcatcggtagcgacgaacagtacgatgttgctttactcaaaatagatgcaaaaaatctacccaccgtgcgtatcggcgactccagttcacttaaacctggtcagtgggtcgttgcgatcggctcccccttcggattagatcactcagtcactgcagggatagtcagcgcactgggacgcagcaccagtgacgatcaacgctatgtcccatttatccaaaccgacgtacccattaaccagggaaattctggtggtccattgctgaatacccgaggtgaagtgattggtatcaactcgcaaatattttccgcctcaggcggctacatgggtattagctttgccattccaatcaatttggcaatcaacgctgccgaacaaatccgtaaaacaggcaaagtgcaacgcagtatgctcggtgttgaaatcggccctatcgacgcactcaaagctcaaggcctaggcttaccggacagccgaggcgcactggtcaataacattccaccccacagcccggccgccaaagcagggattgaagtcggtgacgtcatccgctcagtgaacggcaaagtaatcagtagcttcagcgatctgcctccactgatcggcatgatgccgccaggcaccaaagccaccctgggtattatccgtgacggcaaatcgcttgagatcgtcgtcactctttcggcactcaatcaggatgcaacagtcagcgaagatgaagacgacacatcaccttccaaaccagaaacctctgccaatgtcgaactgctcggccttcaagtcgaaaacctgagcgctgctgagcgcgaacgcctggcctcatcgcaaaacgcgaagggaggagtccgtatcacggcagtcacagcgccgtgggcacgcaacgccaacccgccattagtggaaggtttatttatcctaaggatcggccgcactccggttagcaatgtggcagaactgaaccgtgccctaggaaattataagaagggagatgtcatcatgctcctggtgaccaacggccgtggcacgttctacagtgcgttgaaagcaggcggctaa

SEQ ID NO: 28932 - protein, 514 aa, Xylella fastidiosa
MNSRIHTRCFGLLAITLPLAACGAQHNNSPTPTAHSTPIVTPSTTPAPQLVAGLPDFTQLVDQVGPGVVNIETVITRKKVGKRRGIPLDNDIPEFFRRFFGPDFQMPNQPRGGQDDEGGIAGRGMGSGFIISKDGYILTNHHVITGASEVTIKLTDRREFKAKVIGSDEQYDVALLKIDAKNLPTVRIGDSSSLKPGQWVVAIGSPFGLDHSVTAGIVSALGRSTSDDQRYVPFIQTDVPINQGNSGGPLLNTRGEVIGINSQIFSASGGYMGISFAIPINLAINAAEQIRKTGKVQRSMLGVEIGPIDALKAQGLGLPDSRGALVNNIPPHSPAAKAGIEVGDVIRSVNGKVISSFSDLPPLIGMMPPGTKATLGIIRDGKSLEIVVTLSALNQDATVSEDEDDTSPSKPETSANVELLGLQVENLSAAERERLASSQNAKGGVRITAVTAPWARNANPPLVEGLFILRIGRTPVSNVAELNRALGNYKKGDVIMLLVTNGRGTFYSALKAGG

SEQ ID NO: 28933 - DNA, 1377 bp, Xylella fastidiosa
  CDS (1)..(1377)
atgaatgcttggcttgataaccgcgccgaagcggcatccaacaccaatgccatctcaccaatatcatcactgccaacgggcacggtgcctcaaaccacggctaccaaccagccgctaccatcgttagcacccatgctgcaacaagtgatgccagcagtggtcagcatcaacagtaaacaagtggtacgggtgcgcaatccatttttcgacgacccgatcctacgtcggctattcccagagatcccccaagaacggattaatgagtcgctcggatctggggtgatcatcgacgcgcgcaatggctacgtacttaccaatcatcacgtgatcgaaaatgccgacgccgtgcaggtgacattagcagatgggcgcagcttcaaggccgagttcctcggttctgacgcagacaccgacatcgccttgatccggatcaaagcaaataaactgaccgaaatcaaactcgcagacagtaacaaattacgcgtgggcgacttcgtcgtagccattggtaacccgttcggctttacccaaacggtgacctcaggcatcgtctcggcggtaggtcgcagtggcatcctcggcctgggttaccaaaacttcatccaaaccgacgcatcgatcaacccgggtaactcaggcggcgcactggtgaatcttcatggccagttggttggcatcaacacggccagcttcaacccacagggcagcatggctggcaacatcggcttaggcctggcaattccttcgaatctagcgcgcaacgtcgtcgagcaattggtcacgaaaggcgttgtggtacgcgggacaatcggcgtacaaacacagaatattgatgcacgaatggcacaaagcttaggcctgagtaatccacacggcgcattagtgactcgcgtattacccaattccgctggtgccgcagccggactgcaaccaggtgatgtgatcctggcagccaatgaccaaagggtggacaacgcggaaacattgcacaactacgaaggactacagcccgtcggtagctcagtaacactggaagtacaccgtggcggcaagccactcaaaatacgcctcacactcaaagaattgccacgcgcaatcgccggagaaacgctggattcacgactgtcgggcgccatcttcgttgacctgccagagtccctccgtcaatcaggaatcggtggagtcatggtcaacaaaatcaaacacggcagccgcgctgcggccaatgggttggtagccggagatgtcatcattgccgcatccatcggtgaattctctgatctggcgagctggcgggcaagcttttcccacccaccacaacggctgatactgcgtgtgctgcgcggtaacgcacagtatgatgcgctgatgcgctga

SEQ ID NO: 28934 - protein, 458 aa, Xylella fastidiosa
MNAWLDNRAEAASNTNAISPISSLPTGTVPQTTATNQPLPSLAPMLQQVMPAVVSINSKQVVRVRNPFFDDPILRRLFPEIPQERINESLGSGVIIDARNGYVLTNHHVIENADAVQVTLADGRSFKAEFLGSDADTDIALIRIKANKLTEIKLADSNKLRVGDFVVAIGNPFGFTQTVTSGIVSAVGRSGILGLGYQNFIQTDASINPGNSGGALVNLHGQLVGINTASFNPQGSMAGNIGLGLAIPSNLARNVVEQLVTKGVVVRGTIGVQTQNIDARMAQSLGLSNPHGALVTRVLPNSAGAAAGLQPGDVILAANDQRVDNAETLHNYEGLQPVGSSVTLEVHRGGKPLKIRLTLKELPRAIAGETLDSRLSGAIFVDLPESLRQSGIGGVMVNKIKHGSRAAANGLVAGDVIIAASIGEFSDLASWRASFSHPPQRLILRVLRGNAQYDALMR

SEQ ID NO: 28935 - DNA, 1368 bp, Vibrio parahaemolyticus
  CDS (1)..(1368)
atgaaaaagccattgcttgcgctaaccgttctatctttaagtttgagttccattatcacgccgataacggccacggcagcactgcctctaagtgttgatggccagcaattaccaagcctagccccgatgctagaaaaagtgaccccagcagtcgtgagtattgcggttgagggtaaacaagttcaaaccagtcgtattccggaacaatttcagttcttcttcggccctgacttcccgatggagcaaactcgagagcgtccattccgcggattgggctctggcgtcattattgatgcccaaaaagggcacatcgtcactaactatcatgtgatcaaaggcgcggatgaaattcgagtgcgcctctatgacggccgcgagtacgatgcagaactcgttggcggtgatgagatggcagacgtcgcattgctgaaattagaaaaagcgaaaaatctaactcagattaagattgccgactctgacaagttacgcgtcggcgactttactgttgctatcggcaacccatttggtctcggccaaaccgtcacctcgggtatcgtttctgctctgggtcgtagtggtttaaacgtggagaacttcgaaaacttcatccaaaccgatgccgcaatcaatagtggtaactctggcggtgcactggtaaaccttaacggtgagctgatcggtattaacaccgccattttgggaccaaatggcggcaacgtcgggattggttttgcgatcccatcgaacatgatgagaaacctcactgagcagattttagaatttggtgaagtaaaacgtggcatgttgggcgttcaaggtggtgaagtgacctctgagctggcagaagcactgggttacgagtcaagtaaaggggcattcatcagccaagtcgtgcccgatagcgcagcggacaaagcgggtctaaaagccggtgatgtggttgtatcagttaacggtaagtcaatcgacactttctctgagttgcgcgctaaagtcgccacattaggagcgggtaagaagatcacgctaggcgttattcgtgatggtaagagcaagtcgtttgacgtgactcttggcgagtccaccaacatgaaagccaaagcggaaacgttgcatgaaggcctaaaaggagcagagttaagtaacactacaccgagtgatgccatccaaggggtaaaagtctccagtgttgcagagaattcacctgccgcgcaataccagctaaaacaaggtgacatcattattggcgtcaatcgtcaacgagtgaaaaaccttgcggagcttcgctctattgttgataaacacaaaggtgtgcttgcactaaatattcaacgaggggaacgcactatctacttggtgattcgatag

SEQ ID NO: 28936 - protein, 455 aa, Vibrio parahaemolyticus
MKKPLLALTVLSLSLSSIITPITATAALPLSVDGQQLPSLAPMLEKVTPAVVSIAVEGKQVQTSRIPEQFQFFFGPDFPMEQTRERPFRGLGSGVIIDAQKGHIVTNYHVIKGADEIRVRLYDGREYDAELVGGDEMADVALLKLEKAKNLTQIKIADSDKLRVGDFTVAIGNPFGLGQTVTSGIVSALGRSGLNVENFENFIQTDAAINSGNSGGALVNLNGELIGINTAILGPNGGNVGIGFAIPSNMMRNLTEQILEFGEVKRGMLGVQGGEVTSELAEALGYESSKGAFISQVVPDSAADKAGLKAGDVVVSVNGKSIDTFSELRAKVATLGAGKKITLGVIRDGKSKSFDVTLGESTNMKAKAETLHEGLKGAELSNTTPSDAIQGVKVSSVAENSPAAQYQLKQGDIIIGVNRQRVKNLAELRSIVDKHKGVLALNIQRGERTIYLVIR

SEQ ID NO: 28937 - DNA, 1161 bp, Pseudomonas syringae
  CDS (1)..(1161)
atgttcaaggcactgcgttttttcggctggccattgctggctggcgtgcttatcgccctgctgatcatccagcgttatccgcagtgggttggcctgccgagcatggatgtcaatctgcaacaggcgccacagacgaccaatgtcatgcagggcccctcttcctatgccgatgcggtcattgccgcagcgccagcggtggtcaacctctataccaccaagatggtgaacaagggcaccaacccgctttttgaagacccgcagttccggcgcttctttggcgacaacacgcctaaacagaagcgcatggagtccagccttggctctggcgtgatgatgagcccggaaggctacatcctgaccaataaccacgtcaccactggcgcggaccagatcgtggtggcgctcaaggacggccgcgaaaccatcgccagagtcattggcaacgacccggaaaccgaccttgcggtcttgaaaatcgatctgaaaaacctgccagccattaccatcgcgcgctccgacggcattcgtatcggcgacgtcgcactggccatcggcaacccgttcggcgtcggccagaccgtgacgatgggcatcatcagcgccaccgggcgtaaccagttgggcctgaacacgtatgaagacttcattcagaccgacgcagccatcaaccccggcaactcgggcggtgcgctggtggatgccgctggcaatctgatcggcatcaataccgcgatcttttccaagtccggcggatctcaaggcatcggcttcgctatcccgaccaagctggcgatggatgtcatgaagtcgatcatcgaacacggtcaggtcattcgcggctggctgggcatcgaggttcaaccgttgaccccggagctggccgagtccttcgggctcaaggatcgtccaggcatcgttgtcgctggtatttttcgcgatgggccagcgcagaaagccgggctgcgactgggtgacgtaattcttgccatcaatggcgaacctgcgggtgacggccgtcgctcgatgaaccaggtggcgcgcaccaagcccaaggacaagattgcaatcgacgtgatgcgcaacggcaaggaaatgcgcctcagcgcagaagtaggcctgcgcccaccgcctgcaccgacacctgccgcagcgcccgagtaa

SEQ ID NO: 28938 - protein, 386 aa, Pseudomonas syringae
MFKALRFFGWPLLAGVLIALLIIQRYPQWVGLPSMDVNLQQAPQTTNVMQGPSSYADAVIAAAPAVVNLYTTKMVNKGTNPLFEDPQFRRFFGDNTPKQKRMESSLGSGVMMSPEGYILTNNHVTTGADQIVVALKDGRETIARVIGNDPETDLAVLKIDLKNLPAITIARSDGIRIGDVALAIGNPFGVGQTVTMGIISATGRNQLGLNTYEDFIQTDAAINPGNSGGALVDAAGNLIGINTAIFSKSGGSQGIGFAIPTKLAMDVMKSIIEHGQVIRGWLGIEVQPLTPELAESFGLKDRPGIVVAGIFRDGPAQKAGLRLGDVILAINGEPAGDGRRSMNQVARTKPKDKIAIDVMRNGKEMRLSAEVGLRPPPAPTPAAAPE

SEQ ID NO: 28939 - DNA, 1440 bp, Pseudomonas syringae
  CDS (1)..(1440)
atgtcgacaccacgcatgaaatcctacttttcattgatcgccgccgtgctgatgctcggccaggtcgctacagcccaggcagaaaacctgccggactttaccgggctggtcgagcaggcctcgcctgcggtagtgaacatcagtacacggcagaaactgccggatcgcgccgttgccaacaagcagatgcctgatctggaaggcttgccgccgatgttgcgcgaatttctcgagcgcagcatgccaccaggttcgcgcgcaccaggagccggcaagggtgatcgccagcgcgaggctcagtcgttgggttcgggctttatcatctcccccgatggctatgtgctgaccaacaaccatgtgatcgacggtgccgacgaaattctcgtgcgcctctctgaccgcagcgaattgaaagccaagctgatcggcaccgacccgcgcaccgatgtcgccgtgctgaaaatcgaaggcaaggacctgccgaccgccaagctgggtaattccaacacgctcaaagtgggcgagtgggtcttggcgatcggttcgccgttcggtttcgatcattcggtgaccaaaggtatcgtcagcgcaaagggccgcagtctgcccaatgacacctatgtgccgttcattcagaccgacgtagcgatcaacccgggtaactcgggcggtccgctgttcaacatggcgggcgaagtggtcgggatcaactcgcagatcttcacccgctcgggcggcttcatgggcctgtcgttcgccattccgatcgatgtcgccatggacgttgccaaccagctcaaggccagtggcaaagtcagccgcggctggttgggcgtggttattcaggaagtgaacaaggacctggcggagtcgttcggtctggacaagcccgccggtgcactggttgcacaggtgcttgaagatggtccggcggccaagggtggtttgcaggtcggtgacgttattctcagtgccaacggccagccagtcgtcatgtcggctgacctgccacacctgatcggcaacctcaaggacggcagcaaggccgagcttgaagtgattcgtgatggcaagcgtcagaaactgaccgtcactgtcggcgcgctgccggatgaaggcctggaaatgggcggtgctgcaggcgccagtgccgagcgcagcagcaaccgtctgggcgtttcggtgatcgagctgaccgccgagcagaagaagacgctggacatcaagggtggcgtggccatcaaggaagtcactgatggtcctgcatcgctgatcggtttgcagccgggtgatgtcatcactcacctgaacaatcaggcgatcacgtccgggaagcaattcactgatgtggcgaaaagcctgcccaaggaccgttctgtctcgatgcgcgtactgcgtcagggccgagcgaccttcattaccttcaaactgtcggaataa

SEQ ID NO: 28940 - protein, 479 aa, Pseudomonas syringae
MSTPRMKSYFSLIAAVLMLGQVATAQAENLPDFTGLVEQASPAVVNISTRQKLPDRAVANKQMPDLEGLPPMLREFLERSMPPGSRAPGAGKGDRQREAQSLGSGFIISPDGYVLTNNHVIDGADEILVRLSDRSELKAKLIGTDPRTDVAVLKIEGKDLPTAKLGNSNTLKVGEWVLAIGSPFGFDHSVTKGIVSAKGRSLPNDTYVPFIQTDVAINPGNSGGPLFNMAGEVVGINSQIFTRSGGFMGLSFAIPIDVAMDVANQLKASGKVSRGWLGVVIQEVNKDLAESFGLDKPAGALVAQVLEDGPAAKGGLQVGDVILSANGQPVVMSADLPHLIGNLKDGSKAELEVIRDGKRQKLTVTVGALPDEGLEMGGAAGASAERSSNRLGVSVIELTAEQKKTLDIKGGVAIKEVTDGPASLIGLQPGDVITHLNNQAITSGKQFTDVAKSLPKDRSVSMRVLRQGRATFITFKLSE

SEQ ID NO: 28941 - DNA, 1479 bp, Pseudomonas putida
  CDS (1)..(1479)
atgcaggggtctttccaaactaccgctcgttgtgacgggagtcgtatgtcaataccacgcttgaaatcctacctaatgatgttcgctgctgtgctgatgctcggccaagtagtcgccgcccaggccgaggaagccctgccggacttcaccaccctggtggagcaggcttcgccggcggtggtcaacatcagtaccaagcagaagctgcctgaccgccggatcgccgcaaaccagatgccggatctggaaggcctgccgccgatgttccgcgagttcttcgagcgcaacatgccccagcagccccgttcgccgcgcggcgaccgccagcgcgaggcgcagtcgctgggctcgggcttcatcatttccagtgatggctacgtgctcaccaataaccatgtggtggccgatgccgacgagatcatcgtccgcctgtcggaccgtagcgagctccaggccaagctggtcggcaccgacccgcgcactgacgtggcgctgctgaaggtcgatggcaagaatttgccaacggtgaaactgggtgactccgagaagctcaaggtgggcgagtgggtactggccatcggttcgccgttcggcttcgaccattcggtgaccaaaggtatcgtcagcgccaagggccggaccctgcccaatgacacctacgtaccgttcatccagaccgacgtggccatcaacccgggtaactccggcggcccgctgttcaacatgaaaggcgaagtggtggggatcaactcgcagatcttcacccgttctggcggtttcatgggcctgtcgttcgccatcccgattgatgtggcgatcgatgtctccaaccagctgaagaaagacggcaaggtcagccgcggctggctgggcgtggtgattcaggaggtcaacaaggacctggctgaatcgttcggcctggacaagccggcgggcgccctggtggcccaggtgctggaaaacggcccggcagccaaaggcggcctgcaggtgggcgacgtgatcctcagcatgaacggccagccaatcgtcatgtcggccgatctgccgcacctggtaggcggcctcaaggatggcgagaaggccaagctggaaatcatccgcaatggcaagcgccagaacctggacatcagcgtcggcgcgctgccggatgacgacgttgacattggcgctggcaccgaaggcagcgccgagcgcagcagcaaccgcctgggtgtatcggtcgccgacctgaccgccgagcagaaaaaatccctggagctcaaaggtggcgtggtcatcaaggaagtgcaggatggcccggcagccatgatcggcttgcgccctggtgatgtcatcagccatctgaacaaccaggccatcggttcggccaaggaattcaccgaaatcgccaaggaactgccgaagaatcgttccgtgtcgatgcgcgtactgcgtcagggccgtgccagcttcatcactttcaagcttgctgaataa

SEQ ID NO: 28942 - protein, 492 aa, Pseudomonas putida
MQGSFQTTARCDGSRMSIPRLKSYLMMFAAVLMLGQVVAAQAEEALPDFTTLVEQASPAVVNISTKQKLPDRRIAANQMPDLEGLPPMFREFFERNMPQQPRSPRGDRQREAQSLGSGFIISSDGYVLTNNHVVADADEIIVRLSDRSELQAKLVGTDPRTDVALLKVDGKNLPTVKLGDSEKLKVGEWVLAIGSPFGFDHSVTKGIVSAKGRTLPNDTYVPFIQTDVAINPGNSGGPLFNMKGEVVGINSQIFTRSGGFMGLSFAIPIDVAIDVSNQLKKDGKVSRGWLGVVIQEVNKDLAESFGLDKPAGALVAQVLENGPAAKGGLQVGDVILSMNGQPIVMSADLPHLVGGLKDGEKAKLEIIRNGKRQNLDISVGALPDDDVDIGAGTEGSAERSSNRLGVSVADLTAEQKKSLELKGGVVIKEVQDGPAAMIGLRPGDVISHLNNQAIGSAKEFTEIAKELPKNRSVSMRVLRQGRASFITFKLAE

SEQ ID NO: 28943 - DNA, 1524 bp, Bradyrhizobium japonicum
  CDS (1)..(1524)
atgaccgctgccatcattgccccgtcccgcttgcgccatcgtgcgcgacttggcgtgagaattgggctggccgcgctcgccgtcagtgcttttggcgcgttcggcacgccagctcaggcgcgcggaccggagggcatcgccgacgtcgccgagaaggtgatcgacgcggtcgtcaacatttcgacctcgcagaccgtcgaagccaagggcggcggcagcaacaccatgccgcaactgccgcccggctcgcccttcgaggagttcttcgacgacttcttcaagaaccgcaggggtcccggcggccccggtggcggcaagggcggcgacaacggcccgccccgcaagaccaactcgctcggctccggcttcatcatcgacacatcaggcgtcgtcgtcaccaacaaccacgtcattgcggacgccgacgagatcaacgtcatcctcaacgacggcaccaagatcaaggccgagctggtcggcgtcgacaagaagaccgacctggccgtgttgaagttcaagccgacgaagccgctggtcgcggtgaagttcggcgattccgacaagctgcgtctcggcgactgggtggtcgcgatcggcaacccgttcagcttgggcggcacggtgacggccggcatcgtctccgccaagaaccgcgacatctcctcgggtccctatgacagctacatccagaccgacgccgccatcaaccgcggcaattccggcggtccgctgttcaatctcgatggcgacgtcatcggcgtcaacacgctgatcatctcgccatccggcggctcgatcggcatcggcttcgccgtgccgtcgaagacggtcatgggcgtcgtcgaccagctccgccagttcggcgaattgcgccgcggctggctgggggtgcgcatccagagcgtcaccgatgagattgccgagagcctcaacatcaagccgccgcgcggcgcgctggttgccggcgtcgacgacaagggcccggccaagccggccggcatcgagcccggcgacgtcgtcgtcaagttcgacggcaaggacgtcaaggacccgaaggatctctcccgcgtcgtcgccgacacagcggtcggcaaggaggtcgacgtcatcatcatccgcaagggccaggaggagaccaagaaggtcacgctcggccgcctccaggatcccgacaaggtgcaggccgcggtgaagaccgacgagcccgcgccggagaagccggtgacccagaaggcgctcggcctcgatctcgccgtgctgaacaaggacctgcgtacacgctacaagatcaaggacagcgtcaagggcgtggtcgtcaccaatgtcgacgccaattccgacgccgccgagaagcgcctgtccgccggcgacgtcatcgtcgaggtggcacaggaggtcgtctccagcggcgccgacatccagaagcgggtcgaccagctcaagaaggacggcaagaagtcggtgctgctgctggtctccaacgccgacggcgagctgcggttcgtggcgctgagcgtgcagtaa

SEQ ID NO: 28944 - protein, 507 aa, Bradyrhizobium japonicum
MTAAIIAPSRLRHRARLGVRIGLAALAVSAFGAFGTPAQARGPEGIADVAEKVIDAVVNISTSQTVEAKGGGSNTMPQLPPGSPFEEFFDDFFKNRRGPGGPGGGKGGDNGPPRKTNSLGSGFIIDTSGVVVTNNHVIADADEINVILNDGTKIKAELVGVDKKTDLAVLKFKPTKPLVAVKFGDSDKLRLGDWVVAIGNPFSLGGTVTAGIVSAKNRDISSGPYDSYIQTDAAINRGNSGGPLFNLDGDVIGVNTLIISPSGGSIGIGFAVPSKTVMGVVDQLRQFGELRRGWLGVRIQSVTDEIAESLNIKPPRGALVAGVDDKGPAKPAGIEPGDVVVKFDGKDVKDPKDLSRVVADTAVGKEVDVIIIRKGQEETKKVTLGRLQDPDKVQAAVKTDEPAPEKPVTQKALGLDLAVLNKDLRTRYKIKDSVKGVVVTNVDANSDAAEKRLSAGDVIVEVAQEVVSSGADIQKRVDQLKKDGKKSVLLLVSNADGELRFVALSVQ

SEQ ID NO: 28945 - DNA, 1272 bp, Bradyrhizobium japonicum
  CDS (1)..(1272)
atgcagcgggtgcagccggcggtcgtcaacgtctatgccgccaaggtggtgcagaaccgcaatccgctgctggatgatcccatcttccgccgcttcttcggcgtgcccggccagcagcccgagcagatgcagcgctcgctcggctccggcgtcatcgtcgatgcgtcgggcctcgtcgtcaccaatgtccacgtcatcgagggcgcggaccaggtcaaggtgtcgctgtcggacaagcgcgagttcgaggccgagatcctgctgaaggatccccgcaccgatctcgccgtgttgcgcctgaaggacaccaaggagaaatttccaacgctcgacttcaccaattccgacgagctgctggtcggcgacgtcgtgctcgcgatcggcaaccccttcggcgtcggccagaccgtgacccacggcatcatctcggcgctggcgcgcacgcaggtcggcatcaccgactaccagttcttcatccaaaccgatgcggcgatcaatcccggcaattccggcggtgcactggttgacatgagcggcaagcttgccggcatcaacaccgcgatctattcgcgctccggcggctcgcagggcatcggctttgcgatccccgccaacatggtgcgcgtggtcgtcgcttccgccaagggcggcggcaaggcggtgaagcgtccctggctcggcgcgaagttgcaggcggtgacgcccgagatcgccgaaagcctcggcttgcgttcgccgaccggcgcgctggtcgcgagcgtggtctcgaacggtcccgcagcgaaggccggcctgaaatcctccgatctgatcaccgggatcgacggccagaccgtggatgatcccaatgccttcgactaccgcttcgcgacgcgtccactcggcggttccgcgcagatcgacgtgcagcgcggcggcaagccgctcaagctcgcgatcgcgctggagaccgcacccgacgccggccgcaacgagctcgtcatcactgcgcgttcgccgttccagggcgcgaaggtctcgaccatcacgccggcggttgccgacgagctgcatctggacgccgacaccgaaggcgtcgtgatcgccgatctcggcggcgacagcgcggccgcgaatgtcggcttccagaagggcgacatcatcctggctgtcaacaatcagaagatcagcaagaccggcgatctcgaaaaggctgcgggtgagcgcccgcggatctggcgcatcacgctggtgcgcggcgggcagcagatcaacgtcacgctgggcggatga

SEQ ID NO: 28946 - protein, 423 aa, Bradyrhizobium japonicum
MQRVQPAVVNVYAAKVVQNRNPLLDDPIFRRFFGVPGQQPEQMQRSLGSGVIVDASGLVVTNVHVIEGADQVKVSLSDKREFEAEILLKDPRTDLAVLRLKDTKEKFPTLDFTNSDELLVGDVVLAIGNPFGVGQTVTHGIISALARTQVGITDYQFFIQTDAAINPGNSGGALVDMSGKLAGINTAIYSRSGGSQGIGFAIPANMVRVVVASAKGGGKAVKRPWLGAKLQAVTPEIAESLGLRSPTGALVASVVSNGPAAKAGLKSSDLITGIDGQTVDDPNAFDYRFATRPLGGSAQIDVQRGGKPLKLAIALETAPDAGRNELVITARSPFQGAKVSTITPAVADELHLDADTEGVVIADLGGDSAAANVGFQKGDIILAVNNQKISKTGDLEKAAGERPRIWRITLVRGGQQINVTLGG

SEQ ID NO: 28947 - DNA, 1578 bp, Bradyrhizobium japonicum
  CDS (1)..(1578)
atgaccgaacgtcccgacctttcgaaccttccgtcctaccggcagccgcgccggtcggtcttctccgcgcgcaagatcgcgctgatggcctcggtcgtcgccggcttcggcgcagccgtctacggcttcagcccgtccgtgtcgccggccgacctgttctcgagcccggcgcatgcgcaggtcaacaacgaggtccggaaggttgaacgcccggtcggcttcgccgacatcgtcgagcgcgtgaagccgtcggtgatctctgtgaaggtcaacatcaaggaaaagaccgcgagcaacgatgacggcgacgattcctcctcgccgttccagccgggctcgccgatggagcgcttcttccggcgcttcggcggtccggatggcatcccgggcatgaagggcggccgtggccgcgtcgtgcagggccagggttccggcttcttcatctcggctgacggctttgccgtgaccaacaaccacgtggtcgacggcgccgacaaggtcgaggtcaccaccgacgacggcaagacctataccgccaaggtgatcggcaccgaccagcgcaccgaccttgccctgatcaaggtcgagggcggctcgaacttcccgttcgcaaagcttgccgacggcaagccgcggatcggcgactgggtgctcgcagtcggcaatcccttcggtctcggcggcaccgtgaccgcgggcatcgtctcggccagcggccgcgacatcggcaacggtccctatgacgatttcatccagatcgacgcgcccgtgaacaagggcaattccggcggtccggccttcaacaccgacggcgaggtgatgggcgtcaacaccgcgatctactcgccctccggcggcagtgtcggcatcgcgttctcgatcccggccaacaccgtgaagacggttgttgcccagctcaaggacaagggttcggtcagccgcggctggatcggcgtgcagattcagccggtgacgtcggatatcgccgacagcctcggcatgaagaaggccgaaggggcgctggtggcggagccgcaggcgaacggtccggcggcgaaggccggcatcgagtccggcgacgtgatcacctcggtcaacggcgaatccgtcaaggacgcccgcgagctcgcccgcaccatcggcggcatggcgcccggtgcgatcgtgaagctcaacgtgctgcacaagggccaggacaaggtcgtgaacctcaccctcggccagctgccgaacacggtcgaggccaaggccgataccgataacgacagcggcaagggcgcgaccaagggcaccgacgtgcccaagctcggcatgaccgttgcgcccgcgaactccgtggccggcgccggtaaggaaggcgtcgtggttaccgaagtcgatccgaagagcgccgcggccgaacgcgggttcaaggaaggcgacgtgattctcgaagtcggcggcaagagcgtgagcaccgccggcgatgtccgcgaggccatcaacacggcgcggaccgacaacaagaacagcgtcctgatgcgcgtgaagagcggcggccagtcgcgcttcgtcgcgattcccctcgccaaggggtaa

SEQ ID NO: 28948 - protein, 525 aa, Bradyrhizobium japonicum
MTERPDLSNLPSYRQPRRSVFSARKIALMASVVAGFGAAVYGFSPSVSPADLFSSPAHAQVNNEVRKVERPVGFADIVERVKPSVISVKVNIKEKTASNDDGDDSSSPFQPGSPMERFFRRFGGPDGIPGMKGGRGRVVQGQGSGFFISADGFAVTNNHVVDGADKVEVTTDDGKTYTAKVIGTDQRTDLALIKVEGGSNFPFAKLADGKPRIGDWVLAVGNPFGLGGTVTAGIVSASGRDIGNGPYDDFIQIDAPVNKGNSGGPAFNTDGEVMGVNTAIYSPSGGSVGIAFSIPANTVKTVVAQLKDKGSVSRGWIGVQIQPVTSDIADSLGMKKAEGALVAEPQANGPAAKAGIESGDVITSVNGESVKDARELARTIGGMAPGAIVKLNVLHKGQDKVVNLTLGQLPNTVEAKADTDNDSGKGATKGTDVPKLGMTVAPANSVAGAGKEGVVVTEVDPKSAAAERGFKEGDVILEVGGKSVSTAGDVREAINTARTDNKNSVLMRVKSGGQSRFVAIPLAKG

SEQ ID NO: 28949 - DNA, 1587 bp, Bradyrhizobium japonicum
  CDS (1)..(1587)
atgttgcgtgcaaggcgacacctgacccaacatggacatttcgacatgaatgaccgcgtcaattccgacatcaccacgtcccgcaggatcttgaagccgcgccggctcgcgctgctcggcaccgtggccgcgcttggcgtggctgtgctggcggcatctcccggctcttcgccgctcggcgtgacctccttcatcgcgccggcccaggccgcggaaagcgctgcgactccgccgggcttcggcgacctcgtcgccagggtcaaacctgccgtcatctcggtgcgggtcaggatcgaccaggacaacgacaagagcgcgatgctgcaacagaaccggatggattccgacgaggacgcgccgttcgaccagttctcgcggcagttcggcttccgccttccgggtggcatgaacggcatgccgcgccagcgtcaccagatggtcacgggcgaaggctccggcttcttcatctcagccgacggctatgccgtgaccaacaaccacgtcgtcgaccacgccgagtccgtgcaggtcaccatggacgacgggacgagctacaccgcgaaggtggtcggcaccgatccgaagaccgatctcgcgctgatcaaggtcgatggcaagaaggactttcccttcgtcaagttctccgaccagaagccgcggatcggcgactgggtggtcgcggtcggcaatcccttcggcctcggcggcaccgtgaccgccggcatcgtctcggcgagcggccgcgacatcggcaacggcccctatgacgacttcatccagatcgacgcgcccatcaacaagggcaattccggcggcccggccttcgacatgagcggcaacgtgataggcgtgaacactgcgatcttctcgccgtcgggcggttcggtcggcatcggcttcgacattccggccacgaccgcaaagctcgtcgtcgcgcagttgaaggacaagggtgcggtcacccgcggctggctcggcgtgcaggtgcagccggtgacatcagagatcgccgacagcctcggcctgaaggaggcgcgcggcgcgatcgtcgacaatccgcaggacaatagcccggcggcaaaggccggcatcgaggcgggcgacgtcatcaccgccgtcaacggcaccgcgatcaaggactcccgcgatctcgcccgcaccgtcgccacgctggcgccgggcacgtccgtgaagctcgacgtcttccacaagggcgcgagcaagacggtgaccctcgcgctcggcgagctgccgaacgagcggcaggctcaaggcaaggccgacgagggcaaggcgcagccgggcaacggcacgccgcgcctcgggctcagcttggcgccggccggcgacgtgcagggcgccggccagaagggcgtcgtcgtcaccgaggtcgatccgcaagggccggcggcgcagcgcggcatccagaccggcgacgtcatcctcaatgtcggcggcaagcccgtcgccaatgtcggcgacgtccgcgccgagctggcgcaggcgaaatcgtccggcaagaacagcgtgctgttgcagatcagaagcgcggacgcgacccggttcgtcgcggtgccgctcgcgtaa

SEQ ID NO: 28950 - protein, 528 aa, Bradyrhizobium japonicum
MLRARRHLTQHGHFDMNDRVNSDITTSRRILKPRRLALLGTVAALGVAVLAASPGSSPLGVTSFIAPAQAAESAATPPGFGDLVARVKPAVISVRVRIDQDNDKSAMLQQNRMDSDEDAPFDQFSRQFGFRLPGGMNGMPRQRHQMVTGEGSGFFISADGYAVTNNHVVDHAESVQVTMDDGTSYTAKVVGTDPKTDLALIKVDGKKDFPFVKFSDQKPRIGDWVVAVGNPFGLGGTVTAGIVSASGRDIGNGPYDDFIQIDAPINKGNSGGPAFDMSGNVIGVNTAIFSPSGGSVGIGFDIPATTAKLVVAQLKDKGAVTRGWLGVQVQPVTSEIADSLGLKEARGAIVDNPQDNSPAAKAGIEAGDVITAVNGTAIKDSRDLARTVATLAPGTSVKLDVFHKGASKTVTLALGELPNERQAQGKADEGKAQPGNGTPRLGLSLAPAGDVQGAGQKGVVVTEVDPQGPAAQRGIQTGDVILNVGGKPVANVGDVRAELAQAKSSGKNSVLLQIRSADATRFVAVPLA

SEQ ID NO: 28951 - DNA, 1536 bp, Bacteroides thetaiotaomicron
  CDS (1)..(1536)
atgaaacagacaacaaagaacattctgggagtaggagcaattattcttctgagctcaggagttgcaggattgacaacttacaaattgttgcaatctaacgaagctgccaaggaaacatcttttaatgagatgttcaagcagaatcccaatgtcaaattggctgcttttgatgcggtaaacgctcagccggttgatttgacacaggctgctgagaactcccttcatgctgttgtacatataagatctacgcaagaatccaaaactaaaacgattcagcaggcaccggatattttcgatttcttcttcggtgacggacgtggacaacagcgtcaggtacaaacccagcctcgcgtaggttttggctcgggagtgattatctctaaagacggttatatcgtaaccaacaaccacgtgattgaaggtgcagatgaaatcagtgtgaagctgaatgataatcgtgagtttaaaggacgtgtaatcggtactgacccgagcactgaccttgcattagtgaaaatagaaggagatgatctgccgactattccggtaggtgactctgatgcactgaaagtaggcgagtgggtattggcagtaggtaacccgttcaatcttaactctactgtaactgccggtatcgtcagcgcaaaggcccgttcattgggtgtatataatggtggtatagaatcttttatccagacagacgctgccattaaccagggaaatagtggtggtgcactggtcaatgctaagggagaactggtaggtatcaactctgtactttcttctccgaccggagcttatgccggatatggatttgctattccgaccagcattatgacgaaggttattgctgacctgaaacaatatggaactgtgcagcgtgctttgcttggtatccgtggaggatctattggcagcagcttgatggatgacagacaaccgattgataagtccggtactactttggcagataaagctaaggcactgggtgtagtagaaggagtctgggtttctgaaattgttgaaggtggctcggctgcaggtgctgatatcaaagtcgatgacgtaattatcggtctggataataagaaggtttcaaatatggccgacttgcaggaagctcttgctaaacatcgtcctggtgataaggtgaaagtaaaactgatgcgtgataagaaggaaaagactgttgaagtaacgttgaagaacgaacaaggcacaacgaagattgtaaaagacgcaggtatggacatcctgggtgctgcattcaaagaattgccggatgacttgaagaaacagttgaacctcggttatggtctgcaagtgacaggtgtttcttccggtaagatgtcagatgcaggagtccgcaaaggcttcatcatcctgaaagctaatgaccagccgatgcgcaaagtcagtgatctggaagaagcaatgaaagctgctgttaagtctccgaatcaggtattgttcctgacaggtgtattcccatccggtaaacgcggatactttgcagttgatctgactcaggaataa

SEQ ID NO: 28952 - protein, 511 aa, Bacteroides thetaiotaomicron
MKQTTKNILGVGAIILLSSGVAGLTTYKLLQSNEAAKETSFNEMFKQNPNVKLAAFDAVNAQPVDLTQAAENSLHAVVHIRSTQESKTKTIQQAPDIFDFFFGDGRGQQRQVQTQPRVGFGSGVIISKDGYIVTNNHVIEGADEISVKLNDNREFKGRVIGTDPSTDLALVKIEGDDLPTIPVGDSDALKVGEWVLAVGNPFNLNSTVTAGIVSAKARSLGVYNGGIESFIQTDAAINQGNSGGALVNAKGELVGINSVLSSPTGAYAGYGFAIPTSIMTKVIADLKQYGTVQRALLGIRGGSIGSSLMDDRQPIDKSGTTLADKAKALGVVEGVWVSEIVEGGSAAGADIKVDDVIIGLDNKKVSNMADLQEALAKHRPGDKVKVKLMRDKKEKTVEVTLKNEQGTTKIVKDAGMDILGAAFKELPDDLKKQLNLGYGLQVTGVSSGKMSDAGVRKGFIILKANDQPMRKVSDLEEAMKAAVKSPNQVLFLTGVFPSGKRGYFAVDLTQE

SEQ ID NO: 28953 - DNA, 1410 bp, Escherichia coli O6
  CDS (1)..(1410)
atgaatctcttttcttatcattcaggtacgagagcaggaataatgaaaaaacaaacccagctgttgagtgcattagcgttaagtgtcgggttaactctctcggcgtcatttcaggccgtcgcgtcgattccaggccaggttgccgatcaggcccccctccccagtctggctccaatgctggaaaaagtgcttccggcagtggtgagcgtacgggtggaaggaacggccagtcagggacagaaaatcccggaagaattcaaaaagttttttggtgatgatttaccggatcaacctgcacaacccttcgaaggtttaggctccggtgtcatcatcaacgccaataaaggctatgtgctgaccaacaaccatgtgattaatcaggcacagaaaatcagtattcagctcaatgatgggcgcgagtttgatgcaaaactgattggtagcgatgaccagagcgatatcgccctgttgcaaattcaaaacccgagcaaattaacgcaaatcgctattgccgactccgataaattgcgcgtcggtgattttgccgtggcggtcggtaacccatttggccttgggcaaaccgccacctctggcattatatccgcattaggccgcagcgggttgaatcttgaaggtctggaaaactttatccagacagatgcttccattaaccgcggtaactccggcggtgcactgttaaaccttaacggtgagttaattggcatcaacactgcaatccttgcgcctggcggcggtagcgtcgggattggatttgccattcccagtaatatggcgcgaacactggcgcagcagcttatcgactttggagaaatcaaacgcggcctgttaggcatcaaaggcaccgagatgagtgccgatatcgccaaagccttcaaccttgacgtgcagcgtggcgcgtttgtcagcgaagtgttgccaggttctggctcggcaaaagcgggcgtcaaagcgggcgatattattaccagcctcaacggcaaaccgctgaatagctttgctgagttgcgctctcgtatcgcgaccaccgagccgggcacaaaagtgaagcttggcctgctgcgtaacggcaaaccactggaagtagaagtgacgctcgataccagcacctcttcgtcggccagcgctgaaatgatcacgccagcgctggaaggtgcaacgttgagcgatggtcagctaaaagatggtggcaaaggtattaagatcgatgaggttgtcaaaggaagcccagctgctcaggctggcttgcaaaaagacgatgtgatcattggcgtcaaccgcgatcgggtgaactcgattgctgaaatgcgtaaagtgctggcggcaaaaccggccatcattgccctgcaaattgtacgcggcaatgaaagcctctacctactaatgcgttaa

SEQ ID NO: 28954 - protein, 469 aa, Escherichia coli O6
MNLFSYHSGTRAGIMKKQTQLLSALALSVGLTLSASFQAVASIPGQVADQAPLPSLAPMLEKVLPAVVSVRVEGTASQGQKIPEEFKKFFGDDLPDQPAQPFEGLGSGVIINANKGYVLTNNHVINQAQKISIQLNDGREFDAKLIGSDDQSDIALLQIQNPSKLTQIAIADSDKLRVGDFAVAVGNPFGLGQTATSGIISALGRSGLNLEGLENFIQTDASINRGNSGGALLNLNGELIGINTAILAPGGGSVGIGFAIPSNMARTLAQQLIDFGEIKRGLLGIKGTEMSADIAKAFNLDVQRGAFVSEVLPGSGSAKAGVKAGDIITSLNGKPLNSFAELRSRIATTEPGTKVKLGLLRNGKPLEVEVTLDTSTSSSASAEMITPALEGATLSDGQLKDGGKGIKIDEVVKGSPAAQAGLQKDDVIIGVNRDRVNSIAEMRKVLAAKPAIIALQIVRGNESLYLLMR

SEQ ID NO: 28955 - DNA, 1392 bp, Yersinia pestis
  CDS (1)..(1392)
atgagagagtttaaatcaatgaagaaaacatcattacttcttagtgcgctagcaataagcgtcggcttaggtctcgcttctgttcctatggtgagtgcagcagcactgcctgcggcggtcgccggacaaacgttacctagcctggcaccaatgctggaaaaagtattacccgccgttgtcagtgttcatgtctctgggagccaggcacagcaacaacgcttgccagaagagtttaaattcttctttggcccgaatgcaccatcaggaaaagagagcagccggccattcgaaggcttaggatcaggcgttattattaacgctgagaagggctacatcctgaccaacaatcacgtcatcaataatgccgataaaattcgtgttcagctgaatgatggtcgtgaatacgatgcaaaattgttgggtcgtgatgaacaaaccgacatcgctttactgcaattaacggatgctaaaaatctgactgcgatcaaaattgcagattccgataacctgcgggtgggggattttgctgtcgccgtaggtaacccgtttggtctagggcaaaccgcgacgtcaggtattatttcagcactgggtcgtagtggcttgaatctggaagggctggaaaactttatccagaccgatgcctcaatcaaccgtggtaattctggcggtgctctggtgaatctggatggggaactgatcggaattaataccgccatccttgcgccaggtggcggtaatatcggtatcggcttcgctatcccaagtaacatggcacaaaacctcagccagcagttgatcgagtttggcgaagtgaaacgtgggctgctcggtatccgtggtagtgagatgacggctgacattgcgaaagcctttaatattgatgctcagcgtggggcttttgtcagtgaagtgctgccaaaatcagcggcagcgaaagccgggatcaaaccaggtgatgtgttgatttccgttgatgggaaaaagattagcagctttgctgaattgcgcgccaaagtcgggacaacggggccaggcaaaaccattaaaattggtttactgcgcgaagggaaaccactggaagtatcggtgacgctggataacagtagctcaacatccaccagcgctgaaaatctatcgccatcattacagggcgcatccctgagtaacggtgagctcaaagacggtagtaaggggatcaaagttgatagcgtcactaaaggttcgccagccgcacaatctggcttacaaaaagatgatgtgattattgccgtaaaccgcgaacgggttaaggatattgctgagttgcgtaaagccatcgaagccaaacctgccgtgattgcactgaatatcgtgcgtggtgaagataatatttacttattaatccgctaa

SEQ ID NO: 28956 - protein, 463 aa, Yersinia pestis
MREFKSMKKTSLLLSALAISVGLGLASVPMVSAAALPAAVAGQTLPSLAPMLEKVLPAVVSVHVSGSQAQQQRLPEEFKFFFGPNAPSGKESSRPFEGLGSGVIINAEKGYILTNNHVINNADKIRVQLNDGREYDAKLLGRDEQTDIALLQLTDAKNLTAIKIADSDNLRVGDFAVAVGNPFGLGQTATSGIISALGRSGLNLEGLENFIQTDASINRGNSGGALVNLDGELIGINTAILAPGGGNIGIGFAIPSNMAQNLSQQLIEFGEVKRGLLGIRGSEMTADIAKAFNIDAQRGAFVSEVLPKSAAAKAGIKPGDVLISVDGKKISSFAELRAKVGTTGPGKTIKIGLLREGKPLEVSVTLDNSSSTSTSAENLSPSLQGASLSNGELKDGSKGIKVDSVTKGSPAAQSGLQKDDVIIAVNRERVKDIAELRKAIEAKPAVIALNIVRGEDNIYLLIR

SEQ ID NO: 28957 - DNA, 1374 bp, Wigglesworthia glossinidia brevipalpis
  CDS (1)..(1374)
atgaaaaaaatttttttatttaaaatattaataatattaatattgactttaaactttatttttaacaaagacgcaaaagcatttttttatggagaaaacaaagagcaaataatgccaagtttggctcctatgttaactaaagttcttcctgcagtagtgagcgttcatgttgaaggtagtcagccaatcaaaagatttgttttaccaaaagagtttaaatatttttttgggccagacctaccatttggtagtaatggaataaaaccatttgaaggattagggtctggagtaataatagatgctataaatggatatgtcattacaaacaatcatgttataaatggagctgataaaataaaaattcaattaaatgataatagagaatttgttgcaaaattaattggaaaggatgatcaaacagatttagctttattgcaaattcctatcaacaaaaatctaatagcaattcaaattgctgattcagataatttaaaagtaggagattttgcaattgcaataggtaatccatttggattaggacagactgtaacttctggaatagtatctgccttaggcagaagtggattaaatctagaaggtttagaaaattttatacaaacagatgcttctataaatagaggaaattcaggaggagctttagttaatttaaatggagaattaataggaattaatactgctattttagctcctggaggaggaaacattggaattggatttgccattccaagcaatatagtaaaaaatttatgtcaacaaataatagaacatggaaaagtaaaaagaggacaactaggaataaaaggaacagagcttacatatgatatagctaaagcatttaatatagatgcacaaaggggtgcttttgtaagtgaagttataccaaattctgcagcttccaaagctggaatgaaagctggagatataattttatcagtaaatggaaaatctataaaaagttttgcagaattaagagtaaaagttggaattactgctcctggcaaaacaatttctcttggcatattgagaaatggaaaaccaaaaaatatatctgtaacattggatgataaatctaatatttatacgttagaagatatatcaataccttcattgcagggagtatcattatctaatggatcattaaaagatgggactttaggtgtaaaagtagaagatgtaataaaagattctcctgcttatgttataggtttgaaaaaaaacgatataattataggaattaacagagaaagagtacaaaatttagatcaattaaaaaaagcattaaattctaaaccatcagtaatagctttaaatatagtaagaggagaagcaaaaatttttcttttattaagataa

SEQ ID NO: 28958 - protein, 457 aa, Wigglesworthia glossinidia brevipalpis
MKKIFLFKILIILILTLNFIFNKDAKAFFYGENKEQIMPSLAPMLTKVLPAVVSVHVEGSQPIKRFVLPKEFKYFFGPDLPFGSNGIKPFEGLGSGVIIDAINGYVITNNHVINGADKIKIQLNDNREFVAKLIGKDDQTDLALLQIPINKNLIAIQIADSDNLKVGDFAIAIGNPFGLGQTVTSGIVSALGRSGLNLEGLENFIQTDASINRGNSGGALVNLNGELIGINTAILAPGGGNIGIGFAIPSNIVKNLCQQIIEHGKVKRGQLGIKGTELTYDIAKAFNIDAQRGAFVSEVIPNSAASKAGMKAGDIILSVNGKSIKSFAELRVKVGITAPGKTISLGILRNGKPKNISVTLDDKSNIYTLEDISIPSLQGVSLSNGSLKDGTLGVKVEDVIKDSPAYVIGLKKNDIIIGINRERVQNLDQLKKALNSKPSVIALNIVRGEAKIFLLLR

SEQ ID NO: 28959 - DNA, 1128 bp, Synechococcus elongatus
  CDS (1)..(1128)
atgatgaaacgccttgcccatttacttcagcagaccctcaaattctgccttggccttacccttgtttggtccctgaacagcggtacaccagtgtgggcagcagcagctcaccatagttttgtcgcagctgcagtggagcgggttggcgatgcagttgttcgcattgataccgaacgcacaattgtgcgcacccccgatcccctcttgagtgatcccttctttcgccaatttttccctggtttagccttgcccccccaagaggatcggctgcggggtcaagggtcggggttcatcattgatcctagtggcattgtcatgaccaacgcccatgtggtgagtcaagcagatacggtaaacgtgcgcctcaaggatggccgggtctttgagggggaagtgcgcggcgtggatgaggtgtctgatctagcaattgtcaaactcaaaggggtcaccgaaccattgcccacggcgcccctcggtgattccagtgaggtgaaagtgggggattgggcgatcgccgtcggcaatccccttggccttgataacacagtaacattgggaattatcagtacactccaccgctccagcgcccaagtgggtatccccgataagcgccttgactttatccaaaccgatgcagccatcaaccccggcaattctggggggcctttactcaatgaagcgggggaagtgattggcattaacaccgctattcgtgccgacgccatggggattggcttcgccattcccatcaacaaagccaaagccctgcaagcccgcctgattcggggtgagaaaattcaacacgcctacatcggcattcaaatgactaccttcacgccggcaatggccaaggaaaacaatgctaaccccaactcacccgtgattctgccggaagtcaatggtgttcttgtcctacaggtgttgcccaatacgcctgcggcaaaagccggtctgcgctggggggatgtgattaccgcagtcgatggggaaccaattaccagtgccgatcagttgcagaccattgtcgatagtgccgcggtgggacaagttctcaatctgaccgttcaacggggcgatcgcgctcaacgcattgcggtgcggacagcagagttgcagggagcggcttag

SEQ ID NO: 28960 - protein, 375 aa, Synechococcus elongatus
MMKRLAHLLQQTLKFCLGLTLVWSLNSGTPVWAAAAHHSFVAAAVERVGDAVVRIDTERTIVRTPDPLLSDPFFRQFFPGLALPPQEDRLRGQGSGFIIDPSGIVMTNAHVVSQADTVNVRLKDGRVFEGEVRGVDEVSDLAIVKLKGVTEPLPTAPLGDSSEVKVGDWAIAVGNPLGLDNTVTLGIISTLHRSSAQVGIPDKRLDFIQTDAAINPGNSGGPLLNEAGEVIGINTAIRADAMGIGFAIPINKAKALQARLIRGEKIQHAYIGIQMTTFTPAMAKENNANPNSPVILPEVNGVLVLQVLPNTPAAKAGLRWGDVITAVDGEPITSADQLQTIVDSAAVGQVLNLTVQRGDRAQRIAVRTAELQGAA

SEQ ID NO: 28961 - DNA, 1170 bp, Synechococcus elongatus
  CDS (1)..(1170)
atgacagtgcgtcttggtaaatcggtcacctacctctcgttcatggcattgggggcagccgctgcaatgtttgtcacccacttgatgccagcgtcaacgcccttggtgacccccagcttggcacagttaccggcaccgctgccagcgggaaatgacactaactttattgcccgtgctgttgaacaggtggggcctgccgtggtgcggattgatgcttcccgtacggtgcagacccgtgtgccagctatttttaatgaccctttctttcaggaattttttgggccaatgatgcccccccgcagccgtgaagaacggggtctagggtctggttttatcattagtagcgatggcctgatcctgacaaatgcccacgtggtagatggtgctaaccgggtgcgagtaaccctcaaagatggccgcacctttgagggtcaggtgcttggtcaagaccgtctgactgatgtggcggtggtcaaggtgaatgcgagcaatttaccggtggtgcgtctgggtaattctgatcatttgcgccctggggagtgggcgatcgccatcggtaatccgttgggtctcgataatacggtgaccgcaggcattatcagtgcaaccggacgctcgagcggcgatattggtgtgcctgataaacgagtgggctttattcaaaccgatgcagctattaaccccggtaactctggcggccccctgttgaaccagcggggagaggtgattggcatgaatactgcgatcattggcggtgcccagggcttgggatttgccattcccatcaacacagcccagcgaattgccaatcaactgattgccaatggtcgcgtagatcaccccttcttgggtattcgcatgaccaatcttacccctgaggtgcagcaacgcctcaacaccaaccccaatagtcctgtgcgcgtggaggaaagttcgggtgtgttgatttttgaagtgctacccaactctcccgctgcccgtgcgggtctgcaacctggagatgtgatccgtcgtatcaatggccaaaccatcactaaagcagatcaagtgcagcaaatcgtggaaagcacaggcattggtcgcacaatggaactggaagtgcgccgtcgtggccagacggtgatcgtggctgtccagccggctcccctcccagcccaggccattcgctaa

SEQ ID NO: 28962 - protein, 389 aa, Synechococcus elongatus
MTVRLGKSVTYLSFMALGAAAAMFVTHLMPASTPLVTPSLAQLPAPLPAGNDTNFIARAVEQVGPAVVRIDASRTVQTRVPAIFNDPFFQEFFGPMMPPRSREERGLGSGFIISSDGLILTNAHVVDGANRVRVTLKDGRTFEGQVLGQDRLTDVAVVKVNASNLPVVRLGNSDHLRPGEWAIAIGNPLGLDNTVTAGIISATGRSSGDIGVPDKRVGFIQTDAAINPGNSGGPLLNQRGEVIGMNTAIIGGAQGLGFAIPINTAQRIANQLIANGRVDHPFLGIRMTNLTPEVQQRLNTNPNSPVRVEESSGVLIFEVLPNSPAARAGLQPGDVIRRINGQTITKADQVQQIVESTGIGRTMELEVRRRGQTVIVAVQPAPLPAQAIR

SEQ ID NO: 28963 - DNA, 1353 bp, Shewanella oneidensis
  CDS (1)..(1353)
atgaaaacgaaattatctgtactttcagccgcaatgttagccgcaaccctgacaatgatgccagctgtctcacaggccgctattccgcaatctgttgagggacaatccatacccagtcttgcgcccatgttagagcgtacgactcccgccgtggtttctgtggcggtttctggaacccatgtttctaaacaacgcgtgcccgatgtgttccgttatttctttggccctaatgcgccacaagaacaagtgcaagagcgtccatttagaggcttaggctccggcgttattatcgatgccgacaaaggctatattgtcaccaataaccacgtgatcgacggtgccgatgatatccaagtgggtttacacgatggccgtgaagtcaaagccaaattgattggtactgactccgaatccgacattgcgttattgcaaatcgaggctaaaaatctggtcgcgattaaaacctctgattctgatgaactgcgcgtcggtgactttgccgtcgctatcggtaaccccttcggtctaggacaaaccgtaacatcagggattgtcagtgccctaggccgtagcggtttaggcattgaaatgcttgaaaactttatccaaaccgacgcagccatcaacagtggtaactcgggcggcgctctagttaaccttaaaggcgaactgatcggtattaacacggctatcgtcgcgcctaacggcggtaacgtaggtatcggttttgcgattccagcaaacatggtgaaaaacctcatcgcacagattgctgagcatggtgaagttcgccgcggcgtattggggattgctggccgtgatttagatagccaacttgcccaaggctttggcttagacactcaacacggtggctttgtgaatgaagttagcgcgggcagtgccgccgaaaaagctggtattaaggcgggcgatattatcgttagcgtcgatggccgtgcgatcaagtcgttccaagagctgcgtgctaaagtcgcgacgatgggcgctggcgctaaagtcgaactgggccttatccgtgatggcgataagaaaactgtcaacgtcaccttaggtgaagcaaaccaaacgacagaaaaagcagctggtgcagtgcatcctatgctacaaggtgcctcattagaaaatgcctctaaaggggtcgaaattaccgatgttgcacaaggatctccagcggcaatgagcggtctgcaaaaaggcgatttgattgtcggtatcaaccgtactgcggttaaagatcttaaatcgctcaaagagctgctcaaagatcaagaaggtgctgtcgccctgaagattgtccgtggtaagagcatgctttacttagtgcttcgttaa

SEQ ID NO: 28964 - protein, 450 aa, Shewanella oneidensis
MKTKLSVLSAAMLAATLTMMPAVSQAAIPQSVEGQSIPSLAPMLERTTPAVVSVAVSGTHVSKQRVPDVFRYFFGPNAPQEQVQERPFRGLGSGVIIDADKGYIVTNNHVIDGADDIQVGLHDGREVKAKLIGTDSESDIALLQIEAKNLVAIKTSDSDELRVGDFAVAIGNPFGLGQTVTSGIVSALGRSGLGIEMLENFIQTDAAINSGNSGGALVNLKGELIGINTAIVAPNGGNVGIGFAIPANMVKNLIAQIAEHGEVRRGVLGIAGRDLDSQLAQGFGLDTQHGGFVNEVSAGSAAEKAGIKAGDIIVSVDGRAIKSFQELRAKVATMGAGAKVELGLIRDGDKKTVNVTLGEANQTTEKAAGAVHPMLQGASLENASKGVEITDVAQGSPAAMSGLQKGDLIVGINRTAVKDLKSLKELLKDQEGAVALKIVRGKSMLYLVLR

SEQ ID NO: 28965 - DNA, 1518 bp, Chlorobium tepidum
  CDS (1)..(1518)
atgaaaaagaaactgactatgctcaaatcggcagcgctggtatctgtggggatcaccgctggggcgctcgctttttccaatctcgatttttcgtttaacggaggcggcaataacgggtttatggtttccagtcaccccaactcgagtattgcggctgaaacccttcgcaaccatccgatacggacgctcaacgatctcaatgatgctttcgtggatatcgctgagtcagctaccccttcggtggtgacgatttatactgaaaccgaagtggatcgccggattatgacccccttcgattttttcggcaaatcgtttggagagatgtttgactttcctttacccgaagaaccgaacgttcgcaaggaggtgatccatggactgggatcgggtgtgatcgtcagccaggatggctacattctgaccaacaaccatgtgatcgaccaggcgggctccattgcggttatgacctctgataaccggaaattcaaggccaagatcgtcggcaccgatccccgcaccgacctggctgtgctgaagatttccggttccggtctcaagccgatcgctttcggcgacagcgacaagctgcgggtcggggagtgggtgctcgccatcggcagtccactcggcgaaaacctcgcccgcaccgtgacgcagggtatcgttagcgccaagggccgtgtcaatgtcggggtggccgattacgagaattttatccagactgatgcagccatcaatccaggaaactctggcggcccattggtcaatatcggtggcgagctggtaggcatcaatacggcgatagccagccgcactggtgggtttgaaggtatcggctttgccgtgccgtcgaacatggcatatcgggtctatacttcgctggttaaaaacggcaaggtcgagcgcggctacctcggcgttacgattcaggatatcgatgagaatatcgccaaggggctgcaactcaaatctcccgaaggggttctggtcggcacggtgatgcagggtggccctgcggccagggccggcctgaagagcggggatgtgatccttgaattcaacggacggaaggtgaacagcgcggcggagctgcgcaaccggatcgcggcgatggctcccggcagcagcgccgccatcaggatcaatcgcgacggcgcgattctcaccttgaacgcacgcctcgaatcgcttccagacaacgcgaccgcctcggctcgaagcaccgaatcgaagaacgaattgctcggcttctcggttgcgccattgacccccgaactggccgggcggctgaatctgaaagccgactcgcgccggatcgtggtgacatcagtcagcaaatcgagcagggccttctcggttggccttcgtccgggcgatgtggtcatatcggtcgacaaaaagccggtggattcggttgcggcattcaatgcaatcgtcaaaaacaagaaaaggggcgatctgctcttcctgttggttgagcgcggatggagtcggatgtattttgcgtttaatctgtaa

SEQ ID NO: 28966 - protein, 505 aa, Chlorobium tepidum
MKKKLTMLKSAALVSVGITAGALAFSNLDFSFNGGGNNGFMVSSHPNSSIAAETLRNHPIRTLNDLNDAFVDIAESATPSVVTIYTETEVDRRIMTPFDFFGKSFGEMFDFPLPEEPNVRKEVIHGLGSGVIVSQDGYILTNNHVIDQAGSIAVMTSDNRKFKAKIVGTDPRTDLAVLKISGSGLKPIAFGDSDKLRVGEWVLAIGSPLGENLARTVTQGIVSAKGRVNVGVADYENFIQTDAAINPGNSGGPLVNIGGELVGINTAIASRTGGFEGIGFAVPSNMAYRVYTSLVKNGKVERGYLGVTIQDIDENIAKGLQLKSPEGVLVGTVMQGGPAARAGLKSGDVILEFNGRKVNSAAELRNRIAAMAPGSSAAIRINRDGAILTLNARLESLPDNATASARSTESKNELLGFSVAPLTPELAGRLNLKADSRRIVVTSVSKSSRAFSVGLRPGDVVISVDKKPVDSVAAFNAIVKNKKRGDLLFLLVERGWSRMYFAFNL

SEQ ID NO: 28967 - DNA, 1461 bp, Rhizobium etli
  CDS (1)..(1461)
atgttccccttgacaaggatcaatgcgctttgcttgcgctacacaaaagcttcttcgtcaagacgtccgccgacaaccggcggcgcttccgcaaggagatcagagatgtcgcgttcgttgctcgccttggcggcgctcttcatcgcaggtgagagcctattgtcggctccagccgttgcagacagcctgtcgctcgcgccgatgctccagcgtgtcgtgccgagcgtcgtcagcatctcggtgcagggcagggaactcgacgacgcggatgcaacgcttgctgatcccttctacagaaagttcttcggactacctgacgacgctgcgccggcagagcacagcttccaatcggccggatcgggtgtcgtcatcgacgaggtccacggctacatcgtcaccaaccagcatgtcatagcaagcgcctcaaaaatcgaggtggcgctctccgacggccgacgcttccaagcgaaacttgtcggcgccgatcccgagacggatgtcgctgtcgttcaaattccacctgatcatcttgttcaagccgagtttggaagcgcgtcctcgcttcacgtcggcgacgtcgtcgtggcgatcgggaatcccttcggcctgggccagaccgcgacgatgggcatcgtaagcgcgcttgggcgccgtgccgtgggatcggaggggtacgaaggattcattcagacggacgcgtcgaccaatcccggcaattcgggcggcgcgcttgtaagcgaggacggcgtcgtggtcgggatcaatagcgcgatcatcggccccgccggaggaagcatcggcatcggttttgcggtcccagccgagactgtcggcatcgtgatgcggcagctcatcctgaccggcaagttggtacgcggcgaggtgggaattttaacgcaggacctgacgcccggtctcgcaaaggcgttcggcatcgatgaaggggcgggcgcgctggtcagcgaagtccttccgggttcaccggcggcaaatgcaggaattcagccgggcgacgtcattcggatggtcgacggaaggacggtgcgcggcgcgtccgacgttcgaaggcttgtgggatcgctaccgttgcagtccaagccgtccttccagatcgaccgcgcgagccgaaggatagaagcatttcccgtggtgtccgacgcaccggttgccgaaccggctgctccgcgtaccattcatatcggccgcggccctctcgccgacgccgagatggcgaactctcccgatggtcccggcgcccgcgtcgtcgtcgtcgccgagggttcggtcgcggcacaggccggcctgcagccggacgacgttatcgtcgctctcgaccagcagccggtgacggacgtcgggcaactcctctcaatactcgtgaaggagcatgcccgtgctctcatcaccgtcgtgaggaacggccaccgcctcttcgtggccgctgacgtgcagacccagtag

SEQ ID NO: 28968 - protein, 486 aa, Rhizobium etli
MFPLTRINALCLRYTKASSSRRPPTTGGASARRSEMSRSLLALAALFIAGESLLSAPAVADSLSLAPMLQRVVPSVVSISVQGRELDDADATLADPFYRKFFGLPDDAAPAEHSFQSAGSGVVIDEVHGYIVTNQHVIASASKIEVALSDGRRFQAKLVGADPETDVAVVQIPPDHLVQAEFGSASSLHVGDVVVAIGNPFGLGQTATMGIVSALGRRAVGSEGYEGFIQTDASTNPGNSGGALVSEDGVVVGINSAIIGPAGGSIGIGFAVPAETVGIVMRQLILTGKLVRGEVGILTQDLTPGLAKAFGIDEGAGALVSEVLPGSPAANAGIQPGDVIRMVDGRTVRGASDVRRLVGSLPLQSKPSFQIDRASRRIEAFPVVSDAPVAEPAAPRTIHIGRGPLADAEMANSPDGPGARVVVVAEGSVAAQAGLQPDDVIVALDQQPVTDVGQLLSILVKEHARALITVVRNGHRLFVAADVQTQ

SEQ ID NO: 28969 - DNA, 1368 bp, Pasteurella piscicida
  CDS (1)..(1368)
atgagaaaacctctgcttgttttaagtgcactggctttaggtattagttcagttgtcaccccgatgacggcaactgcggcgttacctaccgccgttaataatcaacaagtacctagccttgcgccaatgcttgagcaagtaacaccagctgtagtaagcattgcagttgaaggtaaacacgtttccaaacagcgcctacctgaggcttatcgctttttctttggtccagattttcctaccgagcaagtacgagaacaaccatttagggggttaggctcgggggttatcattgacgctaaaaaagggtatgtcgttaccaataaccatgttattgatggcgcagataccatcaaagtacagctttctgacggacgtgagataaaagcaaagctgcttggtaccgataaaatgtctgatattgcgttgctgcaattagaagatgccaaagatcttacggctatcaaactcgctgattctgataatcttcgcgtaggcgatttcgccgttgctatcggtaacccatttggcctaggacaaacagtaacatcaggtattgtttccgctcttggtcgtagtggtttaaatatcgagaacttcgaaaactttatccaaactgatgcgccaatcaatagcggtaactcaggtggtgccttagtaaacttaaacggtgagttgattggtattaataccgcgattcttgcgcctaacggtggtaacgtcggtatcggttttgcaatccctgctaatatggtgaaaaacttaacagatcaacttatcgaatttggtcaagttaagcgcggtgttctgggtgttactggtggtgagctaacctctgagctagctgaaacctttggttataaaacaaatcacggcgcgtttgtaaaccaagtacttcctgaaggctctgcggcaaaagcaggtctaaaagcaggtgatattattgtttcagtcaataataagccgattcgtactttcagtgaattacgcgcaaaaattgtaactctaggtgctggtaagaaagtaacactaggcctaattcgcgatggtaaagagctgaatgttcctgtgactttagaagcagcaaaacagactcaagttaaagctgatgatctgcatgaaagcttagccggtgctgaatttgctaatactagcccagaagataaagttcacggagttaaagtaaccgagctgaacaagcaatctattgcggctcgctatggcttgaagaagggcgatatcattattggtctaaaccgtcagccaattaaaaaccttggcgaacttcgtaaggcgcttgagaaaaaaccaaacgtacttgcaatggaagttaaacgtggtgatagcgtactgtatttaatcatgcgttaa

SEQ ID NO: 28970 - protein, 455 aa, Pasteurella piscicida
MRKPLLVLSALALGISSVVTPMTATAALPTAVNNQQVPSLAPMLEQVTPAVVSIAVEGKHVSKQRLPEAYRFFFGPDFPTEQVREQPFRGLGSGVIIDAKKGYVVTNNHVIDGADTIKVQLSDGREIKAKLLGTDKMSDIALLQLEDAKDLTAIKLADSDNLRVGDFAVAIGNPFGLGQTVTSGIVSALGRSGLNIENFENFIQTDAPINSGNSGGALVNLNGELIGINTAILAPNGGNVGIGFAIPANMVKNLTDQLIEFGQVKRGVLGVTGGELTSELAETFGYKTNHGAFVNQVLPEGSAAKAGLKAGDIIVSVNNKPIRTFSELRAKIVTLGAGKKVTLGLIRDGKELNVPVTLEAAKQTQVKADDLHESLAGAEFANTSPEDKVHGVKVTELNKQSIAARYGLKKGDIIIGLNRQPIKNLGELRKALEKKPNVLAMEVKRGDSVLYLIMR

SEQ ID NO: 28971 - DNA, 1437 bp, Xanthomonas campestris
  CDS (1)..(1437)
atgcgaccgctgcccaccctgctgtccctttcgctggccgccgcgttcggcggtttcgctgccagcggcatcaatgcctggctggacaaccgcgccgaagcggcgcccactgccggtgcggcgtttacgctgcccaccgccgccacgttgccggcggcggtcgccgggcagccggtgccctcactggcgccgatgctgcagcaggccatgccggcagtggtgagcgtcaacaccaagcaggtggtgcgggtacgcaacccgttcttcaatgatccgatcctgcgccggctgtttccggaaattccgcaggaccgcatcaacgagtcgctgggctcgggggtgatcatcgatgcgcaaaaaggctatgtgctgaccaaccaccacgtcatcgaaaacgccgacgacgtacaggtgacgctcggcgacgggcgcacggtcaaggccgatttcattggctccgatgccgataccgacatcgcgctgatccgcatcaaggccgacaacctcaccgacatcaaactggctgacagcaacgccttgcgcgtcggcgactttgtggtggcgatcggtaacccgttcggcttcacccagacggtcacctcgggcatcgtgtcggcggtgggccgcagcggcatccgtgggctgggctaccagaacttcatccagaccgatgcgtcgatcaaccccggcaattccggcggtgcgctggtcaatctgcagggccagttggtcggcatcaataccgccagcttcaacccgcaaggcagcatggccggcaacatcggcctgggcctggcgatcccgtccaacctggcgcgcaacgtggtcgagcaattggtgaccaagggcgtggtggtgcgcggcacgcttggcctggaaacccagaacctgacccagcaaatgctgcagggcctgggtgtggattcgctgcgcggtgcgctggtgacgcgcgtgctgccgggttcggccgcggcagcggctggcgtgcaacctggtgatgtgatcgtggcagccaacgatcaacgcgtggacagcgcgcaggcgctgcacaactacgaaggcctgcaggcagtaggcagtgcggtcacgctggacatccgccgcgacggcaagccgctcaagctcaaggccaccttgaaggaacaggaccgcacagtcaccggcgacatgctcgacccgcgcctgggcggcgccaccttcgtggatctgcccgaatcgctgcgccagtccggtgtcaccggggtcatggtgagcgaggtcaaacgcggcgggcgcgcggctgccaacgggctggtgagcggcgatgtgatcgtggccagcagcgtgggcgagttcgccgacctggccagctggcgggccaatttccagcgcaagccgcaacagctggtgctacgcatcctgcgcggaaacgcccagtacgacgcgctcatgcgttga

SEQ ID NO: 28972 - protein, 478 aa, Xanthomonas campestris
MRPLPTLLSLSLAAAFGGFAASGINAWLDNRAEAAPTAGAAFTLPTAATLPAAVAGQPVPSLAPMLQQAMPAVVSVNTKQVVRVRNPFFNDPILRRLFPEIPQDRINESLGSGVIIDAQKGYVLTNHHVIENADDVQVTLGDGRTVKADFIGSDADTDIALIRIKADNLTDIKLADSNALRVGDFVVAIGNPFGFTQTVTSGIVSAVGRSGIRGLGYQNFIQTDASINPGNSGGALVNLQGQLVGINTASFNPQGSMAGNIGLGLAIPSNLARNVVEQLVTKGVVVRGTLGLETQNLTQQMLQGLGVDSLRGALVTRVLPGSAAAAAGVQPGDVIVAANDQRVDSAQALHNYEGLQAVGSAVTLDIRRDGKPLKLKATLKEQDRTVTGDMLDPRLGGATFVDLPESLRQSGVTGVMVSEVKRGGRAAANGLVSGDVIVASSVGEFADLASWRANFQRKPQQLVLRILRGNAQYDALMR

SEQ ID NO: 28973 - DNA, 1437 bp, Xanthomonas axonopodis
  CDS (1)..(1437)
atgcgaccgctgcctaccctgctgactctttcgctggccgctgccttcggcggctttgccgccaccggcatcaacgcctggctcgacaatcgcgccgaagccacaccccccagcaacgccgcctttaccctgccgacggccgccgcattgccggcggcggtggccggccaacctgtgccgtcgctggcgccgatgctgcagcaggccatgcccgcggtggtgagcgtgaacaccaaacaggtggtgcgcgtccgcaacccgttcttcaacgacccgatcctgcgccggctgtttccgcaggtgccgcaggaccgcatcaacgagtcgctgggttcgggcgtgatcatcgatgcgcaaaaagggtatgtgctgaccaatcaccacgtcatcgaaaacgccgacgacgtgcaggtgacgctcggcgacggacgcacggtcaaggccgagttcatcggctccgatgccgataccgatattgcgctgatccgcatcaaggccgacaacctcaccgatatcaaactggccgacagcaacgcgctacgcgtgggcgattttgtggtggccatcggcaacccgttcggcttcacccagaccgtcacctccggcatcgtctcggcagtggggcgcagcgggattcgcggcttgggctaccagaacttcatccagaccgatgcctcgatcaaccccggcaactcgggcggcgcgctggtcaacctgcaaggccagttggttggcatcaacaccgccagcttcaatccgcagggcagcatggccggcaatatcggcctggggctggcgattccgtccaacctggcgcgcaatgtcgtcgagcaattggtgaccaagggcgtggtggtgcgcggcacgctcggcctggagacccagaacctcacccaacagatgctgcagggcctgggggtggattcgttgcgcggcgcattggtgacacgggtgttgccgggctccgcagcggcggcggcaggcgtgcaaccgggcgatgtcgtggtggcggccaacgaccagcgcgtggacagcgccgaagcgctgcacaactacgaaggcctgcaggcggttggcagtgcggtgaccctggatatccgtcgcgatggcaagccgctcaaactcaaggccacgctgagagagcaggaccgcgccatcaccggcgacatgctggacccgcgtctgaccggcgcgaccttcgtcgatctccccgaatcgctgcgtcagtcgggcatcaccggggtgatggtgagcgaggtcaaacgcggcggtcgcgctgccgccaacggcctggtcgccggcgatgtgatcgtggccagcagcgtgggcgagttcgccgaccttgccagctggcgggccaatttccaacgtaaaccgcagcagcttgtcgtgcgtatcctgcgtggcaacgcgcagtacgacgcgctgatgcgttga

SEQ ID NO: 28974 - protein, 478 aa, Xanthomonas axonopodis
MRPLPTLLTLSLAAAFGGFAATGINAWLDNRAEATPPSNAAFTLPTAAALPAAVAGQPVPSLAPMLQQAMPAVVSVNTKQVVRVRNPFFNDPILRRLFPQVPQDRINESLGSGVIIDAQKGYVLTNHHVIENADDVQVTLGDGRTVKAEFIGSDADTDIALIRIKADNLTDIKLADSNALRVGDFVVAIGNPFGFTQTVTSGIVSAVGRSGIRGLGYQNFIQTDASINPGNSGGALVNLQGQLVGINTASFNPQGSMAGNIGLGLAIPSNLARNVVEQLVTKGVVVRGTLGLETQNLTQQMLQGLGVDSLRGALVTRVLPGSAAAAAGVQPGDVVVAANDQRVDSAEALHNYEGLQAVGSAVTLDIRRDGKPLKLKATLREQDRAITGDMLDPRLTGATFVDLPESLRQSGITGVMVSEVKRGGRAAANGLVAGDVIVASSVGEFADLASWRANFQRKPQQLVVRILRGNAQYDALMR

SEQ ID NO: 28975 - DNA, 1578 bp, Xanthomonas axonopodis
  CDS (1)..(1578)
atgaaccatcgcatccgcacccagatgttcggcctgatcgccatgaccctgccgctggccgcctgcgcgcagcagcccgcacccgctgccaaggacctcgccccgattgctgccaatcgcagtgcaacgccagcgccgcagctggtggcggggctgccggacttcaccaatctggtcgagcaggtcggcccgggtgtggtcaatatcgaaaccaccattacccgcaaggatgccatggcgcgtcagcagcgcagtggcccgggtggtcgtggcggtggtgcgatgccggatgacgatcagatgccggaattcttccgccgctttttcgggccggacttccagatgccgggcggtccgcggcaggggcccggtggcggcgatgacgacggcggcatcgccggcaagtcgatgggctcgggcttcatcatctcggccgacggctacgtcctgaccaatcatcacgtggtcgatggcgccagcgaggtgaccgtcaagctcaccgaccgccgcgagttcaaggccaaggtggtgggtagcgacgagcaatacgacgtggcgctgctgaagatcgaggccaagggcctgccgaccgtgcgcctgggcgattccaacacgctcaagccggggcagtgggtggtggcgatcggctcgccgttcggcctggatcactcggtcaccgccggcatcgtcagcgccaccggccgcagcaatccgtacgccgaccagcgctacgtgcccttcatccagaccgacgtggcgatcaaccagggtaattccggcggcccgctgctcaatacgcgtggcgaagtggtcggcatcaattcgcagatcttctccgcgtccggcggctacatgggcatcagtttcgcgatcccgatcgacctggccttcagcgcggccgagcagatcaaggccaccggccacgtgagtcgcggcatgctgggcgtggcggtcggcccgatcgactcgctcaaggcgcaaggcctgggcttgccggatagccgtggtgccctggtcaacgatatcccggccggtagcccggcggccaaggccggcatcgaggtgggcgatgtgatccgggcggtgaacggcaagtcgatcgatgtcgccagcgatctgccgccaatgatcgggctgatggcgcctggtaccaaggtgaccctggacgtcttgcgcgacggcaagccgcgcaccgtgacggtcaccctggcaccgttgcaggacggcaccgggaacgccgcgccgcgcaccgccgccgaggaggccaagcccggcgcgccggccagcgtggagttgctcggcctgcaagtcgccgacctgaccgccgccgaacgcagccgcctgggcctggaagtgggcgagggtgtgcgtattgccgcggtcacgggcgcggcggcacgcagcacccagccgccgctgtcgccggggctgatcatcgcccgcgtgggccggaccaaggtcggcagcgtcgccgagctcaaccgcgccctgtccagctacaagaagggcgacgtggtcatgctgctggtgaccgacggcaaggcgaccagctacgtggccttgaaggccggcggctaa

SEQ ID NO: 28976 - protein, 525 aa, Xanthomonas axonopodis
MNHRIRTQMFGLIAMTLPLAACAQQPAPAAKDLAPIAANRSATPAPQLVAGLPDFTNLVEQVGPGVVNIETTITRKDAMARQQRSGPGGRGGGAMPDDDQMPEFFRRFFGPDFQMPGGPRQGPGGGDDDGGIAGKSMGSGFIISADGYVLTNHHVVDGASEVTVKLTDRREFKAKVVGSDEQYDVALLKIEAKGLPTVRLGDSNTLKPGQWVVAIGSPFGLDHSVTAGIVSATGRSNPYADQRYVPFIQTDVAINQGNSGGPLLNTRGEVVGINSQIFSASGGYMGISFAIPIDLAFSAAEQIKATGHVSRGMLGVAVGPIDSLKAQGLGLPDSRGALVNDIPAGSPAAKAGIEVGDVIRAVNGKSIDVASDLPPMIGLMAPGTKVTLDVLRDGKPRTVTVTLAPLQDGTGNAAPRTAAEEAKPGAPASVELLGLQVADLTAAERSRLGLEVGEGVRIAAVTGAAARSTQPPLSPGLIIARVGRTKVGSVAELNRALSSYKKGDVVMLLVTDGKATSYVALKAGG

SEQ ID NO: 28977 - DNA, 2077 bp, Klebsiella pneumoniae
  CDS (374)..(1807)
tctagatgcaccttgcaggcatgcaagcttcggccgcctaggccgcggccgcacttgtgtataagagtcaggtcaccggcttggcctatgttgaagcggtaaataaactggcgcgtacggcgcccgaatttgcgctgatggaatactattatcgctgccgtctgattcaggactatatcagcgggatgacggatttgtatgcgtgggatgaatatcggcgactcatggcggtggaataggctggagttttgtaaagatggacaataaatttttactttttccagaaacttaattccggaacttagcgttataaaatgactctgatagtcacgtacacagcaactttcgttacctgatattgagattgaaactgatgaaaaaaaccacgttagcaatgagtgcactggctctgagtttaggtctggcgttgtccccgctctctgcgagcgcggcagaaacggcatcttcggccactaatgcacagcagatgccaagcctggccccgatgctggagaaggtgatgccgtcggtggtgagcattaacgttgaaggtagcaccaccgttaataccccacggatgccacgtaacttccagcagttctttggcgataattcgccgttctgccaggatggttctcctttccagagttcgccgttttgccagggcggcggacagggcggtcagcctgacggcggccagcaacagaaatttatggcgctgggctccggcgtcatcattgatgccgccaaagggtatgtggtgaccaacaaccacgtcgttgacaacgccaccacgattaaggttcagctgagcgatggccgtaggtttgatgccaaagtcgtcggcaaagatccgcgctctgatatcgcgctgattcagattcaggatccaaaaaacctgacggcgattaagcttgccgactccgatgcgctgcgcgtcggtgattacaccgtggctatcggcaacccgttcggtctgggcgaaaccgtgacctccgggattgtctccgcgctgggccgtagcggcctcaacgtggaaaactacgaaaactttatccagaccgatgcggcgattaaccgcgggaactccggcggtgcgctggtgaacctcaacggcgagctgatcggtatcaacaccgccattctggcgccggacggcggcaacatcggtatcggttttgctatcccgagcaacatggtgaaaaacctgaccgagcagatggtgaaatatggccaggtgaaacgcggtgagctcggcattatgggcaccgaactgaactctgagctggcgaaagcgatgaaagtcgatgcccagcgcggggccttcgtcagccaggtaatgccaggttcggcggccgcgaaagcgggcattaaagccggcgatgtcatcacgtccctcaacgggaaagcgatcagcagcttcgccgcgctgcgtgcccaggtcggcaccatgcctatcggcagcaaagttgagcttggtctgttgcgcgacggcaaaccggtgaccgtgaccgtcgaactgcagcagagcaaccagacccaggttgactccagcaccatcttcaacgggattgaaggggcagaaatgagcaataagggtcaggataagggcgtggtggtcaataatgtgaaagccggtaccccggcggcacagattggcctcaagaaaggcgatgtcatcattggggcgaatcagcagccggtgaaaaacatcgccgatctgtggaaaatcttcgacgccaaaccgtccgtactggcgctgaacattcagcgcggcgacgcctctatctatctgctgttgcagtaaccgccagcgctcgcttcccagccccttccctcgccgagggcaggggcttttttcgttctgtgaccgcccccacaactccacatatctcaccccggcttagtgcaaatgcacaatgcagcgcgacgatgactcttttatgctggtgcccagcaaaggggaggactacatggctggctggcatcttgataccaaaatggcgcaggatattgtggcgcggaccatgcgcatcatcgataccaatatcaacgtgatggatgcccgtgggcggat

SEQ ID NO: 28978 - protein, 477 aa, Klebsiella pneumoniae
MKKTTLAMSALALSLGLALSPLSASAAETASSATNAQQMPSLAPMLEKVMPSVVSINVEGSTTVNTPRMPRNFQQFFGDNSPFCQDGSPFQSSPFCQGGGQGGQPDGGQQQKFMALGSGVIIDAAKGYVVTNNHVVDNATTIKVQLSDGRRFDAKVVGKDPRSDIALIQIQDPKNLTAIKLADSDALRVGDYTVAIGNPFGLGETVTSGIVSALGRSGLNVENYENFIQTDAAINRGNSGGALVNLNGELIGINTAILAPDGGNIGIGFAIPSNMVKNLTEQMVKYGQVKRGELGIMGTELNSELAKAMKVDAQRGAFVSQVMPGSAAAKAGIKAGDVITSLNGKAISSFAALRAQVGTMPIGSKVELGLLRDGKPVTVTVELQQSNQTQVDSSTIFNGIEGAEMSNKGQDKGVVVNNVKAGTPAAQIGLKKGDVIIGANQQPVKNIADLWKIFDAKPSVLALNIQRGDASIYLLLQ

SEQ ID NO: 28979 - DNA, 1536 bp, Xanthomonas campestris
  CDS (1)..(1536)
atgaccctgccgttggctgcctgcgcgcagcaacccgaagcgccagccaagaccagcgcgccgatcgcggccaaccgcagcaccacgccggcgccgcagctggtggcgggcttgccggatttcaccaatctggtcgagcaggtcggcccgggcgtggtcaatatcgaaaccaccatcacccgcaaggacgccatggcgcgctcgcagcgcggcggtccgggcggacgtggcggcggcgcgatgcccgacgacgagcagatgccggagtttttcaagcgcttcttcggcccggatttccagatgccgggcggcccgcgtcaggggccggggcagggcgatgatgatggcggcatcgccggcaagtcgatgggttcgggcttcatcatttccgccgacggctacgtgctgaccaatcatcacgtggtggatggcgccagcgaggtgaccgtcaagctcaccgaccgtcgcgagttcaaggccaaggtggttggcagcgacgagcagttcgacgtggccctgctgaagatcgaggccaagggcctgccgaccgtgcgcatcggcgattccaacacgctcaagccgggccagtgggtggtggcgatcggttcgccgttcgggctggatcattcggtcactgccggcatcgtcagcgccaccggtcgcagcaatccatacgccgaccagcgctacgtgccgttcatccagaccgacgtggcgatcaaccagggcaactccggtggtccgctacttaatacgcgtggtgaggtggtcggcatcaattcgcagatcttctccgcttcgggtggctacatggggatcagcttcgcgatcccgatcgacctggctttcagtgcggccgagcagatcaaggccagcgggcatgtcagccgcggcatgctgggcgtggccgtcggtccgatcgatacgctgaaagcgcagggtctgggcctgccggatacgcgcggcgcgctggtcaacgacatccccgccggcagcccggctggcaaggccggcatcgaggtgggcgatgtgatccgctcggtcaacggcaaggaaatcgcggtggccagcgacctgccgccgatgatcggcctgatgccgccgggcaccaaggtcagcttgaacgtgctgcgcgacggcaagccgcgccaggtcaccgtcaccctgggcacgctggaaaacgagtctggcagcagcgccccgcgcactgcggccgacgatagcaagccgtccgcgccggccagcgtggagctgctgggcctgcaggttgcggacctgaccgccgccgagcgcagccgcatgggtctggaagcgggtgagggtgtgcgcattgcctcggtcaccggctcggctgcacgcagtacccagccgccactagctccgggcctggtgatcgcccgggtcggccgcaccaaggtcggcagcgttgccgagctgaaccgtgcgctggccagctacaagaagggcgacgtggtgatgctgctggtcaccgatggcaaggccaccagctatgtggcgttgaaggcgggcggctga

SEQ ID NO: 28980 - protein, 511 aa, Xanthomonas campestris
MTLPLAACAQQPEAPAKTSAPIAANRSTTPAPQLVAGLPDFTNLVEQVGPGVVNIETTITRKDAMARSQRGGPGGRGGGAMPDDEQMPEFFKRFFGPDFQMPGGPRQGPGQGDDDGGIAGKSMGSGFIISADGYVLTNHHVVDGASEVTVKLTDRREFKAKVVGSDEQFDVALLKIEAKGLPTVRIGDSNTLKPGQWVVAIGSPFGLDHSVTAGIVSATGRSNPYADQRYVPFIQTDVAINQGNSGGPLLNTRGEVVGINSQIFSASGGYMGISFAIPIDLAFSAAEQIKASGHVSRGMLGVAVGPIDTLKAQGLGLPDTRGALVNDIPAGSPAGKAGIEVGDVIRSVNGKEIAVASDLPPMIGLMPPGTKVSLNVLRDGKPRQVTVTLGTLENESGSSAPRTAADDSKPSAPASVELLGLQVADLTAAERSRMGLEAGEGVRIASVTGSAARSTQPPLAPGLVIARVGRTKVGSVAELNRALASYKKGDVVMLLVTDGKATSYVALKAGG

SEQ ID NO: 28981 - DNA, 1473 bp, Ralstonia solanacearum
  CDS (1)..(1473)
atgacgcgtcaaaccatggcacgcagcgcggtcgggctggccgcagtgctggccgttgcgggcggctatgcctatctgcagaaggacgtgatgacgcgcgcggtggccgcgccgctggcggcctccgcgaccgcccaaacctcggccgccccgatggcggtggccgtgccgatggacttctccgccatcgtcgagcgctacggtccggcggtggtcaacatcagtaccaccgcgcgcgcgcagcgcacctccatccagggtttgccgcccggcgtgagcccggacgatccgttcgccgagttcttccggcgcttcatgccccaggcgccgcagcagcagggcgaccaggtcgtcaagggcctgggctccggcttcatcgtgtcgcctgacgggctgatcctgaccaacgcccacgtggtcgacggcgcgcaggaagtcagcgtcaagctgaccgaccgccgcgagttcaaggccaaggtgctgggggtggacaagcaatccgacgtggccgtgctgcgcatcgcggccagcaacctgccgaccgtgcagatcggcagtccggccggcaccaaggtgggcgagccggtgctggcgatcggctcgccgtacggcttcgagaacactgtcaccgcgggcatcgtgagcgccaagtcgcgctcgctgccggacgacacctacgtgccgttcatccagaccgacgtggccgtcaatcccggcaactcgggcggcccgctgttcaaccagcgcggcgaggtgatcggcatcaactcgcagatctacagccagaccggcggctaccagggcctgtcgttcgccgtgccgatcgacgtggcgatgaaggtggagcagcagctggtggccaccggcaaggtcacgcgcggccggctgggcatttcggtgcaggaggtcgaccagtcgctggccgattccttcaacctgcccaagccggaaggcgcgctggtcaacgcggtggaaaaagacggccctgccgccaaggccggcctgcagcccggtgacgtgatcctgcagatcggcgacgtgcacatcggccattcgggcgacctgcccgagcaggtggccgagatcaagccgggctcgaccgtgccgctgcagatcatccgccacggcaagccgaccgcgctgtcggtcaccgtgggcgaggccaaggatgccaaggtcgccgccaatacgtccgccgcgcccgacaagggccgcctgggcctggccgtgcgcccgctgcaggcggaagaaaagcgccagagcggcctgcccggcggtctggtggtgatggactcgagcggcccggccgccaaggcgggcatccagccgggcgacgtgatcctgtcgctcaacggcacgccggtgtcgtcggcgcaggaactgcgcgcgctggtggatcgcgccggcaagcacgtggcgctgctggtgcagcgcgacgatgccaagatcttcgtgccgctggacctgggctga

SEQ ID NO: 28982 - protein, 490 aa, Ralstonia solanacearum
MTRQTMARSAVGLAAVLAVAGGYAYLQKDVMTRAVAAPLAASATAQTSAAPMAVAVPMDFSAIVERYGPAVVNISTTARAQRTSIQGLPPGVSPDDPFAEFFRRFMPQAPQQQGDQVVKGLGSGFIVSPDGLILTNAHVVDGAQEVSVKLTDRREFKAKVLGVDKQSDVAVLRIAASNLPTVQIGSPAGTKVGEPVLAIGSPYGFENTVTAGIVSAKSRSLPDDTYVPFIQTDVAVNPGNSGGPLFNQRGEVIGINSQIYSQTGGYQGLSFAVPIDVAMKVEQQLVATGKVTRGRLGISVQEVDQSLADSFNLPKPEGALVNAVEKDGPAAKAGLQPGDVILQIGDVHIGHSGDLPEQVAEIKPGSTVPLQIIRHGKPTALSVTVGEAKDAKVAANTSAAPDKGRLGLAVRPLQAEEKRQSGLPGGLVVMDSSGPAAKAGIQPGDVILSLNGTPVSSAQELRALVDRAGKHVALLVQRDDAKIFVPLDLG

SEQ ID NO: 28983 - DNA, 1518 bp, Ralstonia solanacearum
  CDS (1)..(1518)
atgcgtaccgctcgaaccgtttacgccttgcgtctgctttgcgttgccgccgtcttcgctgccggtggcgcgctgatgccggcttacgcgcagaacgccaccggtagcgtggcgacgggcacctatggcctgcctgactttgccgatctggtcgaaaaggtcagcccggcggtggtcaatatccgcaccaccgagaaggtgcggatgcagaacaacccgagcgatgacgacatggccgagtttttccgccgcttcttcggcgtaccgatgccgggtacgccggggcaggggcagggccagaagcgccgcaacgccccgccgcaggccgaggaggagcagagtcgcggcgtcggctccggcttcatcatgtcgggcgacggctatgtgctgaccaacgctcacgtggtcgaaggcgcggagacgatctacgtgacgctgaccgacaagcgtgaattcaaggccaagctgatcggctccgacaagcgcaccgatgtggcgctggtcaaggtggaggccaccggcctgccgagcctgaagctgggcgattcggacaaggtgcgtgtgggcgagtgggtgctggcgattggttcgccgttcgggctggacaacaccgtcaccgcgggcatcgtgtcggccaaggggcgtgacaccggcgattatctgccgttcatccagtccgacgtggccgtgaatcccggcaactcgggcggcccgctgatcaacctgcgtggcgaggtgatcggcatcaacaaccagatcttcagccagagcggcggctacatgggcatctcgttcgcgattccgatcgatgaagcgatgcgcgtggccgagcagctcaagacgcaaggccgggtgacgcgcggccgcatcggtgtggcgatcgacaatgtgccgaaggacgcagcggagtcgctgggcctaggccgtgcgcgtggcgcctatgtgggcaatgtcgagtcgggtggccccgccgacaaggcaggcatcgaggccggcgacatcgtcctgaaattcaatgggcgcgacgtcgagaaggccggtgacctgcagcgtcaggtcggcgagagcaagcctggtacgcgcgccaccgtgcaggtgtggcgcaagggcgcgacgcgtgatctgacggtgacggtggccgaactgcagcccgataccaaggtggcgcagcggggcaaaggtggccaatccgacaatggccagccgggcgccggcaagcagaatgcgcttgggctggtggtggccgatctgtcggaaggcgcgcagcgagagttcaagacgaaggcaggcgtcgaggtgcaggtggcggatggtcccgccgcgcgcgccggcatccgcccgggagacgtgatcctgcgcgtgggcgacaccgatgtcaccagcgccaagcaattcaacgacgtggtcggccggctggacaagagtcgcatggtggcggtgttcgtccgccgtggcgatgccacgcaggtcgtgacgatgcgaccgagcacggcgcgggccggcggcggccagccgtga

SEQ ID NO: 28984 - protein, 505 aa, Ralstonia solanacearum
MRTARTVYALRLLCVAAVFAAGGALMPAYAQNATGSVATGTYGLPDFADLVEKVSPAVVNIRTTEKVRMQNNPSDDDMAEFFRRFFGVPMPGTPGQGQGQKRRNAPPQAEEEQSRGVGSGFIMSGDGYVLTNAHVVEGAETIYVTLTDKREFKAKLIGSDKRTDVALVKVEATGLPSLKLGDSDKVRVGEWVLAIGSPFGLDNTVTAGIVSAKGRDTGDYLPFIQSDVAVNPGNSGGPLINLRGEVIGINNQIFSQSGGYMGISFAIPIDEAMRVAEQLKTQGRVTRGRIGVAIDNVPKDAAESLGLGRARGAYVGNVESGGPADKAGIEAGDIVLKFNGRDVEKAGDLQRQVGESKPGTRATVQVWRKGATRDLTVTVAELQPDTKVAQRGKGGQSDNGQPGAGKQNALGLVVADLSEGAQREFKTKAGVEVQVADGPAARAGIRPGDVILRVGDTDVTSAKQFNDVVGRLDKSRMVAVFVRRGDATQVVTMRPSTARAGGGQP

SEQ ID NO: 28985 - DNA, 1368 bp, Salmonella typhimurium
  CDS (1)..(1368)
atgaaaaaacacacccagctgttaagtgcattagcgttaagtgtcgggttaactctttcggcgccgtttccagcccttgcatcgataccaggccaggtgccaggccaggcgacgctgccaagccttgcccctatgctggagaaagtgctgcctgctgtcgtcagcgtaaaagtcgagggaaccgccgcccagagccaaaaagtgccggaggagtttaaaaaattctttggcgaggatctgccagaccagccgtcccagccgtttgaaggactcggttcgggggtgattatcgatgccgcgaaaggctatgtattaaccaataatcatgtgattaatcaggcacagaagatcagcattcaactgaatgacggacgcgaattcgacgcgaagcagatcggcggcgacgaccagagcgatatcgctctgttacaaattcagaatcccagcaagttaacgcaaattgccatcgccgattccgacaaactccgcgtcggcgatttcgccgtggcggtcggtaatccgtttggtcttggacaaaccgccacctccgggattatttcagcgctgggacgcagcgggcttaatctggaagggcttgagaactttattcaaaccgatgcctctattaaccgcggcaactccggcggcgcgctgcttaacctgaacggcgagctgatcgggattaataccgcgatcctcgcgccagggggcgggagcatcggcattggctttgctattccttccaatatggcgcagacgctggcgcagcagttgattcagttcggcgaaatcaaacgcggattgctgggaattaaaggcactgaaatgaccgctgatatcgccaaggcattcaaactgaacgttcagcgtggcgcttttgtcagcgaggttttacccaattcaggttcggcgaaggccggggtgaaatccggagacgtgattatcagtcttaacggtaagcagctgaatagctttgccgaactgcgttcacgtatcgccaccaccgaaccgggcacgaaagtgaagctgggcctgctgcgcgatggtaagccgctggaggtggaagtcacgctggattccaatacctcttcttccgccagcgccgaaatgatcgccccggcgttgcaaggcgcaacgttgagcgacggccaactgaaagacgggacgaaaggcgttaaggttgatagcgtcgaaaaaagcagtcctgccgcgcaggccggtttgcaaaaagatgatgttatcatcggcgttaatcgcgatcgcatcagttctatcgccgaaatgcgcaaagtgatggcggcaaaaccgtccatcattgctcttcaggtagtacgcggcaacgagaacatttatctattgctgcgctaa

SEQ ID NO: 28986 - protein, 455 aa, Salmonella typhimurium
MKKHTQLLSALALSVGLTLSAPFPALASIPGQVPGQATLPSLAPMLEKVLPAVVSVKVEGTAAQSQKVPEEFKKFFGEDLPDQPSQPFEGLGSGVIIDAAKGYVLTNNHVINQAQKISIQLNDGREFDAKQIGGDDQSDIALLQIQNPSKLTQIAIADSDKLRVGDFAVAVGNPFGLGQTATSGIISALGRSGLNLEGLENFIQTDASINRGNSGGALLNLNGELIGINTAILAPGGGSIGIGFAIPSNMAQTLAQQLIQFGEIKRGLLGIKGTEMTADIAKAFKLNVQRGAFVSEVLPNSGSAKAGVKSGDVIISLNGKQLNSFAELRSRIATTEPGTKVKLGLLRDGKPLEVEVTLDSNTSSSASAEMIAPALQGATLSDGQLKDGTKGVKVDSVEKSSPAAQAGLQKDDVIIGVNRDRISSIAEMRKVMAAKPSIIALQVVRGNENIYLLLR

SEQ ID NO: 28987 - DNA, 1512 bp, Rhizobium meliloti
  CDS (1)..(1512)
atgtcgaaacgacccgaattcttccgcggcctggtgctggcggccgcgacggcactcatattcaccaatgcgacgctggcccagacggccacgtcccggcctccggccggcccgccgtccgtcgccgatctcgccgagggactgctcgacgccgtcgtcaacatatcgatttcgcagaacgtcaagagcgacgacgacaatgcgccgatgccgcaggtgccggaaggatcgccgcatcaggagttcttcgacgagtttttcaggggacagggcggcgagggcggccggccgcgcacggtcaactcgctcggttcgggcttcatcatcgatccggccggctacatagtcaccaacaaccacgtcattcaggatgccgacgatatcgagatcaacttctccgatggatcgaaactgaaggcgaagcttgtcggcatggatacgaaaaccgacctcgccctcctgaaggtcgaaccgaagaagccgctcaaggccgtctccttcggcgactcgcgaaagatcaggatcggcgattgggtgatggtcgtcggcaatccgttcggccttggcgtatccgtgtccgtgggtgtcgtctccgcacgcggtcgcaatatcaatgccggaccctacgacagtttcatccagaccgacgcggcgatcaaccgcggcaattcgggcggtccgctcttcaacatgcagggtgaggtcgtcggcatcaatacggcgatcctttcgcagaccggcatgtcggtcggtatcggctttgccgtgccggcggagcttgcggtgaacgtcgtcaatcaactcaaggaattcggcgaaacccgccgtggctggctcggtgtacggatccagcccgtcacggacgatatcgccgagagcctgaagatggagctgccacgcggcgcgctcgtttcgggcatcatcgaaggcggtccgatcaccaagggcgagatcaagccgggcgacatcatcatccgcttcgacggaacggatatcgcggaaatccgcgacctcatgcgcactgtcggcgagagcccggtcggcaaggcggtcgatgtggtcatcatccgcgacggcaaggaacagaccgttcgcgtgacgctcggtcggctggaggacggcgagcagctcgccaatgcgaaaccgggggaagtgctgccgaatggcggtgaggcgaagcccggcgagccgccggccgcgcaactgcctgcgagtgacacggtgctcggaatgaagcttgccgagctcgacgccgacagtcgccagagtttcggcatcgccgaaagcgtcaaaggcgtcgtgatcaccgaggtacagcccaattcgcccgcggccgagcgtcgggtagagccgggcgaggtgatcgtcgaactcggtcaggaagcaatggaaacgccggaggatgtcacctcacgcgtcaccgaactgaaggccgacgggcgccgcaacgccttgctgatgatcgcgaacaagagcggcgaactgcgcttcgtgacggtgcggatggaatag

SEQ ID NO: 28988 - protein, 503 aa, Rhizobium meliloti
MSKRPEFFRGLVLAAATALIFTNATLAQTATSRPPAGPPSVADLAEGLLDAVVNISISQNVKSDDDNAPMPQVPEGSPHQEFFDEFFRGQGGEGGRPRTVNSLGSGFIIDPAGYIVTNNHVIQDADDIEINFSDGSKLKAKLVGMDTKTDLALLKVEPKKPLKAVSFGDSRKIRIGDWVMVVGNPFGLGVSVSVGVVSARGRNINAGPYDSFIQTDAAINRGNSGGPLFNMQGEVVGINTAILSQTGMSVGIGFAVPAELAVNVVNQLKEFGETRRGWLGVRIQPVTDDIAESLKMELPRGALVSGIIEGGPITKGEIKPGDIIIRFDGTDIAEIRDLMRTVGESPVGKAVDVVIIRDGKEQTVRVTLGRLEDGEQLANAKPGEVLPNGGEAKPGEPPAAQLPASDTVLGMKLAELDADSRQSFGIAESVKGVVITEVQPNSPAAERRVEPGEVIVELGQEAMETPEDVTSRVTELKADGRRNALLMIANKSGELRFVTVRME

SEQ ID NO: 28989 - DNA, 1398 bp, Rhizobium meliloti
  CDS (1)..(1398)
atgatcttcggccatcgagctctcgcggctctcgtgcttgctgttgccatatcgacacctgcgatggcccaggatgccaggaccgtgccgcagtcgcggtcggagatgcagctctctttcgcgccactcgtcaaacagactgcgaatgcagtcgtgaacgtctatgccgagcgcgtggtggagcgccgctcgatctttgccggggaccctttcttcgaggaattcttcgggcagcggatgccgaatcgcaccgagaagcagtcgtctctggggtcgggcgtcatcgtcggccgcaatggcctggtcgtgaccaacaaccatgtcatcgagggggccgacgatatcaaggtggcgctggccgacgggcgtgagtttccctgcaagatcatcctgaaggatgatcgcctcgatctggcggtcctgaaaatccagtcggacggtccgttcgacatcgtcccgatcggtgattccgacgcggtggaggtcggcgacctggtgctggcgatgggcaatcctttcggcgtcgggcagacggtgacgagcggcatcgtgtcggcgctcgcccgcaaccagatctccaacggcgatttcggctttttcatccagacggatgcggcgatcaatccgggcaattccggcggcggcctgatcaacatgaagggcgagttgatcggcatcaatactgcgattttttcgagaggcggcggttccaacggtgtgggctttgcgatccccgccaacttggtcaaggttttcgttgcctccgctgaaggaggcaacggctcgttcatccgtcccttcgtcggcgcgaccttcgagccggtgacctccgacgtggccgaggcgcttgggcttgagcgggcgcgcggggcgctggtgacggcggtcgtcgcaggcggtccggccgagagcgccggcatgcgccccggacaggtggtcaccgccgtcaacggcataccggtcgaacaccccgatgcgctcggctatcgtctgaccaccgtggggatcggtcacgaggcgcgtgtgacggtttcggagaacggcggttcgcgcgaaatcaccctcaagcttgagcgggcgccggaaacgcagccacgagacgaacggctgatcgaggggcgcaatcccttcgccggcgctgtcgtggcaaatctctcgccccggcttgcggaggagttgcgcatgcccacgtcgctgcagggcgtggtcatcacggagatcaatcgcggctcgccggctgcgcgtatcggcctggaaccgaaggacatcgttcgttcggtcaacgggacggcaatcgacagttcgaagacgctggaaagcgtcgtcgccgaggatgcctccttctggcgtgtcgagatcgagcgcaacggtcagatcatccgtcagttcttccgatga

SEQ ID NO: 28990 - protein, 465 aa, Rhizobium meliloti
MIFGHRALAALVLAVAISTPAMAQDARTVPQSRSEMQLSFAPLVKQTANAVVNVYAERVVERRSIFAGDPFFEEFFGQRMPNRTEKQSSLGSGVIVGRNGLVVTNNHVIEGADDIKVALADGREFPCKIILKDDRLDLAVLKIQSDGPFDIVPIGDSDAVEVGDLVLAMGNPFGVGQTVTSGIVSALARNQISNGDFGFFIQTDAAINPGNSGGGLINMKGELIGINTAIFSRGGGSNGVGFAIPANLVKVFVASAEGGNGSFIRPFVGATFEPVTSDVAEALGLERARGALVTAVVAGGPAESAGMRPGQVVTAVNGIPVEHPDALGYRLTTVGIGHEARVTVSENGGSREITLKLERAPETQPRDERLIEGRNPFAGAVVANLSPRLAEELRMPTSLQGVVITEINRGSPAARIGLEPKDIVRSVNGTAIDSSKTLESVVAEDASFWRVEIERNGQIIRQFFR

SEQ ID NO: 28991 - DNA, 1551 bp, Rhizobium loti
  CDS (1)..(1551)
atgaatattgcccccaattcatattcccgcacccgcaagcgtctcctggctgccgctgcttccgtcgccgttgccggcgtgatcggcgttggcgcgctgaccagcggaaccagccccgttctggccgacgccgtacgcgtcgaggcgccgcaggtgcaaggcttcgccgatgtcgtcgagcgcgtttcgcccgccgtggtcagcgtcaaggtgaaggccaagatccagccgaccgccgatgacggctccgatgaccaggatggcttcgacaatcttcccaacaatccgcagctgcgccgcttcttcaaggaattccgcggctttggcgatcagggcggccagaatgatgaaggccatcgccgcttcggtcaccgcgaccgcagcaatgaccagccgcgcccggtggcgcagggctccggcttcttcatctccgaggacggctacctcgtcaccaacaaccacgtcgtcgaagaaggcaccgccttcaccgtggtgaccaatgacggcaaggaactcgacgccaagctggtcggcaccgacccgcgcaccgatctcgccgtgctcaaggtcgaaggcggtggcaagttcacctatgtcgacttcgccgacgattccaaggttcgcgtcggcgactgggtcgtggccgtcggcaatccgttcggcctcggcggcacggtcaccgccggcatcgtgtcggcgcgcggccgtgacatcggcgccggcccctatgacgatttcctgcagatcgacgcctcggtcaaccgcggcaattcgggtggcccgaccttcaacctcaatggccaggtggtcggtatcaacacggcgatcttctcgccctcgggcggcagtgtcggcatcgccttcgacattcctgcctcgaccgccaagcaggttgtcgaggacctgatgaagagcggcgcggtgcagcgcggctggctcggcgtcgaaatccagccggttacctccgacatcgccgaatcgctcggtctgaagtccaacaatggcgcgttggtgtccagcgcccaggacgatggccccggcaagaaggccggcatcacggctggtgacgtcatcacccaggtcgagggcaaggacgtcgcttcgccgaaggaactcgcccgcctgattggcgcctattcgcccggcaagtcggttgacgtcaccgtctggcgcgacggcaagagccagacgatcaaggtcgatctcggcaagctgccggccagcgacaagcaggcctcgaacgaccagcagcagcagcctgccgctccggcaaaacctgatacgctggccgatctcggcctcaccgtcaccaagtccgaaaacggcaaggggcttgtggtgaccgatgtcgatcccgaaagcgctgcggccgaccgcggcatccagccgggagacatcatcaccgcggtcaattcgaacgaagtgaatggcaccgacgatgtcaccaaggcgatgaccgacgcggtgaagtccggccgcaaggcggtgctgatgcagatcacccgcgacaacaacaaccgttttgtcgcgctgcccgtcgccaagggctga

SEQ ID NO: 28992 - protein, 516 aa, Rhizobium loti
MNIAPNSYSRTRKRLLAAAASVAVAGVIGVGALTSGTSPVLADAVRVEAPQVQGFADVVERVSPAVVSVKVKAKIQPTADDGSDDQDGFDNLPNNPQLRRFFKEFRGFGDQGGQNDEGHRRFGHRDRSNDQPRPVAQGSGFFISEDGYLVTNNHVVEEGTAFTVVTNDGKELDAKLVGTDPRTDLAVLKVEGGGKFTYVDFADDSKVRVGDWVVAVGNPFGLGGTVTAGIVSARGRDIGAGPYDDFLQIDASVNRGNSGGPTFNLNGQVVGINTAIFSPSGGSVGIAFDIPASTAKQVVEDLMKSGAVQRGWLGVEIQPVTSDIAESLGLKSNNGALVSSAQDDGPGKKAGITAGDVITQVEGKDVASPKELARLIGAYSPGKSVDVTVWRDGKSQTIKVDLGKLPASDKQASNDQQQQPAAPAKPDTLADLGLTVTKSENGKGLVVTDVDPESAAADRGIQPGDIITAVNSNEVNGTDDVTKAMTDAVKSGRKAVLMQITRDNNNRFVALPVAKG

SEQ ID NO: 28993 - DNA, 1542 bp, Rhizobium loti
  CDS (1)..(1542)
atgtcacctcttggtattcttcgtaggcatcgcgtcgcggccctgctgggcgctgcgctgatcatctcccccgtcgtcgtctcgttcgcccagagcgcgaacagcaccggcgtcagcaaaattgtcgcgacgacccagaccccggttgccggcatcaccgcccccaacggctcgttcgcgccgatcgtggcggccgacaagccggcggtggtcacggtcaccagcatcatgaaggggcagccggcaagtgacgacgacggcatgcctctcggcaactcgccgttcgaccagtatttccgccagttcttcggcgaccagggcatgcccgctccgcagacgccgccgcaacaggcgcaacgggccgaagcgctcggttccggcttcattgtcacagccgacggcaccgtcgtcaccaacaatcacgtcgtcgacggcgcctcttcgatcaaggtgacgctcgatgacggcaccgaacttcccgccaagcttgtcggccgcgacgccaagaacgacctcgccgtgctcaagatcaaatccgacaagcccttgccgacggtcaaatggggcgattccgacaggctgatgaccggcgatcaggtgctggcgatcggcaatccgttcggcatcggcaccacggtcaccgccggcatcgtttcggcacgcggccgcgacctgcatagcgggccgttcgacgacttcatccagatcgacgcgccgatcaaccacggcaattccggcggcccgcttgtggatgtgaacggcaatgtcgtcggcatcaacacggcgatctattcgcccaatggcggcagtgtcggcgtcggcttcgccatcccgtcggaccaggcccaaaaggtcgtcgccaagctgatgaaggacggttccatccagtacggctatctcggcgtcgagatccaagaggtgacgccggacgtggcaagcgccatcgggctcgatcatgccggcggcgcgctggtttccaaggtcaatgacagctcgcccgccgccagcgccggcgtcgaggccggcgacgtcatcaccggcttcgccggtcaggacgtgaaagaccccaaggatctgtcgcgcgccgtcgccgatgtcgcacccggcgccaaggaaacgctggatgtctggcgcaagggcaaggcgatgcagatttccgtcgaagtcgggcaaaacagcgacgatgtgaagacggcgtcggccggcgaatccggcgcaccgagcgccgagcagggctcgcgtgcgccggcgattggccttggcctgatggacatcacgcctgacattcgccaggaaatgaacctcgccggcaatgagcatggcgcggtggttgcgcgcgtcaatcccgacaaggcggccgccgctgccggcattcagccgggcgacatcatcgtcgccgtcaaccaggccccggtgaagagcgccaggcaggtcacgcaggcgattgcgcaggccagcaaatcgggccgcaagtcggtgctgcttttggtcgaacgcgacggcggccagctctatgtcgccgtgccgttcgccaatggctga

SEQ ID NO: 28994 - protein, 513 aa, Rhizobium loti
MSPLGILRRHRVAALLGAALIISPVVVSFAQSANSTGVSKIVATTQTPVAGITAPNGSFAPIVAADKPAVVTVTSIMKGQPASDDDGMPLGNSPFDQYFRQFFGDQGMPAPQTPPQQAQRAEALGSGFIVTADGTVVTNNHVVDGASSIKVTLDDGTELPAKLVGRDAKNDLAVLKIKSDKPLPTVKWGDSDRLMTGDQVLAIGNPFGIGTTVTAGIVSARGRDLHSGPFDDFIQIDAPINHGNSGGPLVDVNGNVVGINTAIYSPNGGSVGVGFAIPSDQAQKVVAKLMKDGSIQYGYLGVEIQEVTPDVASAIGLDHAGGALVSKVNDSSPAASAGVEAGDVITGFAGQDVKDPKDLSRAVADVAPGAKETLDVWRKGKAMQISVEVGQNSDDVKTASAGESGAPSAEQGSRAPAIGLGLMDITPDIRQEMNLAGNEHGAVVARVNPDKAAAAAGIQPGDIIVAVNQAPVKSARQVTQAIAQASKSGRKSVLLLVERDGGQLYVAVPFANG

SEQ ID NO: 28995 - DNA, 1515 bp, Rhizobium loti
  CDS (1)..(1515)
atgacatccacaccccttttgcgcgcggcacggcggacattgatcgccggcacggcagcgctgcttgtcggcactgtcgccgccccgtccttcgtgacgccggtcttcgcggccgatgggcctgcttcggtcgccgacctggcgcagggcgtgctcggcgcggtggtcaacatctcgacttcgcagacggtgaagggcacggaagggccgggcgcggtgccgatgccgcagcttcccgagggctcaccgttccaggacttcttcgacgacttcttcaagaaccgaggcggcgacaaggacaatagcgggcagaaggtgcagtcactgggatccggcttcgtcatcgacgccgagcaaggcatcgtcgtcaccaacaaccacgtgatcgccgacgccgacgacatcgaagtgaatttctccgatggcgtgacgctgaaggcgacgctggtcggcaccgacaccaagaccgacgtcgcggtgcttaaagtcgatccgaagggccacaagctgaccgcggtgaagttcggcgattccaccaagatgcgcgtcggcgactgggtgatggcggtcggcaatccattcggcctcggtggtacggtcacggtcggcatcgtttcggcgcgcaaccgcgatatcaattccggtccctacgacgatttcatccagaccgatgccgcgatcaatcgcggcaattcgggcgggccgctgttcaacagcgccggcgaagtcatcggcatcaacacggcgatcatctcgccgtccggcggctcgatcggcatcggcttctccatcccctcgcagcttgcctcgggcgtcgtcgaccagttgcgccagtttggcgagacgcggcgcggctggctcggcgtgcgcatccagccggtgacggacgacattgccgaaagcctcggcatggcgacagccaagggcgcgctggtggccggcgtcatcaagggcgggccggtcgacaacggcaccatccaggccggcgacgtcatcatcaagttcgacggcaaggacatccatgaaatgcgcgacctgccgcgcgtcgtcgccgaaagccccgtcggcaaggccgtcgacgtgctgatcgtgcgcaagggcgtcgagcagacggtgaaggtgacgctcggccggctcgaggatggcgagaagctcgccagtggcgggaacggtaataccgaccaggataagggcaacaaggctccggccgtttcgaccgcctcggtgctcggcatgaccgtcggcgaactcaatgacgagacgcgcaagaagttcagcatcgccgccgatgtctccggcgtcgtcatcaccgacgtggccaaggactcggccgccgccgagcgcggcatccagccgggtgaggtgatcaccgagatcgcgcaggaatcggtcgccacgcccaaggatgtcatggaccggatcggtgcgctcaaggagcagggccgcaagaacgcgctcctgatgctggcgtcgaagacaggcgagttgcgcttcgtgacgatccggatggattga

SEQ ID NO: 28996 - protein, 504 aa, Rhizobium loti
MTSTPLLRAARRTLIAGTAALLVGTVAAPSFVTPVFAADGPASVADLAQGVLGAVVNISTSQTVKGTEGPGAVPMPQLPEGSPFQDFFDDFFKNRGGDKDNSGQKVQSLGSGFVIDAEQGIVVTNNHVIADADDIEVNFSDGVTLKATLVGTDTKTDVAVLKVDPKGHKLTAVKFGDSTKMRVGDWVMAVGNPFGLGGTVTVGIVSARNRDINSGPYDDFIQTDAAINRGNSGGPLFNSAGEVIGINTAIISPSGGSIGIGFSIPSQLASGVVDQLRQFGETRRGWLGVRIQPVTDDIAESLGMATAKGALVAGVIKGGPVDNGTIQAGDVIIKFDGKDIHEMRDLPRVVAESPVGKAVDVLIVRKGVEQTVKVTLGRLEDGEKLASGGNGNTDQDKGNKAPAVSTASVLGMTVGELNDETRKKFSIAADVSGVVITDVAKDSAAAERGIQPGEVITEIAQESVATPKDVMDRIGALKEQGRKNALLMLASKTGELRFVTIRMD

SEQ ID NO: 28997 - DNA, 1287 bp, Rhizobium loti
  CDS (1)..(1287)
atgcagctttcgttcgcgccgctggtcaagcagacggcgccggccgtggtcaacgtctatgcctcgcagacggccaaggtcacatcgccttttgaaggcgatccgttcttcgaggagtttttcggccgtgcccagccgcgcgcgcagtcctcgctgggctcgggcgtgctcgttgatccaagcggtgtcatcgtcaccaatttccatgtcatcaaggatgccgacgaggtcaaggtggcgaccgccgacggccgtgagttcaccagcaaggtgatgctcaaggacgagacgctcgatctcgccgtgctcaagatcgaatccgacaagccgttcccggtcatcgccattggcgattccgacgcgctcgaggtcggcgacctggtgctggccatcggcaatcccttcggcgtcggccagaccaccaccagcggcattgtttccgcacttgcccgcagccatatcggggtctcggattcgggctatttcatccagaccgacgcggccatcaatcccggcaattccggcggcgcgctgatcaacatgggcggtcagctggtcggtatcaacaccgccatctacagccgcagcggcggctcaatcgggatcggcttcgccattcccgccaacatggtgcgggctttcgccgatgcggcaaaggccggcctcgacttcttcgaacgcccctatatcggcgccgagttcgaggcggtgacgccgcagatcgccgactcgctcggcatggaaaagccgaccggtgcgctggtctcttcggtcgacgcgaccgggccagccggtaaggccgggctgaaggcaggcgatgtcgtgctgcagatcaacggcaagccggtcgagagcatcgaggcgctggactatcgcatggcgacgctgtcgatcggcacaaaggcgaatttcgcggtcctgaccaagggccagaaagcggccatggacatcgcgctggagcgggcgccggaaggtgcgaaagcctcggaagtgacgctgcatggccgcagcccgttctcgggcgccaaggtcgcggaactgtcgccgcggcttgcccagaagcttggcctgcgcaccgatctcaaaggcgtgacggtgatcgatatcaaccgcgattcgccagccgccgatttcggcttcctgccaggcgacatcgtgcgcgaggtcaacggcaccacgatcgataccgccgcgacgctggcgcaggtagcccagcaggatacgcgctggtggcgctttaccgtcgagcgcggcgggcagatactgcgccaggtgttgcgttactga

SEQ ID NO: 28998 - protein, 428 aa, Rhizobium loti
MQLSFAPLVKQTAPAVVNVYASQTAKVTSPFEGDPFFEEFFGRAQPRAQSSLGSGVLVDPSGVIVTNFHVIKDADEVKVATADGREFTSKVMLKDETLDLAVLKIESDKPFPVIAIGDSDALEVGDLVLAIGNPFGVGQTTTSGIVSALARSHIGVSDSGYFIQTDAAINPGNSGGALINMGGQLVGINTAIYSRSGGSIGIGFAIPANMVRAFADAAKAGLDFFERPYIGAEFEAVTPQIADSLGMEKPTGALVSSVDATGPAGKAGLKAGDVVLQINGKPVESIEALDYRMATLSIGTKANFAVLTKGQKAAMDIALERAPEGAKASEVTLHGRSPFSGAKVAELSPRLAQKLGLRTDLKGVTVIDINRDSPAADFGFLPGDIVREVNGTTIDTAATLAQVAQQDTRWWRFTVERGGQILRQVLRY

SEQ ID NO: 28999 - DNA, 1446 bp, Pseudomonas syringae
  CDS (1)..(1446)
atgtcgataccacgcatgaaatcctacttttcattgattgccgctgtgctgatgctcggtcaggttgctacggctcaagccgaaaacctgccggacttcaccgggctggtcgagcaggcgtcgcccgcagtggtgaatatcagtacgcgccagaagttgccggaccgtgccgtcgccaatcagcaaatgcctgatctggaaggcttgccgccgatgcttcgcgagtttctcgagcgcagcatgccgccgggttcgcgtccgccaggttcgggtgctggcaagggtgatcgccagcgtgaggcccagtccctcggctcgggtttcatcatctctcctgacggctacgtgctgaccaataatcacgtaatcgacggcgctgacgaaattctcgtacgcctgtccgaccgcagcgagttgaaggccaagctggtgggtaccgatccgcgtaccgacgttgccgtcctgaaaattgaaggcaaggacctgccaactgccaagctgggtaattccaatacgctcaaggtcggcgaatgggtcctggcgatcggctcgccgttcggtttcgaccattccgtgaccaagggcatcgtcagtgccaaggggcgcagcttgcctaacgatacctatgtgccgttcattcagaccgacgtggccatcaatccgggtaactcgggtggcccgctgttcaacatggcgggcgaggtcgtcgggatcaactcgcagatcttcacgcgctccggtggtttcatggggctgtcgttcgcgattccgatcgacgtcgccatggatgtggccaatcagctcaaggccaatggcaaagtcagccgcggctggctgggtgtggtcatccaggaagtgaacaaggacctcgccgagtcgtttggtctggacaagcctgccggcgcgctggttgcgcaagtgcttgaagacggcccggctgccaagggtggtgtgcaggtgggtgacgtgattctgagcgccaacggtcagccaatcgtcatgtcggctgacctgccgcacctgatcggcaacctcaaggacggcagcaaggccgaacttgaagtgattcgcgacggcaagcgtcagaagctgacggtcaccgtcggtgcactgcctgatgaaggtcaggaaatgggcgatgttggcggtacgggtgccgagcgcagcagtaatcgtctgggcgtatcggtgatcgagctgaccgccgagcagaagaaatccctggatctcaaaggtggtgtggcgatcaaggaagtcacaggcggcccggcttcgctgatcggtctgcaggcgggtgatgtgatcactcacctgaacaatcaggcgatcacgtccagcaagcagttcaccgaggtggcgaaaagcctgcccaaggatcgctctgtctcgatgcgtgttctgcgtcagggccgtgcgaccttcattaccttcaagctgtccgagtaa

SEQ ID NO: 29000 - protein, 481 aa, Pseudomonas syringae
MSIPRMKSYFSLIAAVLMLGQVATAQAENLPDFTGLVEQASPAVVNISTRQKLPDRAVANQQMPDLEGLPPMLREFLERSMPPGSRPPGSGAGKGDRQREAQSLGSGFIISPDGYVLTNNHVIDGADEILVRLSDRSELKAKLVGTDPRTDVAVLKIEGKDLPTAKLGNSNTLKVGEWVLAIGSPFGFDHSVTKGIVSAKGRSLPNDTYVPFIQTDVAINPGNSGGPLFNMAGEVVGINSQIFTRSGGFMGLSFAIPIDVAMDVANQLKANGKVSRGWLGVVIQEVNKDLAESFGLDKPAGALVAQVLEDGPAAKGGVQVGDVILSANGQPIVMSADLPHLIGNLKDGSKAELEVIRDGKRQKLTVTVGALPDEGQEMGDVGGTGAERSSNRLGVSVIELTAEQKKSLDLKGGVAIKEVTGGPASLIGLQAGDVITHLNNQAITSSKQFTEVAKSLPKDRSVSMRVLRQGRATFITFKLSE

SEQ ID NO: 29001 - DNA, 1380 bp, Pasteurella multocida
  CDS (1)..(1380)
atgagaaaaagacgttttctattaacaagtattgcactcggattaagcattttatcgacgccgatgataagtcaagcgtccttaccaactcaagttgacggtcagcaagtccctagcctcgcccctatgttagaaaaagtcttaccagcggtggtatctatttctgtggaagggaaagccaagaatcatggtagtacaccatttcaaggtatcccagaagaatttcgttttttctttggtcccgatcttttcaatgatcgcgcaccacgtaatttccgtggtatcggctcaggcgtcatcattaacgctgaaaaaggttatgtgttaacgaataatcacgtcattgacagtgcagataaaatcaccgtgcagttacaagatggtcgagagttaagcgcaaaagtgattggtactgatgaattatctgatgttgcactgattcaaattgaaaaacccaaaaatttgaccgcactaacgattgctgattccgataaactccgcgttggcgattttactgtagctattggtaatccttttggcttgggacaaaccgtgacatctggtatcgtctctgccttaggtcgttcaacgggttcagataacggtacgtatgaaaactatatccaaactgatgccgcagtaaaccgcggaaattcaggaggtcctttaatcaacctacaaggagagctaattggtattaatactgcgattatttcaccaagtgggggaaatgccggcattgcttttgcaattccaagtaatatggcaaataacttagtacaacaaattttagaattcggtgaagtacgtcgtggcatgctaggcattaaagggggcgagctcaacgcggatctagcgaaagcttttgatattgaagctcaacaaggggcatttgtaagtgaagtcttgcctaattctgctgcagaaaaagccggtttaaaagcaggtgatgtcattgtcgcgatgaatggtcagaaaatttccagttttgctgaaatgcgagcaaagatcgcgacatctggtgcagggaaagaaattgctctcacctatctacgcgacggtaaaacacatcaaacaaaggtcacattacaatcagatgatcaaactcaagccgatgcaagtcacttattaccggcattagctggggctgagatgagcaatcatgatgataaaggcgtcaaaggcgtactcatcacgagtgtgacacctaaatcgcttgcagaacaacgtggtttgaaaaagggcgatgtcatcattggggtgaaccgtcaaaaagtagaaaatttaggtcaactgcgtaaaattttagatgcaaaaccttcggcgattgctctaaatattgtgcgtggcaatacgaatttctatcttcttattcaataa

SEQ ID NO: 29002 - protein, 459 aa, Pasteurella multocida
MRKRRFLLTSIALGLSILSTPMISQASLPTQVDGQQVPSLAPMLEKVLPAVVSISVEGKAKNHGSTPFQGIPEEFRFFFGPDLFNDRAPRNFRGIGSGVIINAEKGYVLTNNHVIDSADKITVQLQDGRELSAKVIGTDELSDVALIQIEKPKNLTALTIADSDKLRVGDFTVAIGNPFGLGQTVTSGIVSALGRSTGSDNGTYENYIQTDAAVNRGNSGGPLINLQGELIGINTAIISPSGGNAGIAFAIPSNMANNLVQQILEFGEVRRGMLGIKGGELNADLAKAFDIEAQQGAFVSEVLPNSAAEKAGLKAGDVIVAMNGQKISSFAEMRAKIATSGAGKEIALTYLRDGKTHQTKVTLQSDDQTQADASHLLPALAGAEMSNHDDKGVKGVLITSVTPKSLAEQRGLKKGDVIIGVNRQKVENLGQLRKILDAKPSAIALNIVRGNTNFYLLIQ

SEQ ID NO: 29003 - DNA, 1362 bp, Aeromonas hydrophila
  CDS (1)..(1362)
atgcgtaaacctctttctgtgctcagtgtgttagccctcagtgtcggtatcgccatgtctgcggcccccgtgcaggctgcactgccctcccttttggcgaacaatcaggagatgccgagcctggcgccggtactcgaacaagtcacccctgccgtggtcaacatttccgtctccggcaagaagatcacccgccagcgtctgccggaacagttccgcttcttcttcggccccaacatgcctgacgaacaggtaagcgagcagcccttccaggcgctcgggtccggtgtcatcatcgacgccaagaagggctacgtgatcaccaacgcccacgtggtgcacgaggcggacgagatcaaggtcaacctgaaggatggccgtgaatacgccgccaagaagatcggcgaagacaagcagtccgacatcgctctgctgcaaatcaaggccgaggatctggttcaaatcaaattcgccgactctgacgagctgcgggtcggtgactatgcgctggccatcggcaacccgttcggtctcggccagaccgtcacctccggcatcgtcagtgcactcggtcgcagcggcctcaacatcgagaacctggaaaacttcatccagaccgatgcggccatcaactcgggcaactcgggtggcgccctgctcaacctgcgcggcgagctgatcggcatcaacaccgccatcctgggccccaacggcggcaacatcggcatcggctttgccattccgtccaacatggtgcgcgacctgtccgaacagatcgtgaaatacggtgaagtccgtcgcggccagctgggcatcatagggaccgagctcacctctgaagtggccaagaccttcggctacaacaagaaggacggcgccttcgtcaaccaggtgatgcctgactctgccgccgccaaggccggcatcaagccgggcgacatcatcgtcagcatcgacggcaaggccattcgctccttcggcgagctgcgggccaagattgccaccatgggtgccgacaagcaggtggcactgggcctgatccgcgatggcaaggagcagaccgtcaaggtcaccctgaagaaggcggatgacagcgaaatcctggccagcgcgctgcacccggcactggaaggggccaagctgagcaccaccagcgagccggtgagcggcgtggccgtctccgagatcgatccgcgctcccctgccgccgcctccggtctgcagaagggcgacgtcatcatcggcgtcaaccgcctgcgcatcaactcgctggaagagctgagcaaggcactgaagaacaagccggatgtgctggccctcaacatccagcgcggcgactcttcgctctacctggtaattcgttaa

SEQ ID NO: 29004 - protein, 453 aa, Aeromonas hydrophila
MRKPLSVLSVLALSVGIAMSAAPVQAALPSLLANNQEMPSLAPVLEQVTPAVVNISVSGKKITRQRLPEQFRFFFGPNMPDEQVSEQPFQALGSGVIIDAKKGYVITNAHVVHEADEIKVNLKDGREYAAKKIGEDKQSDIALLQIKAEDLVQIKFADSDELRVGDYALAIGNPFGLGQTVTSGIVSALGRSGLNIENLENFIQTDAAINSGNSGGALLNLRGELIGINTAILGPNGGNIGIGFAIPSNMVRDLSEQIVKYGEVRRGQLGIIGTELTSEVAKTFGYNKKDGAFVNQVMPDSAAAKAGIKPGDIIVSIDGKAIRSFGELRAKIATMGADKQVALGLIRDGKEQTVKVTLKKADDSEILASALHPALEGAKLSTTSEPVSGVAVSEIDPRSPAAASGLQKGDVIIGVNRLRINSLEELSKALKNKPDVLALNIQRGDSSLYLVIR

SEQ ID NO: 29005 - DNA, 1503 bp, Myxococcus xanthus
  CDS (1)..(1503)
atggcctgctcgctcccctcccgccgcttcctcagtgcgctggtccttcttcccgccgccacgcttggcgcttgtggccaagccattggcaccgcgtccgcggcatcgcccgctcccaccgcccaggtcgccgccgctgttccggcgcaggcggcgccgcccatccagaaggcgctcttcaatccggccgtggccggaagccagggcggcatcacctcgctggcgccgctggtggacgcggtgaagggcgcggtggtcaacgtggaggtgcgcgcacggccccgcaggtcagccgccatgcagcgcctgccacccggcatggcggagcgcttcggcctgccgcccgggttcggcggtgaaggcaacggcccggcgcgacagggcgcgggctccggcttcatcatcgacgcctcgggcatcgtcctcaccaacaaccacgtggtggaggacgccgaccaggtgcgcgtgaagctggatgacggacgtgccttcgacgcggaggtgatgggccgcgacccgctcaccgacgtggccctgctgaagctgaagggggcgccgggcaacctgccggcggtgccgctgggggactcggacgcgctgcgcgtgggcgacgccgtcatggccattggcaatcccttcggcctggcgtccagcgtgagcgcgggcatcctctccgcgcgggcccgcgacatccaggcgggcccctatgacgaattcctccagacggacgccgccatcaaccccggcaactccggcgggccgctcttcaacatgcagggcgaggtggtgggcatgaacaccgccatcgtcggcggcgccacgggcatcggcttcgcggtgcccagcaagctcatccaggcgctgctgccgcagctcaaggagacgggcgtggtgcgtcgcggctggctgggcctggccgtacaggacctcacgccggacctggcgcgggcgctgggcctggaagcgatgaagggcgcggtggtggcgggcgtcaaccgcggcagcccgggtgagcgcgccggcctgcgcgaggaggacgtcatcacctccgtcaacggcaagccggtggagtccgcgggcggactgacgcgcgccgtggccctgctccagcccgacagccgcgtgaaggtgaacctgctgcgcggtggcaaggcgcagtcgctggacgtcaccctgggcacgcggcccgcgcagaatggcgagcaagaggtacttccgcgcaacgcttccgcttccgcgccgaggcggctgggcgtgcaactgtcggacgcgcgggacggcggcgcgcaggtagtcgccgtggagccgggcagccccgccgagcgcgggggactggtgccaggcatggtgctggtccaggtgggcgaccagaaaatcgccagcgtgtcggacgccgcccaggcgctgacggccgcgaagcccggcgccgcactgctcctgcgcgtgcgcatgccggggtcggagtccacgctgctgcgcgcggtggaagtcccggagcgctga

SEQ ID NO: 29006 - protein, 500 aa, Myxococcus xanthus
MACSLPSRRFLSALVLLPAATLGACGQAIGTASAASPAPTAQVAAAVPAQAAPPIQKALFNPAVAGSQGGITSLAPLVDAVKGAVVNVEVRARPRRSAAMQRLPPGMAERFGLPPGFGGEGNGPARQGAGSGFIIDASGIVLTNNHVVEDADQVRVKLDDGRAFDAEVMGRDPLTDVALLKLKGAPGNLPAVPLGDSDALRVGDAVMAIGNPFGLASSVSAGILSARARDIQAGPYDEFLQTDAAINPGNSGGPLFNMQGEVVGMNTAIVGGATGIGFAVPSKLIQALLPQLKETGVVRRGWLGLAVQDLTPDLARALGLEAMKGAVVAGVNRGSPGERAGLREEDVITSVNGKPVESAGGLTRAVALLQPDSRVKVNLLRGGKAQSLDVTLGTRPAQNGEQEVLPRNASASAPRRLGVQLSDARDGGAQVVAVEPGSPAERGGLVPGMVLVQVGDQKIASVSDAAQALTAAKPGAALLLRVRMPGSESTLLRAVEVPER

SEQ ID NO: 29007 - DNA, 1476 bp, Shigella sonnei
  CDS (1)..(1476)
atgaaaaaaaccacattagcactgagtcgactggctctgagtttaggtttggcgttatctccgctctctgcaacggcggctgagacttcttcagcaacgacagcccagcagatgccaagccttgcaccgatgctcgaaaaggtgatgccttcagtggtcagcattaacgtagaaggtagcacaaccgttaatacgccgcgtatgccgcgtaatttccagcagttcttcggtgatgattctccgttctgccaggaaggttcaccgtttcagagctctccgttctgccaggggggccagggcggtaatggcggcggccagcaacagaaattcatggcgctgggttccggcgtcatcattgatgccgataaaggctatgtcgtcaccaacaaccatgttgttgataacgcgacggtgattaaagtccagctgagcgatggccgtaagttcgacgcgaagatggttggcaaagatccgcgctctgatatcgcgctgatccaaatccagaacccgaaaaacctgaccgcaattaagatggcggattctgatgcactgcgcgtgggtgattacaccgtagcgattggtaacccgtttggtctgggcgagacggtaacttccgggattgtctctgcgctggggcgtagcggcctgaatgccgaaaactacgaaaacttcatccagaccgatgcagcgatcaaccgtggtaactccggtggtgcgctggttaacctgaacggcgaactgatcggtatcaacaccgcgatcctcgcaccggacggcggcaacatcggtatcggttttgctatcccgagtaacatggtgataaacctgacctcgcagatggtggaatacggccaggtgaaacgcggtgagctggggattatggggactgagctgatctccgaactggccaaagcgatgaaagttgacgcccagcgcggtgctttcgtaagccaggttctgcctaattcctctgctgcaaaagcgggcattaaagcgggtgatgtgatcacctcactgaacggtaagccgatcagcagctttgccgcactgcgtgctcaggtgggtactatgccggtgggcagcaaactgaccctgggcttactgcgcgacggtaagcaggttaacgtgaacctggaactgcagcagagcagccagaatcaggttgattccagctccatcttcaacggcattgaaggcgctgagatgatcaacaaaggcagagatcagggcgtggtagtgaacaacgtgaaaacgggcactccgcgtgcgcagatcggcctgaagaaaggtgatgtgattattggcgcgaaccagcaggcagtgaaaaacatcgctgaactgcgtaaagtgctcgacagcaaaccgtctgtgctggcactcaacattcagcgcggcgaccgccatctacctgttaatgcagtaatctccctcaaccccttcctgaaaacgggaaggggttctccttacaatctgtga

SEQ ID NO: 29008 - protein, 491 aa, Shigella sonnei
MKKTTLALSRLALSLGLALSPLSATAAETSSATTAQQMPSLAPMLEKVMPSVVSINVEGSTTVNTPRMPRNFQQFFGDDSPFCQEGSPFQSSPFCQGGQGGNGGGQQQKFMALGSGVIIDADKGYVVTNNHVVDNATVIKVQLSDGRKFDAKMVGKDPRSDIALIQIQNPKNLTAIKMADSDALRVGDYTVAIGNPFGLGETVTSGIVSALGRSGLNAENYENFIQTDAAINRGNSGGALVNLNGELIGINTAILAPDGGNIGIGFAIPSNMVINLTSQMVEYGQVKRGELGIMGTELISELAKAMKVDAQRGAFVSQVLPNSSAAKAGIKAGDVITSLNGKPISSFAALRAQVGTMPVGSKLTLGLLRDGKQVNVNLELQQSSQNQVDSSSIFNGIEGAEMINKGRDQGVVVNNVKTGTPRAQIGLKKGDVIIGANQQAVKNIAELRKVLDSKPSVLALNIQRGDRHLPVNAVISLNPFLKTGRGSPYNL

SEQ ID NO: 29009 - DNA, 1512 bp, Bartonella henselae
  CDS (1)..(1512)
atggttaaaaaaactttcttcacaacattagccgcagtaagtttttctgctgctttagaaactgcactgttttttagtggatgtggatcaagcttgtggacgacaaaagctcatgcaaattctgtatttagttcattaatgcaacagcagggatttgcagatattgtttctcaagtaaagcctgctgttgtttcagtgcaggtgaagagcaataaaaagaaaaaagaatggttttttagtgatttttttagtactccgggttttgaccaattaccagatcaacatcccttgaaaaagttttttcaagatttttataatcgtgataagcctagtaataaatctttgcaacgttcgcatagactgcgtcctatagcttttggatcgggtttttttatctcgtctgatggttatattgtgaccaataatcatgtgatttctgatggcacaagttacgctgttgttcttgatgacggtacagaactgaatgcaaaactcattggaacggacccacgaactgatcttgcagtattaaaagtcaatgaaaaaagaaaattttcgtacgttgattttggtgatgattcaaaacttcgtgttggtgattgggttgttgctattggtaatccatttggtcttggtggaactgtgacagcaggtatcgtttcagcacgtggacgtgatatcggtaccggtgtttatgatgattttattcagattgatgctgcagttaatcgaggaaattctggaggtccaacttttgatcttaacggaaaggttgttggagtgaatacggcaattttttctccttctgggggcaacgttgggattgctttcgctattccggcagcaacagcgaagcaggttgtgcaacaacttatcgaaaaaggtttagttcagcgtggttggcttggggttcagattcagcctgtaacaaaagaaatttctgattcaattggtttgaaggaggctaaaggtgcgttaattaccgatccattaaaggggccagccgcaaaagctggtatcaaggcaggtgatgttattatttcggtaaatggtgagaagattaatgatgtccgtgatctagcaaagcgtattgcaaatatgagcccaggagaaacagtaaccttaggagtttggaaatctggtaaagaagagaatattaaggttaaacttgattcgatgcctgaagacgaaaatatgaaggatggctcaaaatattcaaatgagcacggtaattcagatgaaacattggaagattatggtttgattgttgctccttctgatgatggggtagggttggttgtaactgatgtagatccagattctgatgctgcagataaaggaatacgtcctggtgatgtgattgtaacagttaataataaatctgttaaaaaggtctctgatattacggacactatcaaaaatgcccaaaagttaggacgaaaagccatacttctacaagtgcgaacaaatgatcaaaatcgttttgtcgctcttcctatttttaaaaaataa

SEQ ID NO: 29010 - protein, 503 aa, Bartonella henselae
MVKKTFFTTLAAVSFSAALETALFFSGCGSSLWTTKAHANSVFSSLMQQQGFADIVSQVKPAVVSVQVKSNKKKKEWFFSDFFSTPGFDQLPDQHPLKKFFQDFYNRDKPSNKSLQRSHRLRPIAFGSGFFISSDGYIVTNNHVISDGTSYAVVLDDGTELNAKLIGTDPRTDLAVLKVNEKRKFSYVDFGDDSKLRVGDWVVAIGNPFGLGGTVTAGIVSARGRDIGTGVYDDFIQIDAAVNRGNSGGPTFDLNGKVVGVNTAIFSPSGGNVGIAFAIPAATAKQVVQQLIEKGLVQRGWLGVQIQPVTKEISDSIGLKEAKGALITDPLKGPAAKAGIKAGDVIISVNGEKINDVRDLAKRIANMSPGETVTLGVWKSGKEENIKVKLDSMPEDENMKDGSKYSNEHGNSDETLEDYGLIVAPSDDGVGLVVTDVDPDSDAADKGIRPGDVIVTVNNKSVKKVSDITDTIKNAQKLGRKAILLQVRTNDQNRFVALPIFKK

SEQ ID NO: 29011 - DNA, 1437 bp, Buchnera aphidicola
  CDS (1)..(1437)
atgaaaagaataaatatagtattaagcgggataatgctttttttaacgctattactaagttttggaatgtcttgggggaataaaaattttacttcttctcaaaatgtttcttctgtacaactagctcctagtttagctcctatgttagaaaaagttatgccttcagtaatcagtatcaatatagaaggaagcactgtagttcatacttctcgtttacctcatcaatttcaacccttttttggtcataattctcctttttgtcagggtaattcaccatttcgaaattctcctttttgtcgttctaatccaaattctaatagtatgcatgaaaaatttcatgctctgggttccggtgtaattattaatgctgataaggcatatgctgtaacaaataatcatgttgtagaaaatgcaaataaaattcaagtacaattaagtgacggacgtcgttatgaagcctctataattggtaaagactctcgttccgatattgctttaatacagctaaaaaatgcgaaaaatttaagtgcaataaaaattgctgattctgatactcttcgagtaggtgattatactgtagctattggtaatccatacggtcttggtgaaacggtaacttctggtattatttcggcgttgggacgaagtggattaaacattgagcattacgaaaattttattcaaactgatgcagctattaacagaggtaattctggtggtgcattagttaatttaaaaggtgaattaataggtatcaatactgcaatattagcaccagacggaggtaatattggaattggatttgctattcctggaaatatggttaaaaatcttacagaacaaatggttaaatttggacaagtaaaacgtggagaattaggcataataggcatggaactaaattcagatttagctcatgtaatgaaaataaatgctcaaaaaggtgcatttgtaagtcaagttttacctaattcttctgcttttcatgcaggtattaaagcaggtgatattattgtttctttaaataaaaaaacaatttctagttttgcagcattacgtgctgaagtgggatctttgccagtatctactaaaatggaattaggaatattccgaaatggaataactaaaaacgtgattgttgaattaaaaccatctttgaaaaatagtgttagtctaggagatatttatacaggaattgaaggtgctgatttaagtgattgttcattaaatggacaaaaaggtgtaaaaatagaaaatataaaattgaatactcaagcttcaaaaattggttttaagaaagatgatattattgtagaagtcaatcaaaaagtaataaataatttaaatgatttaaaaaatattttagattcaaaaccaaatatattagtttttagtgtgaagagagggaataatagtatttacttagttagtgaataa

SEQ ID NO: 29012 - protein, 478 aa, Buchnera aphidicola
MKRINIVLSGIMLFLTLLLSFGMSWGNKNFTSSQNVSSVQLAPSLAPMLEKVMPSVISINIEGSTVVHTSRLPHQFQPFFGHNSPFCQGNSPFRNSPFCRSNPNSNSMHEKFHALGSGVIINADKAYAVTNNHVVENANKIQVQLSDGRRYEASIIGKDSRSDIALIQLKNAKNLSAIKIADSDTLRVGDYTVAIGNPYGLGETVTSGIISALGRSGLNIEHYENFIQTDAAINRGNSGGALVNLKGELIGINTAILAPDGGNIGIGFAIPGNMVKNLTEQMVKFGQVKRGELGIIGMELNSDLAHVMKINAQKGAFVSQVLPNSSAFHAGIKAGDIIVSLNKKTISSFAALRAEVGSLPVSTKMELGIFRNGITKNVIVELKPSLKNSVSLGDIYTGIEGADLSDCSLNGQKGVKIENIKLNTQASKIGFKKDDIIVEVNQKVINNLNDLKNILDSKPNILVFSVKRGNNSIYLVSE

SEQ ID NO: 29013 - DNA, 1515 bp, Rhizobium meliloti
  CDS (1)..(1515)
atgctgaagaccacgacggtagccggtctcgcagccgtgctgctgacgaccggcctgccggccgaagtcgcgcagtccttcgccgaagccgtgagggtgcaggccccggctgtgccgagtttcgccaatgtggtcgacgccgtttcgccggcggtcgtctccgtccgcgtgcaggcacgtgaacgcgtcagcgacgatgaaagcaacttcaccttcgatttcggcggccgcgggttcgaggacctgccggaagaccatccgctgcggcgtttcttccgcgaattcgctccgcgtgaaaatgaccgtgccgatcgttggcgcgaccgccgcggtccgcgtggcgaaggtcgtctccgtccgcgggcgcaaggctccggcttcttcatcaccgaagacggttacctcgtcaccaacaaccacgtcgtctccgacggctcggccttcaccgttatcatgaacgacggaaccgagctcgacgccaagctcgtcggcaaggacagccggaccgaccttgccgtgctcaaggtcgatgacaagcgcaagttcacctatgtcagcttcgcggacgacgagaaggtgcgcgtcggcgactgggtggtcgctgtcggcaatcccttcggcctcggcggcacggtcactgccggcatcatctccgctcggggccgcgatatcggctccggtccctatgacgattatctgcaggtcgacgcagcggtgaaccgcggcaattccggtggtccgaccttcaatctttccggcgaggtggtcggtatcaacacggccatcttttcgccctccggcggcaatgtcggtatcgcctttgcaatccccgcctcggtcgcgaaggatgtcgtggactccctcatcaaggacggcacggtgtcgcgcggctggcttggtgtccagatccagccggtgacgaaggatatcgccgagtcgctcggcctttccgaagcgaacggcgccctcgtcgtcgagcctcaggcgggctcgccgggtgaaaaggccgggatcaagaacggcgacgtcgtgacggcactcaacggcgagccggtcaaggatccgcgggacctcgcacgtcgcgttgcggccctgcgccccggctccactgcagaggttaccctgtggcgcagcggcaaatccgaaacggtcaacctcgagatcggcacgctgccgagcgatgccaaggaacccgcaccggcgaccggtgaagcgcagcccgacgaagggcaggcaggcgaggaggcgctggccgacctcggcctgacggtgaccccgtcggaggacggcaagggcgtcacgatcgcctccgtcgatccggattcggacgccggcgatcgcggcctgaaggaaggcgagaagatcgtctccgtcaacaatcaggaagtgaaatcggcagacgacgttctcaaggtgatcaacaacgccaagaaggacgggcgcagcaaggctctgttccagatcgaagcacaggaaggcagccgcttcgtcgcactgcccatcactcagggctga

SEQ ID NO: 29014 - protein, 504 aa, Rhizobium meliloti
MLKTTTVAGLAAVLLTTGLPAEVAQSFAEAVRVQAPAVPSFANVVDAVSPAVVSVRVQARERVSDDESNFTFDFGGRGFEDLPEDHPLRRFFREFAPRENDRADRWRDRRGPRGEGRLRPRAQGSGFFITEDGYLVTNNHVVSDGSAFTVIMNDGTELDAKLVGKDSRTDLAVLKVDDKRKFTYVSFADDEKVRVGDWVVAVGNPFGLGGTVTAGIISARGRDIGSGPYDDYLQVDAAVNRGNSGGPTFNLSGEVVGINTAIFSPSGGNVGIAFAIPASVAKDVVDSLIKDGTVSRGWLGVQIQPVTKDIAESLGLSEANGALVVEPQAGSPGEKAGIKNGDVVTALNGEPVKDPRDLARRVAALRPGSTAEVTLWRSGKSETVNLEIGTLPSDAKEPAPATGEAQPDEGQAGEEALADLGLTVTPSEDGKGVTIASVDPDSDAGDRGLKEGEKIVSVNNQEVKSADDVLKVINNAKKDGRSKALFQIEAQEGSRFVALPITQG

SEQ ID NO: 29015 - DNA, 1377 bp, Bacillus subtilis
  CDS (1)..(1377)
atggattatcgacgtgatggccaaaacgatcaacatcaaactgaaccttcacatacagaacagcagaatacagaaaaccagaagctgattggacattctgaacaagaattgcttgacgcgcctgtgtcgtatgaagcgggacggcaggaaacggcttctgctttagaaatggaaaagcaagaaacggctgtgaaaaaagaaaagaaacggagagccgcatggctgagcccgattttaggcggtattatcggcgggggcctcatgcttggcatcgcgccttatctgccgtcagaccaaaatcaggcgaccgaaaccgcttccgcaaataaacaggtgcagtctgataattttacaacggcgccgataacgaacgcatcaaacatcgctgatatggtagaggatttagagcctacgattgtcggaatctcaaatatccaaacctctcaaaataacacattcggcacgggaggaggctccagctcagaaagtgaaagcggaaccgggtcaggtgttattttcaaaaaagacagcgataaagcgtatatcattacaaacaaccatgtcgttgaaggcgcgaacaagctgactgttacgctatacaacggagaaacggaaactgccaagcttgtcggcagcgataccattactgatttggcagttttggaaatcagcggcaagaatgtaaaaaaagtggcgagctttggtgactcttcacagctgcgcactggcgaaaaggtaatcgctatcggtaacccgctcggacagcagttttccggtacagtgacacaaggtatcattagcggactgaaccggacaattgatgtggatacaacacaggggacggtggaaatgaacgtgctgcaaaccgatgcagcgatcaatccggggaacagcggaggcccattaatcaatgcaagcggccaggtcatcggcatcaacagcttgaaggtgagcgaaagcggcgtggaatcacttggatttgcgatcccaagcaatgatgtcgagccgattgttgaccagctgctgcaaaacgggaaggtggaccgtccgtttttaggcgtgcagatgattgacatgtcacaagttcctgaaacctatcaggaaaatacgctcggcctgtttggagatcaattgggcaaaggtgtttatgtaaaagaagttcaagcaaattcgccggcagaaaaagcaggtattaaatctgaggatgtcattgtcaaactaaacggtaaagacgtggaaagcagtgcggatatccgtcagatcctttacaaagacttaaaagtcggagataaaacaacaatccaagtgctgcgaaagggaaaaacgaaaacgttgaacgcaacactgaccaagcagacagaaagcagttcaagctaa

SEQ ID NO: 29016 - protein, 458 aa, Bacillus subtilis
MDYRRDGQNDQHQTEPSHTEQQNTENQKLIGHSEQELLDAPVSYEAGRQETASALEMEKQETAVKKEKKRRAAWLSPILGGIIGGGLMLGIAPYLPSDQNQATETASANKQVQSDNFTTAPITNASNIADMVEDLEPTIVGISNIQTSQNNTFGTGGGSSSESESGTGSGVIFKKDSDKAYIITNNHVVEGANKLTVTLYNGETETAKLVGSDTITDLAVLEISGKNVKKVASFGDSSQLRTGEKVIAIGNPLGQQFSGTVTQGIISGLNRTIDVDTTQGTVEMNVLQTDAAINPGNSGGPLINASGQVIGINSLKVSESGVESLGFAIPSNDVEPIVDQLLQNGKVDRPFLGVQMIDMSQVPETYQENTLGLFGDQLGKGVYVKEVQANSPAEKAGIKSEDVIVKLNGKDVESSADIRQILYKDLKVGDKTTIQVLRKGKTKTLNATLTKQTESSSS

SEQ ID NO: 29017 - DNA, 24 bp, Primer
atgaaaaaaaccacattagcactg

SEQ ID NO: 29018 - DNA, 25 bp, Primer
ttactgcattaacaggtagatggtg

SEQ ID NO: 29019 - protein, 406 aa, consensus
  MISC_FEATURE (1)..(406): consensus for the disclosure of xaa see table XV
VVXXXXXXXXXXXXXXXXXXXXXXXXXXXXXXXXXXXXXXXXXFXXXXXXXXXXXXXXXXXXXXXXXXXXXXXXXXXXXXXXXXXXXGSGXXXXXXXXXXXXGXXXTNXHVXXXXXXXXXXXXXXVXLXXDXXXXXAXXXGXDXXXDXAXXXXXXXXXXXXXXXXXXXXXSXXXXXGXXXXAXGXPXXXGXXXTVTXGIXSAXXRXXXXXXXXXXXXXXXXXXIQTDAXINXGNSGGXLXXXXGXXXGINXXIXXXXGXXXXXXXXXXXXGXXFAIPXXXXXXXXXXXXXXGXXXXXXXRXXXGXXXXXXXXXXXXXXXXXXXXXXXXXXXXXXXXXXXXGXXXXXXXXXXXXAXXAGXXXXXXXXXXGDXXXXXXXXXXXXXXXXXXXXXXXXXXGXXXXXXXXR

SEQ ID NO: 29020 - protein, 66 aa, consensus
  MISC_FEATURE (1)..(66): consensus for the disclosure of xaa see table XV
GXXXXXXXXXXXXXXXXXXTNXHVXXXXXXXXXXXXXXXXXXXXXXXXXXXXXXXXXXXDXAXXXX

SEQ ID NO: 29021 - protein, 37 aa, consensus
  MISC_FEATURE (1)..(37): consensus for the disclosure of xaa see table XV
XXXXXXXXGXXXXAXGXPXXXXXXXXXXXGXXSXXXX

SEQ ID NO: 29022 - protein, 30 aa, consensus
  MISC_FEATURE (1)..(30): consensus for the disclosure of xaa see table XV
XQXDXXXNXGNSGGXXXXXXXXXXGXXXXX

SEQ ID NO: 29023 - protein, 34 aa, consensus
  MISC_FEATURE (1)..(34): consensus for the disclosure of xaa see table XV
XXXXXXPXXXXXXXXXXXXXXGXXXXXXXXXXXX

SEQ ID NO: 29024 - protein, 68 aa, consensus
  MISC_FEATURE (1)..(68): consensus for the disclosure of xaa see table XV
XXXXXXXXXXXXXXXXXXXXXXXXXXXXXXXXXXXXXXXXXXXXXXXXXXXXXXXXXXXXXXXXXXXX

SEQ ID NO: 29025 - DNA, 837 bp, Escherichia coli
  CDS (1)..(837)
atgaggagtctgcttatgacccgtctggcttcgcgctttggcgcagcaaaccttatccgtcgcgaccgtccgttaacccgtgaagagctgtttcgcgtagtgcccagtgtattcagtgaggacaaacacgagtcccgtagtgagcgttatacctatatacccaccatctccctgctcgacagcctacagcgagaaggcttccagccattctttgcctgtcagacccgcgtgcgtgacccgggtcgtcgtgaacatacaaagcatatgctgcgtctgcggcgggaagggcagatcaccggtaaacaggtgccggaaattattctactcaactctcacgatggaaccagttcgtatcagatgttgccgggactatttcgtgcggtttgtcagaacgggctcgtctgcggtgagtcgtttggcgaggtgcgggtgccacacaagggggacgtggtgagtcaggtgattgaaggcgcgtatgaggtgctggggatttttgaccgggtggaggagaaacgggatgccatgcagtcgttgctgttgccacccccggcacagcaggcactggcaaaagccgccctcacataccgctttggtgaagaccaccagccggtgactgaatcgcagatcctctcccctcgccgctggcaggatgagagcaatgacctgtggaccacgtaccagcgtattcaggagaacctgattaagggcgggctcagtggccgtaatgccaaaggaggacggtcacatacccgtgccgttcgcggtatcgacggggacgtgaaacttaaccgggcactgtgggtgatggcggaagccctgctcacgcaactgcagtga

SEQ ID NO: 29026 - protein, 278 aa, Escherichia coli
MRSLLMTRLASRFGAANLIRRDRPLTREELFRVVPSVFSEDKHESRSERYTYIPTISLLDSLQREGFQPFFACQTRVRDPGRREHTKHMLRLRREGQITGKQVPEIILLNSHDGTSSYQMLPGLFRAVCQNGLVCGESFGEVRVPHKGDVVSQVIEGAYEVLGIFDRVEEKRDAMQSLLLPPPAQQALAKAALTYRFGEDHQPVTESQILSPRRWQDESNDLWTTYQRIQENLIKGGLSGRNAKGGRSHTRAVRGIDGDVKLNRALWVMAEALLTQLQ

SEQ ID NO: 29027 - DNA, 831 bp, Ralstonia solanacearum GMI1000
  CDS (1)..(831)
atgcaactcgcatcccgtttcgcttcccgttccccctcgctgcgtagcgattacccgctgaccgatgaccagattcaccgcgtggctccgtccatcttcgcggacgcgccgcatgaaagccgttcgcagcggtacgcctacatccccaccgccgccgtgctggccgaactgcgcaaggaggggtttcaacccttcatggtgacgcaaacccgcgtgcgcgacgaaggcaagcgcgagcacaccaaacacatgctgcgcctgcgccacgcaagccagatcaacggcgcggaagccaatgaaatcgtgttgctcaattcccatgacgggacgagcagttatcagatgctggccggaatgttccggttcgtgtgcagcaatggccttgtatgcggcgacaccgtggccgatgtgcgcgtgccccacaagggcgacgtttccgggcatgtcatcgaaggcgcttacgaagtcttgcgcggcttcgaccgggtgaaggattcccgcgatgccatgcgcgctatcacgctggacgaaggcgaagccaaagtgttcgcccgttccgcgctggccttgaagtacgaccccaccgacaacagacccgcgcccatcacggaaagccaaatcctgatgccgcgccggttcgacgaccgtcgcccggacttgtggagcgtgttcaaccgcacccaagagaacctgaccaaaggcggattgcatggccgcagcgtcaacggacgccgccagcaaacccgcccggtgcagggcattgattccgatgtgcgcctcaatcgcgccctctggatgctggccgatggcctgcgccagttgaaagcctga

SEQ ID NO: 29028 - protein, 276 aa, Ralstonia solanacearum GMI1000
MQLASRFASRSPSLRSDYPLTDDQIHRVAPSIFADAPHESRSQRYAYIPTAAVLAELRKEGFQPFMVTQTRVRDEGKREHTKHMLRLRHASQINGAEANEIVLLNSHDGTSSYQMLAGMFRFVCSNGLVCGDTVADVRVPHKGDVSGHVIEGAYEVLRGFDRVKDSRDAMRAITLDEGEAKVFARSALALKYDPTDNRPAPITESQILMPRRFDDRRPDLWSVFNRTQENLTKGGLHGRSVNGRRQQTRPVQGIDSDVRLNRALWMLADGLRQLKA

SEQ ID NO: 29029 - DNA, 828 bp, Pseudomonas putida
  CDS (1)..(828)
atgcgtctatccagcaacttccgtaacccttgcatggtccgcagcgacagcccactgagcaatgacgagatcgcccgcgtagcaccctcgatctttgccgaggaagcgcacgaaagccgctccgatcgctaccgctacattcccaccgtcgacgtactcgaagcgctgcgcagtgaggggttcatgccgttcatggcctgccaaactcgcgtgcgcaacaccgacaagcgcgaacacaccaagcacatgatccgcctgcgtcacgccaataccatcgtggccaaggaagccaacgaaatcatcctgctgaacagccacgacggcaccagcagctaccaaatgatgggcggttgcttccgtttcgtatgcgccaacggcctggtgctgggcgaggccgcgatggaccagaaagtgcgccacagcggtcgccaggatgttatcggggatgtgatcgagggcgcgtatgaagtcctgaatcaattcgagctgatcgaggatcagcgcgaaaccatgaaaggcatccagctgggcaacgacctgcagcacgctttcgccgaggcagcacttgcctaccgctatgacccagcggacggcccagcgccggtaactgcaagccagctgctggcaccgcgtcgccgcgaagacgccaccaatgacctttggtcgaccttcaaccgcgtacaggaaaacaccatcaaaggagggctgcgaggccgcaacaaacaagggcgccgtaccagcacccgtgccgtttccggcattgaccaggacgtgaaactcaatcgcgccctgtgggttctggcccagcacctgcgccaagccgcctaa

SEQ ID NO: 29030 - protein, 275 aa, Pseudomonas putida
MRLSSNFRNPCMVRSDSPLSNDEIARVAPSIFAEEAHESRSDRYRYIPTVDVLEALRSEGFMPFMACQTRVRNTDKREHTKHMIRLRHANTIVAKEANEIILLNSHDGTSSYQMMGGCFRFVCANGLVLGEAAMDQKVRHSGRQDVIGDVIEGAYEVLNQFELIEDQRETMKGIQLGNDLQHAFAEAALAYRYDPADGPAPVTASQLLAPRRREDATNDLWSTFNRVQENTIKGGLRGRNKQGRRTSTRAVSGIDQDVKLNRALWVLAQHLRQAA

SEQ ID NO: 29031 - DNA, 819 bp, Shigella flexneri 2a str. 301
  CDS (1)..(819)
atgcaattagtcagtcgttttggttatgcgaaccagatacgccgtgaccgtccgctgacacatgaagagctgatgcaccatgtgccggggattttcggggaagagaaacacacgtcccgaagccagaactatacgtacatccccaccatcaccgtactggaaagtctgcagcgggaaggcttccagccctttttcgcctgccagacccgtgtgcgcgacccgggccgccggggatacacaaaacacatgctgcgtctgcggcgggccggagagataaacggagaacatgtccctgaaattattctgctcaactcccatgacggtacctccagctaccagatgctgccgggttacttcagattcgtctgccagaacgggtgtgtctgtggtcagtctctgggggaagtgcgtgttccgcaccggggaaacgtggtggagaaagttattgaaggggcttacgaagtggtgggcgtgtttgaccggattgaggagaaacgtgatgccatgcagtcgctggtcctgccgccaccggcacgccaggcgctggcacaggcggcactgacttaccgttatggtgacgaacatcagcccgtcaccaccgccgacattctgacgccacgacgccgggaggattacggtaaggacctgtggagtacttatcagaccatccaggagaatatgctgaaaggcgggatttccggccgcagtgcaaaaggaaaacgtatccacacccgtgccattcacaacatcgacaccgatattaagctcaaccgcgcattgtgggtgatggcagaaacgctgctggagagcctgcgctga

SEQ ID NO: 29032 - protein, 272 aa, Shigella flexneri 2a str. 301
MQLVSRFGYANQIRRDRPLTHEELMHHVPGIFGEEKHTSRSQNYTYIPTITVLESLQREGFQPFFACQTRVRDPGRRGYTKHMLRLRRAGEINGEHVPEIILLNSHDGTSSYQMLPGYFRFVCQNGCVCGQSLGEVRVPHRGNVVEKVIEGAYEVVGVFDRIEEKRDAMQSLVLPPPARQALAQAALTYRYGDEHQPVTTADILTPRRREDYGKDLWSTYQTIQENMLKGGISGRSAKGKRIHTRAIHNIDTDIKLNRALWVMAETLLESLR

SEQ ID NO: 29033 - DNA, 837 bp, Pseudomonas syringae pv. tomato str. DC3000
  CDS (1)..(837)
atgcgtatgtccagcaacttccgtaacccatgcatgatccgcagtgacgtcccactgagcaacgatcagatcgcccactatgtgccttccatctttgccgaagaagcgcacgacagcaggtcggcacgttatctgtatatcccgaccgtgcaggtacttgatgcgctgcgcgccgaaggatttgaaccattcatggcctgtcagacacgcgtgcgtgaccagggcaaacgtgagcacaccaagcacatgctgcgcttgcgccatgcgagccagatcctggaccaggaagccaacgaaatcatccttctcaacagccacgatggcagcagcagctatcaaatgattggaggcaaattccgtttcgtgtgtgcaaacggactggtactgggggacgttgccgctgaccagaaagtgcgccatagcggccgtggtgatgtggtaaatgacgtgatcgaaggcgccttcgaagtgttgaagcatttcgaacagatcgaccacataaccgccgacatgaagcatcaacaattagaccaggacgagcaagaggcctttgcattggctgccttggcgtatcgctacgatccggcagaaggacctgcgcctgttaccccgtcccagttgctcatgccccgccgtcgtgaggaccgcagcagcgacctttggaccacgttcaatcgagtccaggaaaacaccataaaaggcggtttgaccgggcgcaacaagcaaggccgacgcacgacaacgagggcagttaatggcattgatcaggatgtgaaattgaatcgcgcactgtgggtgctcgcacaggctctgcaaggccgtcagctcgccgcctaa

SEQ ID NO: 29034 - protein, 278 aa, Pseudomonas syringae pv. tomato str. DC3000
MRMSSNFRNPCMIRSDVPLSNDQIAHYVPSIFAEEAHDSRSARYLYIPTVQVLDALRAEGFEPFMACQTRVRDQGKREHTKHMLRLRHASQILDQEANEIILLNSHDGSSSYQMIGGKFRFVCANGLVLGDVAADQKVRHSGRGDVVNDVIEGAFEVLKHFEQIDHITADMKHQQLDQDEQEAFALAALAYRYDPAEGPAPVTPSQLLMPRRREDRSSDLWTTFNRVQENTIKGGLTGRNKQGRRTTTRAVNGIDQDVKLNRALWVLAQALQGRQLAA

SEQ ID NO: 29035 - DNA, 828 bp, Pseudomonas putida
  CDS (1)..(828)
atgcgtctatccagcagcttccgcaacccttgcatggttcgcagcaacacccctttgactaacgacgaaatcgcgcgtgtcgcgccgtccatctttgccgtcgaagcgcacgacagccgctccgatcgctaccgctacatcccaaccgtcgacgtgcttaccgcgctgcgcgcagaagggttcgaacccttcatggcttgccaaacccgcgtgcgtaactccgacaagatccagcacaccaaacacatgatccgcctgcgccatgcgtccaacatcatggacaaggaagccaacgaaatcatcctgctcaacagccacgatggcaccagcagttatcaaatgatgggcgggtgcttccgctttgtgtgcgccaacggccttgtcctgggcgaagccgcgatggatcagaaagtccgtcacagcggtcgacaagacgtaatcggcgaagtcatcgagggggcatatgaggtgctggaccaattcgcactgatcgaggatcagcgcgaaaccatgaagcaaatccagattcgccccgagctgcaacacgctttcgccgaagctgcattagcgtaccgctacgacccagccgaaggcccggcgcctgtgacagcttcacagctgctcatgcctcgccgccgtgaagatcgcaccgatgatctctggaccacattcaaccgcgtacaggaaaactccatcaagggagggcttacaggtcgcaacaagcaaggtcgccgcaccagtacccgcgccgtcaccggcattgaccaggacgtgaagctaaatcgcgccctttgggttctggctcagcacattcgcgaagccgcctaa

SEQ ID NO: 29036 - protein, 275 aa, Pseudomonas putida
MRLSSSFRNPCMVRSNTPLTNDEIARVAPSIFAVEAHDSRSDRYRYIPTVDVLTALRAEGFEPFMACQTRVRNSDKIQHTKHMIRLRHASNIMDKEANEIILLNSHDGTSSYQMMGGCFRFVCANGLVLGEAAMDQKVRHSGRQDVIGEVIEGAYEVLDQFALIEDQRETMKQIQIRPELQHAFAEAALAYRYDPAEGPAPVTASQLLMPRRREDRTDDLWTTFNRVQENSIKGGLTGRNKQGRRTSTRAVTGIDQDVKLNRALWVLAQHIREAA

SEQ ID NO: 29037 - DNA, 822 bp, Escherichia coli
  CDS (1)..(822)
atgcgattagcttcccgttttggtcgatataattctattcgccgtgagcgcccgttaacggatgacgaattaatgcagtttgttccatctgtcttttctggtgataaacatgaatcccggagtgagcgttatacatatatcccaaccatcaatatcatcaataagttacgtgatgaaggtttccagccattctttgcctgtcagagtcgggttcgtgatttgggacgccgcgaatacagtaaacatatgttacgtcttcgcagggaagggcatattaacgggaaagaagttcctgaaattatcctgcttaattcacatgatggttcatccagttatcagatgatcccaggaatttttcgttttgtctgcacaaatggcctggtgtgtgggaataattttggcgaaatccgcgttccacataaaggtgatattgtcgggcaggttattgagggagcgtatgaagtgctcggtgtctttgataaagtcactgaaaatatggagacaatgaaagagatacatcttaacagtgacgaacaacatttatttggcagagctgcattgatggccaggtacgaagatgaaaataaaacgccagtgacgccagaacaaataattactccccgccgttgggaggataaacagaacgatctctggacaacctggcagcgggttcaggagaatatgataaaaggtggattatcggggcgaagtgcctccggtaaaaataccagaacaagagccattacaggcattgacggtgatatccgaatcaacaaagcattatggatgattgccgaacagttcagggagtggaagtcatga

SEQ ID NO: 29038 - protein, 273 aa, Escherichia coli
MRLASRFGRYNSIRRERPLTDDELMQFVPSVFSGDKHESRSERYTYIPTINIINKLRDEGFQPFFACQSRVRDLGRREYSKHMLRLRREGHINGKEVPEIILLNSHDGSSSYQMIPGIFRFVCTNGLVCGNNFGEIRVPHKGDIVGQVIEGAYEVLGVFDKVTENMETMKEIHLNSDEQHLFGRAALMARYEDENKTPVTPEQIITPRRWEDKQNDLWTTWQRVQENMIKGGLSGRSASGKNTRTRAITGIDGDIRINKALWMIAEQFREWKS

SEQ ID NO: 29039 - DNA, 864 bp, Rhodobacter sphaeroides 2.4.1
  CDS (1)..(864)
atgagctatcatttctatatgcgcgggatgagcaacggcggcgcggcctacagccggggcgatcagccgctgacgaatgacgagctgatggcgcgcgttccctcgatctttgcgaccgaggctcacgagagccgcagcgcccggttcgctcctgtccccaccgtcaccgtgctggatggcctgcgcgcggaaggattcgaaccgttctttgctcagcaggcccgcacccgagtcgagggcaaggccgagtttacgaagcacatgctgcgcctgcgtcaccgcggcatcgtcaatgccgagggcgaggcgttcgagatcgtgctggtcaacgcgaatgacggcacgagcgcctatcagatgatcccggggttctttcggtttgtctgcgccaacggcctcatgtgcggcgagaccttcgacgaggtgaaggtccgccatagcggcaatgccattggcgaagtcatcgagggcgcctatcgcgtgcttgaggaggccccccgcgtgaccgagcaggtggaccggttcaaggctatccagctgcaggaccgggagcgcgagatcctggccgaagccgcgcacggccttcgcttccccggcaccgccgagggcaaggaagcgccgatcacgccggccgagctcctgcggccgcggcgctcgaccgaccgcgccaccgacctgtggaccgctttcaacgtggtgcaggagaacaccctgcgcggagggatgcgcggccgcacccggaccgaaagcggccatttccgccgccagaccgtccgcgaggtggccggcatcgaccagtcccgcggcctcaaccgcgcgctctggatgctcaccgagcgcatggccgagctgaaggcaggctga

SEQ ID NO: 29040 - protein, 287 aa, Rhodobacter sphaeroides 2.4.1
MSYHFYMRGMSNGGAAYSRGDQPLTNDELMARVPSIFATEAHESRSARFAPVPTVTVLDGLRAEGFEPFFAQQARTRVEGKAEFTKHMLRLRHRGIVNAEGEAFEIVLVNANDGTSAYQMIPGFFRFVCANGLMCGETFDEVKVRHSGNAIGEVIEGAYRVLEEAPRVTEQVDRFKAIQLQDREREILAEAAHGLRFPGTAEGKEAPITPAELLRPRRSTDRATDLWTAFNVVQENTLRGGMRGRTRTESGHFRRQTVREVAGIDQSRGLNRALWMLTERMAELKAG

SEQ ID NO: 29041 - DNA, 825 bp, Pseudomonas aeruginosa UCBPP-PA14
  CDS (1)..(825)
atgcaactcgcatcccgtttcgcttcccgttccccggcactgcgcagcgattacccgctgaccgatgaccaaatccgcagggtggccccgtccatcttcgcggacgccccgcacgaaagccgctccgagcggtacgcctacatccccaccgcgaccgtgttgcaggaactgcgcggggaaggcttcgagcctttcatggtgtgccagacccgcgtgcgccacgacgaccgccgcgactacaccaagcacatgatccgcctgcgccacgccagccagatcaacgggcgcgaggccaacgaaatcatcctgctgaactcccatgacggcaccagcagttaccagatgctggccggaatgttccgcttcgtgtgcagcaatggccttgtgtgcggtgacaccgtggccgacgtgcgcgtaccccacaagggcgacgtagccgggcacgtcatcgaaggcgcttacgaagtcctgcacggtttcgaccgggcgcaggaatcgcgcgatgccatgcgcgccatcaccctcgacgccggggaatcggaagtgttcgcccgcgccgcgctggccttgaagtacgacgaggacaagcccgcacccatcacggaatcgcaaatcctgatgccgcgccgtggcgacgacgaccgccgcgacctgtggagcgtgttcaaccgcacgcaagaaaacctcatcaaaggtggcctgtccgcccgcgccgccaatggccgccgccagaccacccggcccgtgcagggcatcgaccagagcgtgcgcctgaatcgcgccctgtggctgctggccgatggcctgcgccagctcaaagcctga

SEQ ID NO: 29042 - protein, 274 aa, Pseudomonas aeruginosa UCBPP-PA14
MQLASRFASRSPALRSDYPLTDDQIRRVAPSIFADAPHESRSERYAYIPTATVLQELRGEGFEPFMVCQTRVRHDDRRDYTKHMIRLRHASQINGREANEIILLNSHDGTSSYQMLAGMFRFVCSNGLVCGDTVADVRVPHKGDVAGHVIEGAYEVLHGFDRAQESRDAMRAITLDAGESEVFARAALALKYDEDKPAPITESQILMPRRGDDDRRDLWSVFNRTQENLIKGGLSARAANGRRQTTRPVQGIDQSVRLNRALWLLADGLRQLKA

SEQ ID NO: 29043 - DNA, 834 bp, Burkholderia cepacia R1808
  CDS (1)..(834)
atgcaactcgcttcctcattccgttacggctcgccgatactgcgcgccgactcgcccctctcggacgaccagatccgtagcgtcgcgccgtcaatcttcgcggacggcaagcacgcaagccgctccgaacgctacacctacattcccaccatcgatgtgctgcgcggtctgcgcaatgaaggcttccagccgttcatggtctgccagagccgcgtgcgtgatccaggcaagcgcgagtacacgaaacacatgctccggcttcgtcacgccacccagatcgtcggggaagaagccaacgaggtcgtgctgctgaactcgcacgacggcacgagcagctaccagatgctggctggtgtgctgcgtttcgtctgccagaacggcatggtcgctggcgacagcgtgcgcgatatccgcataccgcacaaaggcaacatcgcacggaacgtcatcgatggcgcgttcgacgtgctcgacaccttcgacctgatccgcgagcagaccgacagcatgcgcggcgtcgaactggaccgcgctgaacagcacgcgttcgcccgttccgcccttgcactgcgctacgacccgactgacacggaggccccctcccctgtcaccgagagccaattgcttgccccgcgccgtttcgaggatcgccgcgacgatctctggacggtgttcaaccgggtgcaggagaacctcaccaaaggcgggctgcacgggcgctcgcgaaccggccgggcaatgtccacccgccccgtcacaggcatcgatcagaacgtgaagctcaatcgcgccctctggatgctggccgacgccatgcgccaaatgaaggcgtaa

SEQ ID NO: 29044 - protein, 277 aa, Burkholderia cepacia R1808
MQLASSFRYGSPILRADSPLSDDQIRSVAPSIFADGKHASRSERYTYIPTIDVLRGLRNEGFQPFMVCQSRVRDPGKREYTKHMLRLRHATQIVGEEANEVVLLNSHDGTSSYQMLAGVLRFVCQNGMVAGDSVRDIRIPHKGNIARNVIDGAFDVLDTFDLIREQTDSMRGVELDRAEQHAFARSALALRYDPTDTEAPSPVTESQLLAPRRFEDRRDDLWTVFNRVQENLTKGGLHGRSRTGRAMSTRPVTGIDQNVKLNRALWMLADAMRQMKA

SEQ ID NO: 29045 - DNA, 864 bp, Rubrivivax gelatinosus PM1
  CDS (1)..(864)
atgtactcgaccccgaccctagcgacccgctttgcccgcaacacccgcgtgatgcgcggtgaccagcccctgagcgaagaccagatgcgcgccgcggcgccgtccatcttcgccgagggcaagcacgcgagccgctccgagcgctacacctacatccccaccatcgatgtcctgcgcggcctgcgcaaggagggcttcgagcccttcatggtcgcccagggtgccagccgcgtcgagggcaaggcggagttcaccaagcacatgatccgcatgcgccacgccggacaggtgcagacccggcccgaggcgaacgagatcatcctgatcaacagccacgacggcgccagttcttaccagatgctggccggcatgttccgcttcgtctgctgcaacggcctggtggtgggcgaggtggtggacgacatccgcatcccgcacaagggcaacatccagggcgaggtgatcgaaggcgcgttccgcgtgctcgacgagttcgaggcggtgaacgagcacaccgaggcgatgaaggcgctgcagctccagccgccggaggagatcgccttcgcgaccgccgctctggcgctgcgcttcggtgagcgcggcgtggaagagactggcggacacaagcccgcgccggtcactgccgagcagctgatcgaggcgcgccggcccgaggacatcggtcacagcctttggacgactttccagcgcgtgcaggagaacgtgatccgcggtggccagcccggccgcagcgcccaggggcgccggctgcagacgcgcccggtgggcagcatcgatcgcggggtgagcctcaaccgtgcgctctggatgctggccgaggagatgcgcaagttgaagggctga

SEQ ID NO: 29046 - protein, 287 aa, Rubrivivax gelatinosus PM1
MYSTPTLATRFARNTRVMRGDQPLSEDQMRAAAPSIFAEGKHASRSERYTYIPTIDVLRGLRKEGFEPFMVAQGASRVEGKAEFTKHMIRMRHAGQVQTRPEANEIILINSHDGASSYQMLAGMFRFVCCNGLVVGEVVDDIRIPHKGNIQGEVIEGAFRVLDEFEAVNEHTEAMKALQLQPPEEIAFATAALALRFGERGVEETGGHKPAPVTAEQLIEARRPEDIGHSLWTTFQRVQENVIRGGQPGRSAQGRRLQTRPVGSIDRGVSLNRALWMLAEEMRKLKG

SEQ ID NO: 29047 - DNA, 831 bp, Ralstonia metallidurans CH34
  CDS (1)..(831)
atgcaactcgcatcccgtttcgcttcccgttccccctcgctgcgcagcgattacccgctgtccgatgaccagattcgcagggtggccccgtccatcttcgccgatgcaccgcatgagagccgttccgagcggtacagctatatccccaccgccgccgtgctgaccgagcttcgcaaagaaggcttccagcccttcatggtgacgcagacccgcgtgcgcgatgaaggcaagcgcgagcacaccaaacacatgctgcgcctgcgccatgccagtcagatcaatggcgcagaggctaacgaaatcgtgctgctgaactcgcacgacggcacgagcagctatcagatgctggccggaatgttccgcttcgtgtgcagcaatggccttgtatgcggcgacaccgtggccgatgtgcgcgtaccccacaaaggcgacgtggccggttccgtcatcgaaggcgctttcgaggtgttgagcggcttcgagcgggtgaaggaatctcgcgatgccatgcgcgcgatcacgctggatgaaggcgaagccgaagtgttcgcccgttccgcgctggccctcaagtacgaccccacgaacaacaagcccgcgcccatcaccgaatcgcaaatcctgatgccgcgtcggttcgatgacagccgccccgacctgtggagcgtgttcaaccgcacgcaggagaacttgaccaagggcggattgcatggccgcagcgccaacggacgtcgccagcagacccgacccgtgcagggcattgattccgatgtgcgcctcaatcgcgccctctggatgctggccgatggcctgcgccagttgaaagcctga

SEQ ID NO: 29048 - protein, 276 aa, Ralstonia metallidurans CH34
MQLASRFASRSPSLRSDYPLSDDQIRRVAPSIFADAPHESRSERYSYIPTAAVLTELRKEGFQPFMVTQTRVRDEGKREHTKHMLRLRHASQINGAEANEIVLLNSHDGTSSYQMLAGMFRFVCSNGLVCGDTVADVRVPHKGDVAGSVIEGAFEVLSGFERVKESRDAMRAITLDEGEAEVFARSALALKYDPTNNKPAPITESQILMPRRFDDSRPDLWSVFNRTQENLTKGGLHGRSANGRRQQTRPVQGIDSDVRLNRALWMLADGLRQLKA

SEQ ID NO: 29049 - DNA, 825 bp, Ralstonia metallidurans CH34
  CDS (1)..(825)
atgcaactcgcatcccgtttcgcttcccgctccccggcactgcgcagcgattacccactgtccgatgaccaaatccgcagggtggccccgtccatcttcgccgacgccccgcacgaaagccgttccgagcgatacagctacatccccaccgcgaccgtcctgcaagaactgcgcggagaaggtttcgagcctttcatggtgacgcaaacccgcgtgcgccacgacgaccgccgcgactacaccaagcacatgatccggctgcgccacgccagccagatcaacggccgcgaggccaacgaaatcatcctgctgaactcccatgacggcaccagcagctatcagatgctggccgggatgttccgcttcgtttgcagcaatggccttgtctgcggcgacaccgtggccgacgtgcgcgtgccgcacaagggcgacgtagccgggcacgtcatcgaaggcgcttacgaagtcctgcacggcttcgaccgggtgcaggaatcgcgcgatgccatgcgcgccatcacgctcgacgccggggaatcggaagtgttcgcccgcgctgcgctggcgttgaagtacgacgaggacaagccagcgcccatcacggaatcgcaaatcctgatgccgcgccgccatgacgacgaccgccgcgacctgtggagcgtgttcaaccgcacgcaggagaacttgaccaaaggcggcctgtccgcccgcgccgcgaatggccgccgccagaccacccggcccgtgcagggcatcgaccaaagcgtgcgcctgaatcgcgccctgtggctgctggccgatggcctgcgccagttgaaagcctga

SEQ ID NO: 29050 - protein, 274 aa, Ralstonia metallidurans CH34
MQLASRFASRSPALRSDYPLSDDQIRRVAPSIFADAPHESRSERYSYIPTATVLQELRGEGFEPFMVTQTRVRHDDRRDYTKHMIRLRHASQINGREANEIILLNSHDGTSSYQMLAGMFRFVCSNGLVCGDTVADVRVPHKGDVAGHVIEGAYEVLHGFDRVQESRDAMRAITLDAGESEVFARAALALKYDEDKPAPITESQILMPRRHDDDRRDLWSVFNRTQENLTKGGLSARAANGRRQTTRPVQGIDQSVRLNRALWLLADGLRQLKA

SEQ ID NO: 29051 - DNA, 798 bp, Burkholderia fungorum LB400
  CDS (1)..(798)
atgctgagcgccaatacaccgctgtcggacgatcaaattcaccgcgtcgccccgtcgatcttcgcggacggcaagcacgaaagccgctccgaacgctacacctacatcccgaccattgatgtgctgcgcggccttcgcaacgaaggtttccaaccgttcatggtctgccagacccgcgtacgcgacgaggccaagcgcgaatacacgaagcacatgctccggcttcgccatgctgaccagatcaccggcgacgaagctgaggaagtcgtgctgctcaattcgcacgacggcaccagcagctatcagatgatcggcggcgtgctgagattcgtttgccagaacggtctggtcgcgggcgaaaacgtggccgatatccgagtgccgcaccagggcaacatcgtccagaacgtcatcaacggcgcatttgacgtgctcgacggctttgatctgatccgcgagcagaaggacggcatgcacgccgtcgagctgaatcgcgacgagcaacacgctttcgcccgttccgcgctcgcgctgcgctacaacccgaccgacgccgaggcaccggcccccgttactgaaagccagctactcgctccccgccgcttcgaggatcgccgcgacgacctctggacggtatttcagcgggttcaggaaaacctcaccaaaggcggcctgcacggacgttcgcgcaacggacgcgccatgtctacgcgtcccatcaccggcatcgaccagaacgtgaagctcaaccgtgcgctgtggatgctcgctgacgccatgcgccagatgaaggcgtaa

SEQ ID NO: 29052 - protein, 265 aa, Burkholderia fungorum LB400
MLSANTPLSDDQIHRVAPSIFADGKHESRSERYTYIPTIDVLRGLRNEGFQPFMVCQTRVRDEAKREYTKHMLRLRHADQITGDEAEEVVLLNSHDGTSSYQMIGGVLRFVCQNGLVAGENVADIRVPHQGNIVQNVINGAFDVLDGFDLIREQKDGMHAVELNRDEQHAFARSALALRYNPTDAEAPAPVTESQLLAPRRFEDRRDDLWTVFQRVQENLTKGGLHGRSRNGRAMSTRPITGIDQNVKLNRALWMLADAMRQMKA

SEQ ID NO: 29053 - DNA, 798 bp, Burkholderia fungorum LB400
  CDS (1)..(798)
atgctccgttccgactcgccgctgtcggacgaccagatccgccgtgttgctccctcgattttcgcggacggcaagcacgaaagccgctccgaccgctacacctacattcccaccatcgacgtgctgcgcggtctgcgcaacgaaggcttccagccgttcatggtgtgccagacccgcgtgcgcgcccaggacaagcgcgaattcaccaagcatctgatccgcatgcgccccgcgagcgaaattaccggcgaggatgtcaacgaagtcatcctcctcaattcgcacgatgggtccagcggattccagttgctcggtggcgtctatcgcttcgtctgccagaacgggatggttgcgggcgaaaccatcggcgaggtccgcgtcccgcacaggggcaacatcgtgcagaacgtcatcaacggcgcgttcgatgtgctcgacggcttcgacctgatccgcgaacagaaggacggcatgaaagccgtcacgctcgatcgcgacgaacagtacgcgttcgcgcgctccgccctcgcgctgcgctacgacccgtccgacaccgaagcacccgcccccgtcaccgaaagccagttactcgccccgcgtcgcttcgaggaccgccgggacgacctgtggacggtatttcaaagaacgcaggaaaacctcaccaagggcggactgcatggacgctcgcgcagcggacgctccatgtccacgcgtcccatcaccggcatcgaccagaacgtgaagctcaaccgcgcgctgtggatgctggctgacgccatgcggcagatgaaatcgtaa

SEQ ID NO: 29054 - protein, 265 aa, Burkholderia fungorum LB400
MLRSDSPLSDDQIRRVAPSIFADGKHESRSDRYTYIPTIDVLRGLRNEGFQPFMVCQTRVRAQDKREFTKHLIRMRPASEITGEDVNEVILLNSHDGSSGFQLLGGVYRFVCQNGMVAGETIGEVRVPHRGNIVQNVINGAFDVLDGFDLIREQKDGMKAVTLDRDEQYAFARSALALRYDPSDTEAPAPVTESQLLAPRRFEDRRDDLWTVFQRTQENLTKGGLHGRSRSGRSMSTRPITGIDQNVKLNRALWMLADAMRQMKS

SEQ ID NO: 29055 - DNA, 798 bp, Burkholderia fungorum LB400
  CDS (1)..(798)
atgctgcgcgccgattccccgctctcggacgagcagatccgtcgcgtcgcgccgtccatcttcgcggacggcaagcacgcaagtcgctccgaacgctacacctacattcccactatcgatgtgctgcgcggcctgcgcaacgaaggcttccagccgttcatggtctgccagagccgcgtgcgcgatccgggcaagcgcgagtacacgaaacacatgctccggcttcgccacgccagccagatcgtcggggacgaagccaacgaggtcgtactcctgaactcgcacgacggcacgagcagctaccagatgctggctggcgtgctgcgtttcgtctgccagaacggcatggtcgcgggcgacagcgtgcgcgatatccgcataccgcacaaaggcaacatcgcacggaacgtcatcgatggcgcgttcgacgtgctcgacggcttcgacctgatccgcgagcagaaggacagcatgcgcggcatcgaactggaccgcgatgaacagcacgcgtttgcccgttccgccctcgcgctgcgctacgacccgactgacgcggaagcccccgcccccgtcaccgagagccagttactcgccccacgccgtttcgaggatcgccgcgacgatctctggacggtgttcaaccgggtgcaggaaaacctcaccaaaggcggactgcacgggcgctcgcggaccggtcgcgcgatctccacgcgccctgtcaccggcatcgaccagaacgtgaaactcaatcgcgccctctggatgctggccgacgccatgcgcaagatgaaggcgtaa

SEQ ID NO: 29056 - protein, 265 aa, Burkholderia fungorum LB400
MLRADSPLSDEQIRRVAPSIFADGKHASRSERYTYIPTIDVLRGLRNEGFQPFMVCQSRVRDPGKREYTKHMLRLRHASQIVGDEANEVVLLNSHDGTSSYQMLAGVLRFVCQNGMVAGDSVRDIRIPHKGNIARNVIDGAFDVLDGFDLIREQKDSMRGIELDRDEQHAFARSALALRYDPTDAEAPAPVTESQLLAPRRFEDRRDDLWTVFNRVQENLTKGGLHGRSRTGRAISTRPVTGIDQNVKLNRALWMLADAMRKMKA

SEQ ID NO: 29057 - DNA, 819 bp, Escherichia coli
  CDS (1)..(819)
atgcgactagccagtcgttttggttatgcgaaccagatacgccgtgaccgtccgctgacacacgaagaactgatgcactatgtgccggggattttcggggaagataaacacacgtcccgaagccagaactatacgtacatccccaccatcaccgtactggaaagcctgcagcgggaaggctttcagccattcttcgcctgccagacccgtgtgcgcgacccgggccgccggggatacacaaaacacatgctgcgtctgcggcgggccggagagataaacggagaacatgtccctgaaattattctgctcaactctcatgacggtacctccagctaccagatgctgccgggttacttcaggttcgtctgccagaacgggtgcgtctgtggtcagtctctgggggaagtgcgtgttccgcaccggggaaatgtggtggacagagtcattgaaggggcttacgaggtagtgggcgtgtttgaccggattgaggaaaagcgtgatgccatgcagtcgctgattctgccgccaccggcacgccaggcgctggcacaggcggcactgacttaccgttatggtgacgaacatcagcccgtcaccaccgccgacattctgacgccacgacgccgggaggattacggtaaggacctgtggagtgcttatcagaccattcaggagaatatgctgaaaggcggaatttcaggtcgcagcgctaaaggaaaacgtatccatacccgtgccattcacagcattgacactgacattaagctcaaccgcgcattgtgggtgatggcggaaaccctgctggagagcctgcgctga

SEQ ID NO: 29058 - protein, 272 aa, Escherichia coli
MRLASRFGYANQIRRDRPLTHEELMHYVPGIFGEDKHTSRSQNYTYIPTITVLESLQREGFQPFFACQTRVRDPGRRGYTKHMLRLRRAGEINGEHVPEIILLNSHDGTSSYQMLPGYFRFVCQNGCVCGQSLGEVRVPHRGNVVDRVIEGAYEVVGVFDRIEEKRDAMQSLILPPPARQALAQAALTYRYGDEHQPVTTADILTPRRREDYGKDLWSAYQTIQENMLKGGISGRSAKGKRIHTRAIHSIDTDIKLNRALWVMAETLLESLR

SEQ ID NO: 29059 - DNA, 1023 bp, Alcaligenes faecalis
  CDS (1)..(1023)
atgcttgtttccttgacggtccacgttcgtgggctcctgaccgtcgcgggcgatgaactcaggaaagacggtggcaacgaggccaaccgggttcctcgtgccgactgcaccgaacagctgaaaagccgggctccgaatcttggaatccggtgtgcagtgaacagccaacctttttatgtcaggagaataaccatgctggtatcccgtttcgctttccgttcccccgtgcttcgcagtgagtccccgttgtcggatgatcaaattcgtgcggttgtgccatccatttttgccgatgcgcctcatgaaagccgttctgaccggtacacctatattcccacagtggctgtgttgaccgagctgcgaaaagaagggtttcagccgtttatggtgacacaaacccgtgtgcgtaataccgagcgccgcgactttacaaaacatatgatccgtttacgccatgccgggcagatcaacacacgcggggaagccaatgaaatcattttgcttaattcccatgacggtagcagcagttatcagatgctggccggtatgttccgttttgtgtgcagcaacgggctggtgtgcggtgaaaccgtcgcagatgttcgcgtaccgcataagggggatgttgccggactggtggtcgagggcgcatatcgtgttctgggtggatttgatcgtgcaagggagtcgcgggagttgatgcgggatatcaccctggaggcgggtgagactgaggtatttgcccgtgccgcgttgtcgttgaaatatgatgatcccgataaaccagcccctgtaactgaaacccagattcttttgccgcgtcgtgccgaggatcgccgttctgatttgtggagtgtgtttaatcgtacccaggaaaacttaaccaaaggtggtttgtcggggcgttcagccaatggcagtcgtcagaaaaccagaccggtgcaggggatagaccagaatatcaaactgaatcgggccttgtggttactggctgacggcatgcgtcaattgaaggcaggttga

SEQ ID NO: 29060 - protein, 340 aa, Alcaligenes faecalis
MLVSLTVHVRGLLTVAGDELRKDGGNEANRVPRADCTEQLKSRAPNLGIRCAVNSQPFYVRRITMLVSRFAFRSPVLRSESPLSDDQIRAVVPSIFADAPHESRSDRYTYIPTVAVLTELRKEGFQPFMVTQTRVRNTERRDFTKHMIRLRHAGQINTRGEANEIILLNSHDGSSSYQMLAGMFRFVCSNGLVCGETVADVRVPHKGDVAGLVVEGAYRVLGGFDRARESRELMRDITLEAGETEVFARAALSLKYDDPDKPAPVTETQILLPRRAEDRRSDLWSVFNRTQENLTKGGLSGRSANGSRQKTRPVQGIDQNIKLNRALWLLADGMRQLKAG

SEQ ID NO: 29061 - DNA, 819 bp, Escherichia coli
  CDS (1)..(819)
atgcgattagccagccgttttggttatgtaaatcagatccgccgggagcgcccgctgacacgcgaagaactgatgtaccacgtcccgagtatttttgcggaagaccggcacacctcccgcagtgaacggtatgcgtacattcccaccatcaccgtcctggaaaatctgcagcgggaaggctttcagccgttcttcgcctgccagacccgtgtgcgcgaccagagccgccgggaatataccaaacatatgctgcgtctgcgacgggccggacagataaccggtcagcatgtgcctgaaattattctgctcaactcccatgacggttcatccagctaccagatgttacccggatattttcgtgccatctgcaccaatggcctggtctgcggtcagtcgctgggagaagtccgggtgccacaccggggaaacgtggtggacagtgtgattgaaagtgcttacgaggtggtgggggtttttgaccggattgaagaaaagcgtgacgccatgcagtcgctggtcctgccgccaccgtcacgccaggcgctggcacaggcggcactgacttaccgttatggtgacgaacatcagcccgtcaccaccgccgacattctgacgccacgacgccgggaggattacggtaaggacctgtggagtgcttatcagaccatccaggagaatatgctgaaaggcgggatttccggtcgcagtgccagaggaaaacgtatccatacccgtaccattcacagcatcgacaccgacattaagctcaaccgggcgttgtgggtgatggcagaaacactgctggagagcatgcgctga

SEQ ID NO: 29062 - protein, 272 aa, Escherichia coli
MRLASRFGYVNQIRRERPLTREELMYHVPSIFAEDRHTSRSERYAYIPTITVLENLQREGFQPFFACQTRVRDQSRREYTKHMLRLRRAGQITGQHVPEIILLNSHDGSSSYQMLPGYFRAICTNGLVCGQSLGEVRVPHRGNVVDSVIESAYEVVGVFDRIEEKRDAMQSLVLPPPSRQALAQAALTYRYGDEHQPVTTADILTPRRREDYGKDLWSAYQTIQENMLKGGISGRSARGKRIHTRTIHSIDTDIKLNRALWVMAETLLESMR

SEQ ID NO: 29063 - DNA, 819 bp, Escherichia coli
  CDS (1)..(819)
atgcgattagccagtcgttttggttatgcgaaccaggtacgtcgtgatcgtccgctgacacacgaagaactgatgcgccatgtaccgagtatttttggggaagaccgacatacctcccgcagtgaacactatgcgtacattcccactatcaccgtcctggaaaatctgcagcaggaaggctttcagccattcttcgcctgccagacccgcgtacgtgacccgggccgccggggatacacaaaacacatgctgcgcctgcgccgtaacggggagataaacggacaacatgtccctgaaattattctgctcaactcccatgacggtacctccagctaccagatgctgccgggttacttcagattcgtctgccagaacggctgcgtctgcggtcagtctctgggggaagtccatgtgccccaccggggaaatgtggtggacagagtcattgaaggggctcacgaggtagtgggcgtttttgaccggattgaggaaaagcgtgatgccatgcagtctctggttctgccgccaccggcacgtcaggcactggcacaggcggcgctgacttaccgttatggtgatgaacatcaacccgtcaccactgccgacattctgacaccacgacgccgggaggattacggtaaggacctgtggagcgcatatcagaccatccaggagaatatgctgaaaggcgggatttccggccgtagtgcaaaaggaaaacgtatccatacccgcgccattcacagtatcgacaccgacatcaagctcaatcgcgcattgtgggtgatggcggaaacgctgctggagagcatgcgctga

SEQ ID NO: 29064 - protein, 272 aa, Escherichia coli
MRLASRFGYANQVRRDRPLTHEELMRHVPSIFGEDRHTSRSEHYAYIPTITVLENLQQEGFQPFFACQTRVRDPGRRGYTKHMLRLRRNGEINGQHVPEIILLNSHDGTSSYQMLPGYFRFVCQNGCVCGQSLGEVHVPHRGNVVDRVIEGAHEVVGVFDRIEEKRDAMQSLVLPPPARQALAQAALTYRYGDEHQPVTTADILTPRRREDYGKDLWSAYQTIQENMLKGGISGRSAKGKRIHTRAIHSIDTDIKLNRALWVMAETLLESMR

SEQ ID NO: 29065 - DNA, 828 bp, Wautersia oxalatica
  CDS (1)..(828)
atgcaacttgcatcccgcttcgctcaccactcacccgcattgcgcagcgaaaccccgctgtccgatgaccagattcgcagagtggccccgtccatcttcgcggacgccccgcacgaaagccgttccgagcggtacagctacatccccaccgccgccgtgctgaccgaacttcgcaaggaggggttccagcccttcatggtgtgccagacccgcgtgcgcaacgaggggcggcgcgagcacacgaaacacatgctgcgcctgcgccatgccaaccagatcaacgcccgcgaggccaacgaaatcatcctgctgaactcgcacgacggcacgagcagctatcaattgctgggtggcatgttccgctttgtttgcagcaatggccttgtctgcggcgacaccgtgggcgatgtgcgcgtgccccacaaaggcgacgtggccgggcatgtcatcgagggcgcttatcaggtgctgggtggcttcgagtatgcgcaggcatcgcgtgaatccatgcaggccatcacgttggatgccggggaatccgaagtgttcgcccgcgccgcgttggccctcaagtacgacgacccggacaagcccgcgcccatcacggaatcgcaaatcctgatgccgcgccgcttcgaggaccgccgtcccgacctgtggagcgtgttcaaccgcacgcaggagaacttaaccaagggcggattgcatggccgcgccgccaatggccgcaggcagcagacccgccccgtgcagggcatcgattcggacattcgcctgaatcgcgctctgtggctgctggccgatggcatgcgccaactcaaagcctga

SEQ ID NO: 29066 - protein, 275 aa, Wautersia oxalatica
MQLASRFAHHSPALRSETPLSDDQIRRVAPSIFADAPHESRSERYSYIPTAAVLTELRKEGFQPFMVCQTRVRNEGRREHTKHMLRLRHANQINAREANEIILLNSHDGTSSYQLLGGMFRFVCSNGLVCGDTVGDVRVPHKGDVAGHVIEGAYQVLGGFEYAQASRESMQAITLDAGESEVFARAALALKYDDPDKPAPITESQILMPRRFEDRRPDLWSVFNRTQENLTKGGLHGRAANGRRQQTRPVQGIDSDIRLNRALWLLADGMRQLKA

SEQ ID NO: 29067 - DNA, 819 bp, Escherichia coli
  CDS (1)..(819)
atgcaattagccagtcgttttggtcatgtaaatcagatccgtcgggagcgcccactgacacgcgaagaactgatgtaccacgtcccgagtatttttggagaagaccggcacacctcccgcagtgaacggtatgcgtacattcccaccatcaccgtcctggaaaatctgcagcgggaaggctttcagccgttcttcgcctgccagacccgtgtgcgcgaccagagccgccgggaatataccaaacatatgctgcgtctgcggcgggccggacagataaccggtcagcatgtgcctgaaattattctgctcaactcccatgacggttcatccagctaccagatgttacccggatattttcgtgccatttgtaccaatggcctggtctgcggtcagtcgctgggagaagtccgggtgccacaccggggaaacgtggtggacagggtcatagaaggtgcttacgaagtggtgggcgtgtttgacctgattgaggaaaagcgtgatgccatgcagtcgctggtcctgccgccaccggcacgccaggcgctggcacaggcggcgctgacttaccgttatggtgatgaacatcagcccgtcaccactaccgacattctgacgccacgacgccgggaggattacggtaaggacctgtggagtgcttatcagaccatccaggagaatatgctgaaaggcgggatttccgctcgcagtgccagaggaaaacgtatccatacccgggccattcacagcatcgataccgacattaagctcaaccgggcgttgtgggtgatggcagaaacgctgctggagagcctgcgctga

SEQ ID NO: 29068 - protein, 272 aa, Escherichia coli
MQLASRFGHVNQIRRERPLTREELMYHVPSIFGEDRHTSRSERYAYIPTITVLENLQREGFQPFFACQTRVRDQSRREYTKHMLRLRRAGQITGQHVPEIILLNSHDGSSSYQMLPGYFRAICTNGLVCGQSLGEVRVPHRGNVVDRVIEGAYEVVGVFDLIEEKRDAMQSLVLPPPARQALAQAALTYRYGDEHQPVTTTDILTPRRREDYGKDLWSAYQTIQENMLKGGISARSARGKRIHTRAIHSIDTDIKLNRALWVMAETLLESLR

SEQ ID NO: 29069 - DNA, 828 bp, Pseudomonas aeruginosa
  CDS (1)..(828)
atgcaactcgcctctcgtttcgctccccgctcgccgatactgcgcgctgatcatccgctgtccgatgagcagattcgcgcggtggcaccgtcgatctttgcggacaccccgcatgagagccggtccgagcgctacagctacatccccaccgcttcggtacttgccgagctgcgcggagaaggtttccagcctttcatggtgtgccagacccgcgtgcgccacgaggaccgccgcgaattcaccaagcacatgatccgccttcgccacgccagccagatcaatggcaacgaagcgaatgaaatcatcctcctcaactcgcacgacggcaccagcagctaccagatgctcgccggcatgttcaggttcgtctgccacaacggcttggtctgcggtaacaccctcgccgatgtccgtgtgcatcacaaaggcaatgtcgccgagcacgtgatcgaaggtgcctacgaggtcctccacggcttcgaacaggtgcaggcgtcgcgcgacgcgatgcgcctgatcaccctggacgaaggcgagcaagaagtcttggcccgctcggcactggcgctcaagtacgacacgcccaaccaggtagtgccgatcaccgaggcacaggtgctgatgccccgacgcgtcgatgaccggggcagcgacctgtggtccaccttcaatcgcattcaggagaacctcgtcaaaggcggtttgaacggacgcagcgcccatggccgccgccagagtacccggccggttcaggggatcgaccagaacgtgcggctcaaccgcgcactgtggatgctggccgaaggcatgcaacagctgaaggcctga

SEQ ID NO: 29070 - protein, 275 aa, Pseudomonas aeruginosa
MQLASRFAPRSPILRADHPLSDEQIRAVAPSIFADTPHESRSERYSYIPTASVLAELRGEGFQPFMVCQTRVRHEDRREFTKHMIRLRHASQINGNEANEIILLNSHDGTSSYQMLAGMFRFVCHNGLVCGNTLADVRVHHKGNVAEHVIEGAYEVLHGFEQVQASRDAMRLITLDEGEQEVLARSALALKYDTPNQVVPITEAQVLMPRRVDDRGSDLWSTFNRIQENLVKGGLNGRSAHGRRQSTRPVQGIDQNVRLNRALWMLAEGMQQLKA

SEQ ID NO: 29071 - DNA, 828 bp, Pseudomonas aeruginosa
  CDS (1)..(828)
atgtctctggtatcccgctttgctccgcaatccccgatcctgcgctctgatcgcccactctcggacgaccgcattcgtgccgtcgttccgtcgatcttcgccgacgctccacatgggagccggtccgatcggtatgcctacataccgacctcgaccgtgctgaccaagctgcgccaggagggcttcgagcccttcatggtgtgtcagacgcgcgtgcgcaacgaagaccggcgcgagtacacgaagcacctcatccgacttcgccatgcaagccagatcaacggcgacgaggcgaacgagatcatcctgctcaacagccatgacggcacgagcagctatcagatgctcgccggcatgttccggttcgtctgccacaacggcctggtttgcggtgacaccaccgcagacatccgcgttccccacaagggcgacgtggccagccaggtgatcgaaggtgcctacggagtcctcgaaggtttcgagcgcgtgcataacgcgcgcgatgcgatgcgcaccatcaccctcgatgagggcgaagcggaggtctttgcgaactctgcgctcgcactcaagtacgacgatccggccaagtccacgcctgtcaccgagagccaactgctggcccctcggcgatgggacgaccgcaagaacgacctgtgggccgtcttcaaccgcgtccaggagaacctagtcaaagggggcctgaacggacgcacggccaacggccgcaatcagcgcacccgtccggtgcaaggcatcgaccagaacctgcgcctgaaccgggcgttgtggctgctggccgaaggcatgcgccagctcaaggcgtga

SEQ ID NO: 29072 - protein, 275 aa, Pseudomonas aeruginosa
MSLVSRFAPQSPILRSDRPLSDDRIRAVVPSIFADAPHGSRSDRYAYIPTSTVLTKLRQEGFEPFMVCQTRVRNEDRREYTKHLIRLRHASQINGDEANEIILLNSHDGTSSYQMLAGMFRFVCHNGLVCGDTTADIRVPHKGDVASQVIEGAYGVLEGFERVHNARDAMRTITLDEGEAEVFANSALALKYDDPAKSTPVTESQLLAPRRWDDRKNDLWAVFNRVQENLVKGGLNGRTANGRNQRTRPVQGIDQNLRLNRALWLLAEGMRQLKA

SEQ ID NO: 29073 - DNA, 822 bp, Escherichia coli
  CDS (1)..(822)
atgacccgtctggcttcgcgctttggcgctgcaaatcttattcgccgtgaccgtccgttaacccgtgaagagttatttcgcgtggtgcccagcgtattcagtgaggataaacacgaatcccgcagtgaacgctacacgtatatacccacaatttccctgctggacagcctgcagcgggaaggcttccagccattctttgcctgtcagacacgggtacgtgacccccgtcgtcgtgagcatactaagcatatgctgcgcctacgtcgggaggggcaaattaccggtaaacaggttccggaaattatcctgcttaactctcacgatggcaccagttcgtaccagatgctgccgggcatgttcagggcggtgtgccagaacggtctggtctgcggcgagtcgtttggcgaggtgcgggtgccacacaagggggatgtggtgagtcaggttattgagggggcgtatgaagtgctggggatttttgagcgtgtggaagaaaagagggatgccatgcagtcgttgcttttaccgccacctgtgcagcaggcactggcaaaagcagcgcttacgtatcgctttggtgaggaccaccagccggttactgaatcgcagatactctccccacgccgctggcaggatgagagcaatgacctttggaccacctatcagcggattcaagaaaacctgattaagggcggactcagtgggcgtaatgctaaaggcggacgaactcatactcgtgccgtgcgtggcattgacggggatgtgaagcttaaccgtgcgctgtgggtgatggcagaaacactgctcacgcaactgcagtag

SEQ ID NO: 29074 - protein, 273 aa, Escherichia coli
MTRLASRFGAANLIRRDRPLTREELFRVVPSVFSEDKHESRSERYTYIPTISLLDSLQREGFQPFFACQTRVRDPRRREHTKHMLRLRREGQITGKQVPEIILLNSHDGTSSYQMLPGMFRAVCQNGLVCGESFGEVRVPHKGDVVSQVIEGAYEVLGIFERVEEKRDAMQSLLLPPPVQQALAKAALTYRFGEDHQPVTESQILSPRRWQDESNDLWTTYQRIQENLIKGGLSGRNAKGGRTHTRAVRGIDGDVKLNRALWVMAETLLTQLQ

SEQ ID NO: 29075 - DNA, 822 bp, Escherichia coli
  CDS (1)..(822)
atgcgattagcttcccgttttggtcggtataattccatccaccgtgaacgtcctttaacggatgatgaattaatgcagttcgtgccttcggtattttccggtgataaacatgagtcccggagtgaacgttatacgtatattccaacaatcaatatcatcaataagttacgtgatgaaggtttccagccattctttgcctgtcagagtcgggttcgtgatttgggacgtcgcgaatacagtaaacatatgttacgtcttcgcagggaagggcatattaacgggcaggaagttcctgaaattatcctgcttaattcacatgatggttcatccagttatcagatgatccccggaatttttcgttttgtctgcacaaatggcctggtgtgcggaaataattttggcgaaatccgcgttccacataaaggtgatattgtcgggcaggttatagagggcgcgtatgaagtgctcggtgtctttgataaggtcactgataatatggaggcgatgaaagaaattcatcttaacagtgacgagcaacatttatttggcagagctgcactgatggtcaggtatgaagatgaaaataaaacgccagtgacgcctgaacaaataattactccccgtcgttgggaggataaacagaacgatctctggacaacctggcagcgggttcaggagaatatgataaaaggtggattatcggggcgaagtgcctccgggaaaaataccaggacaagagccattacaggtattgatggtgatataagaatcaacaaggcgttgtgggtgattgccgaacagttcagaaagtggaagtcatga

SEQ ID NO: 29076 - protein, 273 aa, Escherichia coli
MRLASRFGRYNSIHRERPLTDDELMQFVPSVFSGDKHESRSERYTYIPTINIINKLRDEGFQPFFACQSRVRDLGRREYSKHMLRLRREGHINGQEVPEIILLNSHDGSSSYQMIPGIFRFVCTNGLVCGNNFGEIRVPHKGDIVGQVIEGAYEVLGVFDKVTDNMEAMKEIHLNSDEQHLFGRAALMVRYEDENKTPVTPEQIITPRRWEDKQNDLWTTWQRVQENMIKGGLSGRSASGKNTRTRAITGIDGDIRINKALWVIAEQFRKWKS

SEQ ID NO: 29077 - DNA, 23 bp, Primer
atgaggagtctgcttatgacccg

SEQ ID NO: 29078 - DNA, 23 bp, Primer
ttactgcagttgcgtgagcaggg

SEQ ID NO: 29079 - protein, 260 aa, consensus
  MISC_FEATURE (1)..(260): consensus for the disclosure of xaa see table XV
PLXXXXXXXXXPXXFXXXXHXSRSXXXXXXPTXXXXXXLXXEGFXPFXXXQXXXRXXXXXXXXKHXXRXRXXXXXXXXXXXXEXXLXNXXDGXSXXQXXXGXXRXXCXNGXXXGXXXXXXXXXHXGXXXXXXXVXXXAXXVXXXXXXXXXXXXXXXXXXXXXXXXXXXXXXAXXXXXXXXXXXXXXXXXXXPXTXXXXXXXRRXXDXXXXLWXXXXXXQENXXXGGXXXRXXXXXXXXXXXXXRXXXXIDXXXXXNXALW

SEQ ID NO: 29080 - protein, 279 aa, consensus
  MISC_FEATURE (1)..(279): consensus for the disclosure of xaa see table XV
LXSXFXXXXXXXRXXXPLXXXXXXXXXPSIFXXXXHXSRSXRYXYIPTXXVLXXLXXEGFXPFXXXQXRVRXXXXRXXTKHMXRLRXXXXIXXXXXXXEIXLLNSHDGXSSYQMXXGXFRFVCXNGXVXGXXXXXXRVPHXGXXXXXXXVIEGAXXVLXXFXXXXXXXXXMXXXXLXXXXXXXXAXXALXXXYXXXXXXXXXXXXXXPXTXXXXLXPRRXXDXXXDLWXXXXXXQENXXKGGXXGRXXXGXXXXXXXXTRXXXXIDXXXXLNRALWXXA

SEQ ID NO: 29081 - protein, 75 aa, consensus
  MISC_FEATURE (1)..(75): consensus for the disclosure of xaa see table XV
XXXXXPLXXXXXXXXXPXXFXXXXHXSRSXXXXXXPTXXXXXXLXXEGFXPFXXXQXXXRXXXXXXXXKHXXRXR

SEQ ID NO: 29082 - protein, 44 aa, consensus
  MISC_FEATURE (1)..(44): consensus for the disclosure of xaa see table XV
EXXLXNXXDGXSXXQXXXGXXRXXCXNGXXXGXXXXXXXXXHXG

SEQ ID NO: 29083 - protein, 44 aa, consensus
  MISC_FEATURE (1)..(44): consensus for the disclosure of xaa see table XV
VXXXAXXVXXXXXXXXXXXXXXXXXXXXXXXXXXXXXXAXXXXX

SEQ ID NO: 29084 - protein, 39 aa, consensus
  MISC_FEATURE (1)..(39): consensus for the disclosure of xaa see table XV
PXTXXXXXXXRRXXDXXXXLWXXXXXXQENXXXGGXXXR

SEQ ID NO: 29085 - protein, 23 aa, consensus
  MISC_FEATURE (1)..(23): consensus for the disclosure of xaa see table XV
RXXXXIDXXXXXNXALWXXXXXX

SEQ ID NO: 29086 - DNA, 1644 bp, Escherichia coli
  CDS (1)..(1644)
atgagagttaacctactaataacgatgataattttcgcgctaatctggccagtaactgcgctcagagcggcagtgagcaaaacaacctgggcggatgcaccggcacgcgagtttgtgtttgtcgaaaacaactcagacgacaactttttcgtcactcctggcggggcgctggatccgcgcctgaccggtgccaaccgctggaccggtttaaaatacactggttcaggaaccatctatcagcaaagcctcggctacattgataacggttacaacaccggcctttataccaactggaagtttgatatgtggctggaaaattcaccagtttcatctcctttaactggcttgcgctgcatcaactggtacgctgggtgtaatatgaccaccagtcttatcctgccgcaaaccaccgacgccagtggattttatggcgcgacggtgaccagcggcggcgcgaagtggatgcacggcatgttgtcagacgcgttttaccagtatatgcaacaaatgcccgtcggcagcagctttacaatgaccatcaatgcctgccagacctctgtgaactatgacgccagcagcggcgcacgctgtaaggatcaggcctccggcaactggtatgttcgcaacgtcacccatacgaaagcagcaaatctacggttgataaatacccactcgctggcggaagtatttatcaacagcgacggagtaccgactctgggcgaagggaacgccgactgccggacgcaaaccatcggcagccgttcaggattaagttgtaagatggttaactataccctgcaaacaaacggactcagcaacacctcaatccatatattcccggcgatcgccaactcgtcgttagcctcggccgtcggggcgtacgatatgcagttcagtctgaatggcagttcatggaaaccggtgagcaataccgcctattactacaccttcaacgagatgaagagcgcagactcgatctatgttttcttctcgagcaacttctttaagcagatggtgaacctcgggatcagcgatatcaacaccaaagatctattcaactttcgctttcagaacaccacatcaccggagtctggctggtatgaattttctacctccaacacgctgattatcaaaccccgtgatttcagcatcagtattatctccgatgaatatactcagacaccgtcgcgggagggatatgttggcagcggcgagtcggcactcgatttcggctatatcgtaaccaccagcggtaaaacagctgccgacgaagtgctgatcaaggtgaccggacccgcgcaggtgattggcgggcgctcctattgtgtcttcagctccgatgacggtaaggcgaaagtaccgttcccggcgacactttcctttattacccgcaacggagctacaaaaacctacgatgccgggtgcgatgatagctggcgggatatgaccgatgcgctgtggttgaccacaccgtggactgatatctctggcgaagtggggcagatggataagaccacagtcaaattttcgattccaatggataacgccatttcgctgcgtacggtagatgataacggctggtttggcgaagtcagcgcttcaggagagattcatgttcaggcgacgtggcgtaacattaactaa

SEQ ID NO: 29087 - protein, 547 aa, Escherichia coli
MRVNLLITMIIFALIWPVTALRAAVSKTTWADAPAREFVFVENNSDDNFFVTPGGALDPRLTGANRWTGLKYTGSGTIYQQSLGYIDNGYNTGLYTNWKFDMWLENSPVSSPLTGLRCINWYAGCNMTTSLILPQTTDASGFYGATVTSGGAKWMHGMLSDAFYQYMQQMPVGSSFTMTINACQTSVNYDASSGARCKDQASGNWYVRNVTHTKAANLRLINTHSLAEVFINSDGVPTLGEGNADCRTQTIGSRSGLSCKMVNYTLQTNGLSNTSIHIFPAIANSSLASAVGAYDMQFSLNGSSWKPVSNTAYYYTFNEMKSADSIYVFFSSNFFKQMVNLGISDINTKDLFNFRFQNTTSPESGWYEFSTSNTLIIKPRDFSISIISDEYTQTPSREGYVGSGESALDFGYIVTTSGKTAADEVLIKVTGPAQVIGGRSYCVFSSDDGKAKVPFPATLSFITRNGATKTYDAGCDDSWRDMTDALWLTTPWTDISGEVGQMDKTTVKFSIPMDNAISLRTVDDNGWFGEVSASGEIHVQATWRNIN

SEQ ID NO: 29088 - DNA, 1644 bp, Escherichia coli O157:H7
  CDS (1)..(1644)
atgagagttaacctactgatagcgatgataatctttgcgctaatctggccagtaactgcgctcagagcggcagtgagcaaaacaacctgggcggatgcaccggcacgcgagtttgtgtttgtcgaaaacaactcagacgacaactttttcgtcactcctggcggggcgctggatccgcgcctgaccggtgccaaccgctggaccggtttaaaatacaatggttcaggaaccatctatcagcaaagcctcggctacattgataacggttacaacaccggcctttataccaactggaagtttgatatgtggctggaaaattcaccagtttcatctcctttaactggcttgcgctgcatcaactggtacgctgggtgtaatatgaccaccagtcttatcctgccgcaaaccaccgacaccagtggattttatggcgcgacggtgaccagcggcggcgcgaagtggatgcacggcatgttgtcagacgcgttttaccagtatctgcaacaaatgcccgtcggcagcagctttacaatgaccatcaatgcctgccagacctctgtgaactatgacgccagcagcggcgcacgctgtaaggatcaggcctccggcaactggtatgttcgcaacgtcacccatacgaaagcagcaaatctacggttgataaatacccactcgctggcggaagtatttatcaacagcgacggagtaccgactctgggcgaagggaacgccgactgccggacgcaaaccatcggcagccgttctggattaagttgtaagatggttaactataccctgcaaacaaacggactcagcaacacctcaatccatatattcccggcgatcgccaactcgtcgttagcctcggccgtcggggcgtacgatatgcagttcagtctgaatggcagttcatggaaaccggtgagcaatactgcctattactacaccttcaacgagatgaagagcgcagactcgatctatgttttcttctcgagcaacttctttaagcagatggtgaaccagggaatcagcgatatcaacaccaaagatctattcaactttcgctttcagaacaccacatcaccggagtctggctggtatgaattttctacctccaacacgctgattatcaaaccccgtgatttcagcatcagtattatctccgatgaatatactcagacaccgtcgcgggagggatatgtcggcagcggcgagtcggcactcgatttcggctatatcgtaaccaccagcggtaaaacagctgccgacgaagtgctgatcaaggtgaccggacccgcgcaggtgattggcgggcgctcctattgtgtcttcagctccgatgacggtaaggcgaaagtaccgttcccggcgacgctttcctttattacccgcaacggagctacaaaaacctacgatgccgggtgcgatgatagctggcgggatatgaccgatgcgctgtggttgaccacaccgtggactgatatctctggcgaagtggggcagatggataagaccacagtcaaattttcgattccaatggataacgccatttctctgcgtacggtagatgataacggctggtttggcgaagtcagcgcttcaggagaaattcatgttcaggcgacgtggcgtaacattaactaa

SEQ ID NO: 29089 - protein, 547 aa, Escherichia coli O157:H7
MRVNLLIAMIIFALIWPVTALRAAVSKTTWADAPAREFVFVENNSDDNFFVTPGGALDPRLTGANRWTGLKYNGSGTIYQQSLGYIDNGYNTGLYTNWKFDMWLENSPVSSPLTGLRCINWYAGCNMTTSLILPQTTDTSGFYGATVTSGGAKWMHGMLSDAFYQYLQQMPVGSSFTMTINACQTSVNYDASSGARCKDQASGNWYVRNVTHTKAANLRLINTHSLAEVFINSDGVPTLGEGNADCRTQTIGSRSGLSCKMVNYTLQTNGLSNTSIHIFPAIANSSLASAVGAYDMQFSLNGSSWKPVSNTAYYYTFNEMKSADSIYVFFSSNFFKQMVNQGISDINTKDLFNFRFQNTTSPESGWYEFSTSNTLIIKPRDFSISIISDEYTQTPSREGYVGSGESALDFGYIVTTSGKTAADEVLIKVTGPAQVIGGRSYCVFSSDDGKAKVPFPATLSFITRNGATKTYDAGCDDSWRDMTDALWLTTPWTDISGEVGQMDKTTVKFSIPMDNAISLRTVDDNGWFGEVSASGEIHVQATWRNIN

SEQ ID NO: 29090 - DNA, 26 bp, Primer
atgagagttaacctactaataacgat

SEQ ID NO: 29091 - DNA, 24 bp, Primer
ttagttaatgttacgccacgtcgc

SEQ ID NO: 29092 - DNA, 2685 bp, Escherichia coli K12; identical to SEQ ID NO: 1982
  CDS (1)..(2685)

SEQ ID NO: 29093 - protein, 894 aa, Escherichia coli K12; identical to SEQ ID NO: 1983

SEQ ID NO: 29094 - DNA, 2679 bp, Caulobacter crescentus; identical to SEQ ID NO: 1984
  CDS (1)..(2679)

SEQ ID NO: 29095 - protein, 892 aa, Caulobacter crescentus; identical to SEQ ID NO: 1985

SEQ ID NO: 29096 - DNA, 2709 bp, Salmonella enterica subsp. enterica serovar Typhi; identical to SEQ ID NO: 1986
  CDS (1)..(2709)

SEQ ID NO: 29097 - protein, 902 aa, Salmonella enterica subsp. enterica serovar Typhi; identical to SEQ ID NO: 1987

SEQ ID NO: 29098 - DNA, 2691 bp, Listeria innocua; identical to SEQ ID NO: 1988
  CDS (1)..(2691)

SEQ ID NO: 29099 - protein, 896 aa, Listeria innocua; identical to SEQ ID NO: 1989

SEQ ID NO: 29100 - DNA, 2727 bp, Yersinia pestis; identical to SEQ ID NO: 1990
  CDS (1)..(2727)

SEQ ID NO: 29101 - protein, 908 aa, Yersinia pestis; identical to SEQ ID NO: 1991

SEQ ID NO: 29102 - DNA, 2658 bp, Pseudomonas aeruginosa; identical to SEQ ID NO: 1992
  CDS (1)..(2658)

SEQ ID NO: 29103 - protein, 885 aa, Pseudomonas aeruginosa; identical to SEQ ID NO: 1993

SEQ ID NO: 29104 - DNA, 2634 bp, Staphylococcus aureus; identical to SEQ ID NO: 1994
  CDS (1)..(2634)

SEQ ID NO: 29105 - protein, 877 aa, Staphylococcus aureus; identical to SEQ ID NO: 1995

SEQ ID NO: 29106 - DNA, 2703 bp, Agrobacterium tumefaciens; identical to SEQ ID NO: 1996
  CDS (1)..(2703)

SEQ ID NO: 29107 - protein, 900 aa, Agrobacterium tumefaciens; identical to SEQ ID NO: 1997

SEQ ID NO: 29108 - DNA, 2658 bp, Staphylococcus aureus; identical to SEQ ID NO: 1998
  CDS (1)..(2658)

SEQ ID NO: 29109 - protein, 885 aa, Staphylococcus aureus; identical to SEQ ID NO: 1999

SEQ ID NO: 29110 - DNA, 2691 bp, Sinorhizobium meliloti; identical to SEQ ID NO: 2000
  CDS (1)..(2691)

SEQ ID NO: 29111 - protein, 896 aa, Sinorhizobium meliloti; identical to SEQ ID NO: 2001

SEQ ID NO: 29112 - DNA, 2703 bp, Clostridium acetobutylicum; identical to SEQ ID NO: 2002
  CDS (1)..(2703)

SEQ ID NO: 29113 - protein, 900 aa, Clostridium acetobutylicum; identical to SEQ ID NO: 2003

SEQ ID NO: 29114 - DNA, 2583 bp, Mycobacterium tuberculosis; identical to SEQ ID NO: 2004
  CDS (1)..(2583)

SEQ ID NO: 29115 - protein, 860 aa, Mycobacterium tuberculosis; identical to SEQ ID NO: 2005

SEQ ID NO: 29116 - DNA, 2547 bp, Streptomyces coelicolor; identical to SEQ ID NO: 2006
  CDS (1)..(2547)

SEQ ID NO: 29117 - protein, 848 aa, Streptomyces coelicolor; identical to SEQ ID NO: 2007

SEQ ID NO: 29118 - DNA, 2694 bp, Photorhabdus luminescens; identical to SEQ ID NO: 2008
  CDS (1)..(2694)

SEQ ID NO: 29119 - protein, 897 aa, Photorhabdus luminescens; identical to SEQ ID NO: 2009

SEQ ID NO: 29120 - DNA, 2688 bp, Chromobacterium violaceum; identical to SEQ ID NO: 2010
  CDS (1)..(2688)

SEQ ID NO: 29121 - protein, 895 aa, Chromobacterium violaceum; identical to SEQ ID NO: 2011

SEQ ID NO: 29122 - DNA, 2715 bp, Bordetella pertussis; identical to SEQ ID NO: 2012
  CDS (1)..(2715)

SEQ ID NO: 29123 - protein, 904 aa, Bordetella pertussis; identical to SEQ ID NO: 2013

SEQ ID NO: 29124 - DNA, 2796 bp, Bordetella bronchiseptica; identical to SEQ ID NO: 2014
  CDS (1)..(2796)

SEQ ID NO: 29125 - protein, 931 aa, Bordetella bronchiseptica; identical to SEQ ID NO: 2015

SEQ ID NO: 29126 - DNA, 2556 bp, Streptomyces avermitilis; identical to SEQ ID NO: 2016
  CDS (1)..(2556)

SEQ ID NO: 29127 - protein, 851 aa, Streptomyces avermitilis; identical to SEQ ID NO: 2017

SEQ ID NO: 29128 - DNA, 2553 bp, Enterococcus faecalis; identical to SEQ ID NO: 2018
  CDS (1)..(2553)

SEQ ID NO: 29129 - protein, 850 aa, Enterococcus faecalis; identical to SEQ ID NO: 2019

SEQ ID NO: 29130 - DNA, 2664 bp, Pseudomonas syringae; identical to SEQ ID NO: 2020
  CDS (1)..(2664)

SEQ ID NO: 29131 - protein, 887 aa, Pseudomonas syringae; identical to SEQ ID NO: 2021

SEQ ID NO: 29132 - DNA, 2655 bp, Pseudomonas putida; identical to SEQ ID NO: 2022
  CDS (1)..(2655)

SEQ ID NO: 29133 - protein, 884 aa, Pseudomonas putida; identical to SEQ ID NO: 2023

SEQ ID NO: 29134 - DNA, 2724 bp, Bradyrhizobium japonicum; identical to SEQ ID NO: 2024
  CDS (1)..(2724)

SEQ ID NO: 29135 - protein, 907 aa, Bradyrhizobium japonicum; identical to SEQ ID NO: 2025

SEQ ID NO: 29136 - DNA, 2613 bp, Leptospira interrogans; identical to SEQ ID NO: 2026
  CDS (1)..(2613)

SEQ ID NO: 29137 - protein, 870 aa, Leptospira interrogans; identical to SEQ ID NO: 2027

SEQ ID NO: 29138 - DNA, 2661 bp, Xanthomonas campestris; identical to SEQ ID NO: 2028
  CDS (1)..(2661)

SEQ ID NO: 29139 - protein, 886 aa, Xanthomonas campestris; identical to SEQ ID NO: 2029

SEQ ID NO: 29140 - DNA, 2661 bp, Xanthomonas axonopodis; identical to SEQ ID NO: 2030
  CDS (1)..(2661)

SEQ ID NO: 29141 - protein, 886 aa, Xanthomonas axonopodis; identical to SEQ ID NO: 2031

SEQ ID NO: 29142 - DNA, 2814 bp, Ralstonia solanacearum; identical to SEQ ID NO: 2032
  CDS (1)..(2814)

SEQ ID NO: 29143 - protein, 937 aa, Ralstonia solanacearum; identical to SEQ ID NO: 2033

SEQ ID NO: 29144 - DNA, 2667 bp, Listeria innocua; identical to SEQ ID NO: 2034
  CDS (1)..(2667)

SEQ ID NO: 29145 - protein, 888 aa, Listeria innocua; identical to SEQ ID NO: 2035

SEQ ID NO: 29146 - DNA, 2724 bp, Rhizobium loti; identical to SEQ ID NO: 2036
  CDS (1)..(2724)

SEQ ID NO: 29147 - protein, 907 aa, Rhizobium loti; identical to SEQ ID NO: 2037

SEQ ID NO: 29148 - DNA, 2565 bp, Rathayibacter rathayi; identical to SEQ ID NO: 2038
  CDS (1)..(2565)

SEQ ID NO: 29149 - protein, 854 aa, Rathayibacter rathayi; identical to SEQ ID NO: 2039

SEQ ID NO: 29150 - DNA, 2658 bp, Geobacter sulfurreducens; identical to SEQ ID NO: 2040
  CDS (1)..(2658)

SEQ ID NO: 29151 - protein, 885 aa, Geobacter sulfurreducens; identical to SEQ ID NO: 2041

SEQ ID NO: 29152 - DNA, 2577 bp, Mycobacterium paratuberculosis; identical to SEQ ID NO: 2042
  CDS (1)..(2577)

SEQ ID NO: 29153 - protein, 858 aa, Mycobacterium paratuberculosis; identical to SEQ ID NO: 2043

SEQ ID NO: 29154 - DNA, 2724 bp, Rhodopseudomonas palustris; identical to SEQ ID NO: 2044
  CDS (1)..(2724)

SEQ ID NO: 29155 - protein, 907 aa, Rhodopseudomonas palustris; identical to SEQ ID NO: 2045

SEQ ID NO: 29156 - DNA, 24 bp, Primer
atgaataacgaacccttacgtccc

SEQ ID NO: 29157 - DNA, 28 bp, Primer
ttacatatcctcatgaaattcttcaagt

SEQ ID NO: 29158 - protein, 922 aa, consensus; identical to SEQ ID NO: 18673
  MISC_FEATURE (1)..(922): consensus for the disclosure of xaa see table XV

SEQ ID NO: 29159 - protein, 194 aa, consensus; identical to SEQ ID NO: 4334
  MISC_FEATURE (1)..(194): consensus for the disclosure of xaa see table XV

SEQ ID NO: 29160 - protein, 61 aa, consensus; identical to SEQ ID NO: 4335
  MISC_FEATURE (1)..(61): consensus for the disclosure of xaa see table XV

SEQ ID NO: 29161 - protein, 15 aa, consensus
  MISC_FEATURE (1)..(15): consensus for the disclosure of xaa see table XV
LXXXXXXNXXXNAXX

SEQ ID NO: 29162 - DNA, 723 bp, Escherichia coli; identical to SEQ ID NO: 417
  CDS (1)..(723)

SEQ ID NO: 29163 - protein, 240 aa, Escherichia coli; identical to SEQ ID NO: 418

SEQ ID NO: 29164 - DNA, 723 bp, Listeria innocua; identical to SEQ ID NO: 453
  CDS (1)..(723)

SEQ ID NO: 29165 - protein, 240 aa, Listeria innocua; identical to SEQ ID NO: 454

SEQ ID NO: 29166 - DNA, 798 bp, Yersinia pestis; identical to SEQ ID NO: 2052
  CDS (1)..(798)

SEQ ID NO: 29167 - protein, 265 aa, Yersinia pestis; identical to SEQ ID NO: 452

SEQ ID NO: 29168 - DNA, 744 bp, Salmonella enterica subsp. enterica serovar Typhi; identical to SEQ ID NO: 2054
  CDS (1)..(744)

SEQ ID NO: 29169 - protein, 247 aa, Salmonella enterica subsp. enterica serovar Typhi; identical to SEQ ID NO: 460

SEQ ID NO: 29170 - DNA, 714 bp, Listeria innocua; identical to SEQ ID NO: 455
  CDS (1)..(714)

SEQ ID NO: 29171 - protein, 237 aa, Listeria innocua; identical to SEQ ID NO: 456

SEQ ID NO: 29172 - DNA, 723 bp, Listeria monocytogenes; identical to SEQ ID NO: 457
  CDS (1)..(723)

SEQ ID NO: 29173 - protein, 240 aa, Listeria monocytogenes; identical to SEQ ID NO: 458

SEQ ID NO: 29174 - DNA, 729 bp, Listeria monocytogenes; identical to SEQ ID NO: 429
  CDS (1)..(729)

SEQ ID NO: 29175 - protein, 242 aa, Listeria monocytogenes; identical to SEQ ID NO: 430

SEQ ID NO: 29176 - DNA, 729 bp, Listeria innocua; identical to SEQ ID NO: 2062
  CDS (1)..(729)

SEQ ID NO: 29177 - protein, 242 aa, Listeria innocua; identical to SEQ ID NO: 432

SEQ ID NO: 29178 - DNA, 729 bp, Bacillus subtilis; identical to SEQ ID NO: 421
  CDS (1)..(729)

SEQ ID NO: 29179 - protein, 242 aa, Bacillus subtilis; identical to SEQ ID NO: 422

SEQ ID NO: 29180 - DNA, 747 bp, Bacillus halodurans; identical to SEQ ID NO: 445
  CDS (1)..(747)

SEQ ID NO: 29181 - protein, 248 aa, Bacillus halodurans; identical to SEQ ID NO: 446

SEQ ID NO: 29182 - DNA, 723 bp, Bacillus halodurans; identical to SEQ ID NO: 433
  CDS (1)..(723)

SEQ ID NO: 29183 - protein, 240 aa, Bacillus halodurans; identical to SEQ ID NO: 434

SEQ ID NO: 29184 - DNA, 714 bp, Bacillus halodurans; identical to SEQ ID NO: 427
  CDS (1)..(714)

SEQ ID NO: 29185 - protein, 237 aa, Bacillus halodurans; identical to SEQ ID NO: 428

SEQ ID NO: 29186 - DNA, 810 bp, Corynebacterium glutamicum
  CDS (1)..(810)
atgaacaccatgcctgaccaaccgctcaaccaggacggattccctaccgcatccaaaggggtggaacccgacaacctccccgaccgcgttctcgtggacggccttaaaccaaagcatcagcagcttcgtgaaattttggaggaaatctgcaccacccagcttcagcctggggacatgctgcctggtgagcgcatcctggaagaaaagtatggcgtcagccgaattacggttcgtcgggcgattggtgatctggtcgcgtccggcaggttgaagcgagctcgcggcaaaggtaccttcgtggcccactcgccgttgatttcccgcctgcatttggcctcgttttccgcagagatggccgcccagaagctatcggctaccagcaggattttgagttcttcccgcggtcccgccccagatgatattgctgatttctttggtaccgatcgcgcggcccagcacatcacgttgcgccgcctgcgctttggaaatggtcgaccctatgccattgacaacggttggtacaactccgaattcgcacctgacctgctggaaaatgatgtgtacaactccgtgtactccatcctggaccgcgtctatggcgtccccgtcacccaggccgagcaaacggtcaccgccgtagcagccgacgaagacaccgcacggcttctggacgtcacccccggcgccccactccttcgtatccttcgacagtcactttctggcgataagcccgtggaatggtgcgtttccttgtaccgaaccgaccgatattctttaaaaacattggttacacgctccgaagatctctag

SEQ ID NO: 29187 - protein, 269 aa, Corynebacterium glutamicum; identical to SEQ ID NO: 462

SEQ ID NO: 29188 - DNA, 732 bp, Bacillus subtilis; identical to SEQ ID NO: 425
  CDS (1)..(732)

SEQ ID NO: 29189 - protein, 243 aa, Bacillus subtilis; identical to SEQ ID NO: 426

SEQ ID NO: 29190 - DNA, 744 bp, Caulobacter crescentus; identical to SEQ ID NO: 2076
  CDS (1)..(744)

SEQ ID NO: 29191 - protein, 247 aa, Caulobacter crescentus; identical to SEQ ID NO: 442

SEQ ID NO: 29192 - DNA, 711 bp, Streptococcus pneumoniae; identical to SEQ ID NO: 2078
  CDS (1)..(711)

SEQ ID NO: 29193 - protein, 236 aa, Streptococcus pneumoniae; identical to SEQ ID NO: 436

SEQ ID NO: 29194 - DNA, 729 bp, Streptococcus pneumoniae; identical to SEQ ID NO: 2080
  CDS (1)..(729)

SEQ ID NO: 29195 - protein, 242 aa, Streptococcus pneumoniae; identical to SEQ ID NO: 438

SEQ ID NO: 29196 - DNA, 708 bp, Streptococcus pneumoniae; identical to SEQ ID NO: 2082
  CDS (1)..(708)

SEQ ID NO: 29197 - protein, 235 aa, Streptococcus pneumoniae; identical to SEQ ID NO: 450

SEQ ID NO: 29198 - DNA, 717 bp, Escherichia coli; identical to SEQ ID NO: 423
  CDS (1)..(717)

SEQ ID NO: 29199 - protein, 238 aa, Escherichia coli [sequence omitted]

SEQ ID NO: 29200 - DNA, 708 bp, Lactococcus lactis subsp. lactis; identical to SEQ ID NO: 443
  CDS (1)..(708)

SEQ ID NO: 29201 - protein, 235 aa, Lactococcus lactis subsp. lactis; identical to SEQ ID NO: 444

SEQ ID NO: 29202 - DNA, 756 bp, Escherichia coli; identical to SEQ ID NO: 439
  CDS (1)..(756)

SEQ ID NO: 29203 - protein, 251 aa, Escherichia coli; identical to SEQ ID NO: 440

SEQ ID NO: 29204 - DNA, 732 bp, Clostridium acetobutylicum; identical to SEQ ID NO: 2090
  CDS (1)..(732)

SEQ ID NO: 29205 - protein, 243 aa, Clostridium acetobutylicum; identical to SEQ ID NO: 448

SEQ ID NO: 29206 - DNA, 747 bp, Bordetella parapertussis; identical to SEQ ID NO: 2092
  CDS (1)..(747)

SEQ ID NO: 29207 - protein, 248 aa, Bordetella parapertussis; identical to SEQ ID NO: 510

SEQ ID NO: 29208 - DNA, 747 bp, Bordetella bronchiseptica; identical to SEQ ID NO: 2094
  CDS (1)..(747)

SEQ ID NO: 29209 - protein, 248 aa, Bordetella bronchiseptica; identical to SEQ ID NO: 508

SEQ ID NO: 29210 - DNA, 738 bp, Bacillus cereus; identical to SEQ ID NO: 503
  CDS (1)..(738)

SEQ ID NO: 29211 - protein, 245 aa, Bacillus cereus; identical to SEQ ID NO: 504

SEQ ID NO: 29212 - DNA, 732 bp, Bacillus anthracis; identical to SEQ ID NO: 2098
  CDS (1)..(732)

SEQ ID NO: 29213 - protein, 243 aa, Bacillus anthracis; identical to SEQ ID NO: 502

SEQ ID NO: 29214 - DNA, 738 bp, Bacillus anthracis; identical to SEQ ID NO: 499
  CDS (1)..(738)

SEQ ID NO: 29215 - protein, 245 aa, Bacillus anthracis; identical to SEQ ID NO: 500

SEQ ID NO: 29216 - DNA, 765 bp, Streptomyces avermitilis; identical to SEQ ID NO: 2102
  CDS (1)..(765)

SEQ ID NO: 29217 - protein, 254 aa, Streptomyces avermitilis; identical to SEQ ID NO: 498

SEQ ID NO: 29218 - DNA, 756 bp, Enterococcus faecalis; identical to SEQ ID NO: 2104
  CDS (25)..(756)

SEQ ID NO: 29219 - protein, 243 aa, Enterococcus faecalis; identical to SEQ ID NO: 496

SEQ ID NO: 29220 - DNA, 708 bp, Enterococcus faecalis; identical to SEQ ID NO: 2106
  CDS (1)..(708)

SEQ ID NO: 29221 - protein, 235 aa, Enterococcus faecalis; identical to SEQ ID NO: 494

SEQ ID NO: 29222 - DNA, 675 bp, Shigella flexneri; identical to SEQ ID NO: 2108
  CDS (1)..(675)

SEQ ID NO: 29223 - protein, 224 aa, Shigella flexneri; identical to SEQ ID NO: 506

SEQ ID NO: 29224 - DNA, 723 bp, Shigella flexneri; identical to SEQ ID NO: 491
  CDS (1)..(723)

SEQ ID NO: 29225 - protein, 240 aa, Shigella flexneri; identical to SEQ ID NO: 492

SEQ ID NO: 29226 - DNA, 927 bp, Pseudomonas putida; identical to SEQ ID NO: 2112
  CDS (1)..(927)

SEQ ID NO: 29227 - protein, 308 aa, Pseudomonas putida; identical to SEQ ID NO: 490

SEQ ID NO: 29228 - DNA, 711 bp, Lactobacillus plantarum; identical to SEQ ID NO: 487
  CDS (1)..(711)

SEQ ID NO: 29229 - protein, 236 aa, Lactobacillus plantarum; identical to SEQ ID NO: 488

SEQ ID NO: 29230 - DNA, 699 bp, Streptococcus mutans; identical to SEQ ID NO: 485
  CDS (1)..(699)

SEQ ID NO: 29231 - protein, 232 aa, Streptococcus mutans; identical to SEQ ID NO: 486

SEQ ID NO: 29232 - DNA, 699 bp, Streptococcus agalactiae; identical to SEQ ID NO: 2118
  CDS (1)..(699)

SEQ ID NO: 29233 - protein, 232 aa, Streptococcus agalactiae; identical to SEQ ID NO: 484

SEQ ID NO: 29234 - DNA, 747 bp, Oceanobacillus iheyensis; identical to SEQ ID NO: 481
  CDS (1)..(747)

SEQ ID NO: 29235 - protein, 248 aa, Oceanobacillus iheyensis; identical to SEQ ID NO: 482

SEQ ID NO: 29236 - DNA, 756 bp, Escherichia coli O6; identical to SEQ ID NO: 479
  CDS (1)..(756)

SEQ ID NO: 29237 - protein, 251 aa, Escherichia coli O6; identical to SEQ ID NO: 480

SEQ ID NO: 29238 - DNA, 699 bp, Escherichia coli O6; identical to SEQ ID NO: 477
  CDS (1)..(699)

SEQ ID NO: 29239 - protein, 232 aa, Escherichia coli O6; identical to SEQ ID NO: 478

SEQ ID NO: 29240 - DNA, 765 bp, Streptomyces sp; identical to SEQ ID NO: 2126
  CDS (1)..(765)

SEQ ID NO: 29241 - protein, 254 aa, Streptomyces sp; identical to SEQ ID NO: 468

SEQ ID NO: 29242 - DNA, 714 bp, Streptococcus mutans; identical to SEQ ID NO: 2128
  CDS (1)..(714)

SEQ ID NO: 29243 - protein, 237 aa, Streptococcus mutans; identical to SEQ ID NO: 476

SEQ ID NO: 29244 - DNA, 762 bp, Streptomyces griseus; identical to SEQ ID NO: 2130
  CDS (1)..(762)

SEQ ID NO: 29245 - protein, 253 aa, Streptomyces griseus; identical to SEQ ID NO: 466

SEQ ID NO: 29246 - DNA, 726 bp, Clostridium perfringens; identical to SEQ ID NO: 471
  CDS (1)..(726)

SEQ ID NO: 29247 - protein, 241 aa, Clostridium perfringens; identical to SEQ ID NO: 472

SEQ ID NO: 29248 - DNA, 726 bp, Streptococcus pyogenes; identical to SEQ ID NO: 469
  CDS (1)..(726)

SEQ ID NO: 29249 - protein, 241 aa, Streptococcus pyogenes; identical to SEQ ID NO: 470

SEQ ID NO: 29250 - DNA, 705 bp, Pseudomonas fluorescens; identical to SEQ ID NO: 463
  CDS (1)..(705)

SEQ ID NO: 29251 - protein, 234 aa, Pseudomonas fluorescens; identical to SEQ ID NO: 464

SEQ ID NO: 29252 - DNA, 765 bp, Streptomyces coelicolor; identical to SEQ ID NO: 2138
  CDS (1)..(765)

SEQ ID NO: 29253 - protein, 254 aa, Streptomyces coelicolor; identical to SEQ ID NO: 474

SEQ ID NO: 29254 - DNA, 23 bp, Primer
atgggacacaagcccttataccg

SEQ ID NO: 29255 - DNA, 23 bp, Primer
ttatcgcgatgattttcgctgcg

SEQ ID NO: 29256 - protein, 222 aa, consensus
  MISC_FEATURE (1)..(222): consensus for the disclosure of xaa see table XV
YXXXXXXXXXXXXXXXXXXXXXXPXEXXLXXXXXXSRXTXXXAXXXLXXXGXXXXXXGXGTXXXXXXXXXXXXXXXXXXXXXXXEXXXXXXXXXXXXXXXXXXXXXXXXXXXXLXXXXXXXXXXXXXRXRXXXXXPXXXEXXXXXXXXXXXXXXXXXXXXXXXXXXXXXXXXXXXXXXXXXXXXXXXXXXXXXXXLXXXXXXXXXXXXXXXXXXXXXXXXXE

SEQ ID NO: 29257 - protein, 23 aa, consensus
  MISC_FEATURE (1)..(23): xaa in position 2 is Arg, Ile or Val, xaa in position 3 is any amino acid, xaa in position 5 to 11 is any amino acid, xaa in position 13 to 22 is any amino acid.
SXXTXXXXXXXLXXXXXXXXXXG

SEQ ID NO: 29258 - DNA, 594 bp, Escherichia coli
  CDS (1)..(594)
atgatcattcgtgacgaaaactattttactgataaatatgaattaacccgcacacactctgaagtactggaagcggtgaaagtggttaaaccgggtaaaacgctggatctgggctgtggcaatggtcgtaacagtctttacctggcagccaatggttatgatgttgacgcatgggataaaaatgccatgagtatcgccaacgtcgagcgcattaaatccattgaaaatctggataatttacacacccgagtcgttgatctgaataacctcacatttgatagacagtacgattttattctttcgactgtggtgctgatgttccttgaggctaaaaccatccccgggttgattgccaatatgcaacgttgcactaaacctggtggttacaacctgattgtggcggcgatggataccgctgattatccatgtaccgtcggcttcccgtttgccttcaaagagggagaattacgtcgatattacgaaggctgggagagggtgaaatacaatgaagacgtcggcgagctgcaccgcaccgacgccaacggtaatcgtattaaactgcgtttcgccacgatgctggcacgtaaaaaatga

SEQ ID NO: 29259 - protein, 197 aa, Escherichia coli
MIIRDENYFTDKYELTRTHSEVLEAVKVVKPGKTLDLGCGNGRNSLYLAANGYDVDAWDKNAMSIANVERIKSIENLDNLHTRVVDLNNLTFDRQYDFILSTVVLMFLEAKTIPGLIANMQRCTKPGGYNLIVAAMDTADYPCTVGFPFAFKEGELRRYYEGWERVKYNEDVGELHRTDANGNRIKLRFATMLARKK

SEQ ID NO: 29260 - DNA, 879 bp, Streptococcus thermophilus CNRZ1066
  CDS (1)..(879)
atgataatagatcagcaacttgtttgctacaaacgccttccaaactggacagccacaacactcccagaaatggtgactcaaaaacataacactaaggttggaacctgggctaaactgactattctatcaggaactcttcacttttatgaattagatgaacagggagagattactgcagagcacctcttcacgcctgaaacagaaattccttttgtcgaaccacaatcttggcatcgaatcgctgctgcttcagataatttagaatgctatctttccttctactgcaagccagaggactacatggctaaaaagtatgatactaaagcccactctgaggttcttgaagccgtccagtctggacatattaaacctggtcgtacccttgatttaggctgtggccatggtcgtaacgctctttatttagcatcacttggacacgaagttactgccgttgatattaacaatgaagccacacaacgtatccaaatgattgctgatgaagaaagttacaatgttagagctggctactacgatatcaatgtttctgctcttcctgagtctgaaacctttgacttcatcctctcaacagtggtcttcatgttcctagatcctaatcaaattccagctattatccaaaatatgcaagagcgtacagccattggtggttacaacctaattgtttgtgctatggatacagaagaacacccttgtaccatgcctttcccatttacttttgaagaaggcgagttgaaaaactactatagtaactgggaattaatcaagtacaatgaaaatcttggtcaccttcaccgtttagatgagcatggcaatccaatcgcccttcaatttgcgaccatgttagccaagaaggtaacataa

SEQ ID NO: 29261 - protein, 292 aa, Streptococcus thermophilus CNRZ1066
MIIDQQLVCYKRLPNWTATTLPEMVTQKHNTKVGTWAKLTILSGTLHFYELDEQGEITAEHLFTPETEIPFVEPQSWHRIAAASDNLECYLSFYCKPEDYMAKKYDTKAHSEVLEAVQSGHIKPGRTLDLGCGHGRNALYLASLGHEVTAVDINNEATQRIQMIADEESYNVRAGYYDINVSALPESETFDFILSTVVFMFLDPNQIPAIIQNMQERTAIGGYNLIVCAMDTEEHPCTMPFPFTFEEGELKNYYSNWELIKYNENLGHLHRLDEHGNPIALQFATMLAKKVT

SEQ ID NO: 29262 - DNA, 861 bp, Pasteurella multocida subsp. multocida str. Pm70
  CDS (1)..(861)
atgcaaaatgaactcatttgttataaaagaatgccaatttggacagcctccagtttgccgcaaatgtttcaagaaaaacataatacgaaaattgggacatggggaaaattaagcgtactaaaagggaaactcaaattctacgaattgacggaaacgggagaaacaatccaagaacatatttttacaccagaaacggctattcctcttgttgaaccgcaggcttggcataaagtagaagccatgtcagaagatctagaatgtgttcttgaatttcattgtaagaaaaaagactactttcataaaaaatacaatatgaccccaacgcattcggaagtgaaaagtgcggtggaaatattgtcaccttgtaaagtattagacttgggctgcggtcaaggacgtaattcactcttcttaagtctgttaggttacaatgtcacagcttgggatcacaacgagaacagtatcaaatttttacaagacactgccgaaaaagaaaatcttactattcagaccgcactttatgacatcaatagtgcaaagatcagcgaaaattatgattttattttgtccactgtcgtctttatgtttctcaagccacaatgtatctcacagattattgaaaacatgcaaacgcataccaatgtgggaggctataatttaattgttgcggcgatgtcaacggaagaggtcccttgtcctgtccccttttcttttacttttaaagaaaatgaattaaaaacctattatcaagattgggaattggttaaatacaacgaagaaatgggcgaattacataaaaccgatgaaaatggtaatcgaattaaaatgaaatttgtcaccatgctcgctaagaaaaaataa

SEQ ID NO: 29263 - protein, 286 aa, Pasteurella multocida subsp. multocida str. Pm70
MQNELICYKRMPIWTASSLPQMFQEKHNTKIGTWGKLSVLKGKLKFYELTETGETIQEHIFTPETAIPLVEPQAWHKVEAMSEDLECVLEFHCKKKDYFHKKYNMTPTHSEVKSAVEILSPCKVLDLGCGQGRNSLFLSLLGYNVTAWDHNENSIKFLQDTAEKENLTIQTALYDINSAKISENYDFILSTVVFMFLKPQCISQIIENMQTHTNVGGYNLIVAAMSTEEVPCPVPFSFTFKENELKTYYQDWELVKYNEEMGELHKTDENGNRIKMKFVTMLAKKK

SEQ ID NO: 29264 - DNA, 870 bp, Neisseria meningitidis MC58
  CDS (1)..(870)
atgaaggagcggatagtgggtcaaagtggcgagttgttttgtttcggacagatgcctgtatggaaagtggaaaacctgccggaagttttgttgtcgggctattcgtctgaggaaggggagtgggtctgcctgaatgtgttgcagggcgatgtcgaagttcgtgcaccggacgggtcggcagaagtttggtcggcagacggcggcgattgtgtgtttgcgccgcagcaggtgttttctgtcaaaccgaaaacggacgatgccgaaatccgtttgtcgctgtattgcgcggcggcagactattttcacaaaaaatacgggatgagtgccacgcattctgcggtcgcggcggcacgggataccgtaccggcgggcagggcgttggatatgggctgcggacaggggcgcaacgcgctgtttctcggtttgaaggggtttgaagttactgcagtcgatcacaatcccgccgccttggcaaacgtggcggagctggcagaggcggagggtttgaacgtccgcacgctggaatatgatttgaacgccgccgccttgcagggcgagtttgattatattgtggcaacagtggtgctgatgttcctgatgccgcagcgcgtacccgacgtgattgccgatatgcaggcgcatacggcggcgggcgggtacaacttgattgtatcggcaatggatacggcggatttcccctgtccgatgccgttcccttttaaatttaaagagggcgagctgaaggattattatcgggattgggaactggtcgaatataaagaagaattgggttctatgcatgccaaagacgaaaacggcaatccgatacggtttaaatttgtaacgatgctggcgaaaaagcctgaataa

SEQ ID NO: 29265 - protein, 289 aa, Neisseria meningitidis MC58
MKERIVGQSGELFCFGQMPVWKVENLPEVLLSGYSSEEGEWVCLNVLQGDVEVRAPDGSAEVWSADGGDCVFAPQQVFSVKPKTDDAEIRLSLYCAAADYFHKKYGMSATHSAVAAARDTVPAGRALDMGCGQGRNALFLGLKGFEVTAVDHNPAALANVAELAEAEGLNVRTLEYDLNAAALQGEFDYIVATVVLMFLMPQRVPDVIADMQAHTAAGGYNLIVSAMDTADFPCPMPFPFKFKEGELKDYYRDWELVEYKEELGSMHAKDENGNPIRFKFVTMLAKKPE

SEQ ID NO: 29266 - DNA, 867 bp, Streptococcus pneumoniae R6
  CDS (1)..(867)
ttgaaaatggaaaaattagttgcctataaacgcatgcctttgtggaataaacaaacaatgcctgaagctgttcagcaaaagcacaatacaaaagttgggacttgggggaaaattactgtcttgaagggagctctcaagtttattgaattgacagaagaaggggaagttctagctgaacacctctttgaagcaggggcagacaatccaatggcccaacctcaagcctggcaccgagtggaagctgccacagatgatgtggaatggtacttggaattttattgtaaacctgaggattattttgctaaaaaatacaataccaatcctgttcattcagaggtcctagaggccatgcagacagtgaaacaagggaaagctttggatttgggttgtggtcaggggcgtaattctctttttctagcccagcaagattttgatgtgacggctgtagatcaaaatggactagctcttgaaatcttgcaaagcattgtggagcaggaagatttggacatgcctgttggcctttacgatatcaattcagctagcattgaacaagaatatgattttatcgtttcaacagttgttctcatgtttctacaagcggaccgcattccagctattattcaaaatatgcaggagaaaaccagtgttggtggttacaaccttatcgtttgtgccatggacacggaggattatccttgctcggttaacttcccattcacctttaaagaaggagaactggcagactattacaaggattgggaattggttaagtacaatgaaaatccaggccatttgcaccgtcgcgatgagaatggcaatcgtattcaactacgctttgcgaccttactagctaagaaaatcaagtaa

SEQ ID NO: 29267 - protein, 288 aa, Streptococcus pneumoniae R6
MKMEKLVAYKRMPLWNKQTMPEAVQQKHNTKVGTWGKITVLKGALKFIELTEEGEVLAEHLFEAGADNPMAQPQAWHRVEAATDDVEWYLEFYCKPEDYFAKKYNTNPVHSEVLEAMQTVKQGKALDLGCGQGRNSLFLAQQDFDVTAVDQNGLALEILQSIVEQEDLDMPVGLYDINSASIEQEYDFIVSTVVLMFLQADRIPAIIQNMQEKTSVGGYNLIVCAMDTEDYPCSVNFPFTFKEGELADYYKDWELVKYNENPGHLHRRDENGNRIQLRFATLLAKKIK

SEQ ID NO: 29268 - DNA, 597 bp, Salmonella typhimurium LT2
  CDS (1)..(597)
atgaccgttcgtgacgaaaattactttactgagaaatacggtttaacccgcacgcattcggatgtgctggcggcggcaaaggttgtcgcgccaggccgaacgctggatttaggatgtggcaatggccgtaatagtctgtatctggccgcgaacggttatgacgttaccgcgtgggataaaaatccggccagtatggctaaccttgagcgtattaaagcggcagaagggctggataatctgcaaaccgaccttgtcgatctgaatacattgacctttgacggcgaatacgattttattctctcgacggtggttatgatgtttcttgaggcgcaaaccattcccggtttaattgccaatatgcaacgctgcacaaaacccggcgggtataatttgattgttgcggcaatggatacgccggactttccctgtacggtgggattcccgttcgcttttaaagaaggcgaattacgccgctattacgaaggatgggacatgctgaaatacaacgaagatgtcggcgagcttcaccgcacggacgaaaatggcaaccgtatcaaactgcgctttgctacgatgctggcgagaaaaacggcctga

SEQ ID NO: 29269 - protein, 198 aa, Salmonella typhimurium LT2
MTVRDENYFTEKYGLTRTHSDVLAAAKVVAPGRTLDLGCGNGRNSLYLAANGYDVTAWDKNPASMANLERIKAAEGLDNLQTDLVDLNTLTFDGEYDFILSTVVMMFLEAQTIPGLIANMQRCTKPGGYNLIVAAMDTPDFPCTVGFPFAFKEGELRRYYEGWDMLKYNEDVGELHRTDENGNRIKLRFATMLARKTA

SEQ ID NO: 29270 - DNA, 588 bp, Methanosarcina acetivorans C2A
  CDS (1)..(588)
ttgttctgggatgaagtatataagggcacgccaccgtgggatattgatcatcctcagcctgcttttcaggctctgatagaaagtggagaaatcaggcctggtcgagctctggacataggatgtggccggggtgagaatgcgataatgctggctaagaatggttgtgacgtcacaggaatagaccttgctaaagacgctatctccgatgcaaaggcaaaggccatagagcgccatgttaaggtaaattttattgtaggaaatgtactggagatggaccagcttttcacggaagatgagtttgatattgttattgactccggcttgtttcatgtgataacggacgaagagaggctactctttactcgacatgtgcacaaagtgctcaaggaaggtggcaaatacttcatgttgtgtttctctgataaggagccgggcgaatacgagctgccaagaagagcttcaaaagctgaaatagagagtactttttcgcctctatttaatataatctatataaaagacgtgattttcgattcgctgcttaaccctggtcgcaggcaagcctaccttttgtcggctacaaaaagttaa

SEQ ID NO: 29271 - protein, 195 aa, Methanosarcina acetivorans C2A
MFWDEVYKGTPPWDIDHPQPAFQALIESGEIRPGRALDIGCGRGENAIMLAKNGCDVTGIDLAKDAISDAKAKAIERHVKVNFIVGNVLEMDQLFTEDEFDIVIDSGLFHVITDEERLLFTRHVHKVLKEGGKYFMLCFSDKEPGEYELPRRASKAEIESTFSPLFNIIYIKDVIFDSLLNPGRRQAYLLSATKS

SEQ ID NO: 29272 - DNA, 888 bp, Yersinia pestis KIM
  CDS (1)..(888)
atggaaaacacctctgcacagctagcacccacactgctatgttacaagaaactccctgtctggaaccgtgatggcgtaccggcaatgtttcaggaaaagcacaatacgaaagcgggcacgtgggcaaaactgaccattttggctggagagatggatttcttaattcttgatgaagccggtaataccgtggaaaagcaccagttctcctgcgaacagcaaccaccatttatcgagccacaagtctggcatcgcattgctacctgctcagatgatctgcaatgtcagctcagtttctactgccagccagaagatttttaccataaaaaatataatttaaccccgacccattctgaagtcattgaagcggtaaaaacagttaagccggggaaggcgctggacttggggtgtggctctggacgcaactcgctgtacctgaacctattgggtttcgatgttactgctgtagataaaaataacgacagcattggtaatttacagcagatcattgataaggaagccctgaaagggattactgccagcagctataatattaatgaggccagtctggatgagcgctacgattttattctatcaaccgtggtcttgatgttcctgcaaccagaaagaatcccacatattatcagtaatatgcaggagtgtactttacccggcggctataacctgattatctccgcaatgtcgaccgatgacttcccttgcaccgtacctttctctttcacattccagtctggtgagttaaaagattattatcaggattgggcgatcctcaagtacaacgaggatgtcgggcaacttcacaagaccgatgcacaaggtaaccggataaaactacgttttgcgactttattggcaaaaaaaatctcataa

SEQ ID NO: 29273 - protein, 295 aa, Yersinia pestis KIM
MENTSAQLAPTLLCYKKLPVWNRDGVPAMFQEKHNTKAGTWAKLTILAGEMDFLILDEAGNTVEKHQFSCEQQPPFIEPQVWHRIATCSDDLQCQLSFYCQPEDFYHKKYNLTPTHSEVIEAVKTVKPGKALDLGCGSGRNSLYLNLLGFDVTAVDKNNDSIGNLQQIIDKEALKGITASSYNINEASLDERYDFILSTVVLMFLQPERIPHIISNMQECTLPGGYNLIISAMSTDDFPCTVPFSFTFQSGELKDYYQDWAILKYNEDVGQLHKTDAQGNRIKLRFATLLAKKIS

SEQ ID NO: 29274 - DNA, 876 bp, Streptococcus agalactiae 2603V/R
  CDS (1)..(876)
atggttaatacaaaaacacttctcccctacaaaactatgccggtttggactgcacagtctattccaaaggcatttttagaaaagcataatactaaggaaggcacctgggcaaaactaaccattctaagtggttctttagtattttaccagttatctcctgatggagaggaaatctcgcggcatatttttgatgctagtagtgatattccttttgttgatccacaagtctggcataaagtttcgccgaatagtccagacttaagttgctatctaactttttactgccaaaaagaagattacttccataaaaaatatggtctcacgcgcacacattctgaggttatcgccagtgcacctctcttatctgagaagagtaatatattagaccttgggtgtggtcaagggcgaaactcactttatttatcgctgctgggacatcaagtgacttctgtcgattcaaacggacagagccttgtagctttagaaaatatggcattagaagaagagcttccttacaatataaaaaggtatgatattaatactgctgctattgaagggcactatgattttattttatcaactgtggtatttatgtttttaaatcccgactgcatttctgatattattttacaaatgcaatcacatactcagattggaggatacaatcttatcgtttctgctatggataccgctgaaaatccttgcccgcttccattcccttttaccttcaaagaaggacaattgaaatcttattacaatgactgggaaatcatcaaatataatgaaaatttaggtgaattgcacagggtggatgaaaacggtaatcgcttaaaattacagtttgcgactttattagctcgaaaattaagatcataa

SEQ ID NO: 29275 - protein, 291 aa, Streptococcus agalactiae 2603V/R
MVNTKTLLPYKTMPVWTAQSIPKAFLEKHNTKEGTWAKLTILSGSLVFYQLSPDGEEISRHIFDASSDIPFVDPQVWHKVSPNSPDLSCYLTFYCQKEDYFHKKYGLTRTHSEVIASAPLLSEKSNILDLGCGQGRNSLYLSLLGHQVTSVDSNGQSLVALENMALEEELPYNIKRYDINTAAIEGHYDFILSTVVFMFLNPDCISDIILQMQSHTQIGGYNLIVSAMDTAENPCPLPFPFTFKEGQLKSYYNDWEIIKYNENLGELHRVDENGNRLKLQFATLLARKLRS

SEQ ID NO: 29276 - DNA, 594 bp, Shigella flexneri 2a str. 301
  CDS (1)..(594)
atgaacattcgtgacgaaaactattttactgataaatatgaattaacccgcacacactctgaagtactggaagcggtgaaagtggttaaaccgggtaaaacgctggatctgggctgtggcaatggtcgtaacagtctttacctggcagccaatggttatgatgttgacgcatgggataaaaatgccatgagtatcgccaacgtcgagcgcattaaatccattgaaaatctggataatttacacacccgggtcgttgatctgaataacctcacatttgatggacagtacgattttattctttcgactgtggtgctgatgttccttgaggctaaaaccatcccagggttgattgccaatatgcaacgttgcactaaacctggtggttacaacctgattgtggcggcgatggataccgctgattatccatgtaccgtcggcttcacgtttgccttcaaagagggagaattacgtcgatattacgaaggctgggagagggtgaaatacaatgaagacgtcggcgagctgcaccgcaccgacgccaacggtaatcgtattaaactgcgtttcgccacgatgctggcacgtaaaaaatga

SEQ ID NO: 29277 - protein, 197 aa, Shigella flexneri 2a str. 301
MNIRDENYFTDKYELTRTHSEVLEAVKVVKPGKTLDLGCGNGRNSLYLAANGYDVDAWDKNAMSIANVERIKSIENLDNLHTRVVDLNNLTFDGQYDFILSTVVLMFLEAKTIPGLIANMQRCTKPGGYNLIVAAMDTADYPCTVGFTFAFKEGELRRYYEGWERVKYNEDVGELHRTDANGNRIKLRFATMLARKK

SEQ ID NO: 29278 - DNA, 882 bp, Streptococcus mutans UA159
  CDS (1)..(882)
atgatgcctaacagaaatacaaatatgctgctggcttataaacgtcttcctaattggactgccaatagcatcccagaaacacttttaaacccgcacaacactaaagtcggaacttgggaacagttaactgtcctttctggaaagcttgatgtttatttttttgataaagatgatcatgttttagaaaagctgacttttgataaggattcccaaatgccttttattcaacctcaagtttgctataaaattgaacctgcttctaatgatttggaatgtcaccttaccctttactgtcaaaagggagattattttaacaaaaaatatgggatgaccaagacacattcagaagtccttttctcggcaccttatttaaaagaaaacagtaaaatactagaccttggatccggtcaaggacgtaattccctctatttgaccatgttaggacatgatgtcacttctgttgataccaatgaacaaagtcttattcatctgaaaaatatagccaatgaagaaaatctaccaagcaagattaactggtatgatatcaatacagcaaatttgcaagagacctatgattttattctatcaacagtggtttttatgttcttaaatagaccagttgtaccagatattatcaaagatatgcaaaaacatactgctattggcggctataatcttatcgtttgcgctatggataccaaatcctatccttgtcccattccttttccttttacctttaagaagggggaacttaaagattattataaagaatggtatctgattaaatataatgaagatttggggcagcttcataaaaccgatgccaatggcaatcgcctgcaaatgcaatttgctaccttgttggccaaaaaggtgaaataa

SEQ ID NO: 29279 - protein, 293 aa, Streptococcus mutans UA159
MMPNRNTNMLLAYKRLPNWTANSIPETLLNPHNTKVGTWEQLTVLSGKLDVYFFDKDDHVLEKLTFDKDSQMPFIQPQVCYKIEPASNDLECHLTLYCQKGDYFNKKYGMTKTHSEVLFSAPYLKENSKILDLGSGQGRNSLYLTMLGHDVTSVDTNEQSLIHLKNIANEENLPSKINWYDINTANLQETYDFILSTVVFMFLNRPVVPDIIKDMQKHTAIGGYNLIVCAMDTKSYPCPIPFPFTFKKGELKDYYKEWYLIKYNEDLGQLHKTDANGNRLQMQFATLLAKKVK

SEQ ID NO: 29280 - DNA, 837 bp, Rhodopirellula baltica SH 1
  CDS (1)..(837)
gtgtgtgtttcgctttccggcgggctatcttgccaaggacaactcaattttatccgatttcttcagacagtctgtatcagcgtgaatcgagtcaccgacgacccatccaacgacttcttcttcgaagcctacgaccgcgaaaacatcgcatacggcatgcaaccttcgccggaattggctgcgtatttgaaacaaactggtgcgaaggcatcgacctacacccaacggccaaaagccattgatttgggtgctggggccggccgagacacgctggcactcgccgcggcgggctatgacgtcacatcggttgatgttagcgaacgagggctcgaccggattcgcgaacgagctgaacgaaccgacttgtccgaacgaattcagacggtcgtttgcgacgtgcgcgagttgtcgatggaagcgaatcagtacgccgccgtcatcgcgacgactgttctggatcatattcctgggaccgatgcgccggccgtttggaaaaaaatgtgtgcctccctgaccgatcacggcatgctgtacgcacaagttcacacgaccgaagatccgggcagcaaccaatcaccgggcaaggaaagcgaccaacccgtcagcgaaacggcgggtgcggtgatcaattatttccgccccaatcaattggtcggttgggcatgcgatcccgattcgaagctgcgtgtcttgcggtacgaagaacgcctcgaatgggacaccacccatggtgccccgcaccaacacggtaaggcggttctgctggccgttcgccatggtttccacccggaatggtttggacaacccgcagcattcccgcgtcccgaacaggattga

SEQ ID NO: 29281 - protein, 278 aa, Rhodopirellula baltica SH 1
MCVSLSGGLSCQGQLNFIRFLQTVCISVNRVTDDPSNDFFFEAYDRENIAYGMQPSPELAAYLKQTGAKASTYTQRPKAIDLGAGAGRDTLALAAAGYDVTSVDVSERGLDRIRERAERTDLSERIQTVVCDVRELSMEANQYAAVIATTVLDHIPGTDAPAVWKKMCASLTDHGMLYAQVHTTEDPGSNQSPGKESDQPVSETAGAVINYFRPNQLVGWACDPDSKLRVLRYEERLEWDTTHGAPHQHGKAVLLAVRHGFHPEWFGQPAAFPRPEQD

SEQ ID NO: 29282 - DNA, 681 bp, Chromobacterium violaceum ATCC 12472
  CDS (1)..(681)
atgggcgtcggcacattttgggtaggtagagcaggggcagaggatatgtgtttcgctaatttcgacgcgttttatcgcaaaaacagttccttttatggcgacaggccggcactgtctctgatgtatttcctcgaaaaatacggcgtggaaggcggcgggcaggggctggacctggcctgcgggcaggggcggaatgctttctacctggccagccgcgggttttccatgttcggcgtggacgagtcctccgaagcgatcgcgagcttgggcgagcgggccgatgagcgccacctcgacgtcagcggcaaggtggtcaacctgaccgagctggacatcgagccgcagcgttaccgcatcatcgtcgcctataccgcgctggatcatgtggatgccgtcgccggcgagcgtctggccaaggcgatgatggccggcctggagccgggagggtatttgttcgccgcggtgttcttggccgacgaccccggctgcacaggccgcggcggtggcgtcagcgagactgccgcctatgtcagacattattaccggcagggcgagctgcgcgatcagttttcagggttgacgccattggcctaccaggaggaattcgccctggacctcagccacggccatcctcaccatcacagcatggccaggctattcgcgcagaagcaggccgcctga

SEQ ID NO: 29283 - protein, 226 aa, Chromobacterium violaceum ATCC 12472
MGVGTFWVGRAGAEDMCFANFDAFYRKNSSFYGDRPALSLMYFLEKYGVEGGGQGLDLACGQGRNAFYLASRGFSMFGVDESSEAIASLGERADERHLDVSGKVVNLTELDIEPQRYRIIVAYTALDHVDAVAGERLAKAMMAGLEPGGYLFAAVFLADDPGCTGRGGGVSETAAYVRHYYRQGELRDQFSGLTPLAYQEEFALDLSHGHPHHHSMARLFAQKQAA

SEQ ID NO: 29284 - DNA, 858 bp, Photorhabdus luminescens subsp. laumondii TTO1
  CDS (1)..(858)
atgagtgacctcatttgttataaacgaatacccatctggcagaaaaatacccttcctgaaatgttcactgaaaggcataacacaaaagaggggacttatgcttgtcttgagatctttgaaggtgaactggaatttgtgattttcgatggtgatcaggaagaaactgcatattttaatgtacaaaagcagcctcccattattcagccacagatttggcataaaattaaatgggtaagtgatgatattaaatgccagctctcttttttatgtgaaccacaatatctgttttataaacaaaataatttgtcattacctcactctgaaattatatatttggcaaatattatttctccttgtaagacattagatctgggggccggtcatggccggaatactttctatctggcagaaagaggttatgacgttacagccgtggatattagtcagcaatgtattaacacaattaatgttattaaagaaaaacagcaatttaaaaatatccgtacggctgtttatgatatcaactctcacaatatcaccgaaaaatatgatttaattatttcaactgtggtactgatgtttctacaacgggaaaaaatcaccgatattatttacaatatgcaaaaacagacgaataaaggtggtattaatctgattgtttgcccgattgaaacagattttgcaccatattcattattgccattcaaaagtttcctcatgccaggtgaattggagaattattattctgactgggaaatcattaaatataatgaaaaccctggtcatcttcataaaacagatgaaaatggtaatagaataaaattaaattttgctacgcttctcgccagaaagcgatga

SEQ ID NO: 29285 - protein, 285 aa, Photorhabdus luminescens subsp. laumondii TTO1
MSDLICYKRIPIWQKNTLPEMFTERHNTKEGTYACLEIFEGELEFVIFDGDQEETAYFNVQKQPPIIQPQIWHKIKWVSDDIKCQLSFLCEPQYLFYKQNNLSLPHSEIIYLANIISPCKTLDLGAGHGRNTFYLAERGYDVTAVDISQQCINTINVIKEKQQFKNIRTAVYDINSHNITEKYDLIISTVVLMFLQREKITDIIYNMQKQTNKGGINLIVCPIETDFAPYSLLPFKSFLMPGELENYYSDWEIIKYNENPGHLHKTDENGNRIKLNFATLLARKR

SEQ ID NO: 29286 - DNA, 591 bp, Geobacter sulfurreducens PCA
  CDS (1)..(591)
atgggagaagagcaggaacgctgggaccagcggtacctttcggaggagtgtctgctgggggagcggccgtcgcggcttcttgccgagtggatcgatgagctgaagcggctctgtcccggccggcgtgccctggacatcgcctgcggcgaggggcggaacagcatcttcctggcccggcacgggtttgccgtcaccggcctcgatatctcgcccgtagggctggacaaggcccggcgctgggcagcgcgggagaagctctccgttgatttccggctgacggatcttgaggggtatcggatcaccggaacctacgatctgatcatcaacttcaatttcctccttcgagacttgattccccacgaggtggcgtcccttgcgccgggcggaatgctcatcttcgataccatcctccagtcgcccacggcgccggtgcctcacaaaaaggagtatctcctgcagcccggcgagctggagcggctattcgccccctttccggggaccgttctctacagcgcagaatttcccgacgatgccacgcccacggcaaagctcatcttccggaatacgccggacgcgcaggctgacagataa

SEQ ID NO: 29287 - protein, 196 aa, Geobacter sulfurreducens PCA
MGEEQERWDQRYLSEECLLGERPSRLLAEWIDELKRLCPGRRALDIACGEGRNSIFLARHGFAVTGLDISPVGLDKARRWAAREKLSVDFRLTDLEGYRITGTYDLIINFNFLLRDLIPHEVASLAPGGMLIFDTILQSPTAPVPHKKEYLLQPGELERLFAPFPGTVLYSAEFPDDATPTAKLIFRNTPDAQADR

SEQ ID NO: 29288 - DNA, 669 bp, Bacillus cereus ATCC 10987
  CDS (1)..(669)
atgcttgattcattattaagaccagcagaaccattttggaatgaattttatgcgaatagagaaaaagatgttccgttttttgaaaacgttccagatgagaacctagtttcgtatataaataaaaattgggtttcaaaaggaaaagtactagaacttggatgtggtccgggtagaaacgcaatttatctagcaaatgaagggtttgatgtaacggcagtggatttatctatagaaggcattaaatgggcgaaagagcgggctttagcaaaagggatagaaattgaatttatttgtgattcaatttttaatttagaggtccaaaatgaatttgattttgtatacgattcgggttgtttacatcatattccaccacatagaagaataaattatgtggatttaattaaaaactcattgaaatcaggtggttatttcggattaacatgttttgcggcaggcgatttagatgagcgaaatggctcagaaataacagattgggacgtatatagaggatggagtctgcaaggtggtctggcttattcggaagagaaattaagagaggtatttaagggatttgaagtgattgaaattagaaaaatgaagcaaattgaacaaccgaatactatgtttggagaatcatttctttggacagcattatttaagaagaaataa

SEQ ID NO: 29289 - protein, 222 aa, Bacillus cereus ATCC 10987
MLDSLLRPAEPFWNEFYANREKDVPFFENVPDENLVSYINKNWVSKGKVLELGCGPGRNAIYLANEGFDVTAVDLSIEGIKWAKERALAKGIEIEFICDSIFNLEVQNEFDFVYDSGCLHHIPPHRRINYVDLIKNSLKSGGYFGLTCFAAGDLDERNGSEITDWDVYRGWSLQGGLAYSEEKLREVFKGFEVIEIRKMKQIEQPNTMFGESFLWTALFKKK

SEQ ID NO: 29290 - DNA, 711 bp, Bacillus thuringiensis serovar konkukian str. 97-27
  CDS (1)..(711)
atgaaaaatgaaacgttgcatacgcaagaagatattattaaaatgctggattcattattaagaccagcagaaccattttggaatgaattttatgcgaatagagaaaaagatgttccgttttttgaaaatgttccagatgagaatctagtttcgtatatacaaaaaaagcgggtttcaaaaggaaaagtactggaacttggatgtggtccgggtagaaacgcaatttatctagcaaatgaagggtttgatgtaacagcagtagatgtatctatagaaggcattaactgggcgaaagagagggcgttagcaaaaggagtagaaattgaatttatttgtgattcaattttcaatttagaggttcaaaatgaatttgattttgtatacgattcgggctgtttgcatcatattccaccacatagaagagtaaattatgtggatttaattaaaaacgcattgaaatcaggtggttatttcggattaacgtgtttcgcggcaggtgatttagatgagcgaaatggatcagaaataacagattgggacgtatatagaggatggagtttacaaggaggtcttgcttattcggaagaaaaactaagagagatatttaaaggatttgaagtgattgaaattagaaagatggaacagattgaacaaccaaatactatgtttggagaatcatttctttggacagcattatttaagaagaattaa

SEQ ID NO: 29291 - protein, 236 aa, Bacillus thuringiensis serovar konkukian str. 97-27
MKNETLHTQEDIIKMLDSLLRPAEPFWNEFYANREKDVPFFENVPDENLVSYIQKKRVSKGKVLELGCGPGRNAIYLANEGFDVTAVDVSIEGINWAKERALAKGVEIEFICDSIFNLEVQNEFDFVYDSGCLHHIPPHRRVNYVDLIKNALKSGGYFGLTCFAAGDLDERNGSEITDWDVYRGWSLQGGLAYSEEKLREIFKGFEVIEIRKMEQIEQPNTMFGESFLWTALFKKN

SEQ ID NO: 29292 - DNA, 861 bp, Erwinia carotovora subsp. atroseptica SCRI1043
  CDS (1)..(861)
atgcaagatctcatttgttataagaagatgccacagtggaacagccagacgctacctgccgcgtttcaggaaaagcacaacacacaagaaggcacttgggcaaaactgaccgtgttgaaaggggaaatgaccttttccatgctgaccgaagatggcgatacgctggagacgttccacttctctgagcaaaatcagccgccgtttgtggagccgcaggcgtggcatcgcatcgtctcgttctctgacgatctggaatgtcagcttagctttttctgttcggcggaagatttctaccataaaaaatacggtctgacgcaaacccattccgaagtgatcaacgcagtacagcacattaagccgggcaaaacgctggatttaggctgcggtggcgggcgcaactcgctgtatctaaacctgcgcgggtttgacgtaactgcctgtgacaagcacgagcaaagcattgattcgctgaataacatcatccagagcgaagcactggaaaacatccgggcgggcgtttacaacatcaatctggcagaaatcaaagagcagtacgatttcatcctgtcgaccgttgtgctgatgttcctagaacgtgaccgtattccgcacatcatcagtaatatgcaaggcagcaccgttgacggtggctataaccttattatcgcagcgatgtcgacggaagattgtccgtgcccgatgcccttctcgtttacctttaaagaagacgagttgaagaactattacgccgattgggagatcctcaaatataacgaggatatgggcgaactacacaagacagatgcacagggtaatcgcatcaagctgcgtttcgctacgctgctggcaagaaagccctaa

SEQ ID NO: 29293 - protein, 286 aa, Erwinia carotovora subsp. atroseptica SCRI1043
MQDLICYKKMPQWNSQTLPAAFQEKHNTQEGTWAKLTVLKGEMTFSMLTEDGDTLETFHFSEQNQPPFVEPQAWHRIVSFSDDLECQLSFFCSAEDFYHKKYGLTQTHSEVINAVQHIKPGKTLDLGCGGGRNSLYLNLRGFDVTACDKHEQSIDSLNNIIQSEALENIRAGVYNINLAEIKEQYDFILSTVVLMFLERDRIPHIISNMQGSTVDGGYNLIIAAMSTEDCPCPMPFSFTFKEDELKNYYADWEILKYNEDMGELHKTDAQGNRIKLRFATLLARKP

SEQ ID NO: 29294 - DNA, 633 bp, Desulfotalea psychrophila LSv54
  CDS (1)..(633)
atgaaaccaacaaatacagaaatcaccattgaggcatatgatataaacgccagtaaatatgccaataaattcatggaattcataccataccaagaaaagatcaagctctttcaagaaaatttcctaacagagaactcaagcattcttgacctcggttgcggacctggaaacaatgccaattttctacttaaggctgacagaggctaccaaatcgagggggtggatctgtctgcccagatgatagagcttgccaaaaaaaatgcgcccgataccaatttcagagtacaggacattcgcaccatcacctctgataagatgtacaatgccatcattgcctctttttgcatagtccacctcgcggaccaagaaacctcttccttaatagagaagattgcaaaaatgctcaaagagaatggccacctctacctcagctttatggagggaaaagtagcgggactcgagagcacaagcttctctaaggaggacatcttctttaactactatgaacgatccgaactggtaaagttacttgctagaaatgatcttgaaaccgtggaaatattggacgatgactataaagagggggatggttctaccaccaaggatgtttttatctttgcccggaaatgttag

SEQ ID NO: 29295 - protein, 210 aa, Desulfotalea psychrophila LSv54
MKPTNTEITIEAYDINASKYANKFMEFIPYQEKIKLFQENFLTENSSILDLGCGPGNNANFLLKADRGYQIEGVDLSAQMIELAKKNAPDTNFRVQDIRTITSDKMYNAIIASFCIVHLADQETSSLIEKIAKMLKENGHLYLSFMEGKVAGLESTSFSKEDIFFNYYERSELVKLLARNDLETVEILDDDYKEGDGSTTKDVFIFARKC

SEQ ID NO: 29296 - DNA, 711 bp, Bacillus cereus ZK
  CDS (1)..(711)
atgaaaaatgaaacgttgcatacgcaagaagatattattaaaatgctggattcattattaagaccagcagaaccattttggaatgaattttatgcgaatagagaaaaagatgttccattttttgaaaatgttccagatgagaatctagtttcgtatatacaaaaaaagcgggtttcaaaaggaaaagtactggaacttggatgtggtccgggtagaaacgcaatttatctagcaaatgaagggtttgatgtaacagcagtagatttatctatagaaggcattaactgggcgaaagagagggcgttagtaaaaggagtagaaattgaatttatttgtgattcaattttcaatttagaggttcaaaatgaatttgattttgtatacgattcgggctgtttgcatcatattccaccacatagaagagtaaattatgtggatttaattaaaaacgcattgaaatcaggtggttatttcggattaacatgtttcgcggcaggtgatttagatgagcgaaatggatcagaaataacagattgggacgtatatagaggatggagtttacaaggaggtcttgcttattcggaagaaaaactaagagagatatttaaagggtttgaagtgattgaaattagaaagatggaacagattgaacaaccaaatactatgtttggagaatcatttctttggacagcattatttaagaagaaataa

SEQ ID NO: 29297 - protein, 236 aa, Bacillus cereus ZK
MKNETLHTQEDIIKMLDSLLRPAEPFWNEFYANREKDVPFFENVPDENLVSYIQKKRVSKGKVLELGCGPGRNAIYLANEGFDVTAVDLSIEGINWAKERALVKGVEIEFICDSIFNLEVQNEFDFVYDSGCLHHIPPHRRVNYVDLIKNALKSGGYFGLTCFAAGDLDERNGSEITDWDVYRGWSLQGGLAYSEEKLREIFKGFEVIEIRKMEQIEQPNTMFGESFLWTALFKKK

SEQ ID NO: 29298 - DNA, 864 bp, Mannheimia succiniciproducens MBEL55E
  CDS (1)..(864)
atgaaatccgagcttatttgctataaaaaaatgcctgtgtggaacaaaaattcactgccgaaaatgtttcaggaaaaacacaataccaaagcaggcacttggggaaaattaacggttttacaaggtaaattaaaattctatacgctgaatgaagacggctctatagtaaacgaacatattttctccgctaatacggataccccttttgttgagccgcaacaatggcacaaagttgaagcgctttccgacgatttagaatgctatttggaattttattgcacaaaagaagattatttcggcaaaaaatataatatgacggcaacccacagcgatgtactgaaaaccgctaaaataattacaccctgtaaagtgctggatttaggttgcggtcacggacgaaattcgctttatttggcactgaaaggctatgatgtgacatcttgggatcataatgcagccagtattgcctttttagccgatagcgccgcgaaagaaaatctgcaaattcagaccgcagtttacgatataaacaatgcaaatattcaagaaaattatgatcttattctctctacggtggtatttatgtttttagaccgggaagccgtaccagcgattattgataatatgcaaaaacacacgaatgcgggtggttataatttaattgttgcggcgatgtccactgaggatatgccttgcccgattcctttcgcttttacttttggcgaaaacgaattgaaaaattattatcagggctgggagtttgtggaatataacgaaaacataggtgaattacacaaaaccgataaaaacggcaatcgttataaaatgaagtttgtgaccatgttggcgaagaaagttaaataa

SEQ ID NO: 29299 - protein, 287 aa, Mannheimia succiniciproducens MBEL55E
MKSELICYKKMPVWNKNSLPKMFQEKHNTKAGTWGKLTVLQGKLKFYTLNEDGSIVNEHIFSANTDTPFVEPQQWHKVEALSDDLECYLEFYCTKEDYFGKKYNMTATHSDVLKTAKIITPCKVLDLGCGHGRNSLYLALKGYDVTSWDHNAASIAFLADSAAKENLQIQTAVYDINNANIQENYDLILSTVVFMFLDREAVPAIIDNMQKHTNAGGYNLIVAAMSTEDMPCPIPFAFTFGENELKNYYQGWEFVEYNENIGELHKTDKNGNRYKMKFVTMLAKKVK

SEQ ID NO: 29300 - DNA, 897 bp, Legionella pneumophila subsp. pneumophila str. Philadelphia 1
  CDS (1)..(897)
atgccaagagaatacgataatttaatctgctacaaacaactatcaattgatgaccatggaaaacttaaattttttcttgaaaagcacagcactaaagaaggaacatggggcaaactttccctaagcgaaggtgaaattgattttattttccagaatggcttggggcaggaactgtcgcgtattcgtcttgataaaaataataggcaactatctattcctccggcctcctggcataaaatcattccgatcagcgcatcgttcaatgctcagcttggtttttattgcaaacctcatcgctactttaacaaaaaatacggcttaactgaggtgcaccgtgacttattgtatgtgtatcatacctacttgtcgcatttaggctcactaaccactctggatgtcggttgtggttccggtagaaatctgttgtatttgacccaacttggccatatagtgactggaattgatatcaatcaaacggcactggaaaatattcaaataatcgctcaaaaagaaaacctgagtctgcttaatattttgtcgcaggatttaaatcaacctcaagcccttgcaccagatcattacgattttgtctgctctacagtgactctccaatttttaaatgcctcacgtatcccctctttattgattgagttgcaggaggcaacgaagaaaaatggctatcattttctggtttttcccgtccaatctgaactttattcactcccaagctcattcacgtttttaccaaaacaagaagagctgtatcatttttaccaggacagcggctggtctatcctcgaatacaaagaatcagtaggacatcttcataaacaggatgaaatgggaagaccagtgcaaggattatttgctctgttgcttgcccagaaagttctataa

SEQ ID NO: 29301 - protein, 298 aa, Legionella pneumophila subsp. pneumophila str. Philadelphia 1
MPREYDNLICYKQLSIDDHGKLKFFLEKHSTKEGTWGKLSLSEGEIDFIFQNGLGQELSRIRLDKNNRQLSIPPASWHKIIPISASFNAQLGFYCKPHRYFNKKYGLTEVHRDLLYVYHTYLSHLGSLTTLDVGCGSGRNLLYLTQLGHIVTGIDINQTALENIQIIAQKENLSLLNILSQDLNQPQALAPDHYDFVCSTVTLQFLNASRIPSLLIELQEATKKNGYHFLVFPVQSELYSLPSSFTFLPKQEELYHFYQDSGWSILEYKESVGHLHKQDEMGRPVQGLFALLLAQKVL

SEQ ID NO: 29302 - DNA, 588 bp, Methylococcus capsulatus str. Bath
  CDS (1)..(588)
atggacgctgagacgccccggcaaaagtgggaccggatctatcgggaatggaagggcccgttccccgatgccgccatggtcctgtcccagaacgagcatctcctgccgggtggcggtagagcgctggacctcgcttgcggactcggaggcaatgcgctgtttctggcccggcgggggttcgaggtggacgccatcgacctgtccgaggcgggaatcgaagcgctcgcccatgccgcacgcctggaaggtctgcccatccacgcccaagtcggcgatgtcatggaaggccaatggtccaacggaagttacgaggtgatcgtcgtgacccggttcctcgaacggacactggtgaagacgatcgtcggcgcgctcaaaccgggcggcttgttgttctatcagactttcgtgaagaccaagagcagcgaccacggccccaacaatccgcgcttcctgctgcacgacaacgagctcatccgactcttcgacggattgctgatccgttattaccgggatgaagcacggacgggccgaccggatgccggccaacgtgacgaagcttttcttgtagcccagagacctgaatcatga

SEQ ID NO: 29303 - protein, 195 aa, Methylococcus capsulatus str. Bath
MDAETPRQKWDRIYREWKGPFPDAAMVLSQNEHLLPGGGRALDLACGLGGNALFLARRGFEVDAIDLSEAGIEALAHAARLEGLPIHAQVGDVMEGQWSNGSYEVIVVTRFLERTLVKTIVGALKPGGLLFYQTFVKTKSSDHGPNNPRFLLHDNELIRLFDGLLIRYYRDEARTGRPDAGQRDEAFLVAQRPES

SEQ ID NO: 29304 - DNA, 759 bp, Leuconostoc mesenteroides subsp. mesenteroides ATCC 8293
  CDS (1)..(759)
atgacagaaaatttatttaaggatgaagtcgtggctaatcagtttaacgactataatgacgtattagaacaggttttgggatataattttgttttgtcgattttgaaatcgactcaagcaaagaaaatattagactatggatgtggccctggaaaagtttcgctgcgtttagcaaaccaactatcagccgatatagttgcggttgacgagtctgctaaaatgattgaaattgcgaaaagagagcgtaagcatcagcaaattgattataaaattgttaaaaaagataatttagattttatctctgataattcagtaaatggtgcgattgcgtgctatgtttttattaacaatcagtctgaacaacgaattttaaagattatgagggaaatttatcgaacattgcgaccaaacagtcacttcatcattttagatactaatccaaataccacgggtgtaccattttcaacttttcaaaatggtgaaccggggaaattttatagttatggtgaagaacgtgttgaaaagttgaatctggactcgcaagaaaaacttattttgcatgattttaactggccaaatcgtatgtatgaaacaaatttaaagcgagcaggatttagtgaaattacagttcggtatccaaagttagaagatttttcagcagaacaaatccaacaaatagaacaagagtatcactataagagttggttaaatgaaaaaacacaagcaccatttattttataccaagctataaaaaagtag

SEQ ID NO: 29305 - protein, 252 aa, Leuconostoc mesenteroides subsp. mesenteroides ATCC 8293
MTENLFKDEVVANQFNDYNDVLEQVLGYNFVLSILKSTQAKKILDYGCGPGKVSLRLANQLSADIVAVDESAKMIEIAKRERKHQQIDYKIVKKDNLDFISDNSVNGAIACYVFINNQSEQRILKIMREIYRTLRPNSHFIILDTNPNTTGVPFSTFQNGEPGKFYSYGEERVEKLNLDSQEKLILHDFNWPNRMYETNLKRAGFSEITVRYPKLEDFSAEQIQQIEQEYHYKSWLNEKTQAPFILYQAIKK

SEQ ID NO: 29306 - DNA, 873 bp, Actinobacillus pleuropneumoniae serovar 1 str. 4074
  CDS (1)..(873)
atgcaaaacttaatttgctataaacaaatgccggtttggaccaaagacagcctgccacaaatgttccaagaaaaacacaatactaaggaaggtacttgggcaaaactgactatacttaaaggcgaattaaaattttatgaattgaccgaacaaggcgaagaagtcaatagcgtgatttttacccctgaaaatcagccgccgtttgtcgagccgcaactttggcataaagtcgaagcgctgtccgatgatttggaatgtcagctcgcattctattgcgaagcgaaagattactatgcgaaaaaatataatctcaccacgactcattccgaagtgttaaatgcggttaattatgtaaaaggtggtaaagcgttggatttaggttgcggacgcggacgcaattcgctctatctgaatttattaggttttgatgtaacggcggttgatcataatgtcgagagtatcgaattcttaaactatatgattgagaaagagaatctgcaaaatatcgaaaccggtgtttatgatattaaccaagccactatcggcagccaaagcggtgaatatgatctaattatttctacggttgtgatgatgttcttaaaccgtgaacgcattccggcaattattgaaaatatgcagaaaaacaccaaggtcggcggctataacttaattgtgtgtgcgatgagtaccgaagaatatccgtgtccgatgccgttctcatttaccttcggcgagcgagaattagcgaactattaccaaggttgggaattagtgaagtacaatgaagatttgggtgaattgcataaaaccgatgcgaacggcaaccgtattaaaatgcgtttcgcaaccatgttagccaagaaaacagcgtaa

SEQ ID NO: 29307 - protein, 290 aa, Actinobacillus pleuropneumoniae serovar 1 str. 4074
MQNLICYKQMPVWTKDSLPQMFQEKHNTKEGTWAKLTILKGELKFYELTEQGEEVNSVIFTPENQPPFVEPQLWHKVEALSDDLECQLAFYCEAKDYYAKKYNLTTTHSEVLNAVNYVKGGKALDLGCGRGRNSLYLNLLGFDVTAVDHNVESIEFLNYMIEKENLQNIETGVYDINQATIGSQSGEYDLIISTVVMMFLNRERIPAIIENMQKNTKVGGYNLIVCAMSTEEYPCPMPFSFTFGERELANYYQGWELVKYNEDLGELHKTDANGNRIKMRFATMLAKKTA

SEQ ID NO: 29308 - DNA, 861 bp, Haemophilus influenzae R2846
  CDS (1)..(861)
atgaaaaacgaattaatttgctataaacaaatgccagtgtggacaaaagacaaattgccacaaatgttccaagaaaagcacaacacaaaagtcggcacttggggaaaattaactgtattaaaaggtaagctcaaattttatgagctaaccgaaaatggcgatatcattgccaaacatatttttacgccagaaagcgacattccttttgttgaacctcaagcatggcatcgtgttgaagcgctttctgatgatttagaatgtaccctaggtttctattgcaaaaaagaagattacttcagtaaaaaatacaacatgacagccactcacggcgatgtggtggatgcagcaaaaattatctcgccttgtaaagtattagatttaggttgtggacaagggcgtaattcactttatttaagtttattgggttatgatgtgacctcttgggatcacaatgaaaacagcattgcctttttaaatgaaaccaaagagaaagaaaaccttaatatttctaccgcactttacgacattaactctgccaacattcaagaaaactatgattttattgtttcaacggtggtgtttatgttcttaaatcgtgaacgtgtgccgtcaatcattaaaaatatgcaagaacataccaatgttggcgggtataacttaatcgttgccgccatctccactgatgatgtgccttgcccacttccgttctctttcacttttgctgaaaacgaattgaaagaatattacaaagattgggaatttttagaatataacgaaaatatgggcgaattacataaaaccgatgaaaacggcaatcgcattaaaatgaaatttgctacgatgttagcgagaaagaaataa

SEQ ID NO: 29309 - protein, 286 aa, Haemophilus influenzae R2846
MKNELICYKQMPVWTKDKLPQMFQEKHNTKVGTWGKLTVLKGKLKFYELTENGDIIAKHIFTPESDIPFVEPQAWHRVEALSDDLECTLGFYCKKEDYFSKKYNMTATHGDVVDAAKIISPCKVLDLGCGQGRNSLYLSLLGYDVTSWDHNENSIAFLNETKEKENLNISTALYDINSANIQENYDFIVSTVVFMFLNRERVPSIIKNMQEHTNVGGYNLIVAAISTDDVPCPLPFSFTFAENELKEYYKDWEFLEYNENMGELHKTDENGNRIKMKFATMLARKK

SEQ ID NO: 29310 - DNA, 753 bp, Burkholderia cepacia R1808
  CDS (1)..(753)
atgaaacaccacgaccaggtcgccgacgcattcggcacgacggctgccgcctatctgacgagcacggtccacgcgacgggcgccgatctcgacatgctggcggccgccgtgcgcgcgacgccggcggccgcggtgctcgatctcggctgcggcgcgggccatgcgagcttcgcggtggcgccgcacgtgcgcgacgtggtcgcgtacgatctcgcggcgccgatgctcgcgaccgtcgacgccgccgcgcgcgagcgcgggctcgcgaacgtccgcacgcagcaggggccggccgagcggctgccgttcgaggcgggcagcttcgactgggtgatcagccggatgagcgcgcatcactggcacgacgtgccggcggcgctcgccgacatgcgccgcgtgctgaagccgggcgggcgcgtgctgatgatcgacatcgcgggcaacgatcatccgttgctcgacacgtatctgcaggcggccgaagtgctgcgcgatgcgtcccacgtgcgcgattaccgcgccgacgagtggctcgcgatgttccgtggcgccgggttcgacgcgcaggtgcaacgccgctggcgtttgccgatcgatttcgacacgtgggtgcagcggatccgcacgccggccgacagcgtcgcgggcatccgcgcgctgtgggcgcatgcaccggacgaagtgcgcggctactacgcggtgcagccggacggctcgttcgagcacgatgcgctgctgatcgaagcgtgctga

SEQ ID NO: 29311 - protein, 250 aa, Burkholderia cepacia R1808
MKHHDQVADAFGTTAAAYLTSTVHATGADLDMLAAAVRATPAAAVLDLGCGAGHASFAVAPHVRDVVAYDLAAPMLATVDAAARERGLANVRTQQGPAERLPFEAGSFDWVISRMSAHHWHDVPAALADMRRVLKPGGRVLMIDIAGNDHPLLDTYLQAAEVLRDASHVRDYRADEWLAMFRGAGFDAQVQRRWRLPIDFDTWVQRIRTPADSVAGIRALWAHAPDEVRGYYAVQPDGSFEHDALLIEAC

SEQ ID NO: 29312 - DNA, 603 bp, Thiobacillus denitrificans ATCC 25259
  CDS (1)..(603)
atgaacgagaaccggagcattgcattcttcgatgagcagttccgccgtcagccgaatgacgttgcactgaaacttaacccgttcgaggcgctcgcgcttccctaccttacgggcgacgtgctcgatttcggttgcggcctgggcaatctcgccttcgccgcggcgggcaggggttgcacggtcacggctctcgatggcagtccggccgccatcgaacacatccgttgccgcgccgctacggaaggcgcttcggtgttcgcgtcccttgccgacctgcgtgactacccgctgacgcgcgaatacgactgcgtcgtctccatcggcctgctgatgttcttcaactgctcaacggcatttcgggtcttggcagatttgcaggcccacgtgcgccccggcggggtcgctgtcatcaatgtcctcgtcgaggggacgacctacctcgagatgttcgatccattggatcactgcctcttcgccccgtcagaattgcaacaccgattcgcaggctggacgatcgagcgcatggagttcgccgatttcgaggccccccaaaacacgctcaagcgcttctgcacagccgtagcgcagaagcgagccgcctga

SEQ ID NO: 29313 - protein, 200 aa, Thiobacillus denitrificans ATCC 25259
MNENRSIAFFDEQFRRQPNDVALKLNPFEALALPYLTGDVLDFGCGLGNLAFAAAGRGCTVTALDGSPAAIEHIRCRAATEGASVFASLADLRDYPLTREYDCVVSIGLLMFFNCSTAFRVLADLQAHVRPGGVAVINVLVEGTTYLEMFDPLDHCLFAPSELQHRFAGWTIERMEFADFEAPQNTLKRFCTAVAQKRAA

SEQ ID NO: 29314 - DNA, 579 bp, Chloroflexus aurantiacus
  CDS (1)..(579)
atgcgtgagcgttatctgaccggtgagattccgtgggatcaccccgatccaccgcctgagatcattgcgctcagtcaggagttaccaccaagccgggctatagacctcggctgtggcaccgggcgcgcttgtgtctggctggctcgcgcaggctggcaggttgatggggtcgattttgtccctgaagccatcgccatggcgcaagagcgcgtagcggctgccggtgttggtgaccgggtacgtctcttcgtggctgatgccaccaatctggcatttctgaacgaaccctacgatctggcgattgatgtcggctgcggccatggctttagcgaaccggaattgtacgcttatctcgatgaagtgcgccgcctcctcaagcccggcggcctgttcgtgttcttcgttcatctcagcgacgcgacaaagcctgatgcacagatgctgaaaaccagagtcgatcaaaacctgctcatgacagcgctccaggagcggtttattatcgagcagtttgtccccggtgaaactgtcgtcatggggcaacgcggcccctcagcctggatctatctccgccgaccgtaa

SEQ ID NO: 29315 - protein, 192 aa, Chloroflexus aurantiacus
MRERYLTGEIPWDHPDPPPEIIALSQELPPSRAIDLGCGTGRACVWLARAGWQVDGVDFVPEAIAMAQERVAAAGVGDRVRLFVADATNLAFLNEPYDLAIDVGCGHGFSEPELYAYLDEVRRLLKPGGLFVFFVHLSDATKPDAQMLKTRVDQNLLMTALQERFIIEQFVPGETVVMGQRGPSAWIYLRRP

SEQ ID NO: 29316 - DNA, 864 bp, Eikenella corrodens
  CDS (1)..(864)
atgaatccagaactcatctgctacaaaaccatgccggtatgggataaagccactattccggcggcagttttgtcgcagcacaacacacaggttggcacatatggcaagctgcgcgtattgcgtgggcggctgaagttttatgaattgcaagaagatggcgtggtactcgcggaacatgtgttgcagccggaaagtgggctgtggacgatttacccgcaggcttggcataaagtggaaccactggatgatgattttgccgtgcagctggaatttcattgcgaaaaagccgactttttccacaaaaaatacggcatgactgctacccattccgccatccgcgaagcagtgcagactgtgccgccgtgtaaaacgttggatttaggctgtgggcaagggcgtaatgcgctgtttttgagcttggccggatacgatgtgcatgctgtggatcacagcccggcggcagtagcttcagtgctggatatggctgcgcgcgaacagttgccgctgcgggcagatgcttacgatattaatgctgccgctttgagtgaagattacgattttatcttctccactgtggtgtttatgtttctccaagccaaccgtgtgtcggagattattgccgatatgcaggtacatacccgatccggtggctataacctgattgtgtcggcaatggatacggcagactacccctgccatatgccgttttcgttcacatttaaagaagacgaattgcggcagtattacgccggctgggaattgctgaaatacgaagaagcggtgggttcgatgcacgctaccgatgcgcaaggtcgaccgattcaattgaagtttgtgacgatgttggcgaaaaagcccggttga

SEQ ID NO: 29317 - protein, 287 aa, Eikenella corrodens
MNPELICYKTMPVWDKATIPAAVLSQHNTQVGTYGKLRVLRGRLKFYELQEDGVVLAEHVLQPESGLWTIYPQAWHKVEPLDDDFAVQLEFHCEKADFFHKKYGMTATHSAIREAVQTVPPCKTLDLGCGQGRNALFLSLAGYDVHAVDHSPAAVASVLDMAAREQLPLRADAYDINAAALSEDYDFIFSTVVFMFLQANRVSEIIADMQVHTRSGGYNLIVSAMDTADYPCHMPFSFTFKEDELRQYYAGWELLKYEEAVGSMHATDAQGRPIQLKFVTMLAKKPG

SEQ ID NO: 29318 - DNA, 858 bp, Photorhabdus luminescens
  CDS (1)..(858)
atgagcgacctcatttgttataaacgaataccaatctggcagaaaaatactattcctgaaatgttcactgaaagacataacactaaagaagggacttacgcttgtcttgagatctttgaaggtgaactggaatttgtgattttcgatggtgatcaggaagaaaccgcttattttaatgtgcaaaagcagcctcccattattcagccacaggtctggcataaaattaaatgggtgagtgatgatattaagtgccagctctcttttctatgtgaaccacaatatctgttttataaacaaaataatttgtcattacctcactctgaaattagatatctggcaaatattatttctccttgtaagacattagatctgggggctggtcgtggccggaatactttctatctggcagaaagaggttatgatgttacagccgtggatattaatccacaatatattaacgcaattaatgctattaaagaaaaacagcggattaaaaatatctgtacggctgtttatgatatcaactctcacaatattatcgaaaaatatgatttaattatttcaacggtggtgctgatgtttctgcaacgggaaaagatcaccgatattatttacaatatgcagaaacagacgaataaaggtggtattaatctgattgtttgcccggttgaaacagattctgcgccatattcattattgccattcaaaagtttcctcatgtcaagtgaattggagaattattattctgactgggaaattattaaatataatgaaaatcctggtcatcttcataaaacagatgaaaatggtaatagaataaaattaaattttgctacgcttattgccagaaagcgatga

SEQ ID NO: 29319 - protein, 285 aa, Photorhabdus luminescens
MSDLICYKRIPIWQKNTIPEMFTERHNTKEGTYACLEIFEGELEFVIFDGDQEETAYFNVQKQPPIIQPQVWHKIKWVSDDIKCQLSFLCEPQYLFYKQNNLSLPHSEIRYLANIISPCKTLDLGAGRGRNTFYLAERGYDVTAVDINPQYINAINAIKEKQRIKNICTAVYDINSHNIIEKYDLIISTVVLMFLQREKITDIIYNMQKQTNKGGINLIVCPVETDSAPYSLLPFKSFLMSSELENYYSDWEIIKYNENPGHLHKTDENGNRIKLNFATLIARKR

SEQ ID NO: 29320 - DNA, 903 bp, Eikenella corrodens
  CDS (1)..(903)
atggtaagtgctctttcatgtacacatgagaggagatgctatgcaatccgaactcatctgctacaaaactatgccggtatgggattaagccactattccggcagcagttttgtcgcagcacaacacacaggttggtacctacggcaagctgcgcgtattgcgcgggcggctgaagtttttgaattgcaggaagacggtacggtgctggcggagcatattttgcagccggattccggtgtgtggacgctttatccacaggctcaacacaaggtggagccgttggatgatgattttgccgtgcagctggaatttcattgcgaaaaagcagattatttccacaaaaaacacggcatgactaccacccattccgccatccgcgaggcggtgcaaaccgtggcgccgtgtaagaccttggatttgggctgtgggcaggggcacaatgcgctgtttttgagcttggccggatatgatgtgcgcgctgtggaccacagcccggcggcagtggcttcggtgctggatatggctgcacgcgaacagttgccgctgcgggcggatgcttacgatattaacgctgctgctttgaatgaagattacgattttatctttgccacggtagtgtttatattcctccaggcaggccgtgtgccggagattattgccgatatgcaggcgcatactcggcctggtggctataacttgatcgtgtcggcaatggatacagcagactacccctgtcatatgccgttttcgttcacattcaaagaagacgagctgcggcagtattatgccgactgggaattgttgaaatacgaagaagccgtgggcttgatgcacgctactgatgcgcaagggcggccgattcaattgaaatttgtgacgatgttggcgaagaagcccggctaa

SEQ ID NO: 29321 - protein, 300 aa, Eikenella corrodens
MVSALSCTHERRCYAIRTHLLQNYAGMGLSHYSGSSFVAAQHTGWYLRQAARIARAAEVFELQEDGTVLAEHILQPDSGVWTLYPQAQHKVEPLDDDFAVQLEFHCEKADYFHKKHGMTTTHSAIREAVQTVAPCKTLDLGCGQGHNALFLSLAGYDVRAVDHSPAAVASVLDMAAREQLPLRADAYDINAAALNEDYDFIFATVVFIFLQAGRVPEIIADMQAHTRPGGYNLIVSAMDTADYPCHMPFSFTFKEDELRQYYADWELLKYEEAVGLMHATDAQGRPIQLKFVTMLAKKPG

SEQ ID NO: 29322 - DNA, 26 bp, Primer
atgatcattcgtgacgaaaactattt

SEQ ID NO: 29323 - DNA, 26 bp, Primer
ttattttttacgtgccagcatcgtgg

SEQ ID NO: 29324 - protein, 27 aa, consensus
  MISC_FEATURE (1)..(27): consensus for the disclosure of xaa see table XV
LDLGCGXGXXXNXXXLXXXGXXVXXXD

SEQ ID NO: 29325 - protein, 33 aa, consensus
  MISC_FEATURE (1)..(33): consensus for the disclosure of xaa see table XV
XXXXXGXGXXXXXXXXXXXXXXXXXXDXXXXXX

SEQ ID NO: 29326 - DNA, 759 bp, Escherichia coli (strain K-12)
  CDS (1)..(759)
atgaaaaccgtaactgtaaaagatctcgtcattggtacgggcgcacctaaaatcatcgtctcgctgatggcgaaagatatcgccagcgtgaaatccgaagctctcgcctatcgtgaagcggactttgatattctggaatggcgtgtggaccactatgccgacctctccaatgtggagtctgtcatggcggcagcaaaaattctccgtgagaccatgccagaaaaaccgctgctgtttaccttccgcagtgccaaagaaggcggcgagcaggcgatttccaccgaggcttatattgcactcaatcgtgcagccatcgacagcggcctggttgatatgatcgatctggagttatttaccggtgatgatcaggttaaagaaaccgtcgcctacgcccacgcgcatgatgtgaaagtagtcatgtccaaccatgacttccataaaacgccggaagccgaagaaatcattgcccgtctgcgcaaaatgcaatccttcgacgccgatattcctaagattgcgctgatgccgcaaagtaccagcgatgtgctgacgttgcttgccgcgaccctggagatgcaggagcagtatgccgatcgtccaattatcacgatgtcgatggcaaaaactggcgtaatttctcgtctggctggtgaagtatttggctcggcggcaacttttggtgcggtaaaaaaagcgtctgcgccagggcaaatctcggtaaatgatttgcgcacggtattaactattttacaccaggcataa

SEQ ID NO: 29327 - protein, 252 aa, Escherichia coli (strain K-12)
MKTVTVKDLVIGTGAPKIIVSLMAKDIASVKSEALAYREADFDILEWRVDHYADLSNVESVMAAAKILRETMPEKPLLFTFRSAKEGGEQAISTEAYIALNRAAIDSGLVDMIDLELFTGDDQVKETVAYAHAHDVKVVMSNHDFHKTPEAEEIIARLRKMQSFDADIPKIALMPQSTSDVLTLLAATLEMQEQYADRPIITMSMAKTGVISRLAGEVFGSAATFGAVKKASAPGQISVNDLRTVLTILHQA

SEQ ID NO: 29328 - DNA, 678 bp, Streptococcus thermophilus LMG 18311
  CDS (1)..(678)
atgaaaattgtagttccgattatgccgactagtttagaggaagcacaagcgcttgagctgtctcgttttgagggggcagacattattgaatggcgtgcagattttttagataagcatagtatcttaacagttgctccagctatttttgagaaattcgcaggctttgaaattgtttttaccattcgtacgacacgtgaaggtggtaagattgagttaactgatggggaatatgtcacactgattaaggatgtagctgctatctattcaccagattatattgattttgagtatttcacacgcaaggaagtctttgaccagatgcttggattttcaaacttggttttgtcttatcataactttgaggagacacctgaaaaccttatggaacttttatctgagatgaccaacttgacgccaagagttgttaaagtagccgttatgcctaagaatgaacaagatgtccttgatcttatgaatttcacacgcggctttaaggcctttaaccctgaacaagagtttgtaactatgtcaatgggtaagttaggtcgtttgtcacgtttggcgggagacttggtggggtcatcatggacttttgctagtcttgacaataccagcgcaccgggtcaagttgctcttgcggacatgtgtaggattagggaggttttggatgcggattga

SEQ ID NO: 29329 - protein, 225 aa, Streptococcus thermophilus LMG 18311
MKIVVPIMPTSLEEAQALELSRFEGADIIEWRADFLDKHSILTVAPAIFEKFAGFEIVFTIRTTREGGKIELTDGEYVTLIKDVAAIYSPDYIDFEYFTRKEVFDQMLGFSNLVLSYHNFEETPENLMELLSEMTNLTPRVVKVAVMPKNEQDVLDLMNFTRGFKAFNPEQEFVTMSMGKLGRLSRLAGDLVGSSWTFASLDNTSAPGQVALADMCRIREVLDAD

SEQ ID NO: 29330 - DNA, 1812 bp, Arabidopsis thaliana
  CDS (1)..(1812)
atggcagcttcttcaactaatgctcgtctcaccaaccctcctcgtctactctccaaaccccgactttcacctacctccgtcgccaatctccgttttccagccgccgatttctccactcgcttctttgccgattcttcgtccccgcggctaaggagtgtaccgtttccggtggtattttccgatcaaaggcgccggcgaagcatggaacctagcaatgtctatgtggcttcaaattccacggaaatggagatcggaagtcatgatatcgtgaagaatccgagcttgatctgtgctccagtgatggcggattcaatagacaagatggtgattgaaacgagtaaagcccatgaattgggtgcagacttggttgaaattcgattagattggctaaaggacttcaatcctcttgaggatctaaaaaccattattaagaaatctcctctacccactttattcacctacagaccaaaatgggaaggtggtcagtatgaaggtgatgaaaatgagagacgggatgtgcttcgtctggccatggagttgggagctgattatattgatgttgaacttcaggtggcaagtgagttcatcaaatctattgacggaaagaagcctggaaagttcaaagtaattgtttcatcgcacaactatcagaataccccttctgttgaggaccttgatggccttgttgcaagaatacaacagactggagccgacattgttaagattgctactactgctgtggacattgcagatgttgctcgcatgttccatataacctcaaaagctcaagttcccacaattggacttgttatgggtgaaagaggtttgatgtctcggattctttgttcgaaatttggtggttatttgacctttggcaccttagattctagtaaagtttctgcgccaggtcaaccaacgatcaaggatctgttggatctttacaactttagaagaattggtcctgacacaaaggtatatggaattattggcaagcctgtcagccacagcaaatcacctattgttcacaatcaagctttcaaatcagttgattttaatggagtatatgtccacctgttagttgataatcttgtaagctttcttcaagcatactcatcctctgatttcgctggattcagctgtacaattccgcacaaagaagctgcattgcaatgttgtgatgaagttgatccattggcaaagtctataggagctgtgaacactatactaaggagaaaaagtgacggaaagttgttgggttacaacacagattgtattggttccatttctgctattgaggatggcctacgaagttcaggtgatccaagcagtgtaccttcttcttcttcgccattggccagtaaaacagtggtggttattggtgctggtggagcaggcaaggctcttgcttatggtgcaaaagaaaagggggccaaagttgtaattgctaatcgaacttacgaacgagcactagaactcgcagaagcaataggaggcaaagcgttatctctgacagatttagataactatcacccagaagatggcatggttttggcaaacacaacatctatgggtatgcaaccaaatgttgaggagactccaatttctaaggatgcattgaagcactatgcactggtctttgatgcggtatacactccgagaatcaccagactgttgagggaagcagaagaaagtggagccataactgtctcagggtcagagatgtttgtcaggcaggcttacgagcagtttgagatcttcaccggtttacccgctccaaaggaactctactggcaaataatgtcaaagtactga

SEQ ID NO: 29331 - protein, 603 aa, Arabidopsis thaliana
MAASSTNARLTNPPRLLSKPRLSPTSVANLRFPAADFSTRFFADSSSPRLRSVPFPVVFSDQRRRRSMEPSNVYVASNSTEMEIGSHDIVKNPSLICAPVMADSIDKMVIETSKAHELGADLVEIRLDWLKDFNPLEDLKTIIKKSPLPTLFTYRPKWEGGQYEGDENERRDVLRLAMELGADYIDVELQVASEFIKSIDGKKPGKFKVIVSSHNYQNTPSVEDLDGLVARIQQTGADIVKIATTAVDIADVARMFHITSKAQVPTIGLVMGERGLMSRILCSKFGGYLTFGTLDSSKVSAPGQPTIKDLLDLYNFRRIGPDTKVYGIIGKPVSHSKSPIVHNQAFKSVDFNGVYVHLLVDNLVSFLQAYSSSDFAGFSCTIPHKEAALQCCDEVDPLAKSIGAVNTILRRKSDGKLLGYNTDCIGSISAIEDGLRSSGDPSSVPSSSSPLASKTVVVIGAGGAGKALAYGAKEKGAKVVIANRTYERALELAEAIGGKALSLTDLDNYHPEDGMVLANTTSMGMQPNVEETPISKDALKHYALVFDAVYTPRITRLLREAEESGAITVSGSEMFVRQAYEQFEIFTGLPAPKELYWQIMSKY

SEQ ID NO: 29332 - DNA, 798 bp, Neisseria meningitidis Z2491
  CDS (1)..(798)
atggcggctgttttttctgtatgtgcctgttttatgtgttcctgccttgttgtcaaaaataccgttatcggaagcggacgcaccaaaatcgccgtgccgcttgtcgcccgcgatgccgccgtactttccgccgtacttgaccaaatcaaaaacctgcccttcgatatcgtcgagttccgcgccgattttttggaatgcgcgggcagcatcggcgaagtattgcgccacacgcagaccgtccgcgacgcgctacccgacaagccgctgctgtttacgttcagacggcatggcgaaggcggctcgttcccgtgttcggacgattattattttgaactgctcgacgcgctgatcgaaagccgcctgcccgacatcatcgacatcgagctgttttccggcgaaaccgccgtccggtgcgccgtggcaaatgctcaaaaaaacggcatcgccgccctgctctgcaatcatgagtttcaccgcacgccgccgcaagaagaaatcgtatgccgtctgaaacagatggaggactgcggcgcggacatctgcaaaattgcggtgatgccgcaaagcgcggaagatgtgctgactttgctttccgccacgctcaaagcgaaagagcttgccgccaaaccgattgttacgatgtcgatggggcagacgggggcggtcagccggcttgccggacaggtgttcggctcaagcatcacgttcggttcgggaacgcaaaactccgcgccggggcaaatcggcgtatccgccctccgtgcgacactcgactgcctcgaaaacggagcagactga

SEQ ID NO: 29333 - protein, 265 aa, Neisseria meningitidis Z2491
MAAVFSVCACFMCSCLVVKNTVIGSGRTKIAVPLVARDAAVLSAVLDQIKNLPFDIVEFRADFLECAGSIGEVLRHTQTVRDALPDKPLLFTFRRHGEGGSFPCSDDYYFELLDALIESRLPDIIDIELFSGETAVRCAVANAQKNGIAALLCNHEFHRTPPQEEIVCRLKQMEDCGADICKIAVMPQSAEDVLTLLSATLKAKELAAKPIVTMSMGQTGAVSRLAGQVFGSSITFGSGTQNSAPGQIGVSALRATLDCLENGAD

SEQ ID NO: 29334 - DNA, 678 bp, Streptococcus agalactiae 2603V/R
  CDS (1)..(678)
atgaaaatagtagtaccagtaatgcctcgcagtcttgaagaggctcaagaaatagatttatcaaaatttgatagtgttgatattattgaatggcgagctgatgccttaccaaaggatgacattattaatgtagctccagctatttttgagaaattcgcaggtcatgaaattatttttactcttcgtacaacgcgtgaaggtggtaatattgtcttatctgatgctgagtatgttgagttaatccagaaaattaattctatctacaatccagattatattgattttgagtatttttcacataaagaagtttttcaagaaatgctagaatttccaaatttagtcctgtcttatcacaattttcaagagacaccggagaatattatggagatattttcagaattaacagccctagcaccacgagttgtgaaaatcgcagtaatgccaaagaatgaacaagatgtcttagacgttatgaattacactcgcggtttcaagactattaatcctgatcaagtttatgcgacggtatctatgagtaaaattggacgtatttctcgttttgctggtgatgtaactggatctagttggacatttgcatatttagattcatctatcgcacccggacaaattactatttcagagatgaagcgtgtcaaagcattgcttgacgctgactga

SEQ ID NO: 29335 - protein, 225 aa, Streptococcus agalactiae 2603V/R
MKIVVPVMPRSLEEAQEIDLSKFDSVDIIEWRADALPKDDIINVAPAIFEKFAGHEIIFTLRTTREGGNIVLSDAEYVELIQKINSIYNPDYIDFEYFSHKEVFQEMLEFPNLVLSYHNFQETPENIMEIFSELTALAPRVVKIAVMPKNEQDVLDVMNYTRGFKTINPDQVYATVSMSKIGRISRFAGDVTGSSWTFAYLDSSIAPGQITISEMKRVKALLDAD

SEQ ID NO: 29336 - DNA, 774 bp, Oceanobacillus iheyensis HTE831
  CDS (1)..(774)
atgaagaatgttgttcatgtgaagaatatcaatatcggtgaggggaaaccgaaagtgtgtgttccgataacgggagctacaaagaaagaaataagtgaggagttagatctactgcaaaccataaaagtcgacctagtggaatggcggggagatttattccaagaaattgaaaatgaaatatcggttaaaaacatgctgcaaaaaataaatcaagaaatccctcaccttccgttattatttacttttcggacaaaaggagaaggcggtggaagggaagtcacgctggaaaaatataaagaaattaatcgttttgttattgaatcaaaactagtcgacttggttgatgttgaattatttcgtggtaagaacttagtaaaagaacttgtttcttttgctcatctgcatgaccaaaaggtaattatttctaatcatgattttaatcagacacctccacgtgatgagatcatagcacgtctaaaattagcagctgataacggggctgatattggaaaaattgcagtaatgcctcgtaacgatgaagatgtgttgaatttactttctgcaacatcacttgtgaaagaattgaatcatattccgatcgtcaccatgtcgatgggagctgatggattgattagtcgcttatctggtgaagtatttggttcagcaattacttttgcttctgggaaaacagcttcagcaccaggacagattgaagctgaaaaattacaaaccgtgctaacgattatccatgattctataaataagaaaaagtag

SEQ ID NO: 29337 - protein, 257 aa, Oceanobacillus iheyensis HTE831
MKNVVHVKNINIGEGKPKVCVPITGATKKEISEELDLLQTIKVDLVEWRGDLFQEIENEISVKNMLQKINQEIPHLPLLFTFRTKGEGGGREVTLEKYKEINRFVIESKLVDLVDVELFRGKNLVKELVSFAHLHDQKVIISNHDFNQTPPRDEIIARLKLAADNGADIGKIAVMPRNDEDVLNLLSATSLVKELNHIPIVTMSMGADGLISRLSGEVFGSAITFASGKTASAPGQIEAEKLQTVLTIIHDSINKKK

SEQ ID NO: 29338 - DNA, 759 bp, Oceanobacillus iheyensis HTE831
  CDS (1)..(759)
atgacagctgatttatttactaataagaacatcccttacatttgcactccaatcactggtaaaagtaaagaagagattattacagaattacattcgttgatccttgaagaaccggatttaattgaatggcgattggactattttgattccattagcgatacaactgaagtcttgtccactttaaagcaactaacctctgctagttctataccattattagttacgataaggtctgaaaaagaaggtggcgagaacataccactatcagaaaaagaaaaagttcaattgctcttagaagtttgtgagaattcatctgtagaaatggtagattatgaagtaggaaatgactgtgtttacgtaaaacaattaagagaagcatcaagaaaatataataaaaaattgatcctctcttatcataattttgattatactcctaatagacaagttattttaaaacgattatatcaaatggagttttatggagcggatatagctaaggtagctgtaatgccgcaaacaaaagacgatgtgctacgccttttagaattgacgaaggaagcaaatgaatcaatggatatacccgtcgtcacaatgtctatgggagctctaggcagtttaagtagaatcgtaggttgggcatatggctcaattatcacctttggattgggagttcaaagttcagcacctggacaggttccaatcgctaatttaaaacgaatgattcagatgatgaaagatacaatcggtgaatggaagtag

SEQ ID NO: 29339 - protein, 252 aa, Oceanobacillus iheyensis HTE831
MTADLFTNKNIPYICTPITGKSKEEIITELHSLILEEPDLIEWRLDYFDSISDTTEVLSTLKQLTSASSIPLLVTIRSEKEGGENIPLSEKEKVQLLLEVCENSSVEMVDYEVGNDCVYVKQLREASRKYNKKLILSYHNFDYTPNRQVILKRLYQMEFYGADIAKVAVMPQTKDDVLRLLELTKEANESMDIPVVTMSMGALGSLSRIVGWAYGSIITFGLGVQSSAPGQVPIANLKRMIQMMKDTIGEWK

SEQ ID NO: 29340 - DNA, 759 bp, Shigella flexneri 2a str. 301
  CDS (1)..(759)
atgaaaaccgtaactgtaaaagatctcgtcattggtgcgggcgcacctaaaatcatcgtctcgctgatggcgaaagatatcgcccgcgtgaaatccgaagctctcgcctatcgtgaagcggactttgatattctggaatggcgtgtggaccactttgccgacctctccaatgtggagtctgtcatggcggcggcaaaaattctccgtgaaaccatgccagaaaaaccgctgctgtttaccttccgcagtgccaaagaaggcggcgagcaggcgatttccaccgaggcttatattgctctcaatcgtgcagccatcgacagcggcctggttgatatgatcgatctggagttatttaccggcgatgatcaggtcaaagaaaccgtcgcctacgcccacgcgcatgatgtgaaagttgtcatgtccaaccatgacttccataaaacgccggaagccgaagaaatcattgcccgtctgcgcaaaatgcagtccttcgacgccgatattcctaagattgcgctgatgccgcaaagtaccagcgatgtgctgacgttgcttgccgcgaccctggagatgcaggagcagtatgccgatcgtccaatcatcacgatgtcgatggcaaaaactggcgtaatttctcgtctggttggtgaagtatttggctcggcggcaacttttggtgcggtaaaaaaagcctctgcgccagggcaaatctcggtaaatgatttgcgcacggtattaactattttacatcaggcataa

SEQ ID NO: 29341 - protein, 252 aa, Shigella flexneri 2a str. 301
MKTVTVKDLVIGAGAPKIIVSLMAKDIARVKSEALAYREADFDILEWRVDHFADLSNVESVMAAAKILRETMPEKPLLFTFRSAKEGGEQAISTEAYIALNRAAIDSGLVDMIDLELFTGDDQVKETVAYAHAHDVKVVMSNHDFHKTPEAEEIIARLRKMQSFDADIPKIALMPQSTSDVLTLLAATLEMQEQYADRPIITMSMAKTGVISRLVGEVFGSAATFGAVKKASAPGQISVNDLRTVLTILHQA

SEQ ID NO: 29342 - DNA, 678 bp, Streptococcus mutans UA159
  CDS (1)..(678)
atgaaaatagtagttcctgttatgcctcaaaatattgaagaggctaaccaacttgatttaacgaggattgatagtacagatattattgaatggcgggcagattatttagttaaagatgatattttaacggtagcaccggctatttttgaaaagttctcgggtcatgaagtgatttttactttgcgtacagaaaaagaaggaggaaatatttccctttctaatgaagactatcttgctatcatccgtgatattgcggctctttatcagcctgattacattgactttgaatatttttcctaccgtgatgttttagaggaaatgtatgatttttcaaatcttattttgtcttatcacaattttgaagaaacaccagaaaatctaatggaagtcttttcagagttaacagctttagctccgcgtgttgtcaagattgctgtcatgcctaaaaatgaacaggatgttcttgatttgatgaactatacaagaggctttaaaactttaaatcccaatcaggaatatgtgactatgtctatgtcgaaactaggtcggatatcacgtttagcagctgatttaataggcagttcgtggacctttgccagcttggaacaagaaagcgctccgggacagatttctttggcagatatgcgtaaaattaaggaggttctagatgcaaattga

SEQ ID NO: 29343 - protein, 225 aa, Streptococcus mutans UA159
MKIVVPVMPQNIEEANQLDLTRIDSTDIIEWRADYLVKDDILTVAPAIFEKFSGHEVIFTLRTEKEGGNISLSNEDYLAIIRDIAALYQPDYIDFEYFSYRDVLEEMYDFSNLILSYHNFEETPENLMEVFSELTALAPRVVKIAVMPKNEQDVLDLMNYTRGFKTLNPNQEYVTMSMSKLGRISRLAADLIGSSWTFASLEQESAPGQISLADMRKIKEVLDAN

SEQ ID NO: 29344 - DNA, 750 bp, Lactobacillus plantarum WCFS1
  CDS (1)..(750)
ttgaaagaagttacagttggggagttaacgttagcgacagggatgcctaagattggtgttgttttagcgggggccacacgggaggacctcttgcgtaaagcggggcagattttaacttcggtggcacaaattgttgtttggcggttagatccttatcaggaattggataaccgtgcggagttagtcaatacagcggcccaattgcaacaagttttggggacgattccattaattgccatgtttgggctggcaaacgatccagctgaagtgaccgaatattatcaaacttatcaaacattagtgaataatcgaagcgtggctggcgtggatattgacttagccatggtcaatcagccagattttatgacgttgaccaaacagatgcgtgccaacgaaattcggttaattgcgagccagaccgtcacgacagcaacaactgacgatttattggcgacttatcacgaattagcagcaactggtgctgatgtcgtgcgggtgacagtggctggacatgatgcacagacggtgttggcattaatggcggcaactgagcaagcacggcagcaattagttgtgccaatcgtggcaacggcgacgggcaagtttggtcgttataacagtgtctgtagtcagttgacggggtcggcagttgcctttggacacgtcggccgggtcggtgatcaaagtcaattagcagtgagtcaggtcaaacaggcgttacaaatgttggcaccacttgaaggggcgtga

SEQ ID NO: 29345 - protein, 249 aa, Lactobacillus plantarum WCFS1
MKEVTVGELTLATGMPKIGVVLAGATREDLLRKAGQILTSVAQIVVWRLDPYQELDNRAELVNTAAQLQQVLGTIPLIAMFGLANDPAEVTEYYQTYQTLVNNRSVAGVDIDLAMVNQPDFMTLTKQMRANEIRLIASQTVTTATTDDLLATYHELAATGADVVRVTVAGHDAQTVLALMAATEQARQQLVVPIVATATGKFGRYNSVCSQLTGSAVAFGHVGRVGDQSQLAVSQVKQALQMLAPLEGA

SEQ ID NO: 29346 - DNA, 702 bp, Coxiella burnetii RSA 493
  CDS (1)..(702)
atgttaaatacaccccgtatctgtgttgtggttatcggcaaaacgctcgaggaatttttgtctcagcttgaagcggcgcaaaccgcggtggattttgtcgagttgcgcatcgactatctcgaacaaataaacccgaactgggtgcgaattattaaaaatcatacccacaaaaaagctatcctttgctgtcgggcacgagcggacggcggaaagtttctaggaacgcccgaagcccaacaggaaatcttacaagcgggaaatgatcttggttttgattatcttgatatcgatctcccggttgcaaataaaatcagcatccacgaaaaaaaagcaaaaattattatttcctaccacaattttcttcatacgcccccgataaccgaacttaactttcttttagagaatatgcgattatttaatccggatgtttttaaatttgcaacgaagtctgagcaatacgaagacgttaagactttatttaaactacttattaataaaaaaaataatgaaaatatgattgtgctcggaatgggcgaacaaggaaaaataattcgtttactttcgcctttattgggagggtatttaaccttttcatcgataaacggcgccatctctgctccagggcaaattgattttaaaaccatgcaagatttttatcagcgcttttacaaaatttcatcaccgctcaagggagaagattaa

SEQ ID NO: 29347 - protein, 233 aa, Coxiella burnetii RSA 493
MLNTPRICVVVIGKTLEEFLSQLEAAQTAVDFVELRIDYLEQINPNWVRIIKNHTHKKAILCCRARADGGKFLGTPEAQQEILQAGNDLGFDYLDIDLPVANKISIHEKKAKIIISYHNFLHTPPITELNFLLENMRLFNPDVFKFATKSEQYEDVKTLFKLLINKKNNENMIVLGMGEQGKIIRLLSPLLGGYLTFSSINGAISAPGQIDFKTMQDFYQRFYKISSPLKGED

SEQ ID NO: 29348 - DNA, 1491 bp, Rhodopirellula baltica SH 1
  CDS (1)..(1491)
atgatttgtgtcagtctcggccgcgcccgccacaaacgcatgatcgccgagcaccagtttttggtcgaacaaggtgctcagctcgtagaactgcgtctcgattacatttctcgcgccgtcgacctgaaacgattactcaatgaccgtccgggtcccgtggtcgccacggttcgcaggaaagaagacggcggtcggtgggaaagatccgaacaagatcgcttgatgctcctgcggagtgttatcgctgcgggtgccgagtacgtcgacatcgaagccgacgtcgcggcacagattccgcgttacggcaacaccaaacgaatcatcagctaccacgacttcagtggcactccggagaatttggacgaactgcacgaggccatggcggcggaagacgcagacatcgtcaaaatcgcttgcatggcgaattcattctcggacaacatccgaatgatcaacctctgcaagaacgcgaaaattccgacgatcgggatctgcatgggcgagatcggcatgctaacgcgaatcctggccaaccgtgtcggatcgccgttcacctacgcaacgttcagctctgacaaaaagcttgcacctggccagctcaactggaaagagatgaacagcgtttatcattacgagaccatcaaggaagacaccgctttattcggcgtgatcgcggatccggtcgctcatagccacagcccgttgatccacaacgctgctttcgtcgacgcgggactgaacgcacgataccttccgctgcgtgtgccgaaagatgacctgccatccttcatgcggacttgcaaggaactggggattcaaggaatcagtatcacgattccccacaaggagtcggcacttcaatactgcacacaggcggaatccagttgcaccggtatcggcgcgatcaacacgatgatcttcaacggcgatgatcgcctcggctacaacaccgactatcgcgccgcaatggattgcatcgaagaatctttcaagatcgaacggggaaccgagaattcgctgcaaggaaaaacagctctggtcctcggtgccggcggcgtctcacgtgccatcgcgtggggactacgtcaacgcaaatgcgacgtcaccatcagttcgcgaacacgtgaacgagccgagatgttggctgctgacatcggttgtcgtgtgatcgactgggaagaacggcacgaggcaaaggtccagcttttgatcaatggaacgcccattgggatgcaccccgacgtcgacaacactcccttcaatcagtcggccctcaaccagttcatggttgtattcgacacagtctacaaccctgaaaacactcttctgatcaaacaagcgacgcagaaacaatctcgtgtgatcacgggagtcgacatgtttgttcgacaagccgcgtaccagttcaagctattcaccgggcaagaggcgtcgatcgagttgatgcgaaagaaaatcaaagaggcaaccaacccagttcgtttgaactaa

SEQ ID NO: 29349 - protein, 496 aa, Rhodopirellula baltica SH 1
MICVSLGRARHKRMIAEHQFLVEQGAQLVELRLDYISRAVDLKRLLNDRPGPVVATVRRKEDGGRWERSEQDRLMLLRSVIAAGAEYVDIEADVAAQIPRYGNTKRIISYHDFSGTPENLDELHEAMAAEDADIVKIACMANSFSDNIRMINLCKNAKIPTIGICMGEIGMLTRILANRVGSPFTYATFSSDKKLAPGQLNWKEMNSVYHYETIKEDTALFGVIADPVAHSHSPLIHNAAFVDAGLNARYLPLRVPKDDLPSFMRTCKELGIQGISITIPHKESALQYCTQAESSCTGIGAINTMIFNGDDRLGYNTDYRAAMDCIEESFKIERGTENSLQGKTALVLGAGGVSRAIAWGLRQRKCDVTISSRTRERAEMLAADIGCRVIDWEERHEAKVQLLINGTPIGMHPDVDNTPFNQSALNQFMVVFDTVYNPENTLLIKQATQKQSRVITGVDMFVRQAAYQFKLFTGQEASIELMRKKIKEATNPVRLN

SEQ ID NO: 29350 - DNA, 1596 bp, Oryza sativa (japonica cultivar-group)
  CDS (1)..(1596)
atgacgctcctgtgcgtgccgctggtgtcgcgcacggtggaggcgatgcaggccgacgcggcggcggccgcggccgccggcgccgacctcgtcgagatccggctcgacttcatcgaggggttccgcccgcgggagcacctcccgagcctgctccgtggctgccctctccctgccctcgtcacctaccggaggcgggctccagattctgcgtccatttcccggtatatccgcagcgcgtgcgcagatgctttcacacccaattgggaaggaggccagtacgatggtgatgatgctacaagatttgaagcactccgtttagcaatggagttaggcgtagactatgttgatattgaattgaaggttgctgacaaatttatcagctttatttctggcagtaagccagagaagtgtaaacttattgtctcatcacacaattatgaaagtactccgtcctgcgaggagcttgcagatcttgtggctagaatacaagcagttggatctgacatagtgaaaatcgcaacaactgctagtgacattgctgatgtgtcacgaatgttccaagtgatggtgcactgccaagtgcctatgattggactagtgatgggcgaaaaaggtttaatgtcaagggtgttatcccccaagtttggaggatatctaacctttgggactcttgatgctacaaagatatcagcacctgggcagccaaccgtcaaagaactgttggacatttataatataaggcgtataggacctgatacaaaggttcttggtcttattgccaacccagtaaaacagagcaagagcccaattttgcacaataaatgtcttcaatctattggatacaatgctgtttatcttccacttttggcagatgaccttgctcgatttctcagcacatattcatctccggatttttcaggattcagttgctctcttcctttcaaagtggacgctgtacagtgttgccatgaacatgacccagttgctaagtcaatcggtgccataaacaccataattaggagaccagatggcaaactagtgggctacaatactgactacattggagcaatttctgctattgaggatggcataggaggcccaggatcaaaggatgctgccatctcacctttggctggcaggcttgttgttgttgtaggtgctggtggagctggtaaggcaattgcttatggggcaaaggagaagggtgcaagagttgtagtagcaaatcgtacctacgaaaaagcagtaagtcttgctgctgcagtgggtggtcatgccctgagattagccgagcttgaaactttcaggcctgaagaagggatgatccttgctaatgcgacatcattgggaatgtaccccaatgtggacggcacccctatcccaaagaaagcattaagcttctatgatgttgtatttgatgcggtatatgccccgaaagttacccggcttctacgagaagcagaagaatgtgggattaaagttgtcagcggtgtagagatgtttgtcagacaagccatgggtcagtttgagcatttcacaggtggtattgaagctcctgaaagcctgatgcgtgagatagctgccaaatacacataa

SEQ ID NO: 29351 - protein, 531 aa, Oryza sativa (japonica cultivar-group)
MTLLCVPLVSRTVEAMQADAAAAAAAGADLVEIRLDFIEGFRPREHLPSLLRGCPLPALVTYRRRAPDSASISRYIRSACADAFTPNWEGGQYDGDDATRFEALRLAMELGVDYVDIELKVADKFISFISGSKPEKCKLIVSSHNYESTPSCEELADLVARIQAVGSDIVKIATTASDIADVSRMFQVMVHCQVPMIGLVMGEKGLMSRVLSPKFGGYLTFGTLDATKISAPGQPTVKELLDIYNIRRIGPDTKVLGLIANPVKQSKSPILHNKCLQSIGYNAVYLPLLADDLARFLSTYSSPDFSGFSCSLPFKVDAVQCCHEHDPVAKSIGAINTIIRRPDGKLVGYNTDYIGAISAIEDGIGGPGSKDAAISPLAGRLVVVVGAGGAGKAIAYGAKEKGARVVVANRTYEKAVSLAAAVGGHALRLAELETFRPEEGMILANATSLGMYPNVDGTPIPKKALSFYDVVFDAVYAPKVTRLLREAEECGIKVVSGVEMFVRQAMGQFEHFTGGIEAPESLMREIAAKYT

SEQ ID NO: 29352 - DNA, 1503 bp, Oryza sativa (japonica cultivar-group)
  CDS (1)..(1503)
atgacgctcctgtgcgtgccgctggtggcccgcacggtggaggcgatgcgggccgacgcggccgcggccgctgccgccggcgccgacctcgtcgagatccggctcgacttcatcggcagcaagttccgcccgcgggaggatctcccgcgcctgctccgcggctgcccgctccccgccatcgtcacctacagacccaattgggaaggaggccaatatgaaggtgatgatgctacaagatttgaagcactccgtttagcaatggagctaggagtaaattatgtcgatattgaattgaaggttgctgacaaatttatcagctttatttatgggagtaagccagagaagtgcaaacttattgtctcggcacataattatgaaagtactccatcctgtgaggagcttgcagatcttgtggctagaatacaagcagttggagctgatatagtgaaaatcgcaacaacagctaatgacattgttgatgtgtcacagatgttccaagtgatggtgcactgccaagtgcctatgattggactagttatgggcgaaaaaggtttaatgtcaagggtgttatcccccaagtttgggggatatctaacctttgggagtcttgatgctacaaaggtatcagcacctgggcagccaaccgtcgaagagctgatagacatttatgatataaggcgcataggacctgatacaaaggttctcggtgttatagccaacccagtaaaacagagcaagagcccagttttgcacaatacatgtcttcaatctgttggatacaatgctgtttatcttccacttttggcagacaacattgctagatttcttagcacatattcgtctccggatttttcaggattcagttgttctcttccttttaaagttgatgccgtacagtgttgtcatgaacatgatccagttgctaagtcaataggtgccataagcactataattaggaggccagatggcaaactactgggctacaataatgactacattggagcaatttgtgccattgaggatggcataggaggtccaggatcaaagaatgctgccgtcacacctttggctggcaggcttcttgttgttgtaggtgctggtggagctggcaaggcaattgcttacggggcaaaggagaagggtgcaagaattgtagtagcaaatcgtacctacgaaaaagcagtaagtcttgctgccgcggttggtggtcatgccctgagattagccgagcttgaaactttcaggcctgaagaagggatgatccttgctaatgcaacatcgttgggaatgtaccccaatgtggatggcacccctattccaaagcaagcactaagcttctacgatgttgtgttcgatgcggtatatgctccgaaagtcacccggcttctacgagaagcagaagaatgtggggttaaagttgtcagcggtgtggagatgtttctcagacaagccttgggtcagttcgagcgtttcacaaatggtattgaaggatttgattcttag

SEQ ID NO: 29353 - protein, 500 aa, Oryza sativa (japonica cultivar-group)
MTLLCVPLVARTVEAMRADAAAAAAAGADLVEIRLDFIGSKFRPREDLPRLLRGCPLPAIVTYRPNWEGGQYEGDDATRFEALRLAMELGVNYVDIELKVADKFISFIYGSKPEKCKLIVSAHNYESTPSCEELADLVARIQAVGADIVKIATTANDIVDVSQMFQVMVHCQVPMIGLVMGEKGLMSRVLSPKFGGYLTFGSLDATKVSAPGQPTVEELIDIYDIRRIGPDTKVLGVIANPVKQSKSPVLHNTCLQSVGYNAVYLPLLADNIARFLSTYSSPDFSGFSCSLPFKVDAVQCCHEHDPVAKSIGAISTIIRRPDGKLLGYNNDYIGAICAIEDGIGGPGSKNAAVTPLAGRLLVVVGAGGAGKAIAYGAKEKGARIVVANRTYEKAVSLAAAVGGHALRLAELETFRPEEGMILANATSLGMYPNVDGTPIPKQALSFYDVVFDAVYAPKVTRLLREAEECGVKVVSGVEMFLRQALGQFERFTNGIEGFDS

SEQ ID NO: 29354 - DNA, 657 bp, Methanococcus maripaludis S2
  CDS (1)..(657)
atgatttgtattcctgtaattgataaagatgtgtctgatgcaataaattccgcaaaagaagctttaaaatacggagatattgtggaatttagaattgatttattaaatgatgtaaattttaaagatatcgaagagttttcaaaaatcccatccataataacaataagggcagaatgggaaggcggtgcttggagaaaatccaatgaagaaagaatcgagcttttaaaaaacgcaataaaaaataatgcgaaatttatagatattgaactaaaagaagaaaaaaacttagaattagttaaatatagaaatgaaattggatcaactacaaaaattatcgtttcatatcatgattttgaaaaaactcctgaaattgacgaattaattgacgtagttgaaaaagagttaaagattggagatattgcaaaatttgcaacatttgcgcattcaaaagaagatactttaaaaatattaaatttgatgaacagatattctgggaaaataattgcaattggcatgggtgaatctggaaaacttacaaggattttgggtttggattttggatcaatactaacctttgcatcaatggggggaaaagcatcagctccgggacaggttgatgttaaaaaattaaaagaaatcttaaaattaataaactaa

SEQ ID NO: 29355 - protein, 218 aa, Methanococcus maripaludis S2
MICIPVIDKDVSDAINSAKEALKYGDIVEFRIDLLNDVNFKDIEEFSKIPSIITIRAEWEGGAWRKSNEERIELLKNAIKNNAKFIDIELKEEKNLELVKYRNEIGSTTKIIVSYHDFEKTPEIDELIDVVEKELKIGDIAKFATFAHSKEDTLKILNLMNRYSGKIIAIGMGESGKLTRILGLDFGSILTFASMGGKASAPGQVDVKKLKEILKLIN

SEQ ID NO: 29356 - DNA, 681 bp, Desulfotalea psychrophila LSv54
  CDS (1)..(681)
atgcattcaagaaaaatttgtgtttcactgggacaaccaactatgcctcaggcgcttgaggcgagcctgcgtatttttggagcagatgttattgaggtgcgtcttgactatatagatgtcccggagatagatccctttgttgaaagtctggcgacggatctgctctttacctgtcgtcctacctgggagggaggtctctttgccgggactgaagaggatcgtctggccttgcttgccgaggcggtgagagccggcgctgcctatattgatctggagcttcggtcagcagaggagtctcatcagtatctgcgtacttatctcgccgagagggagacagagcttattctctcgtatcacgattttgaaagtacggcaactctggcaaaactcaccggtattattgaccagatgcaggacgccggtgctgatataggcaagcttattaccacagccaacagcgcggccgatgttgtccgtgtttttcaggttctggagtatgcagccaagaagggcttacctcttattgccttttgcatgggcgaggcgggagccgttagtcgtgttgccagttgcgaccttggcggctatatgacctactgctgtgccgatggggcagaggtcacagccgcagggcagataactatctctgagatgagagggatctttgcccgttatccgtaa

SEQ ID NO: 29357 - protein, 226 aa, Desulfotalea psychrophila LSv54
MHSRKICVSLGQPTMPQALEASLRIFGADVIEVRLDYIDVPEIDPFVESLATDLLFTCRPTWEGGLFAGTEEDRLALLAEAVRAGAAYIDLELRSAEESHQYLRTYLAERETELILSYHDFESTATLAKLTGIIDQMQDAGADIGKLITTANSAADVVRVFQVLEYAAKKGLPLIAFCMGEAGAVSRVASCDLGGYMTYCCADGAEVTAAGQITISEMRGIFARYP

SEQ ID NO: 29358 - DNA, 765 bp, Bacillus licheniformis DSM 13
  CDS (1)..(765)
ttgaagaaactggtgaaggtcagaggaattacattgggtgaaggccggccaaaaatctgtgtgccgcttgtcggaaaaaaccttgcccaattaaaagaagaagcggcttattttcaaacgcttgatgccgatattgcggagtggcgtgctgatttttatgaagatgtagatgacgttgatcaagtctgcgcggcattggcggaaatccgcggccttttaaaggacactccgctcattttcactttccgcagcgccgccgaaggcggagaaaaagagatcagcacagcgcgatatttttctttaaatgaagcggttgttaaaacagggcttgccgatgtgattgatatcgagctgttcaatgacgaagagcaagtgaaagcgctggtggaaacagcacatggtcatgaagtgtccgtgattatatctaatcatgattttgaaaagacaccagctgcagaagaaattgtttcccgtttgcgaaaagcacaggaattaggggctgatctgcctaaaatcgcggtgatgccggaaaccacggctgatgtcttgcgtctgcttgaagccacttgtacgatgaatgagaagtatgcagatcggccgattattacgatgtcaatggccggcaaaggtatcatcagccgcctggcgggcgaggtattcggttcagcaatgacgttcggtgccgcaaagaaagcttcagcaccggggcagattgcagctggtgagctcaaggaaatccttcatatattgcatcgcaatttataa

SEQ ID NO: 29359 - protein, 254 aa, Bacillus licheniformis DSM 13
MKKLVKVRGITLGEGRPKICVPLVGKNLAQLKEEAAYFQTLDADIAEWRADFYEDVDDVDQVCAALAEIRGLLKDTPLIFTFRSAAEGGEKEISTARYFSLNEAVVKTGLADVIDIELFNDEEQVKALVETAHGHEVSVIISNHDFEKTPAAEEIVSRLRKAQELGADLPKIAVMPETTADVLRLLEATCTMNEKYADRPIITMSMAGKGIISRLAGEVFGSAMTFGAAKKASAPGQIAAGELKEILHILHRNL

SEQ ID NO: 29360 - DNA, 882 bp, Leuconostoc mesenteroides subsp. mesenteroides ATCC 8293
  CDS (1)..(882)
atgacattaagagaactattaaacatacctagcagtacgaataaaccgattatagcagtccccctaactttaggacctacggacaaaattagtccgttcgctcaaaaactacaacaacaaaatccagacattgttgaatggcgggcagattacatcgcagatgactttagtcaggcggttatgtggcaacaagttaaggctggggcacaaagtgaattggcgcaaaaagacgtttctgccatgacagaagcgaaaatgttgtcagaaattgataatgccaagcaagaattcatggctaattggccacaaataaatgttcaaattattaaagagttaactggtacggtgtttaatagtattggtggttttccggtgttgttaacatatcgtacggttgcacagggtggtcgtggcgaaatgagtccaaccgagtatgccacttttatgattactgctttacactcgggatttccgtttgcagctgttgatgttgaatatacattagatgagccgctacgacaaagtattatggacgcagccaataaagccaatattccagtattactgtcataccatgattttgaatctacccctaaaaatttgccagctttaatcagtgatatggctgatacttcagcagatattatcaaattggctgtcatgcctgaatccgaaaaagacgttgattacctattgcaaacaactaagaacgtcaatatttcgcaaccattaatcacgatgagcatgggagagataggtaaaagtagccgtatcgagggatatgaatatgggtcagaaatgacctttgcagtacttgatggtacacaaggaagtgctcctgggcagctgacaattaatgaattattgcaagcttggcaataa

SEQ ID NO: 29361 - protein, 293 aa, Leuconostoc mesenteroides subsp. mesenteroides ATCC 8293
MTLRELLNIPSSTNKPIIAVPLTLGPTDKISPFAQKLQQQNPDIVEWRADYIADDFSQAVMWQQVKAGAQSELAQKDVSAMTEAKMLSEIDNAKQEFMANWPQINVQIIKELTGTVFNSIGGFPVLLTYRTVAQGGRGEMSPTEYATFMITALHSGFPFAAVDVEYTLDEPLRQSIMDAANKANIPVLLSYHDFESTPKNLPALISDMADTSADIIKLAVMPESEKDVDYLLQTTKNVNISQPLITMSMGEIGKSSRIEGYEYGSEMTFAVLDGTQGSAPGQLTINELLQAWQ

SEQ ID NO: 29362 - DNA, 702 bp, Methanococcoides burtonii DSM 6242
  CDS (1)..(702)
atgctgaaaatagggacgttcgatctggaagaaaggccagctatcgttgctgccataagcaacgaacctttacaacagtgcaaaactgcagcagaacatggtgcagatatccttgagataaggttcgacctacttgggataaccacctccaaagaagctgcaaacctgttgaggatgctcaaaggcacgaccagcctcccgtgtattgcaaccaacaggttacaatcccaaggtggaaattgggaaggtacagaagagaacagaattgccctattggaagatatcatgcatctaacagatgccgtggatatcgagctcgaaacagatgaacagctcagggacaggatagtcaaaaaagcaaaagaggaaagtaagaccaccataatctcatcgcacgattttgaaaggacgcctgacaaagagaccctgaaaagcatccttgaccactcccacgacgcaggtgccgatattgcaaaacttgcagtgatgcctgagaatatgcaggatgtactgaacctgctggaagtgacactggaagtagacgatgtctgcacaatatccatgggtaaactgggaaaacacacccgcatcattgcccccctctatggctcaaagcttacatatgcaagcgtatccgatgccgtagcaccaggacaactaaaagtggaagacctgaaaaaagcaatggagatgatggaatga

SEQ ID NO: 29363 - protein, 233 aa, Methanococcoides burtonii DSM 6242
MLKIGTFDLEERPAIVAAISNEPLQQCKTAAEHGADILEIRFDLLGITTSKEAANLLRMLKGTTSLPCIATNRLQSQGGNWEGTEENRIALLEDIMHLTDAVDIELETDEQLRDRIVKKAKEESKTTIISSHDFERTPDKETLKSILDHSHDAGADIAKLAVMPENMQDVLNLLEVTLEVDDVCTISMGKLGKHTRIIAPLYGSKLTYASVSDAVAPGQLKVEDLKKAMEMME

SEQ ID NO: 29364 - DNA, 759 bp, Enterococcus faecium
  CDS (1)..(759)
atggttcgggtaaagggattgaatataggaagcggtagaccaaagatttgtgcgcctcttatcggggccgtccgagaggaagtattacgtgaagcagttcttgcacgtgaagcaggggccgatttagtcgaatggcgagtcgatcattatcgtgaagttttttcttttgatgaagtagcagaaacattggttcttatccatgagatgcttgatggactgccgttattatttacgtttcgtaccttagctgaaggcggagaacaagacatatcgatccgtcagtatcgcgacctttatgaacatgtgatacacacaggattagtagatatggtcgatatcgagttgttcaaagtagaaagtctaggaaaaagactgatagaggaaatcaagtctttaaacattcctttaattatcagtagtcatgattttaaagaaacaccagcagaccctgtcttgctttaccgattgaatgttatggaacattttggagccgatatcggaaaactggcagtaactcccaataatgaacgagatgttttgcggttgatggagttgactagacgggcaaatgcttttgtctccatgcctattattacgatgtccatgggaaatcttggtaaaatttctcgtctggttggcggaacgacgggttccgttatgacatttggttccttaagcagcgattctacttctgctccaggacaattaccggtcaaagcattgaagcaaattattcaattattaaatgaaccgttgtag

SEQ ID NO: 29365 - protein, 252 aa, Enterococcus faecium
MVRVKGLNIGSGRPKICAPLIGAVREEVLREAVLAREAGADLVEWRVDHYREVFSFDEVAETLVLIHEMLDGLPLLFTFRTLAEGGEQDISIRQYRDLYEHVIHTGLVDMVDIELFKVESLGKRLIEEIKSLNIPLIISSHDFKETPADPVLLYRLNVMEHFGADIGKLAVTPNNERDVLRLMELTRRANAFVSMPIITMSMGNLGKISRLVGGTTGSVMTFGSLSSDSTSAPGQLPVKALKQIIQLLNEPL

SEQ ID NO: 29366 - DNA, 801 bp, Methanosarcina barkeri str. fusaro
  CDS (1)..(801)
atggtcatcagcggaaagacaaaaacggaagaagaaacgttcatcagcagaaaacaaaaaccggagcaaacaatgattcatattggccagcttgaccttgagaaaaaagctgccgttgtagcagtaatccttgaaaaatcccttgaaatttcaagaaaggccgccaaaatgggggccgaccttctcgaaattcggcttgatttgcttgggatcagggacctggaaacagctgcagaaacaatcagaaaagtaaaatccgaaaccggacttccggtaattctcacaaatcgctcaattacggaaggaggaaaatgggaaggaaaagaggccgatagaattgaacttcttacaaatctcatttccctgaaagacgggccagatgcagtagacatagagctctctgctgggagagaagcaagagaccaggtaataaaagcggcaaaagcccacggaaaaactgtaatcgtttcttcccatgacttttcaaggactccggcttttcaggaaatgaaaactattctggaagaggcatttctggcaggggcagatattgcgaaacttgctgttatgccgcaatcgagaagagacgtacttaacctgttaagagttgcactggatgccagggaggcaggaaatgctgtatgtacgattgccatgggtaggcttggaaaacatacaagggtaattgctcctttctacggttcggtcctgacatatgcggctgttaatagtgaagtttctgccgcgcccgggcaatttcaggtagacgaagtaaagaagatattggagctgctcgaatga

SEQ ID NO: 29367 - protein, 266 aa, Methanosarcina barkeri str. fusaro
MVISGKTKTEEETFISRKQKPEQTMIHIGQLDLEKKAAVVAVILEKSLEISRKAAKMGADLLEIRLDLLGIRDLETAAETIRKVKSETGLPVILTNRSITEGGKWEGKEADRIELLTNLISLKDGPDAVDIELSAGREARDQVIKAAKAHGKTVIVSSHDFSRTPAFQEMKTILEEAFLAGADIAKLAVMPQSRRDVLNLLRVALDAREAGNAVCTIAMGRLGKHTRVIAPFYGSVLTYAAVNSEVSAAPGQFQVDEVKKILELLE

SEQ ID NO: 29368 - DNA, 2195 bp, Lycopersicon esculentum
  CDS (80)..(1717)
cacttggaatatttcaagctggctgctgaggctacatttctgttgtttacccatctgtgtgctctaaagttggttgccaatggagttggttgtagattctggagtgaagaagatggagggtgaagcaatgaggaagaatcaaactctaatttgtgcaccaattatggctgattcagtggatcaaatgttgattcttatgcaaaaggctaaaattagtggggctgatcttgtggaggttcgagtggatagcttgaaaagctttaatcctcgcccagatattgataccctgatcaaacaatgccctttgcctactctcttcacttacagctatgttttgggcgtggggcaggggatactgttaatacggtactataaaggcatagggcccacttgggaaggtggtcagtatgctggtgatgaaaagagtcgattggatgcacttcgattagcgatggagttgggagctgattacattgatgttgagctaaaggctattggcgagttcaacaatgccctacatggaaataaatctgcaaaatgcaaacttattgtttcttctcacaactatgaaagcacaccgtcagctgaggatctgggcaatctagtagcaagaatacaggcatctggagctgacattgtgaaatttgctacaactgcacaggatatcactgatgttgcacgtgttttccaaattactgttcattctcaagttccaataatagccatggtcatgggagagaagggtttgatgtctcggatactttgtccaaaatttggtggatacctcacgtttggtactcttgaagtgggaaaagtttcagctcctgggcaaccaacagtcgaagatcttctgaatttatacaatttcagacagttgggaccagataccaaaatatttggcattattgggaagccagttagccatagcaaatcacctttattatataatgaatccttcagatcagttgggtttaatggtgttttcatgcatttgctggtagatgatattgcaaactttttccggacttattcatcattagattttgctggattcagctgtacaattcctcacaaagaagccgctcttgactgctgtgctgaaattgatcctactgctaaggcaataggggctgtcaattgtattataaggcgacctgatgggaagttatttggttgtaatacagactatatcggtgctatttccgccattgaagaaggattgcaaggttcacaacctagtatatctgggtcacctttggctggtaaattgtttgtggtcattggtgctggtggcgctggaaaggcgattgcttatggcgcaaaggaaaagggggctagggtggtgattgctaatcgtacctatgaacgagcgcgagaacttgctattgttgttggagctgaggccttatctcttgacgagcttagcaatttccatccagaaaatgatatgattcttgcaaataccacctccataggcatgcaaccaaaggttgatgatacaccaatctctaaggaagctttgaagcactactcacttgttttcgatgctgtttatacacccaaaatcactagactcctgcgagaagctcaggagagtggagcaaaaattgtgacaggagttgaaatgtttatcgggcaggcatatgaacaatatgaaagatttacaggattgccagctcctaaggaacttttcaagaatataatgtctacatactgagaggatccctttcacttttcaatcggggctgctaattattattactcctaaatctgacatgattgtgttagagtttgctctatctaccactgtttgtacttcagaggaagtaattttgtccacgtaaatcgtactttttgcggaaacagaggatgttcagacataccagttaatctatggcaggaaaatccaccatctttctggctatgttagaactcttgattctttgacaagtattgtattttgggaggaaattcattaaacagagatgtatacattgcttcatcattgtaaaatcatacttagaaattcctcttgattatcatcatcattattaaatgttgtcacattattgtatcatactaagacaaattttgaattgagttcaatgacttttgagttgtaagcatgatgcactgccagtttgtgttttaataaatccaggttccactttactagtccatttctcgtgctttta

SEQ ID NO: 29369 - protein, 545 aa, Lycopersicon esculentum
MELVVDSGVKKMEGEAMRKNQTLICAPIMADSVDQMLILMQKAKISGADLVEVRVDSLKSFNPRPDIDTLIKQCPLPTLFTYSYVLGVGQGILLIRYYKGIGPTWEGGQYAGDEKSRLDALRLAMELGADYIDVELKAIGEFNNALHGNKSAKCKLIVSSHNYESTPSAEDLGNLVARIQASGADIVKFATTAQDITDVARVFQITVHSQVPIIAMVMGEKGLMSRILCPKFGGYLTFGTLEVGKVSAPGQPTVEDLLNLYNFRQLGPDTKIFGIIGKPVSHSKSPLLYNESFRSVGFNGVFMHLLVDDIANFFRTYSSLDFAGFSCTIPHKEAALDCCAEIDPTAKAIGAVNCIIRRPDGKLFGCNTDYIGAISAIEEGLQGSQPSISGSPLAGKLFVVIGAGGAGKAIAYGAKEKGARVVIANRTYERARELAIVVGAEALSLDELSNFHPENDMILANTTSIGMQPKVDDTPISKEALKHYSLVFDAVYTPKITRLLREAQESGAKIVTGVEMFIGQAYEQYERFTGLPAPKELFKNIMSTY

SEQ ID NO: 29370 - DNA, 690 bp, Haloarcula marismortui ATCC 43049
  CDS (1)..(690)
atggacttcgagtcgttcaccctgctcgccgccaccgacgacctcggggtggaaccggccgcccgcgtcgatgccgacggactggagctacggatggatttcgccgacgagccgctggcacagctggacgcctacgacggcgacctcccgatactcgtcacgaaccggccgacgtgggagggcggcgaggccgccgacaccgcgggtcgtcttgatgcgctcgaaaccgcgctcgaacacgacgccgtgacggctgtcgacctcgaactcgcagcgctggagggtgctggcgaccacgacgctggccgcgtcgccgacgctgcccgcgaccgcggagcatccgtcgtcgtctcgacacacaacttcgagtcgacgcccgaccgtgaggcaatcgtgagtcggctcgaacgggcctgtgcacacggcgacgttgggaagatggccagcacggcccagtcgccggacgacgtgctggcgatgctcggggcaacccgcgaactgaccgccgaaggcgaacaggtcgccacgatgtgcatgggtgcggctggccgccactccagggctgtcgccccggtgtacggctctcgcatcggctacgcaccggtcgaccctgctgacgcgaccgcaccgggccagtacgacctcgcgacgctccggacactggtcggacagctacagagcgacgcctga

SEQ ID NO: 29371 - protein, 229 aa, Haloarcula marismortui ATCC 43049
MDFESFTLLAATDDLGVEPAARVDADGLELRMDFADEPLAQLDAYDGDLPILVTNRPTWEGGEAADTAGRLDALETALEHDAVTAVDLELAALEGAGDHDAGRVADAARDRGASVVVSTHNFESTPDREAIVSRLERACAHGDVGKMASTAQSPDDVLAMLGATRELTAEGEQVATMCMGAAGRHSRAVAPVYGSRIGYAPVDPADATAPGQYDLATLRTLVGQLQSDA

SEQ ID NO: 29372 - DNA, 1710 bp, Nicotiana tabacum
  CDS (1)..(1710)
atggagttggtagtggattcaggggtgaggaagatggagggggaggcaatgacgaggaacgaaacactaatttgtgcaccaatcatggcagacacagtggatcaaatgttgaatctaatgcaaaaggctaaaattagtggtgctgatcttgtggaagttcgattggatagcttgaaaagctttaatcctcaatcagatatcgatactattatcaaacagtcccctttgcctacccttttcacttacaggcccacttgggaagggggtcagtatgctggtgatgaagtgagtcgactggatgcacttcgagtagcaatggagttgggagctgattacattgatgttgagctaaaggctattgacgagttcaatactgctctacatggaaataaatcagcaaaatgcaaagttattgtttcttctcacaactatgataatacaccatcatctgaggagctcggcaatctagtagcaagaatacaggcatctggagctgacattgtgaagtttgcaacaactgcactggatatcatggatgttgcacgtgtattccaaattactgtacattctcaagtaccaataatagccatggtcatgggagagaagggtttgatgtctcgaatactttgtccaaaatttggtggatacctcacatttggtactcttgaagtgggaaaggtttcggctcctgggcaaccaacaattaaagatcttttgaatatatacaatttcagacagttgggaccagataccagaatatttggcattatcgggaagcctgttagccatagcaaatcacctttattgtataatgaagctttcagatcagttgggtttaatggtgtttatatgcctttgctggttgatgatgttgcaaatttctttcggacttactcatctttagattttgctggctcagctgtaacaattcctcacaaggaagccattgttgactgctgtgatgagttgaatcctaccgctaaagtaataggggctgtcaattgtgtcgtaagccgactcgatgggaagttgtttggttgcaatacagactatgtgggtgcaatctccgccattgaagaagcgttgcaaggctcacagcctagtatgtctgggtctcccttagctggtaaattatttgtggtcattggtgctggtggcgctggcaaggcacttgcttatggtgcaaaggaaaagggggctcgggtggtgattgctaaccgtacctatgaacgagcgagagaacttgctgatgtagttggaggtcaggctttgtctcttgacgagcttagcaatttccatccagaaaatgacatgattcttgcaaataccacctccattggcatgcaaccaaaggttgatgatacaccaatctttaaggaagctttgaggtactactcacttgtatttgatgctgtttatacgcccaaaatcactagactcttgcgggaagctcacgagagtggagtaaaaattgtaacaggagttgaaatgtttatcggccaggcatatgaacaatatgagagatttacagggcttgccagctccaaaggaacttttcaagaaaattatggctggatattgagagcaaggtctctttcccttttcaatgcggccctgctagttacttttcctcctaaatccctacatagttgtgtgatagcaatggtcttagattcctctgccctaccatttgtgcttcggaggaattaa

SEQ ID NO: 29373 - protein, 569 aa, Nicotiana tabacum
MELVVDSGVRKMEGEAMTRNETLICAPIMADTVDQMLNLMQKAKISGADLVEVRLDSLKSFNPQSDIDTIIKQSPLPTLFTYRPTWEGGQYAGDEVSRLDALRVAMELGADYIDVELKAIDEFNTALHGNKSAKCKVIVSSHNYDNTPSSEELGNLVARIQASGADIVKFATTALDIMDVARVFQITVHSQVPIIAMVMGEKGLMSRILCPKFGGYLTFGTLEVGKVSAPGQPTIKDLLNIYNFRQLGPDTRIFGIIGKPVSHSKSPLLYNEAFRSVGFNGVYMPLLVDDVANFFRTYSSLDFAGSAVTIPHKEAIVDCCDELNPTAKVIGAVNCVVSRLDGKLFGCNTDYVGAISAIEEALQGSQPSMSGSPLAGKLFVVIGAGGAGKALAYGAKEKGARVVIANRTYERARELADVVGGQALSLDELSNFHPENDMILANTTSIGMQPKVDDTPIFKEALRYYSLVFDAVYTPKITRLLREAHESGVKIVTGVEMFIGQAYEQYERFTGLASSKGTFQENYGWILRARSLSLFNAALLVTFPPKSLHSCVIAMVLDSSALPFVLRRN

SEQ ID NO: 29374 - DNA, 819 bp, Acinetobacter sp
  CDS (1)..(819)
atgtcattgcctatattgtcaacgacctatgcggctgaaaatactgtaccagcatctaaatcaacttatgttgtaaaaaatttaaacattggtgatttacctgttaaaaccctcgtgccaatcactgctaaaacaagagagcaagctttggcacaggcaaaagtaatcgcggaaaataaagatgcagatattgccgaatttcgtatcgatttacttgagtttgccagcgataccaaaaaagtcattgctttaggacaagaacttaatcagattttaaaagataaaccgttacttgcaacaattcgtacgtctaacgaaggtggaaagttgaaagtaacagatcaagaatatgaaaaaatctacagtgaatatcttaaaaaaccgttcatgcaattgctagatattgaaatgtttcgtgatcaggctgcagttgccaaattgaccaaacttgcgcaccagaaaaaagtattggttgtcatgtcaaaccatgattttgataaaacaccaagtgagcaggaaattgtaagccgtctattgaagcaagatcaaatgggtgcagatattctaaaaattgcagtcatgccaaaatctaaacaagatgtatttacattgatgaatgcgacattaaaagtcagtgagcaaagtacaaagccactacttaccatgtcaatggggcgtttaggtacgatttcgcgtattgcaactgcaaatatgggcggtagcttaagcttcggtatgattggggaggcttctgcaccaggtcaaattgatgttactgcacttaaacaattccttaaaacagttcaacctacaccttaa

SEQ ID NO: 29375 - protein, 272 aa, Acinetobacter sp
MSLPILSTTYAAENTVPASKSTYVVKNLNIGDLPVKTLVPITAKTREQALAQAKVIAENKDADIAEFRIDLLEFASDTKKVIALGQELNQILKDKPLLATIRTSNEGGKLKVTDQEYEKIYSEYLKKPFMQLLDIEMFRDQAAVAKLTKLAHQKKVLVVMSNHDFDKTPSEQEIVSRLLKQDQMGADILKIAVMPKSKQDVFTLMNATLKVSEQSTKPLLTMSMGRLGTISRIATANMGGSLSFGMIGEASAPGQIDVTALKQFLKTVQPTP

SEQ ID NO: 29376 - DNA, 660 bp, Aquifex aeolicus
  CDS (1)..(660)
atgctcatcgccgttccccttgatgatacaaacttttccgaaaacttaaaaaaggctaaggaaaagggtgcggatattgtagaactccgtgtggaccagttctcagacacttccttaaattacgtaaaggaaaaactggaagaagtacattcgcaaggtttgaaaacgatactgactatacgctctcccgaggagggaggaagggaagttaaaaacagggaagagctctttgaagaactttctcccctcagcgattacacggatatagaactctcttccagagggcttttggtaaaactttacaatataacgaaagaagcgggaaaaaagttgataatctcctaccacaactttgagctcacaccccctaactggataataagggaagttttaagggagggatacaggtacggaggaataccgaagatagcggtaaaggcaaactcctacgaagatgttgcaaggcttttatgtatttccagacaggttgagggagaaaagatattaatttccatgggtgattacggaaagatttcaaggctcgcgggatacgtttttgggtccgtaataacctactgctccttagaaaaggctttcgctcctggtcaaattcctttagaagagatggttgagctcagaaagaagttctacaggctttaa

SEQ ID NO: 29377 - protein, 219 aa, Aquifex aeolicus
MLIAVPLDDTNFSENLKKAKEKGADIVELRVDQFSDTSLNYVKEKLEEVHSQGLKTILTIRSPEEGGREVKNREELFEELSPLSDYTDIELSSRGLLVKLYNITKEAGKKLIISYHNFELTPPNWIIREVLREGYRYGGIPKIAVKANSYEDVARLLCISRQVEGEKILISMGDYGKISRLAGYVFGSVITYCSLEKAFAPGQIPLEEMVELRKKFYRL

SEQ ID NO: 29378 - DNA, 768 bp, Bacillus subtilis
  CDS (1)..(768)
gtgaacgtgttaacgattaaaggagtttccatcggggaagggatgccgaaaatcatcattccgctgatgggaaagacggaaaaacaaattctgaatgaagcagaggcagtaaaattactgaatccggacattgttgaatggagagtcgacgtatttgaaaaagcgaatgacagagaagcggtcacaaagctcatttctaagcttcgtaaatctttagaagacaagctatttctatttacattcagaacccacaaagagggcgggagcatggagatggacgaaagctcctatcttgctttgctggaatcggcaatccaaacaaaagacatcgatctgatagacatcgaattattttcaggagatgcaaatgtaaaagcgttagtatcgctggcggaagaaaacaacgtctatgtggtgatgtcaaatcacgactttgaaaaaacacctgtaaaagatgaaattatttccagacttcgaaaaatgcaggacttaggcgcgcatattccaaaaatggctgtcatgccgaatgatactggagatctcctaacactgcttgatgcgacgtatacaatgaaaacaatatatgcagaccgccccattattacaatgtcaatggctgcaacagggctcatcagcaggctgagcggtgaggtttttggatcggcttgtacttttggagctggagaagaggcgtccgcaccaggccaaattcctgtttctgagctaaggagtgtcttagatattttgcataaaaacacacggggatag

SEQ ID NO: 29379 - protein, 255 aa, Bacillus subtilis
MNVLTIKGVSIGEGMPKIIIPLMGKTEKQILNEAEAVKLLNPDIVEWRVDVFEKANDREAVTKLISKLRKSLEDKLFLFTFRTHKEGGSMEMDESSYLALLESAIQTKDIDLIDIELFSGDANVKALVSLAEENNVYVVMSNHDFEKTPVKDEIISRLRKMQDLGAHIPKMAVMPNDTGDLLTLLDATYTMKTIYADRPIITMSMAATGLISRLSGEVFGSACTFGAGEEASAPGQIPVSELRSVLDILHKNTRG

SEQ ID NO: 29380 - DNA, 681 bp, Halobacterium sp
  CDS (1)..(681)
atggagttccaggattttctgctcgccgcgtcaaccggcgatctcggcgccgcgccagcggcccccgaacacgtcgacctcgtcgagttccgcatggacctggcggccgacccgctggcggccctcgacgactacgacggagtgttgccggtgttggcgaccaaccgcgccgactgggagggcggggctgcggccgacggcggcgaccggatcgacgccctcgcggaggccgcaaggaccgactgcgtcgcagccgtcgacatcgagcgcagtgcgctcgtggacgacgacaccgccgacggcgcggaggcgcttgcggcggcgcgttcgacagacaccacaacggtggtgtcagcccacgacttcgacgggacgccgtcgctgtccgcgatggcggatctgctcggggaggcgtgctcgctgggcgacgtggggaagctagcggtgaccccccaggaccgcggtgacgcgctggacgtgatccgtgtgacacacgagtacagcgccgcggggatgaccgtggcgaccatgggcatgggcgatctgggccgacacacgcgggccgtaaccccgctgtacgggtcgaagctcggatacgcgccggttgccgacggggagacgaccgcgcccgggcagtacgcgccggcggcgctacaggcgctgatcgccgacctacagtag

SEQ ID NO: 29381 - protein, 226 aa, Halobacterium sp
MEFQDFLLAASTGDLGAAPAAPEHVDLVEFRMDLAADPLAALDDYDGVLPVLATNRADWEGGAAADGGDRIDALAEAARTDCVAAVDIERSALVDDDTADGAEALAAARSTDTTTVVSAHDFDGTPSLSAMADLLGEACSLGDVGKLAVTPQDRGDALDVIRVTHEYSAAGMTVATMGMGDLGRHTRAVTPLYGSKLGYAPVADGETTAPGQYAPAALQALIADLQ

SEQ ID NO: 29382 - DNA, 681 bp, Lactococcus lactis
  CDS (1)..(681)
atgagaaaaacaaaaattgttgttccaatcatgctgacagagttagcagagcttgagaaagtttctgtcagtgattatcgaacagcagatattgttgaatggcgtgccgattttttgtcagcagatgaaattttagagatggctcctaaattctttgaaaaatttaaagaaagtaagattttatttactttaagaacagtcagagaaggcggaaatattcaagtttctgaaaaaaaatatttacagattttaaaagaaattttgacttacaatcccgcatatatcgatgtcgaattctttacgcatggcccttcatttgccgctttgaaagattttcgggataaaatggtgctttcttatcataattttgatgaagttccgtccgatttaaccaatcggttgattaaaatgcacgaagaaggaactgcctttgttaaagttgctgtgatgccagaacgtgaatgtgatgttcttgatttattacaaatcactcgtgatatgactttagaatacggtgatcattttatcagcatggcaatgggtgacttaggacgactttcaagaatttctggctatttgactggctcttgctggacttttgcaagtttagaaaattctagtgcgcctgggcaaatttctctcaaagaaacagagtatattttggatatcttagaaaaatag

SEQ ID NO: 29383 - protein, 226 aa, Lactococcus lactis
MRKTKIVVPIMLTELAELEKVSVSDYRTADIVEWRADFLSADEILEMAPKFFEKFKESKILFTLRTVREGGNIQVSEKKYLQILKEILTYNPAYIDVEFFTHGPSFAALKDFRDKMVLSYHNFDEVPSDLTNRLIKMHEEGTAFVKVAVMPERECDVLDLLQITRDMTLEYGDHFISMAMGDLGRLSRISGYLTGSCWTFASLENSSAPGQISLKETEYILDILEK

SEQ ID NO: 29384 - DNA, 759 bp, Lactobacillus plantarum
  CDS (1)..(759)
atgcaaccagcgataaagctacgaaatattgaacttggtagttgtcgacctaagttggcagtgcctatcacaggaacgacgattaatgatattttagcagcgacgacaccgattttagctgcacagccagatgtcgttgaatggcgaattgattttttcaaggatgtaactaatccagaacagttgaaatcggccggtcagcaacttcgtcaggctttaggtgatattgccttattaactactttccgaactaaaggtgaaggcggcgaattagcactatcagatactgagtattttaaactgtgtgagacggtcttagatggtgggttcacggatgcattagatgttgaacgttaccatgacgaacaagctgttaagcaaattgttgcagcagctcatgagcatcaagtagttgtgatcatgagtaatcatgattttgataaaacgccggcggttgctgagatcgttaagcgccttactagtatggtcgattatggtgctgatgttgctaagatggctgtgatgccacaatcggtggaggatgtcttaacattactgacagcgactaatattgcacgccaaacactaccacagccagtaatcacaatgtcgatgggtgacttaggaaaagtgtcacggcttgctggtgaagtgttcggctcttgtttatcatttgcaacggtcggggcggcttcggcacctgggcaaattgcacttgaaaatttacggccggaattggaagatctgaagttaaattaa

SEQ ID NO: 29385 - protein, 252 aa, Lactobacillus plantarum
MQPAIKLRNIELGSCRPKLAVPITGTTINDILAATTPILAAQPDVVEWRIDFFKDVTNPEQLKSAGQQLRQALGDIALLTTFRTKGEGGELALSDTEYFKLCETVLDGGFTDALDVERYHDEQAVKQIVAAAHEHQVVVIMSNHDFDKTPAVAEIVKRLTSMVDYGADVAKMAVMPQSVEDVLTLLTATNIARQTLPQPVITMSMGDLGKVSRLAGEVFGSCLSFATVGAASAPGQIALENLRPELEDLKLN

SEQ ID NO: 29386 - DNA, 759 bp, Listeria innocua
  CDS (1)..(759)
atgaataaagtagtcgtaaagaatgttacgtttggtgaaggtgcgccaaaaatttgtgtaccaatggtcggtaaaacggttgctgctcttaaagaagaagcagaaatgttaaaaacaatcgatttggacgttgtcgaatggcgcgttgacttttttgaggacgtaaaagatttagttaaagtgaaagctgcgctagatgagattcgcgcaattttgccagaaacaccgattttattcactttccgcagtgcaaaagaaggcggcgagttagctgttagtgatgaattttattttgaattaaatgaaacactagctggcactggcaaaattgatttagttgacgtggaacttttcaatgaagaagcggatgttttacgcttaatcgaaacagcccacaaaaacaatgtaaaagtagtgatgtcgaaccatgattttgataaaacacctgcgaaggaagaaattgtttctcgcttaactcgcatggaagcactcggcgcggaccttccgaaaatcgctgttatgccaaaatctgctggagacgtactaactttattagatgcaacgaataccgtatctgaaaaagctaatcaaccaatcattacgatgtcgatggcgggaactggtgtcatcagtcgtcttgctggcgaagtatttggctccgcaatgacatttggtgctgcgaaaaaagcatccgctcctggtcaaattgatgttaatgagttacgtcatgtccttgatttactgcataaacaattttaa

SEQ ID NO: 29387 - protein, 252 aa, Listeria innocua
MNKVVVKNVTFGEGAPKICVPMVGKTVAALKEEAEMLKTIDLDVVEWRVDFFEDVKDLVKVKAALDEIRAILPETPILFTFRSAKEGGELAVSDEFYFELNETLAGTGKIDLVDVELFNEEADVLRLIETAHKNNVKVVMSNHDFDKTPAKEEIVSRLTRMEALGADLPKIAVMPKSAGDVLTLLDATNTVSEKANQPIITMSMAGTGVISRLAGEVFGSAMTFGAAKKASAPGQIDVNELRHVLDLLHKQF

SEQ ID NO: 29388 - DNA, 759 bp, Listeria monocytogenes
  CDS (1)..(759)
atgaataaagtagtcgtaaagaatgttacgtttggtgaaggtgcgccaaaaatttgtgtaccaatggtcggtaaaacggttgctgcgcttaaagaagaagcagaaatgttacaaacaattgatttggacgttgtcgaatggcgcgttgacttttttgaggacgtaaaagatttagctaaagtggaagctgcacttggcgaaattcgcgcaattttaccagaaacaccgattttattcactttccgcagtgcaaaagagggcggcgagttagctgtcagtgacgaattttattttgaattaaatgaaacactagctggcactggcaaaattgatttagtagatgtggaacttttcaatgaagaagcggacgttttacgcttaattgaaacagctcacaagaacaatgtaaaagtagtgatgtcgaatcatgattttgataaaacacctgcgaaggaagaaatcgtttctcgcttaactcgcatggaagcacttggcgcggaccttccgaaaatcgccgtcatgccaaaatctgctggagacgtactaactttactagatgcaacgaatactgtatttgaaaaagctaatcaaccaatcattacgatgtcgatggctggaactggtgtcatcagtcgtcttgctggcgaagtatttggctccgcaatgacatttggcgctgcgaaaaaagcatcggctcctgggcaaattgatgttaatgagttacgtcacgttcttgatttactgcataaacaattttaa

SEQ ID NO: 29389 - protein, 252 aa, Listeria monocytogenes
MNKVVVKNVTFGEGAPKICVPMVGKTVAALKEEAEMLQTIDLDVVEWRVDFFEDVKDLAKVEAALGEIRAILPETPILFTFRSAKEGGELAVSDEFYFELNETLAGTGKIDLVDVELFNEEADVLRLIETAHKNNVKVVMSNHDFDKTPAKEEIVSRLTRMEALGADLPKIAVMPKSAGDVLTLLDATNTVFEKANQPIITMSMAGTGVISRLAGEVFGSAMTFGAAKKASAPGQIDVNELRHVLDLLHKQF

SEQ ID NO: 29390 - DNA, 729 bp, Methanosarcina acetivorans
  CDS (1)..(729)
atgacgcaaataggcccttttgaccttgaaaaaaaagctgcagttgttgcagtaatccttgaaaagcctcttgaaacttcaaaaaaggcagccgaaaaaggggctgacatcctcgaagtccggctggatttgctggggataaggaacccagaaagtgctgcaaaaataatcagggaaattaaatccgaaaccgggcttcccgtactcgttaccaaccgttccgtggcagaaggaggaaagtgggaagggaaagaggtagaccgaacagagcttctggtagccctcctttcccttaaagacggacctgatgctgtcgatattgaactctctgccagcagggaagatagagataaagttataaaagcggctaaagctcacggaaaaaccgtaataatttcttcccacgacttttcgaaaactccttctccacaggaaatgacggcaactcttgcagaaatgtttcttgccgaggcggatattgccaaaattgcggtgatgcccgggtcaatggaagatgtccttaacctgctgaaagttacgctggaattcaaaaatacagggaaaaccgtatgcaccattgcaatgggcaagccgggaaaacacacgcgagtggttgcccctctttacggttctgtcctgacatacgcatcgatagaaagcaatgcagtggcagccccgggtcagcttccggtagatgaagtaaagaagataatggaaatgttaaaatga

SEQ ID NO: 29391 - protein, 242 aa, Methanosarcina acetivorans
MTQIGPFDLEKKAAVVAVILEKPLETSKKAAEKGADILEVRLDLLGIRNPESAAKIIREIKSETGLPVLVTNRSVAEGGKWEGKEVDRTELLVALLSLKDGPDAVDIELSASREDRDKVIKAAKAHGKTVIISSHDFSKTPSPQEMTATLAEMFLAEADIAKIAVMPGSMEDVLNLLKVTLEFKNTGKTVCTIAMGKPGKHTRVVAPLYGSVLTYASIESNAVAAPGQLPVDEVKKIMEMLK

SEQ ID NO: 29392 - DNA, 663 bp, Methanococcus jannaschii
  CDS (1)..(663)
atgatatgtttgccagtagttgaagatagtgtagaaaaagcaataaaaacagctgaaaagtatttagaaatagcagatattgttgaatttaggatagatatgcttaaagaagttagtgaagaagatatagagaaatttgctaagtatccttgcataataactgttagagcagattgggagggtggttattggaagggaaataatgaggaaagattaaacttaataaaaaaggcaattgaatgcaatgccaaatttgttgatattgaattgagagaggagaaaaataaagaacttgtaaaatttagagatgaaattggttcaaaaacaaaaattataatttcttatcatgattttgaaaaaactccttctaaggaaaaattggtagagattgttgaaaaagctcttagcattggagatatagcaaaatttgcaacaatggcaaatagtaaagaagatgtcctcaatatcttagaagtgataaataaatatcctggaaagattattggtattggaatgggcgagaaagggaaactaacaagaatcttaggggtttattttggctcaatattaacgtttgcttcatataaagggaaaagttctgcccctgggcaggttgatattgatacattaaaagaaatctggagactaatggatttaaagtaa

SEQ ID NO: 29393 - protein, 220 aa, Methanococcus jannaschii
MICLPVVEDSVEKAIKTAEKYLEIADIVEFRIDMLKEVSEEDIEKFAKYPCIITVRADWEGGYWKGNNEERLNLIKKAIECNAKFVDIELREEKNKELVKFRDEIGSKTKIIISYHDFEKTPSKEKLVEIVEKALSIGDIAKFATMANSKEDVLNILEVINKYPGKIIGIGMGEKGKLTRILGVYFGSILTFASYKGKSSAPGQVDIDTLKEIWRLMDLK

SEQ ID NO: 29394 - DNA, 648 bp, Methanopyrus kandleri
  CDS (1)..(648)
ttgatcatcgccactcttacaggcagaaccatcgaggatatggtggaactggctatagaagccgtagagcagggtgcggacgctctggaggtcaggctcgattacttggagaacttagacatgtcgacggcgctcagagccgtgcgagagtgtactaggtacgaacgcgtagtggcgacgctccgacgcgaagaggagggaggactgtacaaaggcgatgaagatcggaggctcgaaatcctggagcgggtgtcctccgaggccgactacgtggacttggagctcgacgtagcggaggaagagatcataagcccgtcctgtgagacgatcgtgtcgtaccacaacttcgaaaatacgccgcctaaggaggagctgatcggcatcagggaccggtgcgccgaattaggagacgttgcgaaggtcgtcactatggccaggggacacgaagacgcactgcggatcctggaagtagtacgaacggcagaagcacccactataggattcgcgatgggagaggaggccaagtacaccagggtagtgagtgttctgatcggcgggttcgcgacttacgccgctgtgaggaagaaagcggcaccagggcagctgacggtcgaggagacacgcaagttgctggaactactcggttag

SEQ ID NO: 29395 - protein, 215 aa, Methanopyrus kandleri
MIIATLTGRTIEDMVELAIEAVEQGADALEVRLDYLENLDMSTALRAVRECTRYERVVATLRREEEGGLYKGDEDRRLEILERVSSEADYVDLELDVAEEEIISPSCETIVSYHNFENTPPKEELIGIRDRCAELGDVAKVVTMARGHEDALRILEVVRTAEAPTIGFAMGEEAKYTRVVSVLIGGFATYAAVRKKAAPGQLTVEETRKLLELLG

SEQ ID NO: 29396 - DNA, 729 bp, Methanosarcina mazei
  CDS (1)..(729)
atgactcaaataggctcgtttgaccttgaaaagaaaactgcagttgttgcagtcattcttgagaaaccccttgaaaattcaaagaaggcagccgaaaaaggagctgatatccttgaaatccggctggacctgcttgggataaggacccctgagagagccgcagaggtgatcagggaaataaaagccgaaaccgggattcccataattgttaccagccgttcgggagcggaaggaggaaagtgggatggaaaagaagaagatagaacaggacttcttataaatcttctttctttaaaagatggcccggatgcgattgatatcgaactttctgccggcatgaaagaaagaaacagggttattaaagcggctaaggaccgggaaacagctgtaatcgtctcttcccatgactttttgaaaacccctcccctccagaacatgaggacaattattgaagaaatgtttcttgcaggtgcagatattgccaaacttgcagttatgcccctgtcagtgggagatacccttaacctgctgagagttactctggactttaaagatgcaggaaaatccgtgtgcacaattgcaatgggcagtcaaggaaagcatacaagagttgttgcccctttttatggttcagtccttacatatgcttctatagaaagtaatgcgtctgcagctcctggccagcttccggtagatgaagtaaaaaaaataatggaaatgctaaaatga

SEQ ID NO: 29397 - protein, 242 aa, Methanosarcina mazei
MTQIGSFDLEKKTAVVAVILEKPLENSKKAAEKGADILEIRLDLLGIRTPERAAEVIREIKAETGIPIIVTSRSGAEGGKWDGKEEDRTGLLINLLSLKDGPDAIDIELSAGMKERNRVIKAAKDRETAVIVSSHDFLKTPPLQNMRTIIEEMFLAGADIAKLAVMPLSVGDTLNLLRVTLDFKDAGKSVCTIAMGSQGKHTRVVAPFYGSVLTYASIESNASAAPGQLPVDEVKKIMEMLK

SEQ ID NO: 29398 - DNA, 666 bp, Methanobacterium thermoautotrophicum
  CDS (1)..(666)
atgaacacaaagatctgtgtccctgtatttgagaagacagccccggaggttactgagtcagccgggagggccattgatgcaggtgcggatatccttgaaataagaattgatggcctccagaatcctggagaagttaatatcagggaactcatagaggatatagggttccctgtgattgcaaccaaccgatcacctgtcgagggtggtcatttcagtggcagcgaggatgaaagaataaagctgctgatggctgccgctgaggtcgccgacttcgtggatattgaactcagcagtgcccgtgaggacatagagcgggtcacaggtagtgccaggagaagcatcgtatcctaccataacttcagggagacgccctcactggaggccctcctgaggatcgtcaggatggctaaggagatgggtgacatcgccaaggtagctgtgatgccagagaacctggcagacaccctggtggtactccagctcctcacatttgaggaggacactgtggcaatatccatgggggaactcggtaaatacacgagggttgcagccgccctctttggctcacccatcaccttcgcatcaatggggagggggacagccccgggacagatggatgttgatgtaacccggaaaatgattggagaactcatgccggaggattga

SEQ ID NO: 29399 - protein, 221 aa, Methanobacterium thermoautotrophicum
MNTKICVPVFEKTAPEVTESAGRAIDAGADILEIRIDGLQNPGEVNIRELIEDIGFPVIATNRSPVEGGHFSGSEDERIKLLMAAAEVADFVDIELSSAREDIERVTGSARRSIVSYHNFRETPSLEALLRIVRMAKEMGDIAKVAVMPENLADTLVVLQLLTFEEDTVAISMGELGKYTRVAAALFGSPITFASMGRGTAPGQMDVDVTRKMIGELMPED

SEQ ID NO: 29400 - DNA, 648 bp, Pyrococcus abyssi
  CDS (1)..(648)
atgatagcaaccgttatcttggctgactccattaaggaggcgattgagaagattaaatcatcgtcttccgatttgtacgagctaagggctgactcccttaaggattactctaaattggaactccttgaaccctactccgagaagcttgtggtaacaataaggagcaaggatgaagggggttttaaggagttaagtgatgaaaagaggttggagctctattcaaaattcctcgagataaagccgaggtacgtggatgtagagttcagatccaagataaaggatgaagttatggagatagcaaaaagggttggttctagggttattctctcttaccataacttccgtgagacacctccttttggcgtgctctacaatcttttagaggatatggagagcgagggggctgatattgtaaagatcgttactcatgcaagctctcccaaggataacataaggattataaggctctacgagtttgcggataatttaatagccttttgcatgggttccaagggtaaaatctcgaggattttcagctcaatgtactcgccgataacttatgtagccctggataagaaagctgctccaggacaattaacgcttgaagagctaagggttatacttaaaatcctgggtgaggggagatga

SEQ ID NO: 29401 - protein, 215 aa, Pyrococcus abyssi
MIATVILADSIKEAIEKIKSSSSDLYELRADSLKDYSKLELLEPYSEKLVVTIRSKDEGGFKELSDEKRLELYSKFLEIKPRYVDVEFRSKIKDEVMEIAKRVGSRVILSYHNFRETPPFGVLYNLLEDMESEGADIVKIVTHASSPKDNIRIIRLYEFADNLIAFCMGSKGKISRIFSSMYSPITYVALDKKAAPGQLTLEELRVILKILGEGR

SEQ ID NO: 29402 - DNA, 906 bp, Pyrobaculum aerophilum
  CDS (1)..(906)
atgttacaatatggggtattaatctgcggcgtcgtccccgtcagaaagccgcgcgatatagaaaaggcgctggaggcgcccgtgacctgtctagagctgaggctcgactatttagaggcggatctcgccgaggtgcggccccttttagaacacgcagtggcgagacgcgtggtaatttttacagtgaggaggcgtgaggaggggggccagtggaggggagacgaggaggggagagaggccttgtacagaaagctcctggagctaaacccgcactacatcgacgtagaggccgagtcgcccattataggcgaagtggcgaaaattaagggaaaggcgcagttaatagccagcagacacgacttcgagaagacgcctcctctcgacgtgttgagccagtgggctaaaaaagcggcggcggtcggcgacttggtgaaaatcgtcacctacgccaaagagccgggggacgggctcagagtgctgtcgttaataggggcggtggagaagcccactgtcgccttcgccatggggcccgcaggggcgtacacaagagtggccgccgcggcgctgggaagccccattatgtacgtctcgctgggcgaggccacggccccaggccagttgactgcagacgcctactacgccgccctgctcgccctgggcattacgccgagcgggggcgggctcccggcgctgagagaggccttggactgggtagacggaggcctcatgtacttactcaagaagaggctggaggtgtgtagagacatggggcgcctcaaaaaagacgcaggactgcccatatacgacgacgtacgcgaggcgcaggtactgcgcagggcgggggatttcaaacagatatttgaactagtggtacagatgtgcaaagcagtacagctagtggcgtaa

SEQ ID NO: 29403 - protein, 301 aa, Pyrobaculum aerophilum
MLQYGVLICGVVPVRKPRDIEKALEAPVTCLELRLDYLEADLAEVRPLLEHAVARRVVIFTVRRREEGGQWRGDEEGREALYRKLLELNPHYIDVEAESPIIGEVAKIKGKAQLIASRHDFEKTPPLDVLSQWAKKAAAVGDLVKIVTYAKEPGDGLRVLSLIGAVEKPTVAFAMGPAGAYTRVAAAALGSPIMYVSLGEATAPGQLTADAYYAALLALGITPSGGGLPALREALDWVDGGLMYLLKKRLEVCRDMGRLKKDAGLPIYDDVREAQVLRRAGDFKQIFELVVQMCKAVQLVA

SEQ ID NO: 29404 - DNA, 654 bp, Pyrococcus furiosus
  CDS (1)..(654)
atgcctaaattggccggagttataatagctaaaaccattgaagaagctgtaaaaaagataaagctacatgaagccgacctttatgagcttagagtagattacctggagagcatggagaacattgaactcctcttacctcattcaaacaagctgatagtgaccgtgaggaaagtagaagagggaggagcaaaacgcattgaagaacaagaaaggttaaaattatttgagaagtttgcaaaaattaaacctgcatatttcgatgttgaactttactcaaatatcgtggaggatgtaataaacctctcctcaaaaatagggagcaaagtaatcctatcataccataacttttctaaaactccttcataccaaactctccaatcaattttggattcgatgatagagcttgaaccagatataataaaaatcgtgacctatgcgagggattttcgagacaacatagaggtgatcaaactctacgagaacagcgaaaatctaattgcgttttgcatgggcgagaagggaaaaatttcaagaatatttagcgccctctactctccttttacgtatgttagcattgacaatagcgtagctcctggacaatttacagttggagagatgagaaaaatcctagaattgctaggtgagacaaaatga

SEQ ID NO: 29405 - protein, 217 aa, Pyrococcus furiosus
MPKLAGVIIAKTIEEAVKKIKLHEADLYELRVDYLESMENIELLLPHSNKLIVTVRKVEEGGAKRIEEQERLKLFEKFAKIKPAYFDVELYSNIVEDVINLSSKIGSKVILSYHNFSKTPSYQTLQSILDSMIELEPDIIKIVTYARDFRDNIEVIKLYENSENLIAFCMGEKGKISRIFSALYSPFTYVSIDNSVAPGQFTVGEMRKILELLGETK

SEQ ID NO: 29406 - DNA, 759 bp, Salmonella enteritidis
  CDS (1)..(759)
atgaaaaccgtaactgtaagagatctcgtggttggcgaaggcgcgccaaagatcattgtgtcgctaatgggaaaaaccattaccgatgtgaaatcggaagcactcgcctaccgtgaagcggatttcgatattctggagtggcgcgttgaccattttgccaacgtgacaacggcggaaagcgtacttgaggccgccggcgccatccgggagattattaccgataaacccttgctatttaccttccgcagtgcgaaagaaggcggcgaacaggcgctaactaccggacagtatatcgctctgaatcgtgcagcggttgacagcggtctggtcgatatgatcgatcttgagctttttaccggcgacgacgaggtgaaagccaccgtcggctatgctcatcaacacaatgttgcggtgatcatgtctaaccatgattttcataaaacgcccgcagcggaagagattgttcagcgtctgcgtaaaatgcaggaactgggcgccgatattccgaagatcgccgtcatgccacagactaaagccgatgtcctgaccttacttaccgccactgtagaaatgcaggagcgctatgcggatcgtccgattattaccatgtcgatgtcgaaaaccggggtaatatctcgtcttgccggcgaagtgttcggttctgcagcaacgtttggcgcggtgaaaaaagcatctgcgccgggacaaatatcggtagccgatctgcgtaccgtattaactatattgcaccaggcgtaa

SEQ ID NO: 29407 - protein, 252 aa, Salmonella enteritidis
MKTVTVRDLVVGEGAPKIIVSLMGKTITDVKSEALAYREADFDILEWRVDHFANVTTAESVLEAAGAIREIITDKPLLFTFRSAKEGGEQALTTGQYIALNRAAVDSGLVDMIDLELFTGDDEVKATVGYAHQHNVAVIMSNHDFHKTPAAEEIVQRLRKMQELGADIPKIAVMPQTKADVLTLLTATVEMQERYADRPIITMSMSKTGVISRLAGEVFGSAATFGAVKKASAPGQISVADLRTVLTILHQA

SEQ ID NO: 29408 - DNA, 759 bp, Salmonella typhi
  CDS (1)..(759)
atgaaaaccgtcaccgtaaaaaatcttatcattggcgaagggatgcccaaaattatcgtgtcgttgatgggaagagacatcaatagcgtgaaagcggaggcgctggcctaccgcgaagctacattcgatattctggagtggcgcgtggatcactttatggatatcgcatcgactcaatccgttcttaccgctgcgcgtgttatccgcgatgcgatgcctgacattccgttactgtttactttccgcagcgccaaagaaggcggcgagcagacaataaccactcagcattatctcacgcttaatcgtgccgcaatcgacagcggcctggtcgatatgatcgatcttgagctatttaccggtgatgctgacgttaaagccactgtcgattatgcccatgcgcataatgtttatgtcgtgatgtctaaccacgattttcaccagacgccgtccgcagaggaaatggttctgcggctacgtaaaatgcaagcactcggcgcggatattcccaagattgccgttatgccgcaaagcaagcatgatgtattaacgttactcactgccacgctggagatgcagcaacattacgccgaccgtccggtaattactatgtcaatggcgaaagagggtgtcatttcacgtctggcaggggaagtgtttggctctgccgccacgtttggcgcggtgaagcaggcttcagcgccggggcaaatcgccgtaaatgatctacgcagtgtattaatgattctgcacaacgcctga

SEQ ID NO: 29409 - protein, 252 aa, Salmonella typhi
MKTVTVKNLIIGEGMPKIIVSLMGRDINSVKAEALAYREATFDILEWRVDHFMDIASTQSVLTAARVIRDAMPDIPLLFTFRSAKEGGEQTITTQHYLTLNRAAIDSGLVDMIDLELFTGDADVKATVDYAHAHNVYVVMSNHDFHQTPSAEEMVLRLRKMQALGADIPKIAVMPQSKHDVLTLLTATLEMQQHYADRPVITMSMAKEGVISRLAGEVFGSAATFGAVKQASAPGQIAVNDLRSVLMILHNA

SEQ ID NO: 29410 - DNA, 759 bp, Shigella dysenteriae
  CDS (1)..(759)
atgaaaaccgtaactgtaaaagatctcgtcattggtgcgggcgcacctaaaatcatcgtctcgctgatggcgaaagatatcgcccgcgtgaaatccgaagctctcgcctatcgtgaaacggactttgatattctggaatggcgtgtggaccactttgccgacctctccaatgtggagtctgtcatggcggcggcaaaaattctccgtgaaaccatgccagaaaaaccgctgctgtttaccttccgcagtgccaaagaaggcggcgagcaggcgatttccaccgaggcttatattgctctcaatcgtgcagccatcgacagcggcctggttgatatgatcgatctggagttatttaccggcgatgatcaggttaaagaaaccgtcgcctacgcccacgcgcatgatgtgaaagttgtcatgtccaaccatgacttccataaaacgccggaagccgaagaaatcattgcccgtctgcgcaaaatgcagtccttcgacgccgatattcctaagattgcgctgatgccgcaaagtaccagcgatgtgctgacgttgcttgccgcgaccctggagatgcaggagcagtatgccgatcgtccaatcatcacgatgtcaatggcaaaaactggcgtaatttctcgtctggctggtgaagtatttggctcggcggcaacttttggtgcggtaaaaaaagcctctgccccagggcaaatctcggtaaatgatttgcgcattttattaactattttacaccaggcataa

SEQ ID NO: 29411 - protein, 252 aa, Shigella dysenteriae
MKTVTVKDLVIGAGAPKIIVSLMAKDIARVKSEALAYRETDFDILEWRVDHFADLSNVESVMAAAKILRETMPEKPLLFTFRSAKEGGEQAISTEAYIALNRAAIDSGLVDMIDLELFTGDDQVKETVAYAHAHDVKVVMSNHDFHKTPEAEEIIARLRKMQSFDADIPKIALMPQSTSDVLTLLAATLEMQEQYADRPIITMSMAKTGVISRLAGEVFGSAATFGAVKKASAPGQISVNDLRILLTILHQA

SEQ ID NO: 29412 - DNA, 717 bp, Staphylococcus aureus
  CDS (1)..(717)
atgacacatgtggaagtagtagcgactatcacgccacaattatatatcgaagaaactttaattcaaaaaattaatcatcgtattgatgcaatagacgtattagaattacgaattgatcaatttgaaaatgtcacagttgatcaagtggcagaaatgattacaaagctgaaggttatgcaagattcattcaaattattggttacgtatcgtacaaagttacaaggtggctatgggcaatttacaaatgactcgtatcttaatttaatatcagacttagcaaatatcaatggcatagatatgattgatatagaatggcaagcagatattgacattgaaaaacatcaacgaatcattacacatttgcaacagtataataaagaggtgattatatcacatcataatttcgaaagtacgcctccattagatgaattgcaatttatattttttaaaatgcaaaaattcaacccagaatacgttaaattagcagtaatgccacataataaaaatgatgtgctaaatttattgcaggcaatgtctacattttcagatactatggactgcaaagttgttggtatttcaatgtctaaacttggactaataagtagaacggctcaaggcgtttttggtggtgcgttgacttatggttgtatcggagaaccacaagctccaggacagattgatgttactgatttaaaagcacaagtgactttatactaa

SEQ ID NO: 29413 - protein, 238 aa, Staphylococcus aureus
MTHVEVVATITPQLYIEETLIQKINHRIDAIDVLELRIDQFENVTVDQVAEMITKLKVMQDSFKLLVTYRTKLQGGYGQFTNDSYLNLISDLANINGIDMIDIEWQADIDIEKHQRIITHLQQYNKEVIISHHNFESTPPLDELQFIFFKMQKFNPEYVKLAVMPHNKNDVLNLLQAMSTFSDTMDCKVVGISMSKLGLISRTAQGVFGGALTYGCIGEPQAPGQIDVTDLKAQVTLY

SEQ ID NO: 29414 - DNA, 717 bp, Staphylococcus aureus
  CDS (1)..(717)
atgacacatgtggaagtagtagcgactatcgcgccacaattatctatcgaagaaactttaattcaaaaaattaatcatcgtattgatgcaatagacgtattagaattacgaattgatcaaattgaaaatgtcacagttgatcaagtggcagaaatgattacaaagctgaaggttatgcaagattcattcaaattattagttacgtatcgtacaaagttacaaggtggctatgggcaatttataaatgacttgtatcttaatttaatatcagacttagcaaatatcaatggcatagatatgattgatatagaatggcaagcagatattgacattgaaaaacatcaacgaatcattacacacttgcaacagtataataaagaggtggttatatcacatcataatttcgaaagtacgcctccattagatgaattgcaatttatattttttaaaatgcaaaaattcaacccagaatacgttaaattagcagtaatgccacataataaaaatgatgtgttaaatttattgcaggcaatgtctacattttcagatactatggactgcaaagttgttggtatttcaatgtctaaacttggactaataagtagaacggctcaaggcgtttttggtggtgcattgacttatggttgtatcggagaaccacaagctccaggacagattgatgttactgatttaaaagcacaagtgactttatactaa

SEQ ID NO: 29415 - protein, 238 aa, Staphylococcus aureus
MTHVEVVATIAPQLSIEETLIQKINHRIDAIDVLELRIDQIENVTVDQVAEMITKLKVMQDSFKLLVTYRTKLQGGYGQFINDLYLNLISDLANINGIDMIDIEWQADIDIEKHQRIITHLQQYNKEVVISHHNFESTPPLDELQFIFFKMQKFNPEYVKLAVMPHNKNDVLNLLQAMSTFSDTMDCKVVGISMSKLGLISRTAQGVFGGALTYGCIGEPQAPGQIDVTDLKAQVTLY

SEQ ID NO: 29416 - DNA, 717 bp, Staphylococcus epidermidis
  CDS (1)..(717)
atgacccatgtagatattgcagcgacaattgcaccagaagacaagctttctaaaactttactcaaagatataaaagtaaacgaagaatcaatagatatcattgaattgcgcattgaccaatggccatcatttaataaggcattattaaatgaagtgattaagcaattaaaaatattccatttgaaaatattagtaacatatagaacttcagttcaaggaggaaaaggagctgtaaatgagcaagagtatttaaatatactaggtgaattaattgagtgtccacaatttgatatgattgatattgagtggagcagtgccgtcaaaattgaaaaatatacgcatcttgttcaacgtgcacaacaaaaagggctcgaagttgttctttcgcatcataattttcaagaaacacctgctttagatgaacttaaatttatttactttaaaatgcaaaaactcaatcctgagtatttaaagcttgcggttatgcccaaatgtcaagaggacgtgttacatttattagaagccatgtcactcacagcgaagcacacaacatgccgaattgtcggtatatcgatgtctagtttgggtaaagtcagccgaattgctcaaggcgtatttggtggaacgctgtcttatggttgcatagaagaaccacaagcacccggacagatacatgtctctaagttaaaatccatggtttctttttatgaggattaa

SEQ ID NO: 29417 - protein, 238 aa, Staphylococcus epidermidis
MTHVDIAATIAPEDKLSKTLLKDIKVNEESIDIIELRIDQWPSFNKALLNEVIKQLKIFHLKILVTYRTSVQGGKGAVNEQEYLNILGELIECPQFDMIDIEWSSAVKIEKYTHLVQRAQQKGLEVVLSHHNFQETPALDELKFIYFKMQKLNPEYLKLAVMPKCQEDVLHLLEAMSLTAKHTTCRIVGISMSSLGKVSRIAQGVFGGTLSYGCIEEPQAPGQIHVSKLKSMVSFYED

SEQ ID NO: 29418 - DNA, 687 bp, Streptococcus pyogenes
  CDS (1)..(687)
atgagaattgtagcaccagtcatgccaagacattttgacgaggctcaagccattgatatttctaaatatgaagatgttaatttaattgaatggcgagcagactttcttcccaaggatgagattgtcgcagtagcaccagctatttttgaaaaatttgccggaaaagaaattatctttacccttcggactgttcaagaaggggggaatattaccctttcaagtcaggagtatgttgatattatcaaagaaatcaatgctatttataatccagactatattgactttgagtattttacgcacaagtcagtatttcaagaaatgcttgattttccaaatcttattttgtcttatcacaactttgaagagactcctgaaaatttaatggaagctttttcagaaatgaccaagttggcaccgcgtgtggttaaaattgctgtgatgccccagagtgaacaagatgttctagatttgatgaactataccagaggctttaagacgctcaatcctgagcaagaatttgcaactatatctatggggaaattaggaagattgtctcgttttgcgggagatgtcattggctcttcctggacatacgtttcattagatcatgttagcggtccaggtcaagtgactctcaatgatatgaaacgtattattgaggtcttagaaatggatatatctaactag

SEQ ID NO: 29419 - protein, 228 aa, Streptococcus pyogenes
MRIVAPVMPRHFDEAQAIDISKYEDVNLIEWRADFLPKDEIVAVAPAIFEKFAGKEIIFTLRTVQEGGNITLSSQEYVDIIKEINAIYNPDYIDFEYFTHKSVFQEMLDFPNLILSYHNFEETPENLMEAFSEMTKLAPRVVKIAVMPQSEQDVLDLMNYTRGFKTLNPEQEFATISMGKLGRLSRFAGDVIGSSWTYVSLDHVSGPGQVTLNDMKRIIEVLEMDISN

SEQ ID NO: 29420 - DNA, 678 bp, Streptococcus pneumoniae
  CDS (1)..(678)
atgaaattaatcgtttcagtaatgccaagaagtttagaggaggctcaggctctggatgccacgaggtacctggatgccgacatcattgaatggcgtgccgactatctgcctaaagaagcgattttgcaggtagctccagccatttttgaaaaattcgcaggccgtgagttggttttcacgctacgaactcgctccgaaggtggagaaatcgacctttctccagaagagtatatccatctaatcaaggaagttgcgcaactctatcaaccagactatattgattttgagtactatagctacaaggatgtttttgaggaaatgctggacttcccaaatcttgttttgagttaccataatttccaagaaacacctgagaacatgatggaaatcttgtcagagttgacgatcctaaatccaaaacttgttaaggttgcggtgatggctcacacggagcaggatgtcttagacttgatgaactatacacgaggctttaaaaccctcaatcctgaacaggaatatgtgaccatttctatgggtaaggtgggcaaggtctctcgtatcactgcggatgtgactggttcgagttggtcttttgccagtctggatgaggttagtgcccctgggcagatttctctagctagcatgaaaaaaatcagggagattttggatgaagcttga

SEQ ID NO: 29421 - protein, 225 aa, Streptococcus pneumoniae
MKLIVSVMPRSLEEAQALDATRYLDADIIEWRADYLPKEAILQVAPAIFEKFAGRELVFTLRTRSEGGEIDLSPEEYIHLIKEVAQLYQPDYIDFEYYSYKDVFEEMLDFPNLVLSYHNFQETPENMMEILSELTILNPKLVKVAVMAHTEQDVLDLMNYTRGFKTLNPEQEYVTISMGKVGKVSRITADVTGSSWSFASLDEVSAPGQISLASMKKIREILDEA

SEQ ID NO: 29422 - DNA, 762 bp, Enterococcus faecalis
  CDS (1)..(762)
gtgaagccagttatagtcaaaaatgtacgaataggtgaagggaatcccaaaattgtggtgcccattgttgctccaacagccgaggatattttggccgaagcaacggcgagccaaacactagattgtgatttggtagaatggcgtttagactattatgaaaatgtcgctgatttttccgatgtatgtaatctttcacaacaagtaatggaacggttggggcaaaaaccgttattgttaacttttcgtacacaaaaagaaggcggcgaaatggctttttctgaggaaaattattttgctttgtatcatgaattagtgaaaaagggtgcgttggatttattagatattgaattatttgcgaatccgctggcggcagatacgttaattcacgaagctaaaaaggcggggattaaaattgttctctgtaatcacgactttcagaaaacaccatcgcaagaggagattgtcgcgcggttacgccaaatgcaaatgcgtcaggcagatatttgtaaaatagctgtgatgccacaagatgcgacagatgtgcttacgttactttcagcaaccaatgaaatgtacacccattatgcatccgttccaatcgttactatgtcaatgggacagttagggatgattagtcgcgtaacaggtcaactgttcggatcggcactaacttttggctcagcccagcaagcgtctgcaccaggccaactatccgtacaagtattaagaaattatttaaagacattcgaacaaaacaagtga

SEQ ID NO: 29423 - protein, 253 aa, Enterococcus faecalis
MKPVIVKNVRIGEGNPKIVVPIVAPTAEDILAEATASQTLDCDLVEWRLDYYENVADFSDVCNLSQQVMERLGQKPLLLTFRTQKEGGEMAFSEENYFALYHELVKKGALDLLDIELFANPLAADTLIHEAKKAGIKIVLCNHDFQKTPSQEEIVARLRQMQMRQADICKIAVMPQDATDVLTLLSATNEMYTHYASVPIVTMSMGQLGMISRVTGQLFGSALTFGSAQQASAPGQLSVQVLRNYLKTFEQNK

SEQ ID NO: 29424 - DNA, 26 bp, Primer
atgaaaaccgtaactgtaaaagatct

SEQ ID NO: 29425 - DNA, 27 bp, Primer
ttatgcctggtgtaaaatagttaatac

SEQ ID NO: 29426 - protein, 163 aa, consensus
  MISC_FEATURE (1)..(163): consensus for the disclosure of xaa see table XV
RXXXEGGXXXXXXXXXXXXXXXXXXXXXXXXXXXDXEXXXXXXXXXXXXXXXXXXXXXXXXXXXXSXHXFXXTPXXXXXXXXXXXXXXXXXXXXKXAXXXXXXXDVXXXXXXXXXXXXXXXXXXXXXXXMXXXGXXXRXXXXXXGXXXTXXXXXXXXXXAPGQ

SEQ ID NO: 29427 - protein, 8 aa, consensus
  MISC_FEATURE (1)..(8): consensus for the disclosure of xaa see table XV
XXXEXRXD

SEQ ID NO: 29428 - protein, 37 aa, consensus
  MISC_FEATURE (1)..(37): consensus for the disclosure of xaa see table XV
XXXXXGXXXXXXXXXXXXXXXXXXXXXXXXXXXXDXX

SEQ ID NO: 29429 - protein, 47 aa, consensus
  MISC_FEATURE (1)..(47): consensus for the disclosure of xaa see table XV
XXXXHXXXXTXXXXXXXXXXXXXXXXXXXXXKXXXXXXXXXDXXXXX

SEQ ID NO: 29430 - protein, 42 aa, consensus
  MISC_FEATURE (1)..(42): consensus for the disclosure of xaa see table XV
XXMXXXXXXXRXXXXXXXXXXXXXXXXXXXXXXPGQXXXXXX

SEQ ID NO: 29431 - DNA, 1701 bp, Escherichia coli
  CDS (1)..(1701)
atgcatcccacaggcccgcatctcgggcctgatgttctgtttcgagagtccaacatgaaagtgacattaacgtttaacgaacaacgtcgtgcggcgtatcgtcagcaagggttatggggcgatgcttcgctggccgattactggcagcagaccgctcgtgcgatgccagacaaaattgccgtggtcgataatcatggtgcatcgtacacctatagcgcgctcgatcacgccgcgagctgtctggcaaactggatgttagcgaagggtattgaatcaggcgatcgcatcgcatttcaactgcctggctggtgtgaatttaccgttatctatcttgcctgcctgaaaatcggtgcagtttccgtgccgctgttgccttcctggcgggaagcagaactggtgtgggtgctcaataagtgtcaggcaaaaatgttctttgcaccgacgttgtttaaacaaacgcgtccggtagatttaatcctgccgctgcaaaatcagcttccacaactacaacaaattgtcggcgtggacaaactggctcccgccacctcttccctctcattaagtcagattatcgccgacaatacctcactgaccacggcgataacgacccacggcgatgaattagctgcggtgctgtttacctccggaaccgagggtctgccaaagggcgtgatgctaacgcataacaatattctcgccagtgagcgggcttattgcgcgcgactgaatctgacctggcaggatgtctttatgatgcctgcgccacttggtcacgcaacgggctttctgcatggcgtaacggcaccattcttaattggcgctcgcagcgtgttgttagatattttcactcctgatgcgtgtctcgcgctgcttgagcagcagcgttgcacctgtatgctcggcgcaacgccgtttgtctatgatcttttgaatgtactagagaaacaacccgcggacctttcagcgctgcgtttctttctttgcggcggaaccacaatccccaaaaaagtggcgcgtgaatgccagcagcgcggcattaaattattaagtgtttatggttccacagaaagttcgccgcatgcggtggtgaatctcgatgatcctttgtcgcgctttatgcacaccgatggttacgctgccgcaggtgtagagattaaagtggtcgatgacgcacgcaagaccttaccgccaggttgcgaaggtgaagaagcctcgcgtggccccaatgtgtttatggggtattttgatgaacctgaattaaccgcccgtgccctggatgaagaaggctggtattacagcggcgatctctgccgtatggatgaggctggctatataaaaattaccggacgcaaaaaagatattattgtccgcggcggcgaaaatattagcagccgtgaagtggaagatattttattgcagcatcctaaaattcacgatgcctgtgtggttgcaatgtccgatgaacgtttaggtgaacgatcatgcgcttatgtcgtgctgaaagcgccgcatcattcattatcgctggaagaggtagtggctttttttagccgtaaacgggtcgcaaaatataaatatcctgaacatatcgtggtaatcgaaaaactaccgcgaactacctcaggtaaaatacaaaagtttttgttaagaaaagatattatgcggcgtttaacgcaggatgtctgtgaagagattgaataa

SEQ ID NO: 29432 - protein, 566 aa, Escherichia coli
MHPTGPHLGPDVLFRESNMKVTLTFNEQRRAAYRQQGLWGDASLADYWQQTARAMPDKIAVVDNHGASYTYSALDHAASCLANWMLAKGIESGDRIAFQLPGWCEFTVIYLACLKIGAVSVPLLPSWREAELVWVLNKCQAKMFFAPTLFKQTRPVDLILPLQNQLPQLQQIVGVDKLAPATSSLSLSQIIADNTSLTTAITTHGDELAAVLFTSGTEGLPKGVMLTHNNILASERAYCARLNLTWQDVFMMPAPLGHATGFLHGVTAPFLIGARSVLLDIFTPDACLALLEQQRCTCMLGATPFVYDLLNVLEKQPADLSALRFFLCGGTTIPKKVARECQQRGIKLLSVYGSTESSPHAVVNLDDPLSRFMHTDGYAAAGVEIKVVDDARKTLPPGCEGEEASRGPNVFMGYFDEPELTARALDEEGWYYSGDLCRMDEAGYIKITGRKKDIIVRGGENISSREVEDILLQHPKIHDACVVAMSDERLGERSCAYVVLKAPHHSLSLEEVVAFFSRKRVAKYKYPEHIVVIEKLPRTTSGKIQKFLLRKDIMRRLTQDVCEEIE

SEQ ID NO: 29433 - DNA, 1614 bp, Salmonella enterica subsp. enterica serovar Paratypi A str. ATCC
  CDS (1)..(1614)
atgatgcgtatacctttcacccgttggccggatgaatttgcccgccgttatcgtgaaaaaggctactggcaagacgtgccgttgaccgatattctgacccgccacgctgacagcgataagatggcggtcattgaaggcgagcgcgcattcagctatcgccagctaaaccaggccgcggataatctggcctgcagtttacgccgtcagggcatcaaacctggcgaaaccgctctggtgcaactggggaatgtaccggaactgtatatcacctttttcgccctgttgaagcttggcgtagcgcccgttctggcgctgtttagccatcaacgtaccgaacttaacgcctatgcgatgcagatcgcgccgacgctggtgattgccgatcgccaacatacgctgttcgccggggaggactttctcaacacgtttgtggctgaacaccgctctgtgcgggtggtgttattgcgcaacgacgacggcgatcacagcctggacgcggcgatgcggcaggcggcggaagatttcaccgccacgccatcacctgctgacgaagtggcctactttcagctttccggcggtactaccggcacgccaaagcttattccccgtacccataacgactattactacagcgtgcgccgcagcaatgagatttgcggtttcaacgaggagacgcgttttctgtgcgcgattcccgccgcgcataactacgccatgagttcgccgggcgcgctgggcgtttttctcgccaaaggaacggtagtgctggcgaccgatcctagcgccacgctctgtttcccgctgatcgaaaaacaccagattaatgccacggcgttggtgccgcccgcggtcagtctatggctacaggctatccaggagtggggcggcaatgcgccgctggcgtcattaaggttattgcaggttggcggcgcgcggctttctgcgacgcttgccgcccgtattccggctgaaattggctgtcagttgcagcaggtcttcggcatggcggaagggttagtgaactatacccggctggacgatagcccggaacggattatcaatacccagggaagacccatgtgtccggacgacgaagtgtgggtggcggatgccgacgggaatccactgccgccgggcgagattggtcgtctgatgacgcgcggcccctatacttttcgcggctatttcaacagtccgcaacacaatgccagcgcctttgacgccaacggtttttactgttccggcgatctgatctccattgatcaagacggctatatcaccgttcacgggcgtgaaaaagatcagatcaatcggggcggcgagaagatagccgccgaagagatagaaaacctgttactgcgccacccggcggtgatccatgcggcgctggtcagcatggaagatgaactgctgggggagaaaagttgcgcatatctggtggtaaaagagccgctgcgagcggtacaggtacgccgtttcctgcgagagcagggcgtggcggaatttaaattaccggatcgcgtggagtgcgttgcgtcactgccactgacgccggttggtaaagtcgataaaaaacaattacgccagcggttggcgtcacgttcaccgctctga

SEQ ID NO: 29434 - protein, 537 aa, Salmonella enterica subsp. enterica serovar Paratypi A str. ATCC
MMRIPFTRWPDEFARRYREKGYWQDVPLTDILTRHADSDKMAVIEGERAFSYRQLNQAADNLACSLRRQGIKPGETALVQLGNVPELYITFFALLKLGVAPVLALFSHQRTELNAYAMQIAPTLVIADRQHTLFAGEDFLNTFVAEHRSVRVVLLRNDDGDHSLDAAMRQAAEDFTATPSPADEVAYFQLSGGTTGTPKLIPRTHNDYYYSVRRSNEICGFNEETRFLCAIPAAHNYAMSSPGALGVFLAKGTVVLATDPSATLCFPLIEKHQINATALVPPAVSLWLQAIQEWGGNAPLASLRLLQVGGARLSATLAARIPAEIGCQLQQVFGMAEGLVNYTRLDDSPERIINTQGRPMCPDDEVWVADADGNPLPPGEIGRLMTRGPYTFRGYFNSPQHNASAFDANGFYCSGDLISIDQDGYITVHGREKDQINRGGEKIAAEEIENLLLRHPAVIHAALVSMEDELLGEKSCAYLVVKEPLRAVQVRRFLREQGVAEFKLPDRVECVASLPLTPVGKVDKKQLRQRLASRSPL

SEQ ID NO: 29435 - DNA, 1518 bp, Silicibacter pomeroyi DSS-3
  CDS (1)..(1518)
atggcaaaccccctctatgaccgtctcttcggcgcccatgcagggcaggacacaccctttctgtatcttcccgacgggcgggtgatcagccatgcggcgtttctggggcaggcggcccggctggcccatgtcgccacaaatctggggctgaagccgggcgaccgggtcgccgcgcaggtcgagaaatcgcccgaggcgctggccctttatgccgcctgcgcccaggccgggctgatctttctgccgctcaacaccgcctataccgccgacgagctgagctacttcatcgacaacagcggtgccgcgctgatcgtctgcgacgggcgcaaccgcgacatgctggccccgatcgccgagggtctgggggcccggatcgagaccctgaacgccgacggatcgggcagcctgaccgagcgcgccgccacgatgcccgaccggttcgacaccgttgcgcggggcggcggtgacctggcggcctttctctatacctcgggcaccacgggccgttccaagggcgcgatgctgacgcaggacaacctgctgtccaatgccgagacgctggcgcgcgaatggcgtttcaccgctgatgatgtgctgctgcacgcgctgccgatctttcacacccacggcctgttcgtggccaccaatatcgcgctgatcaccggcggcagcatgatctttctgccgaggttcgacctcgaccagatcatcgcgcagatgccgcgcgcgaccagcatgatgggggtgccgaccttctacacccggctgttgggcgatgcccggttcacccgcgaactggcgcagcacatgcggctcttcgtgtcgggatcggcccccttgctggccgaaacccatgtcgagttcgaggagcgcaccggtcaccgcatcctggaacgctatgggatgaccgagaccaacatgaacacctcgaacccctatgagggcgcgcgccgtgccggcacggtcggcctgccgctgccgggggtcgagctgaaggtgaccgaccccgaaaccggtgaaaccctgccccagggcgagatcggcgtgatcgaggtgcgcggccccaatgtgttcaagggctattggcagatgcccgagaagacggcggccgagctgcgcgccgacgggttcttcatcaccggcgacctgggatttgtcgatgaacagggctatgtcaccatcgtcgggcgcggcaaggacctgatcatttcgggcgggttcaacatctatcccaaagagctggaactgctgctggacgatcaacccggcgtgctggaaagcgcggtgatcggggtgccccatcccgatttcggagagacccctttgggcctgctggtgccccgccccggccagacccccgatacgcaggcaatcatggccacggtggaaaccgcgttggcccggttcaagcatccccgcaagctgatcgtgctggaggagttgccgcgcaacaccatgggcaaggtgcaaaagaacatcctgcgcgaccagttcaaggcgctgttcgagaagcaatag

SEQ ID NO: 29436 - protein, 505 aa, Silicibacter pomeroyi DSS-3
MANPLYDRLFGAHAGQDTPFLYLPDGRVISHAAFLGQAARLAHVATNLGLKPGDRVAAQVEKSPEALALYAACAQAGLIFLPLNTAYTADELSYFIDNSGAALIVCDGRNRDMLAPIAEGLGARIETLNADGSGSLTERAATMPDRFDTVARGGGDLAAFLYTSGTTGRSKGAMLTQDNLLSNAETLAREWRFTADDVLLHALPIFHTHGLFVATNIALITGGSMIFLPRFDLDQIIAQMPRATSMMGVPTFYTRLLGDARFTRELAQHMRLFVSGSAPLLAETHVEFEERTGHRILERYGMTETNMNTSNPYEGARRAGTVGLPLPGVELKVTDPETGETLPQGEIGVIEVRGPNVFKGYWQMPEKTAAELRADGFFITGDLGFVDEQGYVTIVGRGKDLIISGGFNIYPKELELLLDDQPGVLESAVIGVPHPDFGETPLGLLVPRPGQTPDTQAIMATVETALARFKHPRKLIVLEELPRNTMGKVQKNILRDQFKALFEKQ

SEQ ID NO: 29437 - DNA, 1716 bp, Silicibacter pomeroyi DSS-3
  CDS (1)..(1716)
atggcccagcaaaacgtaaacgccggtttggcagcgcaggatggtctttcccatgttcagggagcaagccagccggacctgtccaatgccacgatcccgcaattgcttcacacgaccgtcgcgcgcggcggggcaaacgacgcgctgatctttgcgggtgcgcggctgagctacgacgcgtttgcgcaagcggtggatgaccttgcctgcgggtttctggcgcttgggctgcaaaagggcgaccgtctcggcatctggtcgcccaaccgggttgaatgggttctcacgcaattcgccaccgcaaggatcggcgtgatcctggtcaacatcaacccggcctatcgcctgagcgaactggaatatgcccttaacaaggtgggctgcaaggcgctggtgctggcgcctgcgttcaaggcttcggattacgtggaaatgatccgcaccctcgcgccggaactggcatcctgcgacaaaggcgggctgcggaccgcaaggcttcctgatctgcggcatgtcatcgtcatgggtgaaaacgcgggccaatgcggtgaatgggcgtttggcgaaattgcccgaatgggcggtgccgaacaccgtgcccgtctgccggatatcgacaagacacttaacccggacgatccgatcaacatccagttcacatcgggcacgaccggccagcccaagggggccacgctgacgcatcgcaacatcgtcaataacgcgcggttcgtgaccgaccggatcaacttgtccgaacgggaccggctggcgatcccggtgccgctctatcactgtttcggcatggtgatgggcgtgctgggggcggtcagcaaaggcgcggcaatggtgtttccgggcgaagcctttgacccggcccagacattggacacggtcgaggcggaacgctgcaccgcgctctatggcgtaccgacaatgttcgtggcgatgttgcaggaactggcgacaacatcgcgcgatctgtcgtcgctgcgtacgggtatcatggcggggtctccctgtccggtcgacgtgatgaaacaggtcaacgaccggatgcacatgggcgaggtgacgatctgctacggcatgaccgaaacctcgcccgtgtcctttcagagctttgtcgacgacagcacagaaaagcggtgcgagaccgtaggccggatccacccccacctggaggtcaagatcgtcgatgacaccggtaatacggtgcccgtaggcgttcagggagagctgtgcacgcgcggctattcggtgatgcagggatattgggacgatcctgaacgaaccgccgaggcgatccgtgatggctggatgcataccggcgacctggcggtgttggacgcggatgggttctgcaccatcaccgggcgggtcaaggacatgatcatccggggcggcgagaacatctatccgcgcgagatcgaggaattcctgttcggccatcccgacatcaaggaggtgcaggtctttggcatccccgatgcgcggatgggcgaagaggtctgcgcctgggtcgtcgccaagcccgggtgcgagatttccgccgaagacgttcgcacctattgccgggggcaaatcgcccatttcaaggtgccccgtcatgtccgcatcgtaacagaactgccgatgaccatcaccggcaaaccacagaaattcatcatgcgcgaccggatggtcgaaatgctgggccatgcaggggcgtcggactaa

SEQ ID NO: 29438 - protein, 571 aa, Silicibacter pomeroyi DSS-3
MAQQNVNAGLAAQDGLSHVQGASQPDLSNATIPQLLHTTVARGGANDALIFAGARLSYDAFAQAVDDLACGFLALGLQKGDRLGIWSPNRVEWVLTQFATARIGVILVNINPAYRLSELEYALNKVGCKALVLAPAFKASDYVEMIRTLAPELASCDKGGLRTARLPDLRHVIVMGENAGQCGEWAFGEIARMGGAEHRARLPDIDKTLNPDDPINIQFTSGTTGQPKGATLTHRNIVNNARFVTDRINLSERDRLAIPVPLYHCFGMVMGVLGAVSKGAAMVFPGEAFDPAQTLDTVEAERCTALYGVPTMFVAMLQELATTSRDLSSLRTGIMAGSPCPVDVMKQVNDRMHMGEVTICYGMTETSPVSFQSFVDDSTEKRCETVGRIHPHLEVKIVDDTGNTVPVGVQGELCTRGYSVMQGYWDDPERTAEAIRDGWMHTGDLAVLDADGFCTITGRVKDMIIRGGENIYPREIEEFLFGHPDIKEVQVFGIPDARMGEEVCAWVVAKPGCEISAEDVRTYCRGQIAHFKVPRHVRIVTELPMTITGKPQKFIMRDRMVEMLGHAGASD

SEQ ID NO: 29439 - DNA, 1659 bp, Archaeoglobus fulgidus DSM 4304; identical to SEQ ID NO: 13992
  CDS (1)..(1659)

SEQ ID NO: 29440 - protein, 552 aa, Archaeoglobus fulgidus DSM 4304; identical to SEQ ID NO: 13993

SEQ ID NO: 29441 - DNA, 1710 bp, Archaeoglobus fulgidus DSM 4304
  CDS (1)..(1710)
atgcttggtgtggaaggaaagagcataacagaaattgacgagaaggagataaacaggatctggctaaagcactacgatgaaggagttaggcccaacattgactaccccgaaattccgctgtatcagcttctggaggatacggcgaagaagtatcccgacaagaccgcgctgattttcttcggaaagaaaatcacgtacagagagcttgacgagatgagcgacagaattgcaggttttttgaagagcctcggcattaagaaaggagacagggtcattctggacctcccgaacgtgcctcagtatgttgcggcctactacggaattttaaaggtcggcgcgaccgttgtgcagtgcaaccctctctatactgagagggaaatcaggtacattcaggagaacagcgaggcggagtacggattctttgtcgaattcgtttatcctagaataaagggtcttttagctgaaggaaagttaaagaaagcggtaatctgtaaaattgaggattatctcccattccccctgaacatcctttatccgctcaagaaggagaaggtaagaatcgagaagagcgataaggtagtttactggaaagatgccttgaagtcaccgctaacaaaggaaaggcctgaaatcaaccccaaggatgatgtggcaatcttcctttacaccggaggtaccactggtgtgccaaaggctgtgatgtcgacgcacttcaatctcgtcgcgaatgtttaccagacacttgagtgggttgttgacagaactcctgatgatgtcttcattggagtgctgccctacttccacagctttggaatgacgacctcaatgaacgctccaatcgccaacggctcaaccatcgtcctgattcccgaccccagagacatcaagaggatacttgagagcattcagaagtacagggcgagcattttctgcggagttccgacgatgtatgcggcgataatcaaccaccccgatgtgaagaagtacgatttaagttcggtgaaagcatgtattagtggtgctgccccacttcccgttgaggttaagaggaggttcgaggagattacgggaggtaagctggttgagggctatggtttaagtgaaacctctcccgtagcacttggcaaccctgtttacggcctcaacaaggaggggagcattggcatacccttccccgacacctacgctgtcgttatagacgatgaaggaaaggttctcccaatcggtgaagttggagagctagttataaagggaccgcaggtaatgaagggctactacaagatggaggaagagacgaagaaggttctcgtcaatggctggctgctgactggagacatggcgaagatggacgaagatggatacttctacatcgtggacaggaagaaggatatgataattgcaggaggttacaacatctatccgagagaggttgaggaggtgctttacgagcatccagcagttgttgaggctgctgtagtaggagtgcccgacccctacaggggagagacggtcaaggcttacattgtcctgaagccggaatacaagggaaaggttaccgagcaggagataatccagttctgcaaggagagattggctgcatacaaggttccaaagcttgtcgagttcagagatgagctgccgaagtctgcggtaggaaaaatcctcaggagagttctgagagaggaggaaatcaagaaaataaaaggttaa

SEQ ID NO: 29442 - protein, 569 aa, Archaeoglobus fulgidus DSM 4304
MLGVEGKSITEIDEKEINRIWLKHYDEGVRPNIDYPEIPLYQLLEDTAKKYPDKTALIFFGKKITYRELDEMSDRIAGFLKSLGIKKGDRVILDLPNVPQYVAAYYGILKVGATVVQCNPLYTEREIRYIQENSEAEYGFFVEFVYPRIKGLLAEGKLKKAVICKIEDYLPFPLNILYPLKKEKVRIEKSDKVVYWKDALKSPLTKERPEINPKDDVAIFLYTGGTTGVPKAVMSTHFNLVANVYQTLEWVVDRTPDDVFIGVLPYFHSFGMTTSMNAPIANGSTIVLIPDPRDIKRILESIQKYRASIFCGVPTMYAAIINHPDVKKYDLSSVKACISGAAPLPVEVKRRFEEITGGKLVEGYGLSETSPVALGNPVYGLNKEGSIGIPFPDTYAVVIDDEGKVLPIGEVGELVIKGPQVMKGYYKMEEETKKVLVNGWLLTGDMAKMDEDGYFYIVDRKKDMIIAGGYNIYPREVEEVLYEHPAVVEAAVVGVPDPYRGETVKAYIVLKPEYKGKVTEQEIIQFCKERLAAYKVPKLVEFRDELPKSAVGKILRRVLREEEIKKIKG

SEQ ID NO: 29443 - DNA, 1674 bp, Archaeoglobus fulgidus DSM 4304
  CDS (1)..(1674)
atggtagttctctacgggaaggatgtggtggacagatacgttgcagagggatggtgggacaacgtaacgctttttgagagattcaggaggaactgcaagagaaatcctgaaaggactgctgttgttgaccctccaaacaaggaggagctcgtgggttttaagcctgaaaggttgagttatgctgagctcagcgattttgatgacagactggcctcatttctgctcgataacggagttttcaaggatagctgcgttttggtgcagcttcccaatacggtggagctaattgctgcatacctcgcaacgtggagggcttcagccttcatctctcccgttccaatgcagtggagggagcacgagatggggcatgtttgcagggttttgcagccaaaggttttcataacagcagacaccttcaaaggcttcgaccacgctcagatggcctccaggattaaggaggcttttccgagcattgagaaagtcgtaacgtattcccagctttacgagatttgcagaaactaccgcataagggaggatcttgatgaggcgtcatcctttgcatctggaaacgatattgccgtggtgcagtggacctcaggaaccgaagccgagcccaaagcctgtcccctctcccacaacaactggggctttctgcgctttctttacgatggagagagatacagaggagggctgctgagcgatggggatgttataatgaacccggcccccatagtgaatatgacaggaattggagttggcctcattccgtggatcatgtgctccggaacctttgttctgcaccaccccttcgaaccaatgctctacgtcaggcagctgattgaggagggtgtgaacttcactctcgctcctcctgctgttgttgttgcaattctaaaacatcccatggcttcacagctcagctttgacaagctgaagtacttcgcccaaggctcggcacctccaccaccatggacttttgtcgagctgaaaaacagggggatagagccgatgaacatctgggggcagaatgaggggactggactgttctcctacgacaggacaatccctgatctggagaagagggcaaggagctttcccattccggataaagtaagggatttgcccttcttcagggctatagagataaagattgttgacgagagtggtaaggagatgaaggagccgggcagtgtgggagagctgtgctacagaagcccacttacgatgccatgctactaccgccagcctgagttgacgaagaagtcctttgatgctgacggcttcttccacacaggtgatctgtttgaggtagttgatgatactacaatcgccttcttcgacagaaagaaggacataataatcagaggagggttcaatgtaagctccgctgaggtggaggacgtcgtcaagaagcaccccaacgtattggatgctgcagcagtgggtgttcctgacgagaggctcggggagagagttggcttgtacgttgttccaaagcccggcactaccgtaacgctggaagacataaagaagcacatggaggagagcggagttgcagtttacaagtggcctgaagtggtggttgttgttgacgagattccaagaaatcctgtggggaaggttctgaagagtaggctgaggaaggagatcgttgagaggatgaaagctggttaa

SEQ ID NO: 29444 - protein, 557 aa, Archaeoglobus fulgidus DSM 4304
MVVLYGKDVVDRYVAEGWWDNVTLFERFRRNCKRNPERTAVVDPPNKEELVGFKPERLSYAELSDFDDRLASFLLDNGVFKDSCVLVQLPNTVELIAAYLATWRASAFISPVPMQWREHEMGHVCRVLQPKVFITADTFKGFDHAQMASRIKEAFPSIEKVVTYSQLYEICRNYRIREDLDEASSFASGNDIAVVQWTSGTEAEPKACPLSHNNWGFLRFLYDGERYRGGLLSDGDVIMNPAPIVNMTGIGVGLIPWIMCSGTFVLHHPFEPMLYVRQLIEEGVNFTLAPPAVVVAILKHPMASQLSFDKLKYFAQGSAPPPPWTFVELKNRGIEPMNIWGQNEGTGLFSYDRTIPDLEKRARSFPIPDKVRDLPFFRAIEIKIVDESGKEMKEPGSVGELCYRSPLTMPCYYRQPELTKKSFDADGFFHTGDLFEVVDDTTIAFFDRKKDIIIRGGFNVSSAEVEDVVKKHPNVLDAAAVGVPDERLGERVGLYVVPKPGTTVTLEDIKKHMEESGVAVYKWPEVVVVVDEIPRNPVGKVLKSRLRKEIVERMKAG

SEQ ID NO: 29445 - DNA, 1773 bp, Mesorhizobium loti MAFF303099
  CDS (1)..(1773)
atgccggtcaatctcgacgagctgaagaacgccaccaatctgcgcggccgcgctgcgcgcgccggcagcgtctttatcgcacccgtcgacggcagggcgcatgtctcgggcgaccgcaaggtgccgctgctcgacaagaccattccggcgcttttctccgacacggccagcaaatacgccacgcaggatgccgccgtcttcgtcggccaggataagcgcttcacctggagcgaactgtcggacacggtggatgcgctggccgccggcttcctggcgctgggcctcgaaaagggcgaccgcgtcggcatctggtcgcccaaccgctgggaatggctggtgacgcagttcgccaccgcccgcatcggcttgatcctggtcaacatcaacccggcctaccggctgaccgaactggaatatgcgctgaacaaggtcggctgcaaggcgctggtgacggccgccagtttcaagacctcggactatctcggcatgatcgagacgctggcgccggagatcgcgaaggccacgccgggcaagctgaaggcgcaaaaattgccggcgctgaagatcgtcatccgcatgggcgaggacaattcgccgggcatgttcaatttcgccgacgtgttggccatggccggccgcgacgagcatgacagcctcgaccgcatttccgaggggctgaagccaggcgatgccatcaacatccagttcacctcaggcacgacaggcgcgcccaagggcgcgacgctgacgcaccacaacatcgtaaacaacggcaatttcgtcacctcggcgatcaaactcaccgtcgacgaccggctctgcatccctgtaccgctctaccattgcttcggcatgtcgatgggcacgatgggctgcgtcaccaagggcgcgaccatggtgtttccgggcgagggcttcgaccccggcgcaacgctgaaggcggtggcgcaggaacgctgcaccggcctctacggcgtgccgaccatgttcgtcggcatgctcgaccatgcggatttcgcgaccttcgacctctccagcctgcgcaccggcatcatggccggctcgccatgcccgatcgaggtgatgaagaaggtggtgtcgctgatgcatatgtccgaggtcaccatcgcctacggcatgaccgagaccagcccggtgtccttccagagcggcgtcgacgatccgcttgaaaagcgcgtctcgacagtcgggcgcatccaccctcatgtcgaggtcaaggccatcgacgccgacggcgccaccgttgcggtcggcgcgccgggcgagctctgcacgcgcggctattccgtgatgaagggctattgggacgacgccgaaaagacccgcgaggcgatcgacagcgacggctggatgcataccggcgacctcgccaccatcgatgccgagggctattgcaacatcgtcggccgggtcaaggacatggtcatccgcggtggcgagaacgtctatccccgagaggtcgaggaattcctctatcgccatcccaaagtcagagaagtgcaggtcttcggtattcccgacgccaaatacggcgaggagctgtgcgcctggatcgtgctcaagcctggccagatcgccactgagcaggagatcaaaaccttctgcgccggccagatcgcccactacaaaatcccgcgccacatccgcttccgcaccgaattgccgatgacggtgaccggcaagccgcaaaaattcctgatgcgtcaggcgatggtcgaggaattggggcttgtggcgcagaagacggcgtga

SEQ ID NO: 29446 - protein, 590 aa, Mesorhizobium loti MAFF303099
MPVNLDELKNATNLRGRAARAGSVFIAPVDGRAHVSGDRKVPLLDKTIPALFSDTASKYATQDAAVFVGQDKRFTWSELSDTVDALAAGFLALGLEKGDRVGIWSPNRWEWLVTQFATARIGLILVNINPAYRLTELEYALNKVGCKALVTAASFKTSDYLGMIETLAPEIAKATPGKLKAQKLPALKIVIRMGEDNSPGMFNFADVLAMAGRDEHDSLDRISEGLKPGDAINIQFTSGTTGAPKGATLTHHNIVNNGNFVTSAIKLTVDDRLCIPVPLYHCFGMSMGTMGCVTKGATMVFPGEGFDPGATLKAVAQERCTGLYGVPTMFVGMLDHADFATFDLSSLRTGIMAGSPCPIEVMKKVVSLMHMSEVTIAYGMTETSPVSFQSGVDDPLEKRVSTVGRIHPHVEVKAIDADGATVAVGAPGELCTRGYSVMKGYWDDAEKTREAIDSDGWMHTGDLATIDAEGYCNIVGRVKDMVIRGGENVYPREVEEFLYRHPKVREVQVFGIPDAKYGEELCAWIVLKPGQIATEQEIKTFCAGQIAHYKIPRHIRFRTELPMTVTGKPQKFLMRQAMVEELGLVAQKTA

SEQ ID NO: 29447 - DNA, 1635 bp, Arabidopsis thaliana
  CDS (1)..(1635)
atggaagatttgaagccaagtgccgctaactcgttaccattgacactgttaggctttcttgagagagcagccaccgtgtatggagactgtacctccatcgtttacggcaattccaccgtgtacacatggcgagaaacgaatcaccgttgcctctgcgtcgcgtctgctctgtcttccattggaataggaagatccgacgttgtctctgtcctatctgctaatactccggaaatgtacgagctccagttttccgttccgatgtctggcgcgatccttaacaacatcaatacccgcctcgacgcgcgaaccgtctctgttcttctccgccattgcgagtctaagctgctcttcgtcgacttcttttactccgatctcgctgtcgaagcgatcacgatgttgctcaatccgccgattctcgtcctaatcgccaatgaggaggaggaagaaggaggagctgaagtaacggagcgttcaaaattctgttacttgtacagtgatctaatcactagagggaatccggattttaaatggatccgacccggaagtgaatgggacccgattgtggtcaattacacatcaggtacgacgtcgtctcctaaaggagtggttcattgccacaggggtatattcgtcatgacgcttgattccctaaccgattgggccgtaccgaaaaccccggtttacttatggaccttaccgatatttcacgccaacggttggacctatccatggggaatcgccgccgtcggaggaactaacgtctgtgtgcgtaaactccacgcgccgtcaatataccatctaatccgtgatcacggcgtgactcacatgtacggcgcaccaatagtgcttcagattctatcggcgagtcaagaatctgatcagcctcttaagagtccggtcaatttcttaaccgccggttcttctccgccagctacggtgcttctccgcgccgagtctctaggtttcatcgtcagtcacggttacggattaacggagacagccggtgtgatcgtctcctgcgcgtggaagccaaactggaatcggttaccggcgagtgatcaagcgcaattgaaatcacggcaaggagtgagaaccgtcggatttagcgaaatcgatgtagtggatccagaatcaggtcggagcgtggagagagacggagaaacagtcggagaaatagtgttgagagggagttcaatcatgctcggatacttaaaaaatccgatcggaactcaaaattcgtttaaaaacgggtggttcttcaccggagacctcggtgtgattcacggggatggttacttagagattaaagatagatcgaaagatgtgattatttcaggaggagagaatgtgagtagtgtggaagtggaggcggtgttgtacacgaatccggcggtgaatgaagcggcggtggtggctagacctgacgagttttggggagagacgccgtgtgcttttgttagtttaaaacccgggttgacccggaaaccaacggataaggagattatagagtattgcaaatataaaatgccacgttacatggctcctaaaacggtctcgtttcttgaagagttaccaaagacttccactgggaagattataaagtcattgcttaaagagattgccaaaaacatgtaa

SEQ ID NO: 29448 - protein, 544 aa, Arabidopsis thaliana
MEDLKPSAANSLPLTLLGFLERAATVYGDCTSIVYGNSTVYTWRETNHRCLCVASALSSIGIGRSDVVSVLSANTPEMYELQFSVPMSGAILNNINTRLDARTVSVLLRHCESKLLFVDFFYSDLAVEAITMLLNPPILVLIANEEEEEGGAEVTERSKFCYLYSDLITRGNPDFKWIRPGSEWDPIVVNYTSGTTSSPKGVVHCHRGIFVMTLDSLTDWAVPKTPVYLWTLPIFHANGWTYPWGIAAVGGTNVCVRKLHAPSIYHLIRDHGVTHMYGAPIVLQILSASQESDQPLKSPVNFLTAGSSPPATVLLRAESLGFIVSHGYGLTETAGVIVSCAWKPNWNRLPASDQAQLKSRQGVRTVGFSEIDVVDPESGRSVERDGETVGEIVLRGSSIMLGYLKNPIGTQNSFKNGWFFTGDLGVIHGDGYLEIKDRSKDVIISGGENVSSVEVEAVLYTNPAVNEAAVVARPDEFWGETPCAFVSLKPGLTRKPTDKEIIEYCKYKMPRYMAPKTVSFLEELPKTSTGKIIKSLLKEIAKNM

SEQ ID NO: 29449 - DNA, 1635 bp, Arabidopsis thaliana; identical to SEQ ID NO: 14012
  CDS (1)..(1635)

SEQ ID NO: 29450 - protein, 544 aa, Arabidopsis thaliana; identical to SEQ ID NO: 14013

SEQ ID NO: 29451 - DNA, 1701 bp, Arabidopsis thaliana
  CDS (1)..(1701)
atggcggcgacacatcttcacataccgccaaatcctaaaacccaaacgtctcaccaaaaccctcccttttggttctcttctaaaacaggaatctacaccagcaaattcccttccctacacctccccgtcgacccaaatctcgacgccgtctccgctcttttctcacacaaacaccacggcgatacagcgctcatcgattccttaaccgggttctcaatatctcacactgagctacagattatggttcaatcaatggcggctgggatctatcacgttttaggtgttcgtcaaggtgacgttgtatcactcgtcttgcctaattccgtctattttccgatgattttcctctctttgatctcgcttggtgctattgttactaccatgaatccttcgagtagtttaggagagattaagaagcaagttagtgagtgtagtgttggattagcttttacttctactgaaaacgttgagaagctgagttctttgggggttagtgtgattagtgtatctgaaagttacgattttgattcgattcgtatcgaaaacccgaagttttactccattatgaaagaaagttttgggtttgtaccaaaaccgttgattaagcaagacgatgtagctgcaattatgtattcatctggaacaactggagctagtaaaggagttttgttaactcataggaatttgatagcatcaatggagctttttgtgaggtttgaagcttctcagtacgaatatccgggatcgagtaatgtttatctagcagctttgcctttgtgccatatctacgggttatcactctttgtgatgggattgttgtctctgggatcaactattgttgttatgaagaggtttgatgcttctgatgttgttaatgtaattgaaaggtttaagatcactcatttcccggttgttccacctatgttgatggcattgacaaagaaggcaaaaggagtttgtggtgaagtgtttaaaagtttgaagcaagtttcttctggagcagctcctttgagtaggaagttcattgaagatttccttcagactcttcctcatgtcgatttgattcagggatatggaatgactgaatcaactgcagttggaacacggggcttcaactcggaaaagcttagtaggtattcttctgtgggactactggctcctaatatgcaagccaaggtagtagattggagctctggttctttccttccaccaggaaaccgaggagagctctggatacaaggtcccggtgtcatgaaaggatacttgaataacccaaaagcaactcagatgagtatagttgaagatagttggctacgtactggggatattgcttattttgatgaagatggttacttgtttattgttgaccgtattaaggagattataaagtacaaaggctttcagatcgctccagcagatttggaggctgttcttgtttcacatcccttgattatcgacgctgcagtaacagctgccccaaatgaagaatgtggagagattccggtagcattcgttgtccggagacaagaaacaacactttcagaagaagatgtaataagctatgtagcttctcaggttgcaccctacaggaaggtgaggaaagtggtgatggtcaactctataccaaaatctccaactgggaagatattgagaaaggaactaaagagaattcttacaaactctgtttcttcaagactatga

SEQ ID NO: 29452 - protein, 566 aa, Arabidopsis thaliana
MAATHLHIPPNPKTQTSHQNPPFWFSSKTGIYTSKFPSLHLPVDPNLDAVSALFSHKHHGDTALIDSLTGFSISHTELQIMVQSMAAGIYHVLGVRQGDVVSLVLPNSVYFPMIFLSLISLGAIVTTMNPSSSLGEIKKQVSECSVGLAFTSTENVEKLSSLGVSVISVSESYDFDSIRIENPKFYSIMKESFGFVPKPLIKQDDVAAIMYSSGTTGASKGVLLTHRNLIASMELFVRFEASQYEYPGSSNVYLAALPLCHIYGLSLFVMGLLSLGSTIVVMKRFDASDVVNVIERFKITHFPVVPPMLMALTKKAKGVCGEVFKSLKQVSSGAAPLSRKFIEDFLQTLPHVDLIQGYGMTESTAVGTRGFNSEKLSRYSSVGLLAPNMQAKVVDWSSGSFLPPGNRGELWIQGPGVMKGYLNNPKATQMSIVEDSWLRTGDIAYFDEDGYLFIVDRIKEIIKYKGFQIAPADLEAVLVSHPLIIDAAVTAAPNEECGEIPVAFVVRRQETTLSEEDVISYVASQVAPYRKVRKVVMVNSIPKSPTGKILRKELKRILTNSVSSRL

SEQ ID NO: 29453 - DNA, 1689 bp, Arabidopsis thaliana
  CDS (1)..(1689)
atgctgacgaaaaccaacgacagccgtttgattgaccggagctccggcttcgatcaacggacaggaatctatcacagtcttcgtccctctctttctctacctcctatagatcaacctctctccgccgccgaattcgcgctttctctcctactcaaatcctcaccacctgccaccgccgggaaaaacattgaagccttaacctacctagttaactcgagctctggtgataacctcacttatggagagcttcttcgtagagttcgttctcttgctgtatctctccgggagcgatttccttctcttgcctccagaaatgtcgcttttatcctctctccttcttcgttggacataccagtgctttacttagctttgatgtcgatcggtgttgttgtttcaccggcgaacccaatcggatctgaatcggaggtgagtcatcaagtcgaagtcagtgaaccagtaattgcgttcgcgacatcgcagacggttaagaagcttcaatcctcttctttgcctctcggaactgttctgatggactcgactgagtttctctcctggttaaatcgatcggattcttcatcggttaatccatttcaggttcaggtcaaccaatcggaccctgccgctatcctcttttcctctggaacaaccgggcgggtcaaaggcgttttgctcactcaccgtaacctaatcgcctcgaccgccgtatctcaccaacggactctccaagatccggttaattacgatcgcgttggactgttctcgcttccgctcttccacgtgtttggtttcatgatgatgattcgagccatctcgcttggagagacattggtgcttttagggagatttgaactcgaggcgatgtttaaggcggtggagaaatataaggttactggtatgcctgtatctcctccgttgattgtagcgttggtcaaatcggagctcacgaagaagtacgatctccggtcgttgcgttcccttggctgcggaggagctccactcggcaaagacatcgcagagaggtttaagcagaaattcccagatgtagatattgtacagggctatggcttgacagagagctcgggaccagctgcctcaacgtttggacctgaagagatggtaaaatatggctcagttggtcgtatctctgagaatatggaagccaaaattgttgatccatccaccggagaatccttgccaccgggaaaaactggtgaactctggctccgaggaccagtcatcatgaaaggttatgtgggaaacgagaaagcgagtgcggagacagtagacaaagaagggtggttaaagactggtgatctctgttattttgattcggaagattttctatatattgttgatcggctaaaggagctaatcaaatacaaggcttatcaggttccaccggtagagttggagcagattcttcactcgaatccagatgtgattgatgctgcagttgttccgttccctgacgaggatgcaggagagattccaatggctttcatagtgagaaaaccaggaagcaatctcaacgaagcgcaaatcattgatttcgtagctaaacaagttactccgtacaagaaggtaagacgagttgcttttataaatgcaatcccaaaaaatcctgctggcaagattctgcgtcgggagcttactaaaatcgctgtggatggcaatgcatcaaaactttga

SEQ ID NO: 29454 - protein, 562 aa, Arabidopsis thaliana
MLTKTNDSRLIDRSSGFDQRTGIYHSLRPSLSLPPIDQPLSAAEFALSLLLKSSPPATAGKNIEALTYLVNSSSGDNLTYGELLRRVRSLAVSLRERFPSLASRNVAFILSPSSLDIPVLYLALMSIGVVVSPANPIGSESEVSHQVEVSEPVIAFATSQTVKKLQSSSLPLGTVLMDSTEFLSWLNRSDSSSVNPFQVQVNQSDPAAILFSSGTTGRVKGVLLTHRNLIASTAVSHQRTLQDPVNYDRVGLFSLPLFHVFGFMMMIRAISLGETLVLLGRFELEAMFKAVEKYKVTGMPVSPPLIVALVKSELTKKYDLRSLRSLGCGGAPLGKDIAERFKQKFPDVDIVQGYGLTESSGPAASTFGPEEMVKYGSVGRISENMEAKIVDPSTGESLPPGKTGELWLRGPVIMKGYVGNEKASAETVDKEGWLKTGDLCYFDSEDFLYIVDRLKELIKYKAYQVPPVELEQILHSNPDVIDAAVVPFPDEDAGEIPMAFIVRKPGSNLNEAQIIDFVAKQVTPYKKVRRVAFINAIPKNPAGKILRRELTKIAVDGNASKL

SEQ ID NO: 29455 - DNA, 1641 bp, Bacillus halodurans C-125; identical to SEQ ID NO: 13982
  CDS (1)..(1641)

SEQ ID NO: 29456 - protein, 546 aa, Bacillus halodurans C-125; identical to SEQ ID NO: 13983

SEQ ID NO: 29457 - DNA, 1542 bp, Bacillus halodurans C-125
  CDS (1)..(1542)
atgctggaaaaagattattctgtttttcctcttttgtatcaggctgtgcaagcaaacccaaaaaaggaagcgctttacgatcttaacgaacggatcacatatgagcaattgcttgaaagagttaatgaactagcagcgattttcatagagatgggggtcgtcaagggggaccgaatcggcgtttgtctaccgaattggaatgaaacagtgatcatcttttttgcagcggcaaagcttggtgcaacggtagtcccgtttaatccaaactatcgggaatatgaaattgcctacattgtcgccaatgctgcgccaaagctattgttcgtctgtgaaaaggtagaagaaaatgtcggacttgccgccctagtagccgatcaacggcaacttatttcggtaaggttcaaaagcccctttgcgattccttttgagcaattgaagcgaacaaacaagtccgccatcgatgtctcaatcgttccgtcacatgaacgttactgcattttgtacacatctgggacgactggattaccaaaaggggtcatgatcacacacagcagtgttgtgcaatctgggctcgcccttgctcgtagcctgaaatgcacgaaagacgatgtctttatcgttccagctccgttattccatattttcggaatggcttgtaacttaatggctgccgtctcatgccaggcgaaggtcattttacaagaaaagttcaagccagaccatacgttagcattaattgagcaagagaaggtgacgattcatcaagctgttccgaccatgtttattttggaattaaatcaccccgatttctcaacttttgacttatcttcactacgagctggtatggttggtgcagccccatgtccgaaagaaaccgtacaagagattcgcaaaagaatgggattccacctttgtatttcttacgggatgaccgaagttggcgccgcaacgattacgccttatgaggatgaagacgaaagcagtcttgatactgtaggaaagccgatggaaggtgtcgagataacgatcgttaatgaggatagagaacctcttcccgttggggatattggcgagattgcgattcgaggcttcggcaatatgatcggttattacaagctacctgaacaaacaaatgaagtactcggcgacaacggctggttttacactggtgacctcggttctttagacgaagaaggttatcttcgttttatcggccgaaagaaggagttaatcattcgcggtggttataacatttatccgcaagaaattgaagcgattttatccgaacatgaaaaagtccaggagtcagcagttattggacttccagatgaggttcttggtgagcttgtatgtgctggcattaagctaaagcaaggggctcattcaagcgagcaagaactgttagcttacttaagcaagcgaatcgctcattacaaagtacctagtaaaatcgtatttgttgaggaattgccggtcaccgcaagtgggaaagttcaaaagagtcaacttcgtgagcagatcattgaaacaatcaagtcttaa

SEQ ID NO: 29458 - protein, 513 aa, Bacillus halodurans C-125
MLEKDYSVFPLLYQAVQANPKKEALYDLNERITYEQLLERVNELAAIFIEMGVVKGDRIGVCLPNWNETVIIFFAAAKLGATVVPFNPNYREYEIAYIVANAAPKLLFVCEKVEENVGLAALVADQRQLISVRFKSPFAIPFEQLKRTNKSAIDVSIVPSHERYCILYTSGTTGLPKGVMITHSSVVQSGLALARSLKCTKDDVFIVPAPLFHIFGMACNLMAAVSCQAKVILQEKFKPDHTLALIEQEKVTIHQAVPTMFILELNHPDFSTFDLSSLRAGMVGAAPCPKETVQEIRKRMGFHLCISYGMTEVGAATITPYEDEDESSLDTVGKPMEGVEITIVNEDREPLPVGDIGEIAIRGFGNMIGYYKLPEQTNEVLGDNGWFYTGDLGSLDEEGYLRFIGRKKELIIRGGYNIYPQEIEAILSEHEKVQESAVIGLPDEVLGELVCAGIKLKQGAHSSEQELLAYLSKRIAHYKVPSKIVFVEELPVTASGKVQKSQLREQIIETIKS

SEQ ID NO: 29459 - DNA, 1695 bp, Pseudomonas aeruginosa PAO1
  CDS (1)..(1695)
atgaatcagccgagctatacctcgggtcgccaggatgtcgccttgctggcgaccaccgtcggcgacgccttcgatgccaccgtcgcgcgtcatgccgagcgcgaggcgctggtggtgcggcatcaacgcctgcgctacagctggcggcaactggcggagcgggtcgatgcctacgcccgcgccttcatcgccctgggcctgcgccccggcgagcgcctggggatctgggcgccgaactgcgccgaatggtgcattacccagttcgccagcgccaaggtcggtgcggtcctggtgaacatcaacccggcataccgcagcagcgagctggaatacgctctcaagcagtccggttgcagttggctgatctgcgccgacgccttcaagaccagcgactaccacgcgatgctcggcgacctgctgccggagctggcgcgggcgcgtccgggcgaactggccagcgagcgcctgccggaactgcgcggcgtgatcagcctggccgagcgggcgccggcgggcttcctgcactggcagggcctgccggggctggccgccgcggtaggcgccgaggaactgcgccagcgccaggcctcgctacagttcgacgagccgatcaacatccagtacacctccggtaccaccggcttccccaagggcgccaccctcagccactacaacatcctcaacaacggctacatggtcggcgaaagcctcggactcggcgcggaagaccgcctggtgatcccggtgccgctgtatcactgcttcggcatggtgatgggcaacctcggctgcgtcacccacggctcgaccatgatctacccggcgcccagcttcgacgccgaggcgaccctgctggccgtggccgaggagcgcgccaccgcgctgtacggggtaccgaccatgttcatcgccgagctggatcatccgcgccgccgcgaattcgacctttccagcctgcgcaccggaatcatggccggcgccacctgcccgatcgaggtgatgcggcgggtcattggcgacatgcacatggccgaggtgcagatcgcctacggcatgaccgagaccagtccggtgtcgctgcagaccggtccggacgatggcctggagctgcgcgtgaccactgtcggacgcacccagccgaggctggagagcaagatcgtcgaccagacgggcagggtggtgccgcgcggcgagatcggcgagctgtgcacccgcggctacagcgtgatgctcggctactggaacgacccccaggccaccgccgaggccatcgacccggcgcgctggatgcacaccggcgacctggcggtgatggacgacgacggctacgtgcggatcgtcgggcgcagcaaggacatgatcatccgcggcggcgagaacatctatccgcgcgaactggaggagttcttcttcactcacccggcggtggccgacgtgcaggtgatcggcatccccgacgagcgctatggcgaggaaatcgtcgcctggatcaagctgcatccgggccaccacgccgatgacgaacagttgcgggcgttctgcaaggcgcgtatcgctcacttcaagatcccgcgccacttcaagttcgtcgacgagttcccgatgaccgttaccggcaagatccagaagttccgcatgcgcgagatcagcatcgaagagattcgcctactcgcgctgcgccaggggcgcgattga

SEQ ID NO: 29460 - protein, 564 aa, Pseudomonas aeruginosa PAO1
MNQPSYTSGRQDVALLATTVGDAFDATVARHAEREALVVRHQRLRYSWRQLAERVDAYARAFIALGLRPGERLGIWAPNCAEWCITQFASAKVGAVLVNINPAYRSSELEYALKQSGCSWLICADAFKTSDYHAMLGDLLPELARARPGELASERLPELRGVISLAERAPAGFLHWQGLPGLAAAVGAEELRQRQASLQFDEPINIQYTSGTTGFPKGATLSHYNILNNGYMVGESLGLGAEDRLVIPVPLYHCFGMVMGNLGCVTHGSTMIYPAPSFDAEATLLAVAEERATALYGVPTMFIAELDHPRRREFDLSSLRTGIMAGATCPIEVMRRVIGDMHMAEVQIAYGMTETSPVSLQTGPDDGLELRVTTVGRTQPRLESKIVDQTGRVVPRGEIGELCTRGYSVMLGYWNDPQATAEAIDPARWMHTGDLAVMDDDGYVRIVGRSKDMIIRGGENIYPRELEEFFFTHPAVADVQVIGIPDERYGEEIVAWIKLHPGHHADDEQLRAFCKARIAHFKIPRHFKFVDEFPMTVTGKIQKFRMREISIEEIRLLALRQGRD

SEQ ID NO: 29461 - DNA, 1647 bp, Methanothermobacter thermautotrophicus str. Delta H
  CDS (1)..(1647)
atggttttcactgaagatacaataggggaattcttcgagaaacaggttgaaaggtacgctgataaggaattcatagtataccccgacagggacctgcgtttcacctacagagaattcaatgaaagggtcaacctccttgcgaagggcctcctatctattggcatcgggaagggggaccacgttggtatctgggcaaccaatgtacctgactggctcaccttcctgttcgcaactgcaaagataggggcggtccttgtaacggtcaacacagcatataagagtcatgaactggaatacgtcatgaaacagtccgatatgaaggccctagccataatagacggcttcagggatgttgactatgtacagacactctatgaactggtacctgaactcaagacccatgagaggggccacctcaggagtgaaaggttccctgaacttcgaagcgtaatatacatcggtgctcagaagcacaggggtatgtacaacaccaatgaactgatgctcctcggaaaacacgtccctgacaccgagctaaggacggtgatgtcaaccctcaaaaacaccgatgttatcaacatgcagtacacctcaggcaccacaggattccccaagggggtaatgctcacccacaggaacatactcaacaacggttactacataggggaaagacagaggttcacagaggaggacaggctatgcctgccggtacccctctttcactgcttcggcatagtcctgggtgtccttgccctcctcacccacgggggcacactggtgatgatagagctcttcgaccccctcctcgtccttgcagctgttgaaaaggagaggtgcaccgcactctacggagttccaacaatgttcatagcagagttcacccacccaatgtttgacatgttcgacctctcctcactgcgcacgggtatcatggcagggtcaccctgcccgatagaggccatgaagcgtgtcatgaatgacatgaacatgaaggaggtcacaatagcctacggcctcacagaggcatcacctgtcttcacacagaccagtgtggacgaccccatcgagaagcgcgtcgagaccgttgggacacccctcccccacattgaggtcaagatagtcgaccctgaaacaggagaggaactcggacccggagaacccggtgagatatgctgccgcggctacaacgtcatgaagggatactacaagatgcctgagatgacagcagaggccatcgatgaggatggatggctccacagcggtgacctggcggttatggatgaggacggctactactccatcgtgggcagaataaaggacatgatcataaggggaggtgagaacatctaccccagggagatcgaggagttcctccacacaatgccgggtgtaaaggacgtgcaggtggtgggtatacccgacgagaagtacggggagatagtaggagccttcatcataagggaggacggtgcagatatcctggaggaggacgtgagggactatgccatccagagaatagcaagatacaaggttccaaagcacgtcttctttgtggacgagttccccctcactgcaagcgggaaggtccagaagttcaaattgagggagatggcggttgagctcctcaagaagaaggagcagccctga

SEQ ID NO: 29462 - protein, 548 aa, Methanothermobacter thermautotrophicus str. Delta H
MVFTEDTIGEFFEKQVERYADKEFIVYPDRDLRFTYREFNERVNLLAKGLLSIGIGKGDHVGIWATNVPDWLTFLFATAKIGAVLVTVNTAYKSHELEYVMKQSDMKALAIIDGFRDVDYVQTLYELVPELKTHERGHLRSERFPELRSVIYIGAQKHRGMYNTNELMLLGKHVPDTELRTVMSTLKNTDVINMQYTSGTTGFPKGVMLTHRNILNNGYYIGERQRFTEEDRLCLPVPLFHCFGIVLGVLALLTHGGTLVMIELFDPLLVLAAVEKERCTALYGVPTMFIAEFTHPMFDMFDLSSLRTGIMAGSPCPIEAMKRVMNDMNMKEVTIAYGLTEASPVFTQTSVDDPIEKRVETVGTPLPHIEVKIVDPETGEELGPGEPGEICCRGYNVMKGYYKMPEMTAEAIDEDGWLHSGDLAVMDEDGYYSIVGRIKDMIIRGGENIYPREIEEFLHTMPGVKDVQVVGIPDEKYGEIVGAFIIREDGADILEEDVRDYAIQRIARYKVPKHVFFVDEFPLTASGKVQKFKLREMAVELLKKKEQP

SEQ ID NO: 29463 - DNA, 1698 bp, Mycobacterium tuberculosis CDC1551
  CDS (1)..(1698)
atgccaccgaaggcggcagatggccgccgacccagtcccgacggcggactgggtggctttgtaccgttccccgcggatcgggccgcgtcgtaccgggcggccggctattggtcggggcgaaccctggacaccgtgctctccgatgccgcgcggcgctggcctgaccgcctcgcggtggccgacgccggtgatcgtcccggccacggcggcctcagttacgccgaactcgaccagcgggccgaccgggccgccgcggcgctgcacggcctgggcatcacgccaggcgaccgggtactgctccagctgccaaacggctgccagttcgcggttgccctgttcgcgttattgcgggcgggagcgatcccagtgatgtgcctgcccggtcaccgcgccgccgaattgggccacttcgccgccgtcagcgcggccaccgggctggtggtcgccgatgtggccagcgggttcgactatcggccgatggcgcgcgaacttgttgccgatcaccccaccctgcgccatgtcatcgtcgatggcgatccgggaccgttcgtgtcgtgggcgcagctgtgcgcccaggccggcaccggttcgccggcaccgccggccgatcccggatcgccagcgctgctgctggtctccggcggcaccactggcatgcccaaactcattccacgcacccacgacgactacgtgttcaacgcgacggccagcgccgcactctgtcggcttagcgccgacgacgtctatctggtggtgctggccgccggccacaatttcccgctggcctgcccgggcctgctcggcgcgatgaccgtcggggccaccgccgtgttcgcccccgatcccagcccggaggccgccttcgccgccatcgagcgccacggtgtcaccgtcaccgcgttggttccggcactggccaaactgtgggcccaatcctgtgagtgggagccggtgacaccgaagtcactgcggttgttgcaggttggcgggtccaagctagaacccgaggacgctcgccgggtacgcaccgcgctcaccccgggcctgcagcaggtgttcggcatggcggaggggctgctgaacttcacccgcatcggcgacccacccgaagtggtggagcacacccaggggcggccactatgcccggccgacgaactgcgcatcgtcaacgccgatggtgagccggtggggcccggggaggaaggcgaactcttggtgcgcgggccctacacgctgaacggctattttgctgccgaacgcgacaacgagcgctgcttcgatccggacggcttctaccgcagcggcgacctggtccgccgccgcgacgacggcaatctggtggtcaccgggcgcgtcaaggatgtcatctgccgtgcgggagaaaccatcgccgccagcgacctcgaagaacagctgctgagccatccggcgatcttctcggccgcggcggtgggactacctgaccagtatctgggggaaaaaatctgcgctgcagtcgttttcgctggagctccgattacgcttgcggagttgaacggctaccttgaccggcgtggtgtggccgcgcatacgcgacccgaccagctggtcgcgatgccggcgctgcccacaacgccgatcgggaagatcgacaaacgagcgatcgtccgccagctcggcatcgcgacgggtcccgtgacgacccagcgctgccattga

SEQ ID NO: 29464 - protein, 565 aa, Mycobacterium tuberculosis CDC1551
MPPKAADGRRPSPDGGLGGFVPFPADRAASYRAAGYWSGRTLDTVLSDAARRWPDRLAVADAGDRPGHGGLSYAELDQRADRAAAALHGLGITPGDRVLLQLPNGCQFAVALFALLRAGAIPVMCLPGHRAAELGHFAAVSAATGLVVADVASGFDYRPMARELVADHPTLRHVIVDGDPGPFVSWAQLCAQAGTGSPAPPADPGSPALLLVSGGTTGMPKLIPRTHDDYVFNATASAALCRLSADDVYLVVLAAGHNFPLACPGLLGAMTVGATAVFAPDPSPEAAFAAIERHGVTVTALVPALAKLWAQSCEWEPVTPKSLRLLQVGGSKLEPEDARRVRTALTPGLQQVFGMAEGLLNFTRIGDPPEVVEHTQGRPLCPADELRIVNADGEPVGPGEEGELLVRGPYTLNGYFAAERDNERCFDPDGFYRSGDLVRRRDDGNLVVTGRVKDVICRAGETIAASDLEEQLLSHPAIFSAAAVGLPDQYLGEKICAAVVFAGAPITLAELNGYLDRRGVAAHTRPDQLVAMPALPTTPIGKIDKRAIVRQLGIATGPVTTQRCH

SEQ ID NO: 29465 - DNA, 1644 bp, Mycobacterium tuberculosis CDC1551
  CDS (1)..(1644)
gtggcagccgcggaagtcgtagaccccaatcggctttcctatgatcgcggtccgagtgcgccatcattgctcgagtcgaccatcggcgccaacctcgcagcgaccgctgccaggtacggacatcgggaagcactcgtggacatggtggcccggcgacggttcaattacagcgaactgctgactgacgtgcaccggctggcgacggggctggtgcgggcggggatcggcccgggcgatcgggtcggcatctgggcaccgaaccggtgggagtgggtgctcgtccagtacgcgaccgctgagatcggcgcgatcctagtgaccataaaccccgcctatcgggtccgcgaagtggagtatgcgcttaggcagtccggtgtcgcgatggtgattgccgtagcgagtttcaaggatgcggactatgccgcgatgctggccgaggttgggccgcgatgccccgatctggccgacgtgattttgctggaaagcgatcgctgggacgcgctggcgggtgccgagcccgatctgcctgcgctgcagcagaccgcggcgaggctagacggcagtgatccggtaaacatccaatacacctccggcacaacggcatacccgaagggtgtcacgctaagccaccgcaatatcctcaacaacggctacctggtgggcgagctgctcgggtacaccgcacaagatcggatttgcatcccggtgcccttctaccactgcttcggcatggtaatgggaaatctggcggccaccagtcacggggcggccatggtgatcccggcgccgggctttgaccctgcggccacgctgcgcgcggtgcaggacgagcgatgcaccagcttgtacggcgtgccgacgatgttcatcgccgagctgggcctgccggacttcaccgactacgaactgggcagtctgcgcaccgggattatggccggcgccgcgtgcccggtcgaggtgatgcgcaaggtgatctcacgcatgcatatgcccggggtctcgatctgctatggaatgaccgaaacgtcaccggtttccacgcagacgcgcgccgacgactcggtggatcgacgggtcggcacggtcggtcgggtgggtccacaccttgagatcaaggtggtggatccggccacgggcgagacggtcccgcgcggggtggtcggcgagttctgcacgcgaggctattcggtgatggccgggtactggaatgacccgcagaagactgcggaggtgatcgacgccgacggctggatgcacaccggagatctggctgagatggacccgtccgggtacgtgcggatcgccggccggatcaaagacctcgtcgtccggggcggcgagaacatctcgccgcgggagatcgaggaactcctccacacgcatcccgatattgtcgacggtcacgtcatcggggtgcccgacgccaaatacggcgaagagctcatggcggtggtcaagctgagaaacgacgcgccggaactgaccatcgagcggctgcgcgagtactgcatgggccgcatcgcgcgattcaagatcccgcggtacctgtggatcgtcgacgagttcccgatgaccgtcaccggcaaagtacgcaaagtggagatgcgacaacaggcgctcgaatacctccgcggccaacagtga

SEQ ID NO: 29466 - protein, 547 aa, Mycobacterium tuberculosis CDC1551
MAAAEVVDPNRLSYDRGPSAPSLLESTIGANLAATAARYGHREALVDMVARRRFNYSELLTDVHRLATGLVRAGIGPGDRVGIWAPNRWEWVLVQYATAEIGAILVTINPAYRVREVEYALRQSGVAMVIAVASFKDADYAAMLAEVGPRCPDLADVILLESDRWDALAGAEPDLPALQQTAARLDGSDPVNIQYTSGTTAYPKGVTLSHRNILNNGYLVGELLGYTAQDRICIPVPFYHCFGMVMGNLAATSHGAAMVIPAPGFDPAATLRAVQDERCTSLYGVPTMFIAELGLPDFTDYELGSLRTGIMAGAACPVEVMRKVISRMHMPGVSICYGMTETSPVSTQTRADDSVDRRVGTVGRVGPHLEIKVVDPATGETVPRGVVGEFCTRGYSVMAGYWNDPQKTAEVIDADGWMHTGDLAEMDPSGYVRIAGRIKDLVVRGGENISPREIEELLHTHPDIVDGHVIGVPDAKYGEELMAVVKLRNDAPELTIERLREYCMGRIARFKIPRYLWIVDEFPMTVTGKVRKVEMRQQALEYLRGQQ

SEQ ID NO: 29467 - DNA, 1503 bp, Mycobacterium tuberculosis CDC1551
  CDS (1)..(1503)
gtgcccgcggcgctggatcgtctcgtgcgccagctacccgaccacacggcgttgatcgccgaggaccggcgtttcacgtcgaccgagctgcgcgacgcggtctacggcgccgcggcggcgctgatcgccctcggtgtcgaacccgcagaccgggtggccatctggtcgccgaacacctggcactgggtggtggcctgcctggcgatccaccacgccggcgccgcggtggtgccgttgaacacccgctacaccgccacagaagccaccgacatcttggaccgagccggcgcgccggtgctgttcgcggcgggcctcttcctgggcgccgaccgggcggccggcctggaccgggccgcgctgcccgcgttgcggcacgtcgtgcgggtgccggtcgaagccgacgacgggacctgggacgagttcatcgccacgggtgccggggccctggatgccgtcgcagcccgtgccgccgccgtcgcaccccaggacgtcagcgacatcctgttcacctccggcaccaccggccgcagcaaaggcgtgctgtgcgcgcaccggcagtcgctgtcggcctcggcatcctgggccgccaacgggaagatcaccagcgacgaccgctacctgtgcatcaacccgttcttccacaacttcggctacaaggccggcatcctggcctgcctgcagaccggtgccacgctgatcccgcacgtgacgttcgatccgctgcacgcgctgcgggccatcgagcgccaccgcatcaccgtgttgccgggccctccgaccatctaccagagcctgctggatcacccggcccgcaaagacttcgacctgagctcgctgcggttcgcggtcaccggtgcggccaccgtgccggtggtgctggtggagcgcatgcagtccgaacttgacatcgacatcgtgctgaccgcctacgggttgaccgaggccaacgggatggggacgatgtgccgccccgaggacgacgcggtgaccgttgcgacgacgtgcgggcggccgttcgccgactttgagttgcgcattgcggacgacggggaagtgttgctgcgcgggccgaacgtcatggtgggctatctggacgacacggaggcgaccgcggccgccatcgacgccgacggctggctgcacaccggcgacatcggtgccgtcgaccaggcgggcaacctgcgcatcaccgaccgcctgaaggacatgtacatctgcggcggattcaacgtctatcccgctgaggtcgagcaggtgctggcccggatggacggcgtcgcggacgccgcggtgatcggcgttcccgaccagcggctgggcgaggtcggccgggcgttcgtggtggcgcgccccggcacgggcctcgacgaggcatcggtgatcgcttacacccgtgaacatttggcgaacttcaagacaccccggtcggtgcggttcgtcgacgtactgccgcgcaacgccgccggtaaggtaagcaaaccacaactgcgagagctgggctag

SEQ ID NO: 29468 - protein, 500 aa, Mycobacterium tuberculosis CDC1551
MPAALDRLVRQLPDHTALIAEDRRFTSTELRDAVYGAAAALIALGVEPADRVAIWSPNTWHWVVACLAIHHAGAAVVPLNTRYTATEATDILDRAGAPVLFAAGLFLGADRAAGLDRAALPALRHVVRVPVEADDGTWDEFIATGAGALDAVAARAAAVAPQDVSDILFTSGTTGRSKGVLCAHRQSLSASASWAANGKITSDDRYLCINPFFHNFGYKAGILACLQTGATLIPHVTFDPLHALRAIERHRITVLPGPPTIYQSLLDHPARKDFDLSSLRFAVTGAATVPVVLVERMQSELDIDIVLTAYGLTEANGMGTMCRPEDDAVTVATTCGRPFADFELRIADDGEVLLRGPNVMVGYLDDTEATAAAIDADGWLHTGDIGAVDQAGNLRITDRLKDMYICGGFNVYPAEVEQVLARMDGVADAAVIGVPDQRLGEVGRAFVVARPGTGLDEASVIAYTREHLANFKTPRSVRFVDVLPRNAAGKVSKPQLRELG

SEQ ID NO: 29469 - DNA, 1650 bp, Bacillus subtilis subsp. subtilis str. 168
  CDS (1)..(1650)
atggctgaactcatccattccacaatcggcaggctgctggaacaaacagctgatgcgtatcccgatcgagatgctgttgtgtatccagaccgaaatatccgctatacgtacgctcaatttgacagtctgtgccgtcaaaccgctaaaggtctcatgcggatggggattggaaaaggagaccacgtcgccatatgggcttctaatatctctgaatggcttgccgtccagttcgcaactgcgaagatcggagccgtgctcgtgaccgtcaataccaattatcaagcacatgagcttgattacttgttaaagcaatcggatgccgcggcgcttattatcatggattcatacaggggcacttcttatccagacatcgtgaacagtttaattccagaactgcaagaagcaaagcccggccaactgaaatctgaacgctatccctttttaaaaacgctgatctatattggcaataaacgattgtctggcatgtatcattgggacgatacagagatattggcgaaaacagtgacagatgctgagcttgaagagagaatgaacagcctggataaagacaatgtgattaatatgcaatacacatcaggaacgacagggtttccaaaaggcgtgatgctgacccatttcaatgtcatcaataacgctgctaatatcgctgaatgtatggctttaacctctcaagaccgcatgtgcatccctgttccgttttttcactgctttggatgcgtccttggggttttggcatgtgtatccgtcggggcagccatgatacccgtgcaagaatttgatcccgttaccgtccttaaaacggtagaaaaagagaaatgcacagtgctccatggtgtgcctaccatgtttatcgccgagctgcatcatccggattttgatgcatatgatctatcgacgctccgaacaggaatcatggccggctctccctgtccaagtgaagtgatgaaagctgtgattgaaaggatgggcatgaaagacattacgatcgcctatggacaaaccgaagcctcgccagtcattacacaaacgagagcaaatgattccttcataagaagagtcgaaacaaccggccgtgccctgccacatactgaggtgaaaattgtagaacccgggacatgtcaagaagttcaaagaggcatgcagggagaactgtgcacccgtggctatcacgtcatgaaaggctattataaagacaaagatgcgaccagaaaagcaatcaatcatgacggatggctgtttaccggagatcttgctgtcatggatgaagacgggtactgccgcatcaccggaagattaaaagatatgctcatcagaggcggcgagaacatttatccgcgggaaattgaagaatttttataccagcatcccgctgttttagatgtacaggtggttggtgtgcctgacgccaaattcggggaggaagctgcagcctggattaaactgaaagacggtaaaagcgtttcacctgatgagcttaaagcctattgcaaagggaaaatcgcccgccacaaaattccgcgttatgttatttttacggatgactatccgatgacggcctcaggcaaaattcaaaaatataaactgcgagaaaaaacgattgaaatgttcaacttatcatcaagtcaatga

SEQ ID NO: 29470 - protein, 549 aa, Bacillus subtilis subsp. subtilis str. 168
MAELIHSTIGRLLEQTADAYPDRDAVVYPDRNIRYTYAQFDSLCRQTAKGLMRMGIGKGDHVAIWASNISEWLAVQFATAKIGAVLVTVNTNYQAHELDYLLKQSDAAALIIMDSYRGTSYPDIVNSLIPELQEAKPGQLKSERYPFLKTLIYIGNKRLSGMYHWDDTEILAKTVTDAELEERMNSLDKDNVINMQYTSGTTGFPKGVMLTHFNVINNAANIAECMALTSQDRMCIPVPFFHCFGCVLGVLACVSVGAAMIPVQEFDPVTVLKTVEKEKCTVLHGVPTMFIAELHHPDFDAYDLSTLRTGIMAGSPCPSEVMKAVIERMGMKDITIAYGQTEASPVITQTRANDSFIRRVETTGRALPHTEVKIVEPGTCQEVQRGMQGELCTRGYHVMKGYYKDKDATRKAINHDGWLFTGDLAVMDEDGYCRITGRLKDMLIRGGENIYPREIEEFLYQHPAVLDVQVVGVPDAKFGEEAAAWIKLKDGKSVSPDELKAYCKGKIARHKIPRYVIFTDDYPMTASGKIQKYKLREKTIEMFNLSSSQ

SEQ ID NO: 29471 - DNA, 1593 bp, Caulobacter crescentus CB15; identical to SEQ ID NO: 13974
  CDS (1)..(1593)

SEQ ID NO: 29472 - protein, 530 aa, Caulobacter crescentus CB15; identical to SEQ ID NO: 13975

SEQ ID NO: 29473 - DNA, 1641 bp, Salmonella typhimurium LT2
  CDS (1)..(1641)
atgagtgttacattaacgtttgacgccgcaaggcggaaaacctatcgcgagtccggctactggggcgatgcttcactgggcgactactggcggcaaaccgcacgcgccgtacccgataaaatcgccgtggtcgataatcatggcgcgtcctggacctacgccgcgctcgactacgcggcaagccgcctggcaaactggttactgtctcaggggattcaaccgggcgatcgcgtggcctttcagcttccgggctggtgtgagtttaccctcatttatctggcctgcctgaaaacgggcgcggtatctgtcccgctacttcccgcctggcgagaagcagagctggtttgggtgctgaacaaatgtcaggctaaaatattcttcgcccccaccgtgttcaaacagaatcgtccggtcgatcttatccttccgctacaaaatcaactgcgccatctgacgcatattgtcggcgtggataaactggcgcctgccaccacagcgcttgcgcttagtcaaatcatcgaccgcagcgaaccgttgcagtcagacattaacattcacggtgatgaactggcggcagtgctgtttacctccggcacagaaggaatgccgaaaggggtgatgttgacccacaataatattcttgccagcgaacgggcgtattgcgcgcggttgaatttaacctggcaagatgtgttcctgatgcctgcgccactgggccacgccaccggatttttacacggcgtcaccgcgccctttttaatcggggcgcgtagcgtattgctggacatctttaccccagaagcctgccttaccttattagcgcagcaacgctgtacctgtatgtcaggcgcgacgccgtttatttacgatctgctttgtgccattgagcaacagcctgccgacctctcctcactacgattcttcttatgcggcggcacgactattcccaaaaaggttgcccgcgactgccagcagcgcggtatcaaattattgagtatttacggttctacagaaagttctccacactcgatggttaatctgggtgattcgacttcacgcatgatgaacaccgatggttatgccgccaccggtgtagaaattaaaatcgtggatgaagatcgcaatacgcttccagcaggccacgaaggcgaagaagcctcgcgcgggccgaacgtttttatgggatacctggacgagccggaacttaccgcccgcgcactggataatgagggctggtattacagcggcgacctctgccgcatggatgaagacggttatatcaaaattaccgggcgcaaaaaggatattattatacgtggaggtgaaaatatcagcagtcgcgaggtggaggatattttattgcaacacccccgcatacacgatgcttgcgtcgttgctatgcctgatgaacgcttaggcgaacgttcatgcgcgtatgtagtcttaaaaccgccacacctttcgctgacgctggaagaggtgatcgcttttttcagtcgaaaacgggtagcgaagtataaatatccggaacggatcgtcatcgtagaaaaactgcccagaaccgcctctggcaaagtgcagaagtttctgttgcggcaggatattattgagcggctgcgccaggagcacactgcggtataa

SEQ ID NO: 29474 - protein, 546 aa, Salmonella typhimurium LT2
MSVTLTFDAARRKTYRESGYWGDASLGDYWRQTARAVPDKIAVVDNHGASWTYAALDYAASRLANWLLSQGIQPGDRVAFQLPGWCEFTLIYLACLKTGAVSVPLLPAWREAELVWVLNKCQAKIFFAPTVFKQNRPVDLILPLQNQLRHLTHIVGVDKLAPATTALALSQIIDRSEPLQSDINIHGDELAAVLFTSGTEGMPKGVMLTHNNILASERAYCARLNLTWQDVFLMPAPLGHATGFLHGVTAPFLIGARSVLLDIFTPEACLTLLAQQRCTCMSGATPFIYDLLCAIEQQPADLSSLRFFLCGGTTIPKKVARDCQQRGIKLLSIYGSTESSPHSMVNLGDSTSRMMNTDGYAATGVEIKIVDEDRNTLPAGHEGEEASRGPNVFMGYLDEPELTARALDNEGWYYSGDLCRMDEDGYIKITGRKKDIIIRGGENISSREVEDILLQHPRIHDACVVAMPDERLGERSCAYVVLKPPHLSLTLEEVIAFFSRKRVAKYKYPERIVIVEKLPRTASGKVQKFLLRQDIIERLRQEHTAV

SEQ ID NO: 29475 - DNA, 1716 bp, Ralstonia solanacearum GMI1000
  CDS (1)..(1716)
atggctggtgaagcgttcgatccgcgtccgcgcggcggtgtgtcgtccgtggtgggcgatacgtcggtgccgctggcgcacgtgagcgtgcccgcgttgctggcggacacggtgcgccgctgtcccgatgcgcaggcggtggtgttccgggagcagggcgtgcgctgcacgtggcgcgcgttcgccgagcaggtcgatgcgctggccgccggcctgcacgcgctggggctgcagcgcggcgagcgcatcggcatctggtcgcccaaccgctacgaatgggtgctgacgcagttcgccaccgcgcggctcgggctgatcctggtcaacatcaatccggcctaccggctcacggagctggaatacgcgctcaacaaggtcggctgcaaggccatcgtggtggccgaggcgttcaagacctcgcgctatctggagatgctgcagacgctggcgcccgaactggctacggcacagccgggcgctctgcgggccgcgaagctgccggcgctgcgctgggtcatccggatgggcgagggggccacacccggcatgatccgcttcgacgaggtgattgcgcgcgggcagggcgtacccgccggcacgctcgacgccatcaccgccgcgctgtcgcccgatgatgcgatcaacatccagttcaccagcggcaccaccggcgcgcccaagggcgccacgctcacccacgtcaacatcgtcaacaacgcgcgcttcgtggccatggcgatgaatctgcagggcacggaccgcctgtgcgttccggtgccgctgtaccactgcttcggcatggtgatgtcggtgctcgcctgcgccgccaccggtgcgtgcatggtcttcccgggcgaggccttcgacccgctcgccacgctgcgcgccgtggccgaggagcgctgcaccgcgctgcacggcgtgccgaccatgttcatcgcgcagctcgatcatcccgaattccccagcttcgatgtgtccagcctgcgcggcggcatcatggccggctcgccgtgtccgatcgaggtgatgaagcgcgtggtggccgagatgcacctgcgcgagatcaccatcgcctacggcatgacggagaccagccccgtgtcgttccagagcgccgtgaccgatccgctcgacaagcgcgtgaccaccgtgggccgcgtccagccgcacctgcaggtcaagctggtggacggcgcgggcgaggtggtgccggtgggcgagaagggcgagctgtgcaccaggggctattcggtgatgctcggctactgggacgacgaggccaagaccgccgagtccatccaagacggctggatgcgcaccggcgatctcgccaccttcgacgccgacggctactgcaacatcgtcggccgcgtgaaggacatgctgatccgcggcggcgagaatgtgtacccgcgcgagatcgaggaattcctcttccgccacccgaaggtgcaggccgtcaacgtgttcggcgtgcccgatccgaagtacggcgaggaagtgtgcgcgtggatcgtgctcaagcccggccagcaggccacgcaagaggagatccgcgaattctgccaaggacagatcgcgcactacaagatcccgcgctacatccgcttcgtcaccgagatgccgatgacggtgacgggcaaggtccagaaattcgtcatgcgcgagcgcatgatcgaagagctcaggctgactgtggctgccacggcctga

SEQ ID NO: 29476 - protein, 571 aa, Ralstonia solanacearum GMI1000
MAGEAFDPRPRGGVSSVVGDTSVPLAHVSVPALLADTVRRCPDAQAVVFREQGVRCTWRAFAEQVDALAAGLHALGLQRGERIGIWSPNRYEWVLTQFATARLGLILVNINPAYRLTELEYALNKVGCKAIVVAEAFKTSRYLEMLQTLAPELATAQPGALRAAKLPALRWVIRMGEGATPGMIRFDEVIARGQGVPAGTLDAITAALSPDDAINIQFTSGTTGAPKGATLTHVNIVNNARFVAMAMNLQGTDRLCVPVPLYHCFGMVMSVLACAATGACMVFPGEAFDPLATLRAVAEERCTALHGVPTMFIAQLDHPEFPSFDVSSLRGGIMAGSPCPIEVMKRVVAEMHLREITIAYGMTETSPVSFQSAVTDPLDKRVTTVGRVQPHLQVKLVDGAGEVVPVGEKGELCTRGYSVMLGYWDDEAKTAESIQDGWMRTGDLATFDADGYCNIVGRVKDMLIRGGENVYPREIEEFLFRHPKVQAVNVFGVPDPKYGEEVCAWIVLKPGQQATQEEIREFCQGQIAHYKIPRYIRFVTEMPMTVTGKVQKFVMRERMIEELRLTVAATA

SEQ ID NO: 29477 - DNA, 1764 bp, Brucella melitensis 16M
  CDS (1)..(1764)
ttggcaccatgctgcgtgcctgcggcctttcggcctgaaacagagcctctccatgtctttgtttctacgcattatccgacgcagagccgcttcgcattgcgggctcgaaaactgcactcgtttttatttcaagcagaacaagtcatgaccatcgaatttacccattggccaccggcacgcgaacgcctctatcgcgaaaagggctactggatcgacaaacccctcacccgcgcactggaagaacaggccgccatgcggcccgatgcgcccgctatcctctgcggcgagcggcgtttcacctatgccgaactcgaccgtctgtcttccaacctggcctcccggcttgcggcagccggcataggcaaaggcgacacggcactggtgcaactgcccaatatcgccgaattctacatcgtgttcttcgcactcatgaaagcgggcatcgcgcccgtcaatgcgcttttcagccatcgcaagctggagcttggcgcctatgccagccagatcgaaccacggctgctgatcggctcacgccagcatgaactcttcatggatgacgcctttgcccgcgaccttggcaaaaatctttccgcaccgctgctaacactttttgcaggcgaggccgaccatgcgtcgagcctcgaccactggatcgccacgcctgcggacaaagccgttcctttctcgccaaccggcgctggcgaagtcgcctttttccagctttccggcggcagcaccggcacgccgaaactcatcccgcgcacgcataatgattatgattacagcgtgcgcgccagcgcggaaatctgcgcgctgacaccgcagacccgttttctctgcgccctgcccaccgcgcataattatccaatgagttcgcccggcgcgctcggcgttttccatgcgggcggctgtgtcgtcatggcccccaacccggaaccgctcaactgcttctccatcatcgaacgtcatggcgtaaacatggtggcactggtgcctccggcagtggcgctctggctacaggcagcccccgatcatctggcagcactcagctcgctgaaactcgtgcaggtgggtggcgcaagctttgcggaggcgcttgcccggcaggtgccacaggttctgggctgcaagctgcaacaggtcttcggcatggccgaggggctggtcaactatacccgccttgacgacccggacgagatcgtcttcaccacccagggccgtccgatcagcccggacgatgaaatcaggatcgtcgatgaggatggcgaacccgtggccgaaggccagccaggaatgctggccacgcgcgggccttacacgttctgcggctattatcgcagccccgaacataatgcgcaggtcttcgacagtgaaggcttttattattcgggcgacgtggtccagcgcacgccggaaggctatctgcgcgtcgtgggccgcgtgaaggaccagattaatcgcggcggcgagaaagttgccgccgaggagattgaaaacctgatcctcctccatcccgatgtgacgcacgccgcacttgtcgccatgcaggatgaattgctgggcgagaaaagctgcgctttcatcgtctcgcgcaatcccgatctcaagccgcctgttctgcggcgtcacctgctggcgctgggcgttgccgaatacaagcttccagaccgcatcaggctcattgaaaccatgccgctcaccgcagttggcaagatcgacaaaaagcatctgcgcaagctttcaagcccatcctcccccggttag

SEQ ID NO: 29478 - protein, 587 aa, Brucella melitensis 16M
MAPCCVPAAFRPETEPLHVFVSTHYPTQSRFALRARKLHSFLFQAEQVMTIEFTHWPPARERLYREKGYWIDKPLTRALEEQAAMRPDAPAILCGERRFTYAELDRLSSNLASRLAAAGIGKGDTALVQLPNIAEFYIVFFALMKAGIAPVNALFSHRKLELGAYASQIEPRLLIGSRQHELFMDDAFARDLGKNLSAPLLTLFAGEADHASSLDHWIATPADKAVPFSPTGAGEVAFFQLSGGSTGTPKLIPRTHNDYDYSVRASAEICALTPQTRFLCALPTAHNYPMSSPGALGVFHAGGCVVMAPNPEPLNCFSIIERHGVNMVALVPPAVALWLQAAPDHLAALSSLKLVQVGGASFAEALARQVPQVLGCKLQQVFGMAEGLVNYTRLDDPDEIVFTTQGRPISPDDEIRIVDEDGEPVAEGQPGMLATRGPYTFCGYYRSPEHNAQVFDSEGFYYSGDVVQRTPEGYLRVVGRVKDQINRGGEKVAAEEIENLILLHPDVTHAALVAMQDELLGEKSCAFIVSRNPDLKPPVLRRHLLALGVAEYKLPDRIRLIETMPLTAVGKIDKKHLRKLSSPSSPG

SEQ ID NO: 29479 - DNA, 1782 bp, Drosophila melanogaster
  CDS (1)..(1782)
atgaacagcaagctgcagaccatctcccgatacatgctcaggcagaaatgtgccttcaactcgatgcgcagcatttccacctcgatgcccagcttgatcagccataagcatcatattggtaaggatcccttggtatatcgcaccattggccagcagttggagctatctgcttcgaattttggggatgtggaggcgattgtctcctgtcacgagggcaagcggtacagcttcaaaagtttgctacaggaagcggatgcgctggcggcgggtttccggaaattgggcctgcagccaggtgatgccgttggtctgtgggcaccgaactacttgcactggtacttgggcatgatgggagcagctcgagcgggtctcacctcggtgggtttgaatccagcttaccagggacccgaaatagcctactgtctgaataaggtcaatgtgaaggccatcattgcgccggagaccttcaagacgcagaactactatgagattttgagagatatctgcccggaaatctcagatgcggatactggcaagatccggagtgagaagtttccgcacctgcgatccgtaatcattgatagcaacgatagcctgaagggtgccctgcgcttcgatgacttcctggacctggccagcaaatcggagcgcgaagaggtggccaaaatgcagaagagcattctgcccgagtctgcgtgcaatattcagttcacatcgggaaccactggcaatcccaaggctgcctgtcttacccatcacaatttcgtcaacaatggcatccatgtgggcaatcgcaacgaactggagggcgagaggatctgtgttcaggtgcccatgttccatgccttcggtgtgatcatctccatcatggctgctctgaccaaaggtgccaccatggtcctacccgctgccggtttcagtcccaaggactcgctgcaagccatcgtcaatgaaaagtgttcggtgatccatggcacaccaaccatgtatgtggatttggtcaacacgcaaaagaagctacaggtgccgctgggcaggattaagaaggccgtcaccggaggtgccattgtatcgccgcagctgatcaaggatgtgagacaggttctcaacgtggaagcggtgcatagtgtctatggcctgacggaaaccacagctgtgatcttccaatccttgcccggcgatagcagtgatgttgtcctcaactcagttggccatctgacggatcacatcgaagccaaggtggtggatgccgagggcaggtgtgtgccatttggacagcccggagagctgtgcgtccgcggatataccacaatgctgggctaccacgatgatgaggagaaaacaaaggaaaccatcggtaatgataggtggttgcgcacgggcgatcagtttgtcctggaggccaatggatatggacggattgtgggtcgcctaaaggagatgctcatccgtggcggcgaaaatatattccccaaagagatcgaagactttctaaacgcccatccacaggtcattgaggcgcatgtgattggagtgcctgatgagcgattgggtgaagaagtctgcgcctatgttcgcctggaggagggcgtggaccccgcctccttcaccgcggagaccttaaaggcctatgccaagggcaagctggcccacttcaaggtgcccagatatgtgatccccatagatgcattccctaaaaccacctcgggcaagatccagaaattcaagctagtggaggctttcaaggccaaggaaacagagctaaaagctgccagactatga

SEQ ID NO: 29480 - protein, 593 aa, Drosophila melanogaster
MNSKLQTISRYMLRQKCAFNSMRSISTSMPSLISHKHHIGKDPLVYRTIGQQLELSASNFGDVEAIVSCHEGKRYSFKSLLQEADALAAGFRKLGLQPGDAVGLWAPNYLHWYLGMMGAARAGLTSVGLNPAYQGPEIAYCLNKVNVKAIIAPETFKTQNYYEILRDICPEISDADTGKIRSEKFPHLRSVIIDSNDSLKGALRFDDFLDLASKSEREEVAKMQKSILPESACNIQFTSGTTGNPKAACLTHHNFVNNGIHVGNRNELEGERICVQVPMFHAFGVIISIMAALTKGATMVLPAAGFSPKDSLQAIVNEKCSVIHGTPTMYVDLVNTQKKLQVPLGRIKKAVTGGAIVSPQLIKDVRQVLNVEAVHSVYGLTETTAVIFQSLPGDSSDVVLNSVGHLTDHIEAKVVDAEGRCVPFGQPGELCVRGYTTMLGYHDDEEKTKETIGNDRWLRTGDQFVLEANGYGRIVGRLKEMLIRGGENIFPKEIEDFLNAHPQVIEAHVIGVPDERLGEEVCAYVRLEEGVDPASFTAETLKAYAKGKLAHFKVPRYVIPIDAFPKTTSGKIQKFKLVEAFKAKETELKAARL

SEQ ID NO: 29481 - DNA, 1653 bp, Methanosarcina acetivorans C2A
  CDS (1)..(1653)
atgcatcttattgaagattctctgggagaatactttgaaaaacaggtaactatcgaccctgaccacgaatttattatttatccagaccgcaacctgcgctttacctatggacagtttaacgaaagggtcaacaaccttgcaaaagggctgcttgcgatcgggataaaaaagggagaccatgtagggatctgggcaaagaatgtccctgactggcttaccttcatgtttgcaacctcaaagataggagcagtgctcgtcacggtaaataccgcctacaggagccatgaagttgagtatgtgctcaaacagtcagatatgaaggccctggctcttatcgatagtttcagggaagtggactacctcgaaattatcaacgaacttgtccctgagctaaaaagttcggaaagagggcgcctgaaaagtaaaaaattcccatacctgaagagcgtgatctatgtcgggcaggaaaagcacaggggaatgtacaacaccagcgagctgatgctccttggcagtcattatccggatgacgaacttaaagaaattctggcaagcgtcagcggggacgatgtaatcaatatgcagtatacctcagggacaacgggtttcccgaaaggagttatgctgacaagtaaaaatatcctgaacaacggcctctccatcggcgaccgccagaagttcacccatgaagatcggctatgtctgcctgttcctcttttccactgctttggaatcgtgctgggagtcatggctgtcctgacccacagggcaacgcttgtgatgcttgaggttttcgaccccctcctggtgcttgccgcagtccagaaagagaagtgcactgccctttacggcgttcctactatgttcattgccgagtacactcatcccatgtttgatatgttcgacctttcttctctcaggacaggaatcatggctggttctacctgtcctgtagaagctatgaaaaaagtagtaaaagatatgcattgtcatcaaatcacgagtgtctacgggcttacggaagcttctcccggcatgacccagactactgtagatgatcctgtagaactcagagtcgagaccgtaggcaaatgtttcccgggcgtggaagtcagagttgtagacccggctaccaacgagctggtacccccggatactgtaggagagatctgctgccgtgggtataacataatgaagggctactacaatatgccggaagaaacgaaaaaagttattgacgaaggcggctggctgcacagcggagaccttgggacctgtgatgaactcggttactacaggattacaggccgcataaaggacatgatcatccggggcggggaaaatatctatcctagagaaattgaggaattcctgcacgccatacccggagtaaaagatgcacaggtcgtcggcatccctgataaaaagtacggggaaatcgtaggagcctttactattctcgagaaaggtgccgatctcacagaagccgatatcagagactatgctctaagcaaaatcgcccgatataaggttccaaagcacgtcttcatagtaaatgaatatcctctgaccgcaagcggcaagatccagaaatacaagctcagggaactggctgtggagcttctgaaaaagagagaggaagacaaagaataa

SEQ ID NO: 29482 - protein, 550 aa, Methanosarcina acetivorans C2A
MHLIEDSLGEYFEKQVTIDPDHEFIIYPDRNLRFTYGQFNERVNNLAKGLLAIGIKKGDHVGIWAKNVPDWLTFMFATSKIGAVLVTVNTAYRSHEVEYVLKQSDMKALALIDSFREVDYLEIINELVPELKSSERGRLKSKKFPYLKSVIYVGQEKHRGMYNTSELMLLGSHYPDDELKEILASVSGDDVINMQYTSGTTGFPKGVMLTSKNILNNGLSIGDRQKFTHEDRLCLPVPLFHCFGIVLGVMAVLTHRATLVMLEVFDPLLVLAAVQKEKCTALYGVPTMFIAEYTHPMFDMFDLSSLRTGIMAGSTCPVEAMKKVVKDMHCHQITSVYGLTEASPGMTQTTVDDPVELRVETVGKCFPGVEVRVVDPATNELVPPDTVGEICCRGYNIMKGYYNMPEETKKVIDEGGWLHSGDLGTCDELGYYRITGRIKDMIIRGGENIYPREIEEFLHAIPGVKDAQVVGIPDKKYGEIVGAFTILEKGADLTEADIRDYALSKIARYKVPKHVFIVNEYPLTASGKIQKYKLRELAVELLKKREEDKE

SEQ ID NO: 29483 - DNA, 1626 bp, Streptomyces coelicolor A3(2)
  CDS (1)..(1626)
atgaccgcacccgcgccccagccgtcgtacgcgcacggcaccagcaccaccccgctgctcggcgacaccgtcggcgccaacctcggccgcgcgatcgccgcccacccggaccgcgaggccctcgtcgacgtcccgtccggacggcgctggacctacgccgagttcggcgccgccgtcgacgagctggcccgggggctgctcgcgaagggcgtcaccaggggcgaccgggtcggcatctgggcggtcaactgccccgagtgggtcctcgtccagtacgccaccgcccgcatcggcgtcatcatggtgaacgtcaacccggcctaccgggcccacgagttggagtacgttctccagcagtccggcatcagcctgctggtcgcctccctcgcccacaagagcagcgactaccgggcgatcgtggagcaggtccgcggccgctgccccgcgctgcgcgagaccgtctacatcggcgacccgtcctgggacgcgctcaccgcgggcgccgccgcggtggagcaggaccgggtcgacgccctcgccgccgaactgagctgcgacgacccggtcaacatccagtacacctccggcaccaccggcttccccaagggcgccaccctctcccaccacaacatcctcaacaacggctactgggtgggccgcacggtcggctacacggagcaggaccgggtctgtctgccggtgcccttttatcactgctttggcatggtgatggggaatctgggtgccacctcccacggcgcctgcatcgtcatccccgccccgtcctccgagccggcggccacgctggaggcggtgcagcgggagcggtgcacgtccctgtacggcgtcccgaccatgttcatcgcggagctgaacctgccggacttcgcctcctacgacctcacctccctgcgcaccggcatcatggcgggctcgccctgcccggtggaggtgatgaagcgggtggtcgccgagatgcacatggagcaggtctccatctgctacggcatgaccgagacctccccggtctccctgcagacccgcatggacgacgacctcgaacaccgcaccggcaccgtcggccgcgtcctgccgcacatcgaggtcaaggtcgtcgacccggtcaccggcgtgaccctgccgcgcggcgaggcgggcgaactgcgcacccgcggctacagcgtgatgctcggctactgggaggagcccgggaagaccgccgaggccatcgacccgggccgctggatgcacaccggggacctcgcggtgatgcgcgaggacggatacgtcgagatcgtcggccgcatcaaggacatgatcatccggggcggcgagaacatctacccgcgcgaggtcgaggagttcctgtacgcccacccgaagatcgcggacgtccaggtcgtcggcgtcccgcacgaacgctacggcgaggaggtcctggcctgcgtcgtcgtgcgcgatgccgccgacccgctcaccctggaggaactgcgcgcctactgcgccgggcagctcgcccactacaaggtgcccagccgcctccagctcctcgactccttcccgatgaccgtctcggggaaggtgcgcaaggtggagttgcgggagcggtacggagcgcgcccctga

SEQ ID NO: 29484 - protein, 541 aa, Streptomyces coelicolor A3(2)
MTAPAPQPSYAHGTSTTPLLGDTVGANLGRAIAAHPDREALVDVPSGRRWTYAEFGAAVDELARGLLAKGVTRGDRVGIWAVNCPEWVLVQYATARIGVIMVNVNPAYRAHELEYVLQQSGISLLVASLAHKSSDYRAIVEQVRGRCPALRETVYIGDPSWDALTAGAAAVEQDRVDALAAELSCDDPVNIQYTSGTTGFPKGATLSHHNILNNGYWVGRTVGYTEQDRVCLPVPFYHCFGMVMGNLGATSHGACIVIPAPSSEPAATLEAVQRERCTSLYGVPTMFIAELNLPDFASYDLTSLRTGIMAGSPCPVEVMKRVVAEMHMEQVSICYGMTETSPVSLQTRMDDDLEHRTGTVGRVLPHIEVKVVDPVTGVTLPRGEAGELRTRGYSVMLGYWEEPGKTAEAIDPGRWMHTGDLAVMREDGYVEIVGRIKDMIIRGGENIYPREVEEFLYAHPKIADVQVVGVPHERYGEEVLACVVVRDAADPLTLEELRAYCAGQLAHYKVPSRLQLLDSFPMTVSGKVRKVELRERYGARP

SEQ ID NO: 29485 - DNA, 1536 bp, Streptomyces coelicolor A3(2)
  CDS (1)..(1536)
atggcaaccctctccgtcgccgccgtcctcgccgagaacgcccggcgccgtcccgacaaggaggcgctggtcgagggcgacctgcggctgaccttcgccgaggtgtggcggcgggccctcgcccgggccggcgccctcgtcggcctggacgtccggccgggggaccgggtggcgctgatggcaccgaacaccgccgacttccccgtcgcctactacgccgccgccgcggccggcgccgtggtggtgccggtgcacctgctgctgtccccggccgaggtcgagcacgtcctgcgcgacagcggtgccaccctgctgctgtgccatccggcccaggcggagaccggagcggccgccgcgcggcaggcgggtgtacggacgatcacgctcggcgaggagttcgaccggctcgccgccgacgccgagcccctgccctcgtacgtcacccgggacgccgacgacccggccgtcgtcttctacaccagcggcacgaccggagtgcccaagggcgccgtgctcagccacttcaacctggtgatgaacgcgacggtcaacgccttcgacgccaacgacatccggcccgacgacgtggcgctcggcgcgctgcccctcttccacgccttcggccagaccgtctccctcaactccacctggcgggcgggcgcgaccctcgtcctgctgccgcgcttcgacgcggcgcgcgcgatcgagctgatggtgaaggagggcgtcaacaccttccacggggtgccgaccatgttcgtcgccctcgccgccgcggcggccggggccgcggccctgccggagctgcgggtgtgcatctccggcggtgcctcgctgccggtggccgtcctcgaacggttcgaggaggccttcggggcgaagatctacgagggctacgggctgtcggagacctctccggcggcggctgtgaaccagccggtgttcggcgccaggccgggcaccatcggccacccgctgtggggcgtcgacgtggagatcgcccgcgccgaggtcgaggacgccgtggaactgctgccgcccggggaactgggcgaggtcgtcgtccgcggccacaacgtcttctccggctacctcggccgccccgaggccaccgctcaggcgctcgtcgacggctggttccgcaccggcgacctgggaaccaaggacgaggacgggttcctgaggatcgtcgaccggaagaaggacgtcatcatccggggcggctacaacgtctatccgcgggaggtcgaggaggtgctgatgcgccaccccggcatcgcccaggtcgccgtcatcgggctcccggacgaactccacggcgaggaggtctgcgccgtggtcgtgcgcgcccccggcacgacgcccgacgcggtgccggacgccgccggggtcaccgagtggtccaagcagcacctcgggcggcacaagtacccgcgccgggtggagttcacggacgagctgccgctcgggccgagcatgaaggtgctgaagcgcgagctgagggcggtgtacaccgaccaccggggaccacgctaa

SEQ ID NO: 29486 - protein, 511 aa, Streptomyces coelicolor A3(2)
MATLSVAAVLAENARRRPDKEALVEGDLRLTFAEVWRRALARAGALVGLDVRPGDRVALMAPNTADFPVAYYAAAAAGAVVVPVHLLLSPAEVEHVLRDSGATLLLCHPAQAETGAAAARQAGVRTITLGEEFDRLAADAEPLPSYVTRDADDPAVVFYTSGTTGVPKGAVLSHFNLVMNATVNAFDANDIRPDDVALGALPLFHAFGQTVSLNSTWRAGATLVLLPRFDAARAIELMVKEGVNTFHGVPTMFVALAAAAAGAAALPELRVCISGGASLPVAVLERFEEAFGAKIYEGYGLSETSPAAAVNQPVFGARPGTIGHPLWGVDVEIARAEVEDAVELLPPGELGEVVVRGHNVFSGYLGRPEATAQALVDGWFRTGDLGTKDEDGFLRIVDRKKDVIIRGGYNVYPREVEEVLMRHPGIAQVAVIGLPDELHGEEVCAVVVRAPGTTPDAVPDAAGVTEWSKQHLGRHKYPRRVEFTDELPLGPSMKVLKRELRAVYTDHRGPR

SEQ ID NO: 29487 - DNA, 1638 bp, Methanosarcina mazei Go1; identical to SEQ ID NO: 14260
  CDS (1)..(1638)

SEQ ID NO: 29488 - protein, 545 aa, Methanosarcina mazei Go1; identical to SEQ ID NO: 14261

SEQ ID NO: 29489 - DNA, 1620 bp, Oceanobacillus iheyensis HTE831
  CDS (1)..(1620)
atgctagaagggtataagccatggccagagaatcttagaaagtactatcaagaaactggttgctggacgggagagactttcggaggaatattagagcaacaagctagagacagaaaagacagtattgcgattactgatggagagaaatccattacgtatcagcaattagatgaaagagtaaacaaactagctgcaggattcatgaaattaggtatagagaaagaagatagagtagttcttcaactaccaaatactattgaattttttgaggtttgtttcgcgttatttcgaattggtgctttacctgtttttgctctaccgctgcatcgaaaaatggaaattagttatttctgtgaatttacagcagctaaagcgtatatcattccagatgtattcgataaatttgactacagagatctagcaaatgaaataaataactctattcctactctggagcatacgattgttgcaggtgaaacagataattttatttcattagaagaattatatatggatgattcagcatcttttccaactattactggaagtgatttagcttttttccaattatcaggtggaagtactggattacctaaactaattccgcgtacacatgatgagtatatttatagtcttcggaaaagtgtggaaatatgtcgaattagtcaagatacgaatttcttagcggttctacctgttgcacataattttacgatgagttcaccaggagtttttggtgtcatatatgctggtgggaaaattattctaagtaaatatcctagtcctgatgtggcttttccgttaatagaaaaggagaaagtagatttcacatcattggttccaccattagcgattgtatggttacaagcgcagaaaaggacaaaagcagatttacgttcgttggaagtcattcaagttggtggagcaaaatgcagtgttgaagttgcgaaacaaattggcccggcgtttcactgtaaattacagcaagtatttggtatggcagaaggcctagtaaattatacgagattagatgacgacgatgaagtagttattcatacacaaggcaaaccgatgtcagcgtatgatgaaattcgtattgtggatgaagaagataatgagctaccagtaggagaaacaggacaacttcaagcgagaggtccatataccatcattggttatttcaatgtagaagaccataatgcaaaagcttttacttcggatggtttttatcgcactggagatttagtcaaactaacggaggaagggtatctaatcgttgaaggaagagataaggatcaaattaatcgtggtggcgaaaaaattgccgcagaagaggtagaaaattatatcctatcactttcaggcatacatgatgtagcaatggtgagtatgccagacaaatttcttggagaaaggtcttgtgcctttgtcataaaaaatgatgaagaattaacgagcaatgacataaaggatttcttacagcataaaggaatagctaattttaaaatcccagatcggatagaattcgtggatcgttttccatatacagcactaggtaaggtgagtaagaaaaacttaagagcaatgataaaagaaaaaatcacacaaaaaagttattaa

SEQ ID NO: 29490 - protein, 539 aa, Oceanobacillus iheyensis HTE831
MLEGYKPWPENLRKYYQETGCWTGETFGGILEQQARDRKDSIAITDGEKSITYQQLDERVNKLAAGFMKLGIEKEDRVVLQLPNTIEFFEVCFALFRIGALPVFALPLHRKMEISYFCEFTAAKAYIIPDVFDKFDYRDLANEINNSIPTLEHTIVAGETDNFISLEELYMDDSASFPTITGSDLAFFQLSGGSTGLPKLIPRTHDEYIYSLRKSVEICRISQDTNFLAVLPVAHNFTMSSPGVFGVIYAGGKIILSKYPSPDVAFPLIEKEKVDFTSLVPPLAIVWLQAQKRTKADLRSLEVIQVGGAKCSVEVAKQIGPAFHCKLQQVFGMAEGLVNYTRLDDDDEVVIHTQGKPMSAYDEIRIVDEEDNELPVGETGQLQARGPYTIIGYFNVEDHNAKAFTSDGFYRTGDLVKLTEEGYLIVEGRDKDQINRGGEKIAAEEVENYILSLSGIHDVAMVSMPDKFLGERSCAFVIKNDEELTSNDIKDFLQHKGIANFKIPDRIEFVDRFPYTALGKVSKKNLRAMIKEKITQKSY

SEQ ID NO: 29491 - DNA, 1608 bp, Oceanobacillus iheyensis HTE831
  CDS (1)..(1608)
ttggaattaaatcaaatcgatacagagttagatagattaattaatcgagtacgaagaaatacattaggcgatctattaacaagaacaagtgagcgctatccggataaaaatgcaatcgcttacaggtctgaaagactaacctatcaagaacttgataaccttgtaaatcaaacagctaatggatttctgaatatcgggattaaaaagggtgacaagctaattttagtttcaaaaaatagtttggactttgtacttgtcacgtatgcacttgctaaaattggagcagtattaattcctgttaattacatgcttacatcccaggaaatacggtatatattagaaaattcaatggcaataggtgtaatggcgtctactgaatttagagatgtagtaatagctgcagcagaagataaaaaccttgaacattatatagccttagaagttgtaccaacagaggtggaatcaagcggtcagtggatagcattaaatcaaattcaatcgaatcaatcttctacaatgccagaggtggaaatttatgatgatgatttagcacatatattgtatacaagtggaactgaatcaaaaccaaaaggtgtaatgttgactcataaaagtatcgtaagtgaatatgtcagtactattattgattgtaaaatggaaagtcatgatatttctatacatgcattgcctctttatcatagtgcacaacttcatgtattcttaggtccaagtatatacatcggatcaagtggcgtcatccttccttctgctagtccggaattaatcttagaaaccattgaaaaagagcaagtaactcaattattttgccctccaactgtatggattggcttattacggcatccagattttaataaaagagatttaagttccttgaaaaaaggttactatggagcagcaattatgccaatggaaattattaaagagttgacggaaagacttccgcaaatcgaactttggaactgctatgggcagacagaagtagctccattagcaacggtactacaaccaaaagaccaattacgaaagttaggttcagctggattaccgagtttaaatgtacagacaaaaattatagatgccaatggagaggaagttgctcgcggaatcgttggagaaattgtacatcgaacccctcacgcgatgacgggatatttatatgctacagaaaaaacgaaagaggcgtttaagcacggatggttccatagtggagatttaggatttatggatgaagaagggtatatcacgattgtagatcgcaagaaggatatgataattactggaggagtaaatgtatctagtcgtgaagttgaagaggttatatatgaaattgatggcgtatcagaagtagctgtaattagtgttccagatccttattggggagaagcagttactgctattattgtattaaaagaagaaaatatagttacaaaacaacaagtcatcgaatattgcagtggtcggttatccaagtttaaaataccaaaatatgtagattttacggatgtattaccgaaaaatccgagcggaaaagtcttaaaacgatcgttacgaaataattatgaagatgtggatttttctactttgtga

SEQ ID NO: 29492 - protein, 535 aa, Oceanobacillus iheyensis HTE831
MELNQIDTELDRLINRVRRNTLGDLLTRTSERYPDKNAIAYRSERLTYQELDNLVNQTANGFLNIGIKKGDKLILVSKNSLDFVLVTYALAKIGAVLIPVNYMLTSQEIRYILENSMAIGVMASTEFRDVVIAAAEDKNLEHYIALEVVPTEVESSGQWIALNQIQSNQSSTMPEVEIYDDDLAHILYTSGTESKPKGVMLTHKSIVSEYVSTIIDCKMESHDISIHALPLYHSAQLHVFLGPSIYIGSSGVILPSASPELILETIEKEQVTQLFCPPTVWIGLLRHPDFNKRDLSSLKKGYYGAAIMPMEIIKELTERLPQIELWNCYGQTEVAPLATVLQPKDQLRKLGSAGLPSLNVQTKIIDANGEEVARGIVGEIVHRTPHAMTGYLYATEKTKEAFKHGWFHSGDLGFMDEEGYITIVDRKKDMIITGGVNVSSREVEEVIYEIDGVSEVAVISVPDPYWGEAVTAIIVLKEENIVTKQQVIEYCSGRLSKFKIPKYVDFTDVLPKNPSGKVLKRSLRNNYEDVDFSTL

SEQ ID NO: 29493 - DNA, 1644 bp, Oceanobacillus iheyensis HTE831; identical to SEQ ID NO: 14216
  CDS (1)..(1644)

SEQ ID NO: 29494 - protein, 547 aa, Oceanobacillus iheyensis HTE831; identical to SEQ ID NO: 14217

SEQ ID NO: 29495 - DNA, 1593 bp, Oceanobacillus iheyensis HTE831
  CDS (1)..(1593)
atgctagcaccactaaccccactagattggaaacgtagagctatcaagtattatccggaaaaaatagcgatagttgatggagataaatcatttacgtataaagaatttggtcatcgagttgatcaattatctaaaggtttgctcgaaaaaggtattaaagaaggtgaccatgtcgctgtaatgcttccaaatacacattatatgttggagtgcttttatggaatctgtcagattggagcagtcatggttccattaaactatcgtctatcagcaaaagatttaaactatattattaatcatagtgatgctaagttattaattgttgatgaggcattcactgagcctattgaagaaattcagaatagtttgtccttggaagagatgattatcgtagaagttgatggagagagtacttccttacaaggtactctttatgaagcgttaatacatcatgataatgataaggtcgaattaccaatagtagaaattgatgaaaatcagttaatgacgattaattatacaagtggtactacgtcgaatccaaagggggttatgctaacccatcgtagtaactatataaacgcagccaacttcctttatcatattaatgtttctcatgatgatcgctatttgcatacattaccaatgtttcatgcgaatggatggggaggagtgtgggcaataactgctgcaggtggtacgcatgtgtgcttgcgcaaagtggatccgccattaatattagatatttttgaagaacaacagataaccatgctttgcggggcacctacagtggttaatatgctggtgaatgagcccaaagcaaaacaattaaatttacaatcgaagcttaggatggcaaccgcaggatctcctcctgcagcggcattaatccaaaaagcacaagatattttaggattagaaatggtgcatgtttacggactaacagaaacgtcaccttttatcttatattgtgaatggaaacaagattttaatgagaaatcctccgatgaacaagcaacaattaaagcaagacagggaattgagcttgcatttaatggtgaaactaccgtcattcgtcctgatggagaagaagttctctggaatggggaggaattaggagagattgtcactcgtggaaatgtagtgatgcaaggttattataaagatgtggaaaaaaccgatgcggccatgaaagacggatggttccatactggagatttagctgtcattcattcagatggttttatagaaattcgggatcgagcaaaggatttaattatttccggtggagagaatatttcatctacagaagtagagggagtgctttataaacatccagatgtattagaagtagccgtaattgcaattcctgatgaaaagtggggagaagtaccattagcaatcattgtgccacaaccacattcagcactgacagaagaggaagtcataacctattgccgagaaaatcttgctcactttaaatctcctaaaaaagttgagtttgttgaagaattaccaaagacagcaacaggaaaactgcaaaaattccgtttgcgagagttgtactgggaaagagcaaagagagtaaattaa

SEQ ID NO: 29496 - protein, 530 aa, Oceanobacillus iheyensis HTE831
MLAPLTPLDWKRRAIKYYPEKIAIVDGDKSFTYKEFGHRVDQLSKGLLEKGIKEGDHVAVMLPNTHYMLECFYGICQIGAVMVPLNYRLSAKDLNYIINHSDAKLLIVDEAFTEPIEEIQNSLSLEEMIIVEVDGESTSLQGTLYEALIHHDNDKVELPIVEIDENQLMTINYTSGTTSNPKGVMLTHRSNYINAANFLYHINVSHDDRYLHTLPMFHANGWGGVWAITAAGGTHVCLRKVDPPLILDIFEEQQITMLCGAPTVVNMLVNEPKAKQLNLQSKLRMATAGSPPAAALIQKAQDILGLEMVHVYGLTETSPFILYCEWKQDFNEKSSDEQATIKARQGIELAFNGETTVIRPDGEEVLWNGEELGEIVTRGNVVMQGYYKDVEKTDAAMKDGWFHTGDLAVIHSDGFIEIRDRAKDLIISGGENISSTEVEGVLYKHPDVLEVAVIAIPDEKWGEVPLAIIVPQPHSALTEEEVITYCRENLAHFKSPKKVEFVEELPKTATGKLQKFRLRELYWERAKRVN

SEQ ID NO: 29497 - DNA, 1620 bp, Brucella suis 1330
  CDS (1)..(1620)
atgaccatcgaatttacccattggccaccggcacgcgaacgcctctatcgcgaaaagggctactggatcgacaaacccctcacccgcgcactggaagaacaggccgccatgcggcccgatgcgcccactatcctctgcggcgagcggcgtttcacctatgccgaactcgaccgtctgtcttccaacctggcctcccggcttgcggcagccggcataggcaaaggcgacacggcactggtgcaactgcccaatatcgccgaattctacatcgtgttcttcgcactcatgaaagcgggcatcgcgcccgtcaatgcgcttttcagccatcgcaagctggagcttggcgcctatgccagccagatcgaaccacggctgctgatcggctcacgccagcatgaactcttcatggatgacgcctttgcccgcgaccttggcaaaaatctttccgcaccgctgctaacactttttgcaggcgaggccgaccctgcgtcgagcctcgaccactggatcgccacgcctgcggacaaagccgttcccttctcgccaaccggcgctggcgaagtcgcctttttccagctttccggcggcagcaccggcacgccgaaactcatcccgcgcacgcataatgattatgattacagcgtgcgcgccagcgcggaaatctgcgcgctgacaccgcagacccgttttctctgcgccctgcccaccgcgcataattatccaatgagttcgcccggcgcgctcggcgttttccatgcgggcggctgtgtcgtcatggcctccaacccggaaccgctcaactgcttctccatcatcgaacgtcatggcgtaaacatggtggcactggtgcctccggcagtggcgctctggctacaggcaacccccgatcatctggcagcactcagctcgctgaaactcgtgcaggtgggtggcgcaagctttgcggaggcgcttgcccggcaggtgccacaggttctgggctgcaagctgcaacaggtcttcggcatggccgaggggctggtcaactatacccgccttgacgacccggacgagatcgtcttcaccacccagggccgtccgatcagcccggacgatgaaatcaggatcgtcgatgaggatggcgaacccgtggccgaaggccagccaggaatgctggccacgcgcgggccttacacgttctgcggctattatcgcaaccccgaacataatgcgcaggtcttcgacagtgaaggcttttattattcgggcgacgtggtccagcgcacgccggaaggctatctgcgcgtcgtgggccgcgtgaaggaccagattaatcgcggcggcgagaaagttgccgccgaggagattgaaaacctgatcctcctccatcccgatgtgacgcacgccgcacttgtcgccatgcaggatgaattgctgggcgagaaaagctgcgctttcatcgtctcgcgcaatcccgatctcaagccgcctgttctgcggcgtcacctgctggcgctgggcgttgccgaatacaagcttccagaccgcatcaggctcattgaaaccatgccgctcaccgcagttggcaagatcgacaaaaagcatctgcgcaagctttcaagcccatcctcccccggttag

SEQ ID NO: 29498 - protein, 539 aa, Brucella suis 1330
MTIEFTHWPPARERLYREKGYWIDKPLTRALEEQAAMRPDAPTILCGERRFTYAELDRLSSNLASRLAAAGIGKGDTALVQLPNIAEFYIVFFALMKAGIAPVNALFSHRKLELGAYASQIEPRLLIGSRQHELFMDDAFARDLGKNLSAPLLTLFAGEADPASSLDHWIATPADKAVPFSPTGAGEVAFFQLSGGSTGTPKLIPRTHNDYDYSVRASAEICALTPQTRFLCALPTAHNYPMSSPGALGVFHAGGCVVMASNPEPLNCFSIIERHGVNMVALVPPAVALWLQATPDHLAALSSLKLVQVGGASFAEALARQVPQVLGCKLQQVFGMAEGLVNYTRLDDPDEIVFTTQGRPISPDDEIRIVDEDGEPVAEGQPGMLATRGPYTFCGYYRNPEHNAQVFDSEGFYYSGDVVQRTPEGYLRVVGRVKDQINRGGEKVAAEEIENLILLHPDVTHAALVAMQDELLGEKSCAFIVSRNPDLKPPVLRRHLLALGVAEYKLPDRIRLIETMPLTAVGKIDKKHLRKLSSPSSPG

SEQ ID NO: 29499 - DNA, 1611 bp, Shigella flexneri 2a str. 301
  CDS (1)..(1611)
atgagcattccattcacccgctggccggaagagtttgcccgtcgctatcgggaaaaaggctactggcaggatttgccactgaccgacattctgactcgccacgctgcgagtgacagcatcgcggttatcgacggcgagcggcagttgagttatcgggagctgaatcaggcggcggataacctcgcctgtagtttgcgccgtcagggcattaaacctggtgaaaccgcgctggtacaactgggtaacgtcgctgaactttacattacctttttcgcgctgctgaaactgggcgtcgcgccggtgctggcgctgttcagccatcagcgtagtgaactgaacgcctacgccagccagattgaaccggcgttactgattgccgatcgccagcatgcgctatttagcggggatgatttcctcaacacatttgttgcagagcattcttccattcgcgtggtgcaactgcacaacgacagcggtgagcataacttgcaggatgcgattaaccatccggcagagggttttactgccacgccatcacctgctgatgaagtggcctatttccagctttccggcggcaccaccggcacaccgaaactgatcccgcgcactcataacgactattactacagcgtgcgtcgtagcgccgagatttgtcagttcacacaacagacgcgctacctgtgctcgatcccggcggctcataactacgctatgagttcgccaggatcgctgggcgtctttcttgccggaggaacggttgttctggcggccgatcccagcgccacgctttgcttcccgttgattgcaaaacatcaggttaacgttaccgcgctggtgccgccggcagtcagcctgtggttgcaggcgctggctgaaggcgaaagccgggcgcagcttgcctcgctgaaactgttacaggtcggcggcgcacgtctttctgccacgcttgcagcgcgtattcccgctgagattggctgccagttgcagcaggtgtttggcatggcggaagggctggtgaactacacccgtcttgatgatagcgcggagaaaattatccatacccagggttacccaatgtgtccggacgatgaagtgtgggttgccgatgccgaaggaaatccactgccgcaaggggaagttggacgcctgatgacgcgcgggccgtacaccttccgtggctattacaaaagtccgcagcacaatgccagtgcctttgatgccaacggtttttactgttccggcgatctgatctctattgatccagagggttacatcaccgtgcaggggcgcgagaaagatcagatcaaccgtggcggcgagaagatcgctgccgaagatatcgaaaacctgctgctgagccatccggcagtgatctatgccgcactggtgagcatggaaaatgagctgatgggcgaaaaaagctgtgcttatctggtggtaaaagagccgctgcgcgcggtgcaggtgcgtcgtttcctgcgtgaacagggtattgccgaatttaaattaccggatcgcgtggagtgtgtggattcacttccgctgacggcggtcgggaaagtcgataaaaaacaattacgtcagtggctggcgtcacgcgcatcagcctga

SEQ ID NO: 29500 - protein, 536 aa, Shigella flexneri 2a str. 301
MSIPFTRWPEEFARRYREKGYWQDLPLTDILTRHAASDSIAVIDGERQLSYRELNQAADNLACSLRRQGIKPGETALVQLGNVAELYITFFALLKLGVAPVLALFSHQRSELNAYASQIEPALLIADRQHALFSGDDFLNTFVAEHSSIRVVQLHNDSGEHNLQDAINHPAEGFTATPSPADEVAYFQLSGGTTGTPKLIPRTHNDYYYSVRRSAEICQFTQQTRYLCSIPAAHNYAMSSPGSLGVFLAGGTVVLAADPSATLCFPLIAKHQVNVTALVPPAVSLWLQALAEGESRAQLASLKLLQVGGARLSATLAARIPAEIGCQLQQVFGMAEGLVNYTRLDDSAEKIIHTQGYPMCPDDEVWVADAEGNPLPQGEVGRLMTRGPYTFRGYYKSPQHNASAFDANGFYCSGDLISIDPEGYITVQGREKDQINRGGEKIAAEDIENLLLSHPAVIYAALVSMENELMGEKSCAYLVVKEPLRAVQVRRFLREQGIAEFKLPDRVECVDSLPLTAVGKVDKKQLRQWLASRASA

SEQ ID NO: 29501 - DNA, 1737 bp, Shewanella oneidensis MR-1
  CDS (1)..(1737)
atgtctgtttcaacgaatcaagtaacaaatcaagcaactaatcaaaccattagtccccttaaatacagtgagttccgggggcctaatgccccggaacttgttgaaaaaaccatagggcaataccttgacgatatcgctaacacctatccagaacagttagctgttgtcgttaaccatcaagatattcgttggaattaccgtcaatatcttgcgcgaatcgatgcccttgccgcgggcttgctcaaattgggtataggtcccggtgatcggatcggtatttggtcacctaataatattgaatggtgtttaacccaattcgccaccgccaaaattggcgccatcatggtgtgtattaaccccgcttatcgccctgaagaattacaatatgctctgactaatgtgggttgccgagcggtgatctgcgctgacaaatttaaatccagcaactatttgcagatgctttatacgctggcgcctgagctaaaggagtgcgccgcgggtcaattgcaggctaaggcattaccagagttgcagtttgttatccgcatgggggctgaaaagtctcccggcatgttgaacttcgatgacttattagtcgaggtgagcgcagatgataaggcaatgcttgagcgtatcgccaacggactcagcccctatgatgctatcaatattcagtttacctctggcacaacaggtagtcccaaaggggcgaccttatcacaccataacatcttgaataacggttacttagtggccgaggcaatgaagtttacctgtgacgacaagctctgtatccctgtgcctttataccattgttttggtatggtgttaggtaacctcgtttgcttagctaagggcgctgcggctgtatttccgggagattctttcgatccgcttaccaccttagaagtggttgagcgcgagcgctgcaccgcactgcacggtgttcccaccatgtttattgccgaattagaacatcctgaatttacacgttttgatctcagttcgttacgtacgggcgtgatggcgggggcgacttgccctgaagaagttatgcgccgtgtacaacagctaatgtatatgcaggaagtgttaattgggtatggccaaaccgagtgcagcccgctgaatcacattaccgaaatcgattctccagtggagaagcgtgttctcaccgtcggccgtgcgttgccccataccgaagtgaaaattgtcgatgaatttggcgaagtgctgccgattaatcagcccggtgaagtttgtagccgagggtattgcatcatgcagtgctactggaatgatcctgaaaaaaccgcggctacgattgaccgcgaaggttggttacattctggcgatattggtcaaatggatgaacagggttatgtgcaaatcgttggccgtattaaagatatgattattcgcggtggtgagaatatctatccccgtgaaattgaagaaaaactctatacccataaagatgtgcaggatgccgcggtgtttggggtacacagtgataaatatggtgaggaagtctgtgcctggatcaaggtccgctcaggggcgacgatcaaagaggaagatattcgtcatttcctcactgaaaagttcgcctattttaaagtgccacgttacatcaaatttgtggaccaatacccaatgactgttacgggtaaaatccaaaaattcaaaatgcgtgagttgatgtatcaagagttgtacgaagatattaatgcctaa

SEQ ID NO: 29502 - protein, 578 aa, Shewanella oneidensis MR-1
MSVSTNQVTNQATNQTISPLKYSEFRGPNAPELVEKTIGQYLDDIANTYPEQLAVVVNHQDIRWNYRQYLARIDALAAGLLKLGIGPGDRIGIWSPNNIEWCLTQFATAKIGAIMVCINPAYRPEELQYALTNVGCRAVICADKFKSSNYLQMLYTLAPELKECAAGQLQAKALPELQFVIRMGAEKSPGMLNFDDLLVEVSADDKAMLERIANGLSPYDAINIQFTSGTTGSPKGATLSHHNILNNGYLVAEAMKFTCDDKLCIPVPLYHCFGMVLGNLVCLAKGAAAVFPGDSFDPLTTLEVVERERCTALHGVPTMFIAELEHPEFTRFDLSSLRTGVMAGATCPEEVMRRVQQLMYMQEVLIGYGQTECSPLNHITEIDSPVEKRVLTVGRALPHTEVKIVDEFGEVLPINQPGEVCSRGYCIMQCYWNDPEKTAATIDREGWLHSGDIGQMDEQGYVQIVGRIKDMIIRGGENIYPREIEEKLYTHKDVQDAAVFGVHSDKYGEEVCAWIKVRSGATIKEEDIRHFLTEKFAYFKVPRYIKFVDQYPMTVTGKIQKFKMRELMYQELYEDINA

SEQ ID NO: 29503 - DNA, 1599 bp, Shewanella oneidensis MR-1; identical to SEQ ID NO: 14206
  CDS (1)..(1599)

SEQ ID NO: 29504 - protein, 532 aa, Shewanella oneidensis MR-1; identical to SEQ ID NO: 14207

SEQ ID NO: 29505 - DNA, 1689 bp, Pseudomonas putida KT2440
  CDS (1)..(1689)
atgccccagccaagctacacccagggcacccaggacaagcccctgctgacccaatgcatcggcgacgccttcgacgccaccgtagcccgcttccccgaccgtgaggcgctggtggttcaccatcaggccctgcgctacacgtggcggcaactggccgatgccgtcgaccagcacgcccgcgcgctgatggccctgggcgtgcagcccggtgaccgtcttggcatctgggcacccaactgcgccgagtggtgcattacccagttcgccagcgccaaggttggcgcgatcctggtcaacatcaacccggcctaccgttccagcgaactggactatgcccttggccagtccggctgccgctgggtgatctgtgccgacgcattcaagacgtccgattaccacgccatgctgcagggcctgctcccgggcctggccagcagccaaccgggtgcgctgatctgcgagcggttccccgaactgcgtggcgtggtcagcctggcgctgtcgccaccgccggggtttctggcctggcacgcattgcaggcccgtgccgaggttgtcagcggcgaggccctggccgcgcgccaggcacaactgcgttgcgacgacccgatcaacatccagtacacctcaggcaccaccggtttccccaagggggccacccttagccacagcaatatcctcaacaacgggtacatggtcggtgaaagcctgggccttaccgagcacgatcggctggtggtgccggtgccgctgtaccactgcttcggcatggtcatggccaaccttggctgcatgacacacggcagcgcactgatttaccccagcgatgccttcgacccgctggccacgctgcgcgcagtggcgcaggaaaaagccactgcgctgtatggcgtgccgaccatgttcattgccgaactggaccatccacagcgtggtgaattcgacctgtcgagcctgcgcaccgggatcatggccggtgcgacctgcccgatcgaggtgatgcgccgggtgattggcgagatgcacatggccgaagtgcagattgcctatggcatgaccgagaccagcccggtgtccttgcagaccggtgccgctgacgacctggagcgtcgcgtgaccagcgtcggtcgcacccagccccggctggagagcaaggtggtggacgctgaaggcaacactgtcccgcgtggcgagatcggtgaactgtgcacccgcggctacagcgtgatgctgggttactggaacaaccccaaagccaccgccgagagcatcgacgcagagggctggatgcacaccggcgacctggcggtgatggacgagcagggctatgtgcgtattgtcgggcgcagcaaggacatgatcattcgcggcggcgagaacatttacccgcgcgagctggaggagttcttcttcacccacccggcggtggccgatgtgcaggtgattggcgtgccctgcagcaagtacggtgaagagatcgtggcctgggtgcggctgcacccggggcatgctgtcagtgaggtagagttgcgtgagtgggcgagggcaaggattgcgcacttcaaggtgccccggtatttccgttttgtcgacgagttcccgatgacggtgacgggcaaggtgcagaaattccggatgcgcgagatcagtgtcgaagagctgaaagcaacggccttgcccaagatttga

SEQ ID NO: 29506 - protein, 562 aa, Pseudomonas putida KT2440
MPQPSYTQGTQDKPLLTQCIGDAFDATVARFPDREALVVHHQALRYTWRQLADAVDQHARALMALGVQPGDRLGIWAPNCAEWCITQFASAKVGAILVNINPAYRSSELDYALGQSGCRWVICADAFKTSDYHAMLQGLLPGLASSQPGALICERFPELRGVVSLALSPPPGFLAWHALQARAEVVSGEALAARQAQLRCDDPINIQYTSGTTGFPKGATLSHSNILNNGYMVGESLGLTEHDRLVVPVPLYHCFGMVMANLGCMTHGSALIYPSDAFDPLATLRAVAQEKATALYGVPTMFIAELDHPQRGEFDLSSLRTGIMAGATCPIEVMRRVIGEMHMAEVQIAYGMTETSPVSLQTGAADDLERRVTSVGRTQPRLESKVVDAEGNTVPRGEIGELCTRGYSVMLGYWNNPKATAESIDAEGWMHTGDLAVMDEQGYVRIVGRSKDMIIRGGENIYPRELEEFFFTHPAVADVQVIGVPCSKYGEEIVAWVRLHPGHAVSEVELREWARARIAHFKVPRYFRFVDEFPMTVTGKVQKFRMREISVEELKATALPKI

SEQ ID NO: 29507 - DNA, 1683 bp, Pseudomonas putida KT2440
  CDS (1)..(1683)
atgagtcaaccgagctatacccgcggtcgccaggaccgacccttgctgacccagaccatcggccaggccttcgatgccaccgtggcccgctgttgcgacagcgaggccctggtgtcccgccaccagggcctgcgttacagctggcggcagttggccgaacaggtcgaaatatacgcccgcgccctgatcgcactgggcgtgaacaccggcgaccgtgttggcatctggtcgcccaactgcgcccagtggtgcatcttgcagctggccagtgccaaggtcggtgccattctggtcaacatcaacccggcctaccgtgtgggcgaactggaatacgtgttgcgccagtccggctgccgctggctggtctgcgctgaagccttcaagacgtctgattaccacaccatggtgcaggagctggtgcctgaactggccagtgccgcgcctggtgagctggccagtgaatgcctgcccgagttgcgtggcgtcatcagcctggccgccaacccgcctgccggcttcctgccctggcacgcatttgccgagcgggcagggcagacgtctgtcgaggcctgcacagcccgtcagcaaagcctgcaattcgaccagccggtaaacatccagtacacctccggcaccaccggtgcacccaaaggtgccacgctcagtcactacaacatcctcaacaacggtttcatggtgggtgaaagccttggcctgacggcccgcgaccgtatggtgatcccggtgccgctgtaccattgcttcggcatggtcatggcaaacctcggctgcatcacccacggcagcaccatgatctaccccaacgatgctttcgacgccgaacttaccttgcgcgccgtggccgaggagcgcgccaccatcctctacggcgtaccgaccatgttcatcgccatgctcgaccacccgtcccgtgcccacatggacctgtcgaccctgcgcagcggcatcatggccggcgctacctgcccgatcgaggtgatgcgccgggtcatcgaccagatgcacatggcagaagtgcagatcgcctacggcatgaccgaaaccagccccgtgtcgctgcagaccggcccggacgacgatctggagctgcgcgtgaccaccgtcggccgcacccagccgcagctggagaacaagctggtggacgccgatggctgcatcgtccctcgcggagagattggcgaactgtgcacccgcggctacagcgtgatgcttggctactgggacaacccccaggccacggcggatgccatcgacccggccggctggatgcattcgggtgacctggcggtgatggacgagcagggctatgtgcgcatcgtcgggcgcaacaaggacatgatcattcgcggcggcgagaacatttacccgcgtgagctggaggagtttttctacacccacccggcggtggccgatgcgcaggtgatcggcattccgtgcagccgctatggcgaagagatcgtcgcctggatcaagctgcacccggggcacagcgccacggtcgaggagctgcagggctggtgcaaggcacgcatcgcacacttcaaggtgccgcggtatatacgttttgtcgacgagtacccgatgaccgtgaccggcaaggtgcagaagttccgcatgcgtgagatcagtgtggcggagattgcggctgcatctgcgggttga

SEQ ID NO: 29508 - protein, 560 aa, Pseudomonas putida KT2440
MSQPSYTRGRQDRPLLTQTIGQAFDATVARCCDSEALVSRHQGLRYSWRQLAEQVEIYARALIALGVNTGDRVGIWSPNCAQWCILQLASAKVGAILVNINPAYRVGELEYVLRQSGCRWLVCAEAFKTSDYHTMVQELVPELASAAPGELASECLPELRGVISLAANPPAGFLPWHAFAERAGQTSVEACTARQQSLQFDQPVNIQYTSGTTGAPKGATLSHYNILNNGFMVGESLGLTARDRMVIPVPLYHCFGMVMANLGCITHGSTMIYPNDAFDAELTLRAVAEERATILYGVPTMFIAMLDHPSRAHMDLSTLRSGIMAGATCPIEVMRRVIDQMHMAEVQIAYGMTETSPVSLQTGPDDDLELRVTTVGRTQPQLENKLVDADGCIVPRGEIGELCTRGYSVMLGYWDNPQATADAIDPAGWMHSGDLAVMDEQGYVRIVGRNKDMIIRGGENIYPRELEEFFYTHPAVADAQVIGIPCSRYGEEIVAWIKLHPGHSATVEELQGWCKARIAHFKVPRYIRFVDEYPMTVTGKVQKFRMREISVAEIAAASAG

SEQ ID NO: 29509 - DNA, 1689 bp, Pseudomonas putida KT2440
  CDS (1)..(1689)
atgcaagccgacttctggaatgacaagcgcccggcaggcgtgccttccaccatcgacatcaatgcctacgcctcggtcgtcgaggtgttcgagcgctcctgcaagcgctttgccgaccgcccggcgttcagcaacctgggcgtgaccctcagctacgcggaactggagcgccattcggcagccttcgctgcctggttgcagcagcacaccgacctcaaaccgggtgagcgcatcgccgtacagatgcccaatgtgctgcagtaccccatcgccgtcttcggtgccatgcgcgccgggctgatcgtggtcaataccaacccgctgtacaccgagcgcgagatgcgccaccagttcaaggacagtggcgcgcgtgcgctggtgtacctgaacatgttcggcaagcgcgtgcaggaggtgctgcccgataccggtatcgaatacctgatcgaggcaaagatgggtgacctgctgccggccgccaagggctggctggtcaacaccgtggtcgacaagttgaagaagatggtgccggcctaccggttgccccaggcggtgccgttcaagcaggtgctgcgcgagggccgcgggctgtcgcccaaaccggtgtcgctgaacctcgatgacatcgcggtgctgcagtacaccggcggcaccaccggcctggccaagggcgccatgctcacccatggcaacctggtggccaacatgctgcaagtgctggcctgcttctcgcagcacggccccgatgggcagaagctgctgaaggacggccaggaagtgatgattgcgccgctgccgctgtaccacatctatgccttcaccgcgaactgcatgtgcatgatggtcaccggcaaccataatgtgctgattaccaacccgcgggatattcccggcttcatcaaggagctgggcaagtggcgtttctctgccttgctgggcctcaataccctgtttgtcgcactgatggaccacccgggattccgtcagctggacttctcggcgctgaaggtcaccaactctggtggcacagcgctggtcaaagccaccgccgagcgctgggaagaccttaccgggtgccgcatcgttgaaggctacggcctgacagaaacctcgccggtggccagcactaacccctacggccagctggcgcgtctgggtaccgtgggcatccccgtggcgggtaccgcgttcaaggtcatcgatgatgatggcaacgaactgccgctgggcgagcggggcgagctttgcatcaaaggcccgcaggtcatgaaggggtactggcagcagcccgaggcaacggcccaggcactggatgcagaaggctggttcaagaccggtgatatcgcggtgatcgacccggacggcttcacccgaattgtcgaccgcaagaaggacatgatcatcgtctcgggcttcaacgtgtaccccaacgaaatcgaggatgtggtgatggggcatcccaaggtcgccaactgtgcggctatcggcgtgccggacgagcgttccggcgaggcggtcaagctgttcgtggtgccgcgcgagggggggctgagcgttgatgagctgaaggcctactgcaaggccaacttcaccggctacaaagtacccaagcacatcgtgctgcgcgaatcgttgcccatgacgccggtgggcaagattttgcggcgggagttgcgcgatatagcgtga

SEQ ID NO: 29510 - protein, 562 aa, Pseudomonas putida KT2440
MQADFWNDKRPAGVPSTIDINAYASVVEVFERSCKRFADRPAFSNLGVTLSYAELERHSAAFAAWLQQHTDLKPGERIAVQMPNVLQYPIAVFGAMRAGLIVVNTNPLYTEREMRHQFKDSGARALVYLNMFGKRVQEVLPDTGIEYLIEAKMGDLLPAAKGWLVNTVVDKLKKMVPAYRLPQAVPFKQVLREGRGLSPKPVSLNLDDIAVLQYTGGTTGLAKGAMLTHGNLVANMLQVLACFSQHGPDGQKLLKDGQEVMIAPLPLYHIYAFTANCMCMMVTGNHNVLITNPRDIPGFIKELGKWRFSALLGLNTLFVALMDHPGFRQLDFSALKVTNSGGTALVKATAERWEDLTGCRIVEGYGLTETSPVASTNPYGQLARLGTVGIPVAGTAFKVIDDDGNELPLGERGELCIKGPQVMKGYWQQPEATAQALDAEGWFKTGDIAVIDPDGFTRIVDRKKDMIIVSGFNVYPNEIEDVVMGHPKVANCAAIGVPDERSGEAVKLFVVPREGGLSVDELKAYCKANFTGYKVPKHIVLRESLPMTPVGKILRRELRDIA

SEQ ID NO: 29511 - DNA, 1578 bp, Bradyrhizobium japonicum USDA 110
  CDS (1)..(1578)
atgtccacacagccattggcgaatctcgccgacatggtgcgcgagcgcgcgacgagtcgcggcaatgccaccgcctacgagttcgagggccgcgtcaccagcttcgccgcgttcgacatcaagaccaatagggtcgccaacgcgctgatctcgatgggcgtgaagaagggcgagcgcatcgcctatctcggcaagaacagcgacctctatttcgagctgctgatgggcgcgatgaaggctgacgtggtgatggcgccggtgaactggcggctcgcggggcccgaggtcgccttcatcgtcgcggattgcagggcgccggtgctgttcgtcgggcccgagttcatcacactggtccgtcagatcagggatcagattccgggcgtgcgcacgatcatcacgaccgagggcggcgcccctgaatggcaggattttacggcctggcgcgatgcgcagagcggcgacgatccgaaggtaccgatcgatacgaaagacatcgcgatccagctctacacctccggcaccacgggcaagccgaagggcgcgatgctgagccacgcgaacttcctcaacctggtgcaaacaggcaatgccgcggacaagccggagtggaaccggtggtccactgacgacgtctcgctggtcgcgatgccgatcttccacattggcggctcgggctggggcgtgatgggtctctatcacggcgcccgcggcgtgatcgcacgcgagttcgatccgaccaaggtgctggatttcttcgagcagtcgggcatcacgaagctcttcatggtgccggcagcgatgcagttcgtggtgcggcagccgcgcgcgaagacagtcgatttctccaggctgaaatacatgctgtacggcgcctcgccgattccggcagcgctgctgaaggagtgcatcgaggtcttcaaatgcggcttcgtgcagatgtacggcatgaccgagacgacaggcaccatcgtcgcgctgccgccggaggatcacgtcgaggggctggagcggatgcgctcggccggcaaggcgctccccggtgtcgagatcgccattctggatgcggacggcaagccgctgccgccgcgccaggttggcgagatcgcgacgcgctcgggctccaacatggcgggctactggaatttgccggaggcgaccgcgtcgacgctgcgcggcgacggctggctgcgtaccggcgatgccggctacatggacgaggacggctacctctatatccacgaccgcatcaaggacatgatcatctccggcggcgagaacgtctatccggccgaggtcgagagcgcgctgtgcgatcatccagatgtcgccgaggccgccgtgatcggcgtgcccgacgataaatggggcgaagcggtgaaggccgtggtggtgatgaagcccggcaagcaggcgaccgccaccgacatcatcaacttcacccgcgagcgcatcgccgggttcaagacgccgaagagcgtggagtttctgccgacgctgccgaggaatccgtcaggcaagattttgcgacggcaattgagggagccgtattgggccgggaaggatcggcgggtgaattga

SEQ ID NO: 29512 - protein, 525 aa, Bradyrhizobium japonicum USDA 110
MSTQPLANLADMVRERATSRGNATAYEFEGRVTSFAAFDIKTNRVANALISMGVKKGERIAYLGKNSDLYFELLMGAMKADVVMAPVNWRLAGPEVAFIVADCRAPVLFVGPEFITLVRQIRDQIPGVRTIITTEGGAPEWQDFTAWRDAQSGDDPKVPIDTKDIAIQLYTSGTTGKPKGAMLSHANFLNLVQTGNAADKPEWNRWSTDDVSLVAMPIFHIGGSGWGVMGLYHGARGVIAREFDPTKVLDFFEQSGITKLFMVPAAMQFVVRQPRAKTVDFSRLKYMLYGASPIPAALLKECIEVFKCGFVQMYGMTETTGTIVALPPEDHVEGLERMRSAGKALPGVEIAILDADGKPLPPRQVGEIATRSGSNMAGYWNLPEATASTLRGDGWLRTGDAGYMDEDGYLYIHDRIKDMIISGGENVYPAEVESALCDHPDVAEAAVIGVPDDKWGEAVKAVVVMKPGKQATATDIINFTRERIAGFKTPKSVEFLPTLPRNPSGKILRRQLREPYWAGKDRRVN

SEQ ID NO: 29513 - DNA, 1689 bp, Pseudomonas syringae pv. tomato str. DC3000; identical to SEQ ID NO: 14190
  CDS (1)..(1689)

SEQ ID NO: 29514 - protein, 562 aa, Pseudomonas syringae pv. tomato str. DC3000; identical to SEQ ID NO: 14191

SEQ ID NO: 29515 - DNA, 1542 bp, Vibrio parahaemolyticus RIMD 2210633; identical to SEQ ID NO: 14188
  CDS (1)..(1542)

SEQ ID NO: 29516 - protein, 513 aa, Vibrio parahaemolyticus RIMD 2210633; identical to SEQ ID NO: 14189

SEQ ID NO: 29517 - DNA, 1650 bp, Bacteroides thetaiotaomicron VPI-5482
  CDS (1)..(1650)
atgcaattatttgaacgtactcttgggcaatggctggaacattgggctgaagagactcccgataaggaatatatcgtttattccgaccgtaatcttcgttttacatggagccagcttaaccagcgtgtggatgatatggcgaaaggactgatcgctgttggtgtggaacgtggtactcatgtcggtatttgggcggcgaacgtgcccgattggctgacattgctgtatgcttgtgccaagattggtgcggtatacgtcacggtgaatacgaattataagcaggccgagctggagtatctctgccagaattccgatatgcatacactttgtatcgtcaatggtgaaaaggacagtgattttgtgcaaatgacgtatacgatgcttcctgaactgaaaacctgcgaacgcggtcatttgaagagtgaacgctttccgtatatgaagaatgtgatatacgtcggtcaggagaaacatcggggaatgtataatactgcggaaatcttgctgctggggaataatgtggaagatgaccgcctgactgaacttaaaagtaaagtggactgtcatgatgtggtaaatatgcaatatacatcaggaactaccggtttcccgaaaggagtgatgctgactcattataatattgccaacaacggttttctgaccggcgaacacatgaagtttacggcggatgacaaactctgttgttgtgtgccgctattccattgttttggagtggtgttggctacgatgaactgtctgactcatgggtgtacacaggtgatggtagagcggtttgatccgttggtcgtgttggcttccattcataaagaacgctgtacggctctttacggagtgcctacgatgtttattgccgagttgcatcatccgatgttcgacttgtttgatatgtcttgtctgcgtaccggtataatggcaggttcgttgtgtccggttgaactgatgaaacaggtagaagaaaagatgtacatgaaggttaccagtgtatacggactgactgaagccgctcccggtatgaccgctacccgcatcgatgattcgtttgatgtacgttgtaatacggtaggacgcgactttgaatttacagaagtcagagtgattgatcctgaaaccggcgaagaatgtccggtaggcgtacaaggcgaaatgtgcaatcgtggatataatacgatgaaagggtattataagaatccggaagctacggctgaagtgattgataaagataacttcctgcattcgggcgacttaggcattaaagatgaggacggaaattaccggatcacagggcgtatcaaggatatgattattcgtggtggtgaaaatatctatccacgtgaaatcgaagaattcctttataaacttgatggagtaaaggatgttcaggtagcagggattccctctaagaaatatggtgaagcggttggtgcttttatcatcttgcaggaaggggtggaaatgcatgagtcggacgttcgtgacttctgtaagaataagatttcccgttataagataccgaaatatgtcttttttgtgaaggagttcccgatgacaggcagtggtaaaattcagaaattcagactgaaagatcttggattgcagctttgtaaggagcagggaatagaaattatttaa

SEQ ID NO: 29518 - protein, 549 aa, Bacteroides thetaiotaomicron VPI-5482
MQLFERTLGQWLEHWAEETPDKEYIVYSDRNLRFTWSQLNQRVDDMAKGLIAVGVERGTHVGIWAANVPDWLTLLYACAKIGAVYVTVNTNYKQAELEYLCQNSDMHTLCIVNGEKDSDFVQMTYTMLPELKTCERGHLKSERFPYMKNVIYVGQEKHRGMYNTAEILLLGNNVEDDRLTELKSKVDCHDVVNMQYTSGTTGFPKGVMLTHYNIANNGFLTGEHMKFTADDKLCCCVPLFHCFGVVLATMNCLTHGCTQVMVERFDPLVVLASIHKERCTALYGVPTMFIAELHHPMFDLFDMSCLRTGIMAGSLCPVELMKQVEEKMYMKVTSVYGLTEAAPGMTATRIDDSFDVRCNTVGRDFEFTEVRVIDPETGEECPVGVQGEMCNRGYNTMKGYYKNPEATAEVIDKDNFLHSGDLGIKDEDGNYRITGRIKDMIIRGGENIYPREIEEFLYKLDGVKDVQVAGIPSKKYGEAVGAFIILQEGVEMHESDVRDFCKNKISRYKIPKYVFFVKEFPMTGSGKIQKFRLKDLGLQLCKEQGIEII

SEQ ID NO: 29519 - DNA, 1488 bp, Streptomyces avermitilis MA-4680
  CDS (1)..(1488)
atggccaatctggcggagttcctggtggagacggcacggcggcagccggaacgccccgcgctgcgactggggggccaggtcaccagctacgcggagctcgaccaacgcagcgcccgcgccgccgcgctgctgcgggccgagggcgtacgaccgggagaccgggtcgctctgatgctgcccaacgttcccgagttcgtcgtcctgtactacggcgtgctgcgtgccggagcggtcgtcgtgccgatgaatccgctgctgaagacccgggagaccgaataccacctgcgcgactcgggcgcgcagatgctcttcgagtggcaccaggcgccgggcgagggcgcgcagggcgcagccgccgccggagtgcggcacatggccgtcgagcctgccgccttcgcgggcctgctggccggccacgcgccgctgccggaggtgagcgagccggacagcgaggacgtggccgtgctgctgtacacctccggcaccaccggccgtcccaagggcgccatgctcacccacaccgggctgcgacacaacaccgaggtcaacgcggtcgatgtgcagcggatgacggcggaggacgtggtcgtgggctgtctgccgctgttccacatcttcggccagatctgcgcgatgagcgtgaccgtccgcgccggtgcctcgctcaccctgatcccccggttcgacccgcagaccgtgctggacgccatcgcccgcgaccgggcgacgatcttcgagggcgtaccgaccatgtacgcggcgctgctccagcacccgtcggaggccgacgtgtccacgctgcggatgtgtatctccggcggagcctcgctgccggtggagatcctgcacggcttcgagcgtcgcttcggctgcgtggtgctggagggcttcggcatgtccgagaccagtccggtggtcaccttcaaccaccccgaccggccgcgcaaggccgggtccatcggcaccccgatcaaggacgtacaggtacggctcctcgacgaaaagggccaggacgtgactcccggcgagatcggcgaactggccgtccgcgggccgaacgtgatgaaggggtactggaaccgcccggaggagacggcagccaccatcccggacggctggctgcgcagcggcgacctcgcacaccgggacgaggacggctacctgtacatcgtcgaccgcaagaaggacatgatcatccgcggcggctacaacgtctacccgcgcgagatcgaggaagtgctccacgaacacccggccgtcgcgctggccgcggtggtgggcctggccgacgcgcatcttggcgaggagatagcggccgcggtggtgctgcgcccgaaggcgcaggccacgcccgacgagctccggcagttcgtcaaggagcgggtggcggcgtacaaatacccgcgcgaggtgtggctcgtggacacgctgccgaccggccccagtggcaagattctcaaaagggagatcagcgcgccgacggggtga

SEQ ID NO: 29520 - protein, 495 aa, Streptomyces avermitilis MA-4680
MANLAEFLVETARRQPERPALRLGGQVTSYAELDQRSARAAALLRAEGVRPGDRVALMLPNVPEFVVLYYGVLRAGAVVVPMNPLLKTRETEYHLRDSGAQMLFEWHQAPGEGAQGAAAAGVRHMAVEPAAFAGLLAGHAPLPEVSEPDSEDVAVLLYTSGTTGRPKGAMLTHTGLRHNTEVNAVDVQRMTAEDVVVGCLPLFHIFGQICAMSVTVRAGASLTLIPRFDPQTVLDAIARDRATIFEGVPTMYAALLQHPSEADVSTLRMCISGGASLPVEILHGFERRFGCVVLEGFGMSETSPVVTFNHPDRPRKAGSIGTPIKDVQVRLLDEKGQDVTPGEIGELAVRGPNVMKGYWNRPEETAATIPDGWLRSGDLAHRDEDGYLYIVDRKKDMIIRGGYNVYPREIEEVLHEHPAVALAAVVGLADAHLGEEIAAAVVLRPKAQATPDELRQFVKERVAAYKYPREVWLVDTLPTGPSGKILKREISAPTG

SEQ ID NO: 29521 - DNA, 1512 bp, Streptomyces avermitilis MA-4680
  CDS (1)..(1512)
atggccgccaccctctccctcgccgcgatcctcgccgagaacgcccgccgccgccccgagaagacggcgctcgtcgagggcgagctgcgcctcaccttcgccgaggtgtggcagcgcgcccgcgcccaggccggcgccctcgtcggtctcggcgtacggccgggggaccgggtggcgctcatggcgcccaacaccgccgacttcccccacgcctactacgcgatcgccgcggccggcggtgtggtcgtcccggtccatctcctgttgtcggcgtccgaggtcgagcacgtcctgaaggacagtggcgccacactgctcctgtgccaccccgcgcaggccgagaccggtacggccgccgctcaggccgtcggcgtccaagtcatcacgctgggcgccgagttcgagaagctggccaggatcgccgagccgctgccctcgtacgtcacccgcgcggcggacgacccggccgtcgtgttctacaccagcggaaccaccggcgtccccaagggcgccgtgctcagccacttcaacctggtcatgaacgcgaccgtcaacgccttcgacgccaacgacatccgccccgacgacgtcgccctcggcgctctcccgctgtttcacgccttcggccagacggtctccatgaactccacctggcgcgcgggcgcgacgctcgtcctgctcccgcgcttcgacgcggcgcgcgcgatcgagctgatggtgaaggagggggtgaacacgttccacggtgtcccgacgatgttcgtcgccctggcgggcgccgccgcagccatggacgcgctgcccgagctgcgcgtctgcgtgtcgggcggcgcctcgctgccactcgccgtactggaacgcttcgaggaggcgttcggcgcgaagatctacgaggggtacgggctgtcggagacctcgccgaccgcgaccgtgaaccagcccgttttcggcaccagggcgggcaccatcgggcacccgctgtggggcgtggacgtcgagatcgcgcgtgccgaggtcgaaggacgcgtcgaactgctgccgcccggcgagctgggcgaggtcgtcgtccggggccacaacgtcttctccggttacctcggccgccccgaagccaccgccgagacgctcgtcgacggctggctgcgcaccggcgacctcggcaccaaggacgacgagggcttcctgcggatcgtcgaccgcaagaaggacgtcatcatccgcggcggctacaacgtctacccgagggaggtcgaggaggtgctcctgcgccaccccggcgtcgcccaggccgccgtgatcggactgccggacgagctgcacggcgaagaggtgtgcgcggtcgtcgtacgcgccacgggcgccgtcccggaggccgccgagatcaccgagtggtcgaaggagcatctggggcggcacaagtacccgcggcgcgtcgagttcacggacgccctgccgctgggcccgagcatgaagatcctcaagcgggagctgagggtgcggtacgcacaatga

SEQ ID NO: 29522 - protein, 503 aa, Streptomyces avermitilis MA-4680
MAATLSLAAILAENARRRPEKTALVEGELRLTFAEVWQRARAQAGALVGLGVRPGDRVALMAPNTADFPHAYYAIAAAGGVVVPVHLLLSASEVEHVLKDSGATLLLCHPAQAETGTAAAQAVGVQVITLGAEFEKLARIAEPLPSYVTRAADDPAVVFYTSGTTGVPKGAVLSHFNLVMNATVNAFDANDIRPDDVALGALPLFHAFGQTVSMNSTWRAGATLVLLPRFDAARAIELMVKEGVNTFHGVPTMFVALAGAAAAMDALPELRVCVSGGASLPLAVLERFEEAFGAKIYEGYGLSETSPTATVNQPVFGTRAGTIGHPLWGVDVEIARAEVEGRVELLPPGELGEVVVRGHNVFSGYLGRPEATAETLVDGWLRTGDLGTKDDEGFLRIVDRKKDVIIRGGYNVYPREVEEVLLRHPGVAQAAVIGLPDELHGEEVCAVVVRATGAVPEAAEITEWSKEHLGRHKYPRRVEFTDALPLGPSMKILKRELRVRYAQ

SEQ ID NO: 29523 - DNA, 1623 bp, Streptomyces avermitilis MA-4680
  CDS (1)..(1623)
atgaccgaactgtcgtacgcgcacgggacgagcacgacaccgctcctcggcgacaccatcggggcgaacctcgaccgggcgatcgccgcgtatcccgaccgtgacgccctcgtggacgtgccctccgggcggcgctggacctacgccgagttcggtgccgccgtcgacgaggtggcgctggggctgctcgccaagggcgtgctgaagggcgaccgggtcggcatctgggcggtcaactgccccgagtgggtgctcgtccagtacgcgaccgcccgcatcggcgcgatcatggtgaacatcaatcccgcctatcgcgcccacgagttggcgtacgtcctccggcaggcggggatctcggtgctcgtcgcctcgctcgcgcacaagagcagcgactaccgcgccctggtcgaccaagtgcgtgagaaatgccccgagttgcgggagacggtctacatcggcgacccgtcctgggaggcgttgacggcgggcgcggcctcggttccgtacgagcggctgatcgccggcgcggccgacttgagctgtgacgacccggtcaacatccagtacacctcgggcaccacgggcttccccaagggggccaccctctcgcaccacaacatcctcaacaacggctactgggtgggccgtacggtcggctacaccgaagaggaccgggtgtgcctgcccgtgccgctctatcactgcttcggcatggtcatgggagctttgggcgccacgtcgcacggcgcgtgcatcgtgctccctgccccttccttcgacccggccgccacccttgcggcggtccagcgggagcgctgcacgtccttgtacggcgtgccgaccatgttcatcgcggagttgaacctcccggacttcgcgtcgtacgacctctcctcgctgcgcaccggcatcatggcgggctcgccctgcccggtggaggtgatgaagcgggtggtcgccgagatgcacatggcggaggtgtccatctgctacggcatgacggagacctcgccggtgtcgttgcagacgcgccgcgacgacgacctggagcaccgcaccggcaccgtcggacgcgtgctcccgcacatcgaggtcaaggtcgtcgacccggcaggcggggtgacggtgccgcgcggcaccgcgggcgagctgtgcacccgcggctacagcgtcatgctcggctactgggacgaacccgagaagaccgcggaggccgtggacgcggggcgctggatgcacacgggcgacctcgccgtgatgcgcgagaacgggtacgtcgagatcgtcggccgcatcaaggacatgatcatccggggtggggagaacatctacccgcgcgagatcgaggagttcctgtacgggcatccgaagatcgccgacgtacaggtggtcggcgtgccgcacgagcggtacggcgaggaggtcctggcctgcgtcatcccgcgcgatccggccgacccgccgacgctggaggagctgtgggccttctgcgacgggcagctggcccactacaagatccccagtcggctgcggatcctggactccttcccgatgacggtgtccgggaaggtgcgcaagatcgaactgcgggagcaggcggcgcgggaggggcgggacgactga

SEQ ID NO: 29524 - protein, 540 aa, Streptomyces avermitilis MA-4680
MTELSYAHGTSTTPLLGDTIGANLDRAIAAYPDRDALVDVPSGRRWTYAEFGAAVDEVALGLLAKGVLKGDRVGIWAVNCPEWVLVQYATARIGAIMVNINPAYRAHELAYVLRQAGISVLVASLAHKSSDYRALVDQVREKCPELRETVYIGDPSWEALTAGAASVPYERLIAGAADLSCDDPVNIQYTSGTTGFPKGATLSHHNILNNGYWVGRTVGYTEEDRVCLPVPLYHCFGMVMGALGATSHGACIVLPAPSFDPAATLAAVQRERCTSLYGVPTMFIAELNLPDFASYDLSSLRTGIMAGSPCPVEVMKRVVAEMHMAEVSICYGMTETSPVSLQTRRDDDLEHRTGTVGRVLPHIEVKVVDPAGGVTVPRGTAGELCTRGYSVMLGYWDEPEKTAEAVDAGRWMHTGDLAVMRENGYVEIVGRIKDMIIRGGENIYPREIEEFLYGHPKIADVQVVGVPHERYGEEVLACVIPRDPADPPTLEELWAFCDGQLAHYKIPSRLRILDSFPMTVSGKVRKIELREQAAREGRDD

SEQ ID NO: 29525 - DNA, 1617 bp, Bacillus cereus ATCC 14579
  CDS (1)..(1617)
atgctagtaggttatacagaatggccaaaagaatttgccgatcattatcgagaagaaggatgttggcttggtgaaacatttggaggagtgttaagagagcgggctgagaaatatggagatcgaatcgcggttgtaagtggtaagaagcatatgacatatagtgaacttgataaaaatgccgatcgtttagcagcaggtttactgaatttaggaataaagaaaggggacagagttgtaatccagttacctaacattatcgagtttttcgaaatatgttttgcactatttcgaattggagcgcttcctgtctttgcactaccttcacatcgaagcagtgaaattagttatttttgtgagtttggtgaggcgagcgcttacgttatttcagataaggctctcggttttgattatcgaaaactagcaagagaagtgaaagagaaagtgccaactttacaacgtgtaattgtagtgggggaagaagaagagtttgtgaacataaatgatctgtatatggatcccgtctcattaccagaagttcagccaagtgatgttgcatttctccaattatcaggagggacaacaggtctttctaaattaattcctagaacacatgatgactatatttatagtttacgtgtaagcgctgaaatttgtaatttgaatgcagaaagcgtctatatggcagttcttccagtagcacacaattacccaatgagttctccagggacatttggaactttctatgcgggtggaaaagtggtattggcaactggtggtagtccagatgaggcatttgctcttattgaaaaagaaaaagttacaattacagcgctcgttcccccattagcaatgatttggcttgatgctgcatcttctcgtaataccgatttatcgagcctagaggttattcaagtaggtggtgctaagtttagcgctgaggttgcaagacgtatacgccctacatttggatgtacgttacagcaagtattcggtatggcggaaggattagtgaactatacaagattagacgatccggaagaaattattattcatacacaaggtagaccaatgtctgcactcgatgaagtacgagttgttgatgaaaatgacaacgatgtacaacctggcgaagtaggtagtttattaacaagaggtccatatacaattcgtggttactataaagctgaagagcataatgcacgatcatttacaaaggatgggttttatcgcacaggtgatcttgtaaaagtaaatgaacaaggatacatcattgtagaaggaagagataaagatcaaattaaccgtggtggtgagaaagttgctgcggaagaagttgaaaatcatttattagcacacgatgcggttcatgacgtagcaattgtatctatgcctgacgattatttaggtgaacgcacctgtgcttttgttatagctcgcgaacaagttccggcagtaagtgaattaaaaatgtttttaagagaacgtggtatcgcggcttataaaattccagatcgaattgaatttattgaatcattcccgcaaacaggagtcggaaaagtcagcaaaaaagaactacgtaaagtcattgctgaaaaactaattatagtaaaacaataa

SEQ ID NO: 29526 - protein, 538 aa, Bacillus cereus ATCC 14579
MLVGYTEWPKEFADHYREEGCWLGETFGGVLRERAEKYGDRIAVVSGKKHMTYSELDKNADRLAAGLLNLGIKKGDRVVIQLPNIIEFFEICFALFRIGALPVFALPSHRSSEISYFCEFGEASAYVISDKALGFDYRKLAREVKEKVPTLQRVIVVGEEEEFVNINDLYMDPVSLPEVQPSDVAFLQLSGGTTGLSKLIPRTHDDYIYSLRVSAEICNLNAESVYMAVLPVAHNYPMSSPGTFGTFYAGGKVVLATGGSPDEAFALIEKEKVTITALVPPLAMIWLDAASSRNTDLSSLEVIQVGGAKFSAEVARRIRPTFGCTLQQVFGMAEGLVNYTRLDDPEEIIIHTQGRPMSALDEVRVVDENDNDVQPGEVGSLLTRGPYTIRGYYKAEEHNARSFTKDGFYRTGDLVKVNEQGYIIVEGRDKDQINRGGEKVAAEEVENHLLAHDAVHDVAIVSMPDDYLGERTCAFVIAREQVPAVSELKMFLRERGIAAYKIPDRIEFIESFPQTGVGKVSKKELRKVIAEKLIIVKQ

SEQ ID NO: 29527 - DNA, 1683 bp, Nitrosomonas europaea ATCC 19718
  CDS (1)..(1683)
atgaatcacgccggcattatcgatctggttcctgccgaggttcgccaacagtggacaaatgatgggatttatcctgataaatccttatttgacctgttttgtgagcatgcgcggaaaaatcctgaaaaaccggctgtggtcacgctggaccacaccctaacctatcggcagttgctgcacaaagttacccgtctggcgaacagtttacggcatctgggggtggttgccggcgatgtcattgcttatcagctggccaatagcgcgcatcactgcgcaattgatctggctgcggcagcattgggtgccatcgttgcacctttcccgccaggacgcggacgccttgacattcaatcgctattgcagcgatgtgatgcgcgtgtaatcgtggttgaacccttgttcctgcaacaggatttatgtgaactgatcgaatcactgcggcctgcgttactgtcgctgcggatactggtggtggatggtgtggcacgaacaggctggcacacgctgaacgacctatttcaatcccggccgattgctaccgaagaactgcctgatgtcgatcctgattcacccgcacgtttcctgatttcttccggaactgaagcagatcccaaatggattgcttattcccataacgcactggcgggcgggcgtggacgtttcctgcagcatattcacacgcgggacaaagatttccgtgcgctttatctggtgccactgggaacggctttcggctcgtcagcgacattcggtgtgttgtcctggatggggggaaccctgattatgttgccgcggtttgatgttgtggcaacgattcgggcgattgggcaactcagaccaacgcatgtttttggtgttccgaccatgtttcagcgcattgcagctgatccggacctggcgaagatcgatatttccagcctggttgcaatcgtcagtggcggtgcaaaaatcgatgaaacctcgatcctgcgttgctgtggcgcattcggatgcagtttcatcaatctgtatggttcagctgatggcgtgaattgccatacgatgctggacgataatatgactaccgttctgcatacaaccggccgtcctaatcccgaggtatgctcgatcagaattgtcgatgatcggaagaacgaactggcgcagggccaaactggtgaaattgctgcgcgcggccccatcacgcctatgcaatatgtcaataatcccgagctggatgcgttgtaccgcgatgccgagggttgggtgtataccggagatctcggatttatcgatgaacagggtaatctggtactgaccggcaggaaaaaggaaatcatcattcgtggtggtatcaacatcagcccggcgcagattgaagatattgccgcatcccatcccgctgtcgtcagcgcagcctgcatcccggtagaggatgaagatctgggacaccgtgtctgcctgtgcctggtgatgagcgaaggtgccgagcggccatcgttggcgcaatttgcccgttttttgctcgatcgcggtctggagcaaaacaaactacccgagtatctgcgctatttgagacaactgccgctcagtccggcaggaaaagtcgataaaaagcagttgattgccgaactggaaaatacgcaattcaagagtaatgctgcggtggtcagtagagtggatttttcagcaaggatgcactga

SEQ ID NO: 29528 - protein, 560 aa, Nitrosomonas europaea ATCC 19718
MNHAGIIDLVPAEVRQQWTNDGIYPDKSLFDLFCEHARKNPEKPAVVTLDHTLTYRQLLHKVTRLANSLRHLGVVAGDVIAYQLANSAHHCAIDLAAAALGAIVAPFPPGRGRLDIQSLLQRCDARVIVVEPLFLQQDLCELIESLRPALLSLRILVVDGVARTGWHTLNDLFQSRPIATEELPDVDPDSPARFLISSGTEADPKWIAYSHNALAGGRGRFLQHIHTRDKDFRALYLVPLGTAFGSSATFGVLSWMGGTLIMLPRFDVVATIRAIGQLRPTHVFGVPTMFQRIAADPDLAKIDISSLVAIVSGGAKIDETSILRCCGAFGCSFINLYGSADGVNCHTMLDDNMTTVLHTTGRPNPEVCSIRIVDDRKNELAQGQTGEIAARGPITPMQYVNNPELDALYRDAEGWVYTGDLGFIDEQGNLVLTGRKKEIIIRGGINISPAQIEDIAASHPAVVSAACIPVEDEDLGHRVCLCLVMSEGAERPSLAQFARFLLDRGLEQNKLPEYLRYLRQLPLSPAGKVDKKQLIAELENTQFKSNAAVVSRVDFSARMH

SEQ ID NO: 29529 - DNA, 1608 bp, Chromobacterium violaceum ATCC 12472
  CDS (1)..(1608)
atgagcgtcgccttcacccgctggccggatgacctggccgcgcgctaccgcgccgccggctactggaacgaccagccgatgaccgagatgctggcgcggcaatgccgcgagcgtcccgacgcgcccgccgtgctgtgcggcgagcgcgagatcagctacgccgagctggaccgccgcgcgggcaacctggccgcctggctgctggcgcgcggcgtggcccgccacgacaccgcgctggtgcagctgccgaatgtcgccgagttctacatcgcgttgttcgcgctgttcaagatcggcgccgcgccggtcaacgcgctgttcagccaccagaagctggagctgtcggcctatgcccgccagatccagcccaagctgctgatcgccgaccgccgccattcgctgttcggcgacgacgcgatggcggacgagctggccgcgatctcgccggcgctgagcgtgcgcctgttcgcccacgacgagctggaaaccgtactggagcgcgactgcggcggcctgccggaccaagccggccccagcgccgccgacgaagtggcgttcttccagctgtccggcggcagcaccggcacgcccaagctgattccgcgcacccacaacgactacttctacagcgtgcgccgcagcgccgagatctgcgaactcggcccgcatacccgcttcctgtgcgcgctgcctgcgccgcacaacttcccgctcagctcgccgggcgcgctcggcgtgttccacgccggcggcgcggtggtgctggcgcccaatccggaagcgctgtcctgcttcgcgctggtggagcgccaccgggtggacatcgccgcgctggtgccgccggccgtcgcgctgtggctgcaggccgcgcccggccgcgaggcccagctgaaaagcctgaaactgctgcaggtcggcggcgccagcttcgccgaagccaccgcccgccaggtgccggaagtgctgggctgcaaactgcagcaggtgttcggcatggccgagggcctggtcaactacacccgcctggacgacggcgatgacatcgtctatggctgccagggccggccgatgagcgatgccgacgaggtgaaggtggtggacgaagccggccatccggtgccgaccggcacgccgggcatgctggccacccgcggtccctacaccttccgcggctactacctggcgccggagcacaacgcccgcgtgttcgacaacgagggattctattactcgggcgacgtggtggtggccgacgagcgcggctacctgcgcgtggtcggccgggtgaaggaccagatcaatcgcggcggcgagaagatcgccgccgaggaaatcgaacacctgctgctgcaacacccgcacgtggcccaggccgcgctggtggcgatgcccgacgcgatgctgggcgagaagagctgcgccttcatcgtgccgcgtggcgacggtctgaagtcggtggcgctgcgccgcttcctgcgcgagcagggcgtggccgactacaagctgcccgaccgtttcgaactgctagacaccctgccactgacccacgtcggcaaaatagacaaacaagcgctgcgcggcatgctggccgccgcggccggagcctga

SEQ ID NO: 29530 - protein, 535 aa, Chromobacterium violaceum ATCC 12472
MSVAFTRWPDDLAARYRAAGYWNDQPMTEMLARQCRERPDAPAVLCGEREISYAELDRRAGNLAAWLLARGVARHDTALVQLPNVAEFYIALFALFKIGAAPVNALFSHQKLELSAYARQIQPKLLIADRRHSLFGDDAMADELAAISPALSVRLFAHDELETVLERDCGGLPDQAGPSAADEVAFFQLSGGSTGTPKLIPRTHNDYFYSVRRSAEICELGPHTRFLCALPAPHNFPLSSPGALGVFHAGGAVVLAPNPEALSCFALVERHRVDIAALVPPAVALWLQAAPGREAQLKSLKLLQVGGASFAEATARQVPEVLGCKLQQVFGMAEGLVNYTRLDDGDDIVYGCQGRPMSDADEVKVVDEAGHPVPTGTPGMLATRGPYTFRGYYLAPEHNARVFDNEGFYYSGDVVVADERGYLRVVGRVKDQINRGGEKIAAEEIEHLLLQHPHVAQAALVAMPDAMLGEKSCAFIVPRGDGLKSVALRRFLREQGVADYKLPDRFELLDTLPLTHVGKIDKQALRGMLAAAAGA

SEQ ID NO: 29531 - DNA, 1689 bp, Chromobacterium violaceum ATCC 12472
  CDS (1)..(1689)
atgccgaacgccagttatgcgcagggcgcctgcgatcagccgttgctggagcgtacgataggcagctttttcgacgcggcttgcgaacggcatggcggccgcctggcgctgcgggtccgccatcaggacatttcatggagttacagggagctgcgcgacctggtggatcgcgtggcttgcggcttgctgaggctgggcttgcatgccggcgaccgggtgggcatctggtcgcagaaccgcgccgaatgggtgctgatgcagttcgcggcggccaaagcgggcttggtgttggtcaacatcaatcccggctaccgccgcgccgagctggagtacgcgctgaacaaggtggggtgccgggcgctggtgttgtctcccagcttcaagagcagcgattacgtggcaatgatccgcgatctggcgccggagctggatgactgccggccgggcgagctgcagtcggtgcgcttgccggcattgcgctgggtgctgcgcatcggtcagcaacgcctgcccggcatgctggcattctccgaactgctggcggagccgtccgcggacgagctggcggccttgcaggcgttgggcgcggcgctgcgggcggacgaggcggccaatatccagttcacctccggcaccaccggccaccccaagggcgcgacgctgtcccaccgcaacatcctcaacaacgcctggttcgtcggcgcggcgatgcggctggaggcggacgacaggctgtgcattccggtgccgctgtaccactgtttcggcatggtgatgggcaccttgtgctgtctgtgccgcggcgcggccatggtgttcccgggagagggcttcgacccgctttccgtgctggagacggtgcaggaggagcgctgcaccgcgctgcatggcgtgccgacgatgttcatcgccatgctcgaccatccgcgtttcgccgaattcgatctgtccagtctgcgcaccggcatcatggccggcagcccgtgcccggtggaggtgatgcggagggtgatagacaggatgcacatggccgaggtgaccatctgctacggcatgaccgaaaccagtccggtcagcctgcagagcgcgaccgataccccgctggagcagagggtttccaccgtgggctccgcgcatcctcatgtggagctcaagatcgtcgatgccgaaggaggcgtggtgccgcggggccagagcggcgagctgtgcgtgcgcggctattcggtgatgctgggatattgggaggatgaggcgatgacgcgcgccgccatcgacgccgaaggctggatgcataccggcgatctggcgtcgatgcgggaggatggctcggtcaacatcgtcggccgggtcaaggacatggtgatacgcggcggcgagaacgtgtacccgcgcgagattgaggagtttctgtaccgccatcccaagattcaggatgtgcaggtgataggcgtgccggacgcgcgttatggcgaggagctgtgcgcctggatccggctgcgcgacggcgaatgcgcgacggaggaggatatccgttctttttgccaggggcagatcgcccactacaagattccgcggtacatcgagttcgtcgacagctttccgatgaccgtcaccggcaagatacagaagtatctgatgcggcggacgatggtggagaagctgggcctggacgacgcgcgaaccgcctga

SEQ ID NO: 29532 - protein, 562 aa, Chromobacterium violaceum ATCC 12472
MPNASYAQGACDQPLLERTIGSFFDAACERHGGRLALRVRHQDISWSYRELRDLVDRVACGLLRLGLHAGDRVGIWSQNRAEWVLMQFAAAKAGLVLVNINPGYRRAELEYALNKVGCRALVLSPSFKSSDYVAMIRDLAPELDDCRPGELQSVRLPALRWVLRIGQQRLPGMLAFSELLAEPSADELAALQALGAALRADEAANIQFTSGTTGHPKGATLSHRNILNNAWFVGAAMRLEADDRLCIPVPLYHCFGMVMGTLCCLCRGAAMVFPGEGFDPLSVLETVQEERCTALHGVPTMFIAMLDHPRFAEFDLSSLRTGIMAGSPCPVEVMRRVIDRMHMAEVTICYGMTETSPVSLQSATDTPLEQRVSTVGSAHPHVELKIVDAEGGVVPRGQSGELCVRGYSVMLGYWEDEAMTRAAIDAEGWMHTGDLASMREDGSVNIVGRVKDMVIRGGENVYPREIEEFLYRHPKIQDVQVIGVPDARYGEELCAWIRLRDGECATEEDIRSFCQGQIAHYKIPRYIEFVDSFPMTVTGKIQKYLMRRTMVEKLGLDDARTA

SEQ ID NO: 29533 - DNA, 1629 bp, Oryza sativa (japonica cultivar-group)
  CDS (1)..(1629)
atggccgaccgcgcgccgcctccgcctccgccgcccgccgggatcgactccaggagcggcttctgcgcggcgacgcggatcttccacagcacccgcgccccgggcgacctcccgccggagtcgctcccgatgaccgcggcggcctacgccttctccctcctgtcgtcgtcgacgctccccggccgccccgcgctcgtcgacgccgccactggcattgccatctcctacccgtccttcctcgccgccgtccgctccctcgcgggggggctctggtgctccctcggcctccgccccggggacgtcgcgctggttgtcgcgccctcgaggttggaggtccccgtgctcgacttcgcgctcatgtccatcggcgccgtcgtgtcgccggcgaacccggtgtccacgcccgaggagtacgcgcaccaggtcgcgctgtccaggccggtcgtcgcgttcgcggcgcccgaggtggccgccaagctgcccgagcatgtgaggtgcgtcgttatcgggtcggatgagtacgggaggctggcggcgtccgacggccgccgcgcggcggctccggcggcggtggcggtgaagcaatcggacacggcggcggtgctctactcgtcgggcaccacagggcgggtcaaggccgtcgcgatcacgcaccgcaacctcatcgcgctcatgtcgctgcacgccgacaaccgggagaaggtcgcgagggaggccgccgaggccggcgaggagccgccgccgccggcggtgacgctgctccccatccccctgttccacgtgttcgggttcatgatggtgctccgctccgtctccatgggggagacctccgtgctcatggagcggttcgacttcatcgccgcgctgcgcgccatcgagcgctaccgcgtgacgctgctgcccgcggcgccgcccgtgctcgtcgccatggtcaagtacgaggaggcgcgccgccgcgacctctcctccctgctggtcatcggcatcggcggcgctcccctaggccgcgaggtcgccgagcaattcgcttccgtcttccccaacgtggagcttgttcagggctacggtttaaccgaatcgtctggcgcggtggctgccacagtcgggccagaggaatcgaaggcatacggatcggtcgggaagctggggtcgcatttgcaggctaagattgtagatccctccaccggttacgtgggtgatgatgaggcgaccgcagcaacggttgactcagaaggctggttgaaaacaggtgacctctgctacttcaatgaagatggttttctatacatcgttgatcgactgaaggagttgataaagtacaagggataccaggtacctccagcagaactggagcatattctgcagtcccatcctggaatcgctgatgcggcagttatcccatatccagatgaagaagctggggaactaccaatggctttcatagtaaggcaaccaggttcaaatattaccaaggaacaagtcatggattatgtcgcaaaacaggttgcgccatacaagaaggtgcgacgagtggcttttgtcactgcaataccaaaatcgcctgcagggaagatccttcggcgggagcttgtgcagcaggccctgtcgatgggtgcctccaagctttga

SEQ ID NO: 29534 - protein, 542 aa, Oryza sativa (japonica cultivar-group)
MADRAPPPPPPPAGIDSRSGFCAATRIFHSTRAPGDLPPESLPMTAAAYAFSLLSSSTLPGRPALVDAATGIAISYPSFLAAVRSLAGGLWCSLGLRPGDVALVVAPSRLEVPVLDFALMSIGAVVSPANPVSTPEEYAHQVALSRPVVAFAAPEVAAKLPEHVRCVVIGSDEYGRLAASDGRRAAAPAAVAVKQSDTAAVLYSSGTTGRVKAVAITHRNLIALMSLHADNREKVAREAAEAGEEPPPPAVTLLPIPLFHVFGFMMVLRSVSMGETSVLMERFDFIAALRAIERYRVTLLPAAPPVLVAMVKYEEARRRDLSSLLVIGIGGAPLGREVAEQFASVFPNVELVQGYGLTESSGAVAATVGPEESKAYGSVGKLGSHLQAKIVDPSTGYVGDDEATAATVDSEGWLKTGDLCYFNEDGFLYIVDRLKELIKYKGYQVPPAELEHILQSHPGIADAAVIPYPDEEAGELPMAFIVRQPGSNITKEQVMDYVAKQVAPYKKVRRVAFVTAIPKSPAGKILRRELVQQALSMGASKL

SEQ ID NO: 29535 - DNA, 1512 bp, Gloeobacter violaceus PCC 7421
  CDS (1)..(1512)
atgaacctcgcccatttgctcgacgaccaactgcgccaccgccccgaaaaagtggctttcgagggcgacgggcgctcgctttcctatgcgcaactggcgcacctgagcgagaattttgccgcctcgcttaccactgccgggtacggccccggcgatcgcatcgcggtagtgctgcccaacgtgccggagtacgccctggccatgttcgcgctgtggcggcggggggcggtgccggtgctgatcaatccgcagttgaccggccgcgaactggactatattctccgtgattcgcaggcgcgggcggtgatcttgcccgaggcgctcctcggggtcctcgcaccgctgcgctccgagttgcccaacctgcgggcgatcgtgctcggtgtgcccgcagatgaagatctgaacttcgccgggctcgctgccacccccggccagtgtcctgtagccgagcgccacggcgacgacatcgcccagatgatgtacaccagcggcaccaccggtaccccgaaaggtgcgctcatcagccacggcaacctgctcgccaacgcccgctcgggcatcgagcggctctccgtcaccggcgacgatcacctgttctgcatcctgcccgtttttcacgccttcgcctttaccgcggcactggtgatcatgcccttggtcggcgggtcggtcagctttgagtaccgcctgagccccaaaaagctgatggagcatctgagcgatccacgggtcagcgtgatggtagcggtgcccagtctgctctcgacaatcttgcgcttcccgaccgaactgaagctctccgctgcgctgcgctgcatcctctgcggcggcggtccgttgccgccccaactggaggcggccttcgcccagcgcttcggcgatctggtccgccagggctacggcatgaccgaatgctcgccctacgccgcctttagccccccggaccggcccagcaaacccggctcgatcggattgcccatgccccaggggcacaaactggcggtccgcgacccgatctcgggcgattttgcggcaccgggcacagtgggcgaactggtcgtctccggtccccatgtcttcaaaggctactggaaccaacccgaggccacctccgaagctttcgtcgagggctggctacgctccggcgatctgggctatatcgacgaggagggctacttcttcctggtcgatcgcctcaaggacatgattatcgtgggcggcgagaaggtctattcccgcgaagtcgaggacgtgctcctcgcttttgcgccgctgcgggaagtggcggtggttgggcagccggatcccgacaagggcgaaatcgtgcgtgcgttcgtcagtctgcaggagggagccgccatcggtgaggaagaaattatccgcttcgcccgcgaaaggctcgcccccgtcaaagtgcccagatcgatcaccgttttggcagaactgcccaaatcggcgaccggcaaaattctgaagcgcgaactgcgcaaacagttcgcaccgaagtga

SEQ ID NO: 29536 - protein, 503 aa, Gloeobacter violaceus PCC 7421
MNLAHLLDDQLRHRPEKVAFEGDGRSLSYAQLAHLSENFAASLTTAGYGPGDRIAVVLPNVPEYALAMFALWRRGAVPVLINPQLTGRELDYILRDSQARAVILPEALLGVLAPLRSELPNLRAIVLGVPADEDLNFAGLAATPGQCPVAERHGDDIAQMMYTSGTTGTPKGALISHGNLLANARSGIERLSVTGDDHLFCILPVFHAFAFTAALVIMPLVGGSVSFEYRLSPKKLMEHLSDPRVSVMVAVPSLLSTILRFPTELKLSAALRCILCGGGPLPPQLEAAFAQRFGDLVRQGYGMTECSPYAAFSPPDRPSKPGSIGLPMPQGHKLAVRDPISGDFAAPGTVGELVVSGPHVFKGYWNQPEATSEAFVEGWLRSGDLGYIDEEGYFFLVDRLKDMIIVGGEKVYSREVEDVLLAFAPLREVAVVGQPDPDKGEIVRAFVSLQEGAAIGEEEIIRFARERLAPVKVPRSITVLAELPKSATGKILKRELRKQFAPK

SEQ ID NO: 29537 - DNA, 1638 bp, Vibrio vulnificus YJ016
  CDS (1)..(1638)
atgaactctgtacaatctgatttcactccatggccagagcagatggcgaacgattatcgacgccttggcttatggcaagataaaacgctctatcagtatctcaagcaatccattattcgctacccgaccaatattgctattgtatgccgtcaacaaagcatcacatacgctgagctggagcgaaaaatccatgcggctgccaatgggtttcgctcgctgggcctcgctgaaggcgataacgtgattctgcagatgaccaatatcgccgagttctatgtcagttactttgcgttgattcatcaaggcattcgcccaatattggcgttatctgcccatcgtcacgctgagattagctacttctgccaacatgcccaagccaaagcgtatctgatcgatggccaaactcgtggttttgactaccaaacgctggccgaaaaacttctcaaagagcacccatgtttgcgccatgtcatcgtcagagccaatcactccgagctgctgcaatctcatttcatctcatttgacgactttcgcgatgaacgagaactggcccctgtcagtaacgcaagtcaggttgccttttttcaactttccggcgggacgacgggcactcccaaattgatcccacgtacgcacaatgattatgcttacagtgtggtcggcagtaacgccatctgtggttttaatgagtacacacgctatctttgcgcgctacccgctgcgcacaattttccgctcagttccccaggttcgcttggagtatttttcgctggtggcaccgttgtcctgacgcaagacccaacgcccaaagcggcatttcctctgattgaacgtcacaaagtaaccgtatcggctctggttcccccgttagctttgctgtggatggatgcggcgccacacgcacgctacaacttatcgagcttacagttaatccaagttggtggtgctaagttgagccaaagtgcggcaaaagctttgccaaaagcactcaattgccagcttcaacaagtgttcggcatggcagaagggctagtgaattatactcgcctggacgatccgctggaggtgatcatcgaaacgcaaggtcggcccatatccgcccatgaccaagtaaaagtggtcaatgaagccggtgaagaggttgcgtgcggagaagaaggttttctccttacccaagggccttatacgattcgcggctactaccgagcaccggagcacaatcagcgttcgttcactcacaacggtttttatcgcactggcgatattgtgaagataacagagcaaggcaatatcatcgtcacaggccgagacaaagatcagatcaatcgtggcggtgaaaaaatcgcggcggaagaagtggagaatcatttactgggccacagtgctattcatgatgtggcgttgattgccattcccgaccgcttgttgggtgaacgaagctgcgcagtgatcgtcaccaaacgtcatctcaatatcacaggaacggaactaaaacgctacttacgcagcaaagggttggcggactataagatccccgatgtgatccaatttgccgatactctgcccaaaacatccgtaggaaaggtcgacaagaaacgcttacgtgaatcttacgcccagcttggtttgagtacttag

SEQ ID NO: 29538 - protein, 545 aa, Vibrio vulnificus YJ016
MNSVQSDFTPWPEQMANDYRRLGLWQDKTLYQYLKQSIIRYPTNIAIVCRQQSITYAELERKIHAAANGFRSLGLAEGDNVILQMTNIAEFYVSYFALIHQGIRPILALSAHRHAEISYFCQHAQAKAYLIDGQTRGFDYQTLAEKLLKEHPCLRHVIVRANHSELLQSHFISFDDFRDERELAPVSNASQVAFFQLSGGTTGTPKLIPRTHNDYAYSVVGSNAICGFNEYTRYLCALPAAHNFPLSSPGSLGVFFAGGTVVLTQDPTPKAAFPLIERHKVTVSALVPPLALLWMDAAPHARYNLSSLQLIQVGGAKLSQSAAKALPKALNCQLQQVFGMAEGLVNYTRLDDPLEVIIETQGRPISAHDQVKVVNEAGEEVACGEEGFLLTQGPYTIRGYYRAPEHNQRSFTHNGFYRTGDIVKITEQGNIIVTGRDKDQINRGGEKIAAEEVENHLLGHSAIHDVALIAIPDRLLGERSCAVIVTKRHLNITGTELKRYLRSKGLADYKIPDVIQFADTLPKTSVGKVDKKRLRESYAQLGLST

SEQ ID NO: 29539 - DNA, 1644 bp, Rhodopseudomonas palustris CGA009
  CDS (1)..(1644)
atggagttcgacgccgttctgctgccaccacgccgcgccgcgagcatcgccgccggcctgtggcacgaccgcaccatcaacgacgatctcgacgcctgcgtggcgcattgtcccgacaaggtcgccctgaccgcggtccggctcgacggcggcgcggtgcgccgcttcagctaccgcgagctcgcaacgctggccgatcgcgtcgcggtcgggctgaaccggctcggcgtcggccgcggcgatgtcgtcgccatgcaacttccgaactggtggcagttcaccgtgctgtatctcgcctgctcgcggatcggcgcggtgctcaatccgctgatgccgatcttccgagagcgcgagctgtcgttcatgctgaagcatggcgacgccaaggtcctggtggtgccgaagagcttccgcggcttcgaccatgaagcgatggcgcgtagcctgcagcccgatttgccggctctgcgtacgatcgtcgtggtcgatggcggcggtgcagacgatttcgacacgctgctgacgacgccggaatgggagaagcagccggacgccgcggcgatccttcaaggcagccgtccttctcctgacgacatcacacaactgatctacacctccggcaccaccggcgagccgaaaggcgtgatgcacagcgccaacacgctgatggccaatatcgtgccctacgcgcagcggctcgcgcttcgcgagtccgacgtgatcctgatggcgtcgccgatggcacaccagaccggcttcatgtatgggctgatgatgccaatcatgctgcgcgccagcgcggtgctgcaggacatctgggagccgacgaaagcggccgaactgattcgcaccgagcgcgtcaccttcaccatggcgtcgacgccgttcctcaccgacctgacccgcgtagtgaaggagagcggcgagccggtacccagcctgaagaccttcctgtgcgccggcgcgccgattcccgggccgctggtcgaacaggctcaggccggtctcggcgccaagatcgtgtcggcctggggcatgaccgagaacggcgcggtgacgctgatcaagctcgacgacgacgacaagctggcctcgaccaccgacggctgcccgctgcccggcgtcgaggtgaaagtaatcgatggcgacggcaaaacgctgccgccgaaccagatcggccggctggtggtacggtcgtgttcgaacttcggtggctatctgaagcggccgcattggaacggcaccgacgccgacggctggttcgacaccggcgacctcgcctacatgacggccgatggctacatccggatcagcggccgcagtaaggacgtgatcatccgcggcggcgaaaacatcccggtcgtcgaggtcgaggcgctgctctacaagcaccccgccgtcgcccaggtcgcgatcgtcgcctatccggacgaacggcttggcgagcgcgcctgcgccgtggtggtgccgaagaccggcgcaagcatcgacttcgccgcaatggtcgagttcctgaaggcgcagaagctggcgctgcaatacatccccgagcggctagtcgtccgcgatgcgatgccggcgacgccgtccggcaagatccagaaattccggctgcgcgagatgctgcagcacaacgatctgtaa

SEQ ID NO: 29540 - protein, 547 aa, Rhodopseudomonas palustris CGA009
MEFDAVLLPPRRAASIAAGLWHDRTINDDLDACVAHCPDKVALTAVRLDGGAVRRFSYRELATLADRVAVGLNRLGVGRGDVVAMQLPNWWQFTVLYLACSRIGAVLNPLMPIFRERELSFMLKHGDAKVLVVPKSFRGFDHEAMARSLQPDLPALRTIVVVDGGGADDFDTLLTTPEWEKQPDAAAILQGSRPSPDDITQLIYTSGTTGEPKGVMHSANTLMANIVPYAQRLALRESDVILMASPMAHQTGFMYGLMMPIMLRASAVLQDIWEPTKAAELIRTERVTFTMASTPFLTDLTRVVKESGEPVPSLKTFLCAGAPIPGPLVEQAQAGLGAKIVSAWGMTENGAVTLIKLDDDDKLASTTDGCPLPGVEVKVIDGDGKTLPPNQIGRLVVRSCSNFGGYLKRPHWNGTDADGWFDTGDLAYMTADGYIRISGRSKDVIIRGGENIPVVEVEALLYKHPAVAQVAIVAYPDERLGERACAVVVPKTGASIDFAAMVEFLKAQKLALQYIPERLVVRDAMPATPSGKIQKFRLREMLQHNDL

SEQ ID NO: 29541 - DNA, 1659 bp, Geobacter sulfurreducens PCA; identical to SEQ ID NO: 14140
  CDS (1)..(1659)

SEQ ID NO: 29542 - protein, 552 aa, Geobacter sulfurreducens PCA; identical to SEQ ID NO: 14141

SEQ ID NO: 29543 - DNA, 1533 bp, Mycobacterium avium subsp. paratuberculosis str. k10
  CDS (1)..(1533)
gtgacgttctggtcgctgattgccgaggccgcacgacgcggctcaccccggccacttctcgccgacgagcacggtcgcagcatgaccgcacgtcagctctacgacgccgcatgcgtcgccgcggccgcgctggccgagcggggagtccgccggggcgccgtcgtgtcctggcagttgcccaccacgctggagaccatggtgctgatggccgcgctggcccggctcggtgcggtgcagaacccgatcatcccggtcctgcgggaaagcgaagtccgcttcatcaccggccagctgaacactgaatactttgtggcgcctgggctttggcgcggcttcgatcacggtgggctggctcgggcactgtcggccgaacggggcttcgaggtcatcaccgtcgacctggcggcgccgccggccgccggtgcgctgcgcctgcccggcgccgatcccgattccctgccggcgccgccgcaatccgccgacgaggcgcgctggatctactactcgtcggggaccaccgccgctcccaaggggattcgccataccgacagctcggtcatcgccggctcggcgggagtggtcggcatggtgggggccaccagcagcgacgtcgatccgatcgcctttccggtcgcacacatcggcggggccgcgatgctggccaccgcactgctgaccggcatgtggttagtgctgttcgaggctttcgacccggccgccactccgctggccatcgccgcacacaatccgacgttcctgggcaccgcgacgcccttcttcgtcgcctatctcgaagcccaacgggcccaagggaatcggccactgttcccgtcgctgcgcggatgcctggccggaggcgcacccatcaccgccgagttgagtcgacgggtccgcgacaccttcggggtggccggcatcgccaacgcctggggaatgaccgagttcccctgcgcgacatccccgtcgctgaccgcggcacccgaggtgctcgaccataccgtggggccgccggtgcccggcgtcgaagtccgcgtggtcgacggcgcagagaatgaactggctgccgggcaggagggcgagctgcggctcaagggaccccagtgcttcctcggctacgccgacccaacgctggacgccgacgccttcgacgaccagggctggctgcgcaccggcgatctcggcctgatcgacgccgacggcaacgtccgcgtcacgggccgcaccaaagacgcgatcatccgcaatgcggagaacatctcggccctcgagatcgagaacgcacttgcggcgcatcccgccgtcgccgacgtcgccgtcatcgggatccccgacccgcgcaccggcgaacgggtctgcgccgtcgtggtacccgcgacggccgacggcgtcacgctggaatcccttgtgcaacactgccgatcacgcgggctgagccgctacaaacaccccgagcgcctggtcgtcgtcgacaccctcccgcgcaaccagttcggcaaggtgatcaagaaggacctgcgcgacgccttcgggtga

SEQ ID NO: 29544 - protein, 510 aa, Mycobacterium avium subsp. paratuberculosis str. k10
MTFWSLIAEAARRGSPRPLLADEHGRSMTARQLYDAACVAAAALAERGVRRGAVVSWQLPTTLETMVLMAALARLGAVQNPIIPVLRESEVRFITGQLNTEYFVAPGLWRGFDHGGLARALSAERGFEVITVDLAAPPAAGALRLPGADPDSLPAPPQSADEARWIYYSSGTTAAPKGIRHTDSSVIAGSAGVVGMVGATSSDVDPIAFPVAHIGGAAMLATALLTGMWLVLFEAFDPAATPLAIAAHNPTFLGTATPFFVAYLEAQRAQGNRPLFPSLRGCLAGGAPITAELSRRVRDTFGVAGIANAWGMTEFPCATSPSLTAAPEVLDHTVGPPVPGVEVRVVDGAENELAAGQEGELRLKGPQCFLGYADPTLDADAFDDQGWLRTGDLGLIDADGNVRVTGRTKDAIIRNAENISALEIENALAAHPAVADVAVIGIPDPRTGERVCAVVVPATADGVTLESLVQHCRSRGLSRYKHPERLVVVDTLPRNQFGKVIKKDLRDAFG

SEQ ID NO: 29545 - DNA, 1545 bp, Mycobacterium avium subsp. paratuberculosis str. k10
  CDS (1)..(1545)
gtgaccggtatccgtgtcgtcgcgcccgagttggcgcgccgctacgaggagcagggctggtggaccccggacacgctcggggatctgctggcccgcggcctcaaagacaaccagcacaacacgtttcgcgtgcactccgcggtgcggccattcgcgggcacgttcggcgatgtcgagctgctggcccgcaggctcgcggcagggctgcgcgcccggggcgtcggcccgggtgacgtggtcgccttccagctaccgaactgggtggaagcggcggtcaccttctgggcctcggcactcctttccgcggtggtcgtgccgatcgtccacttctacgggccgaaggaattgcgctacatcctgtcgagcgtcaggccgcgggtcttcatcaccgccgagggattcgggcgcatgacctacgtgccggaggtctgtgcgggcgtaccgaccgtcgcgctggtgggcgagagctttgacgcgctgctcgaggacgaaccgatggacgccacggtggcgaccgatcccgccaacccggcggtgatcgcgttcacgtcgggcaccaccagcgaccccaagggcgtgatccacagccatcagacactgggcttcgaaacgcgccagctgttggcgaattacccgcaggggctcgggcggcagctcaccgcgctgcccgtcgggcatttcatcggcatgctcggcgcgttcctgatgctggttctcgacggcgcgccgatcgacctcaccgatgtctgggacccggacaaggcgatcgacctgatggacgccgacggcgtggcactcggcgggggaccgccgtacttcgtcaccagcctgctagaccacccccgcttcaccccggatcacctgcgctacatcaaacacatcggactgggtggatccaccgtcccggcggcggtcacccggcgcctggccgacctcgggatcgtcgtcacccgctcctacggcagctccgagcatccgtcgatcaccggttcgcagcacaccgcaccggaggccaagcggctgttcaccgacggcaaggcgcgcgcgggcgtcgaggtgcggttggccgacgacggcgaaatactttcgcgcggaccggatctgttcgtcggctacaccgatcccgtgttgacagcccgagcgttcgacgaggacggctggtatcacaccggcgacatcggggtgatggatgacgacggctacctgaccatcaccgaccgcaagtccgacatcatcatccgcggcggcgagaacatcagcgccctggaagtcgaggaagttctgctcgccatgccggcggtcgccgaggcggtcgtggtttccgcgcccgatgcgcggctcggcgagcacgccgcggccgtgctgcgtcttaagcccgggtatggcatgccgaccatggccgaggtccgcgagcacttcgagcgcgccggggtggccaagcagaagtggcccgaggagctgcacgaagtggccgactttccccgcaccgccagcggcaaggtgcagaaatacgttgtgcgccagagtattcgggagaaagcgtag

SEQ ID NO: 29546 - protein, 514 aa, Mycobacterium avium subsp. paratuberculosis str. k10
MTGIRVVAPELARRYEEQGWWTPDTLGDLLARGLKDNQHNTFRVHSAVRPFAGTFGDVELLARRLAAGLRARGVGPGDVVAFQLPNWVEAAVTFWASALLSAVVVPIVHFYGPKELRYILSSVRPRVFITAEGFGRMTYVPEVCAGVPTVALVGESFDALLEDEPMDATVATDPANPAVIAFTSGTTSDPKGVIHSHQTLGFETRQLLANYPQGLGRQLTALPVGHFIGMLGAFLMLVLDGAPIDLTDVWDPDKAIDLMDADGVALGGGPPYFVTSLLDHPRFTPDHLRYIKHIGLGGSTVPAAVTRRLADLGIVVTRSYGSSEHPSITGSQHTAPEAKRLFTDGKARAGVEVRLADDGEILSRGPDLFVGYTDPVLTARAFDEDGWYHTGDIGVMDDDGYLTITDRKSDIIIRGGENISALEVEEVLLAMPAVAEAVVVSAPDARLGEHAAAVLRLKPGYGMPTMAEVREHFERAGVAKQKWPEELHEVADFPRTASGKVQKYVVRQSIREKA

SEQ ID NO: 29547 - DNA, 1617 bp, Bacillus cereus ATCC 10987
  CDS (1)..(1617)
atgctaacaggttatacaaaatggccaaaagaatttgctgatcgttatcgagaggaagggtgttggcttggggaaacatttggcgtgatgttaagagagcgagctgaaaaatatggcgatcaaattgcagttgtaagtggtaatacgcatattacgtatagtgagcttgataaaaaagtagatcgattagcttcagggctactgaatttaggaataaagcaagaggatcgagttgtaatccagctacctaacgttatcgagtttttcgaagtatgttttgcgctatttcgaattggggcacttcctgtttttgcattaccttcacatcgaagcagtgaaattagttatttttgtgagtttggtgaggcgagtgcttacgttatttcagataaaactctcggttttgattatcgaaaactagcaagagaagtgaaagagaaagtgccaactttacaacatgtaattgtagtgggagaagaagaagaatttgtgaacataagtgatttatatatagatcccgttccattaccagaagttcagccaaatgatattgcgtttctccaattatcaggggggacaacaggactttctaaattaattcctcgaacgcatgatgattatatttatagtttacgtgttagcgctgaaatttgtaatttaagtgcaaagagtgtctatatggccgttcttccagtagcacataattacccgatgagctctcctggaacatttggaactttctatgcgggtggaaaagtagtgctggcaactggaggtagtccagatgaggcgtttgcacttattgaaaaagaaaaagttacgattactgctcttgtaccgccattagcaatgatatggcttgatgctgcatcttcacgtaataacgatttatcgagtctagaggtgattcaagtaggtggcgcgaaatttagtgctgaagttgcaaaacgtatacgccctacatttggatgtacattacagcaagtattcggtatggcggaaggattagtgaactatacaagattagatgatcctgaagaaattattattcatacacaaggtagaccaatgtctgcactcgatgaagtacgagttgttgatgaaaatgacaacgatgtaaaacctggcgaagtaggtagtttattaacaagagggccatatacaattcgtggttattataaagcagaagagcataatgcacaatcgtttacaaaggatggattttatcgcacaggagatcttgtgaaagtaaatgaacaaggttacatcattgtagaaggaagagataaagatcaaattaatcgtggcggtgagaaagttgccgcggaagaagttgaaaatcatctattagcacatgatgcagtacatgatgtagcgattgtatctatgcctgacgattatttaggagaacgtacttgtgcatttgttatagctcgcggacaagctccggcagtaagtgaattaaaaatgtttttaagagaacgcggtatagcagcttataagattccagatcgaattgaatttattgaatcattcccacaaacaggcgttggaaagataagcaaaaaagaattacgtaaagtcattgctgaaaaacttattacagtaaaacaataa

SEQ ID NO: 29548 - protein, 538 aa, Bacillus cereus ATCC 10987
MLTGYTKWPKEFADRYREEGCWLGETFGVMLRERAEKYGDQIAVVSGNTHITYSELDKKVDRLASGLLNLGIKQEDRVVIQLPNVIEFFEVCFALFRIGALPVFALPSHRSSEISYFCEFGEASAYVISDKTLGFDYRKLAREVKEKVPTLQHVIVVGEEEEFVNISDLYIDPVPLPEVQPNDIAFLQLSGGTTGLSKLIPRTHDDYIYSLRVSAEICNLSAKSVYMAVLPVAHNYPMSSPGTFGTFYAGGKVVLATGGSPDEAFALIEKEKVTITALVPPLAMIWLDAASSRNNDLSSLEVIQVGGAKFSAEVAKRIRPTFGCTLQQVFGMAEGLVNYTRLDDPEEIIIHTQGRPMSALDEVRVVDENDNDVKPGEVGSLLTRGPYTIRGYYKAEEHNAQSFTKDGFYRTGDLVKVNEQGYIIVEGRDKDQINRGGEKVAAEEVENHLLAHDAVHDVAIVSMPDDYLGERTCAFVIARGQAPAVSELKMFLRERGIAAYKIPDRIEFIESFPQTGVGKISKKELRKVIAEKLITVKQ

SEQ ID NO: 29549 - DNA, 1650 bp, Methanococcus maripaludis S2; identical to SEQ ID NO: 14100
  CDS (1)..(1650)

SEQ ID NO: 29550 - protein, 549 aa, Methanococcus maripaludis S2; identical to SEQ ID NO: 14101

SEQ ID NO: 29551 - DNA, 1710 bp, Oryza sativa (japonica cultivar-group)
  CDS (1)..(1710)
atgatcacggtggcggcaccggaggcgcagccgcaggtggcggcggcggtcgatgaggcgccgccggaggcggtgacggtgttccggtccaagcttccggacatcgacatccccagccacctgcccctgcacgagtactgcttcgccagggcggccgagctccccgacgcgccgtgcctcatcgcggcggccacggggaggacgtacacgttcgccgagacgcgcctgctgtgccgcagggccgccgcggcgctgcaccggctgggcgtcggccacggcgaccgcgtcatggtgctgctccagaactgcgtggagttcgccgtggcgttcttcgccgcgtcgttcctcggcgcggtcaccaccgccgccaacccgttctgcacgccgcaggagatccacaagcagttcaaggcctccggcgtgaagctcatcctcacccagtccgtctacgtcgacaagctccggcagcacgaggcgttcccaaggatcgacgcctgcaccgtcggcgacgacacgctcaccgtgatcaccatcgacgacgacgaggcgacgccggaaggctgcctgccgttctgggacctgatcgcggacgccgacgaggggtccgtcccggaggtggccatctcgccggacgaccccgtggcgctgccgttctcgtcgggcacgacgggcttgcccaagggcgtggtgctgacgcacaggagcgtcgtgtcgggcgtggcgcagcaggtggacggcgagaacccgaacctgcacatgggtgccggcgacgtggcgctgtgcgtgctgccgctgttccacatcttctcgctcaactccgtgctgctgtgcgcggtgcgcgccggcgcggcggtggcgctgatgcccaggttcgagatgggcgccatgctgggggccatcgagcggtggcgcgtgacggtggcggccgtcgtgccgccgctcgtgctcgcgctcgccaagaacccgttcgtggagcgccacgacctcagctccatccgcatcgtgctctccggcgccgccccgctcggcaaggagctcgaggacgccctccgcgcccgcctgcctcaggccatcttcggacagggatacgggatgacggaggcggggccggtgctgtcgatgtgcccggcgttcgccaaggagccgacgccggcgaagtccgggtcgtgcgggacggtggtgcggaacgcggagctcaaggtggtcgacccggacacgggcttctccctcggccgcaacctccccggcgagatctgcatccgcggcccacagatcatgaaaggttacctgaacgatcccgaggcgaccgccgcgacgatcgacgtcgaggggtggctgcacaccggcgacatcggctacgtcgacgacgacgacgaggtcttcatcgtcgaccgtgtcaaggagctcatcaaattcaaggggttccaggtgccgccggccgagctggagtcgctgctcatcgctcacccgtccatcgctgacgccgccgtcgtcccgcaaaaggatgacgtcgccggcgaggtcccggtcgcgttcgtggtccgcgccgccgactccgacatcacggaggagtccatcaaggaattcatatccaagcaggtggtgttctacaagaggctacacaaggtgcacttcatccatgcgatccccaagtcggcgtctgggaagatactgaggagagagctcagagccaagctcgcggcgtgctga

SEQ ID NO: 29552 - protein, 569 aa, Oryza sativa (japonica cultivar-group)
MITVAAPEAQPQVAAAVDEAPPEAVTVFRSKLPDIDIPSHLPLHEYCFARAAELPDAPCLIAAATGRTYTFAETRLLCRRAAAALHRLGVGHGDRVMVLLQNCVEFAVAFFAASFLGAVTTAANPFCTPQEIHKQFKASGVKLILTQSVYVDKLRQHEAFPRIDACTVGDDTLTVITIDDDEATPEGCLPFWDLIADADEGSVPEVAISPDDPVALPFSSGTTGLPKGVVLTHRSVVSGVAQQVDGENPNLHMGAGDVALCVLPLFHIFSLNSVLLCAVRAGAAVALMPRFEMGAMLGAIERWRVTVAAVVPPLVLALAKNPFVERHDLSSIRIVLSGAAPLGKELEDALRARLPQAIFGQGYGMTEAGPVLSMCPAFAKEPTPAKSGSCGTVVRNAELKVVDPDTGFSLGRNLPGEICIRGPQIMKGYLNDPEATAATIDVEGWLHTGDIGYVDDDDEVFIVDRVKELIKFKGFQVPPAELESLLIAHPSIADAAVVPQKDDVAGEVPVAFVVRAADSDITEESIKEFISKQVVFYKRLHKVHFIHAIPKSASGKILRRELRAKLAAC

SEQ ID NO: 29553 - DNA, 1698 bp, Oryza sativa (japonica cultivar-group)
  CDS (1)..(1698)
atgggacgctcaccggagatggaggtggacgcgcgcagcggctactgcgccgccacccgcacgttccggagcaggcgcgccgacgtgccgctgcccgccgacccggaggtcgacgtggtcagcttcctcgcctcgcgccgccactcgggcgttgtggccctcgtcgacgccgcgactgggcgccggatcaccttcaccgagctctggcgcgccgtggccggggcggcatccgccctcgccgcgcaccccgtctccctccgcaagggccacgtcgcgctcatcctctcccctaactccgtccacttccccgtcgccgccctcgccgccatgtcgcttggcgccgtcctcaccaccgccaacccgctcaatacccccgccgagatcgccaagcaggtcgccgacgcccgccccgtcctcgccttcaccacccgcgagctcctccccaagctcccgcgtgcccacgacctccgcgtcgtcctcctggaatccgcccgcctccccggcgacagctccgacccgcggatcgtcgccaccatcgaggagatctccgccacgacgcccgacccggcgcgccgcaaggaccgcgtcacgcaggacgatccggccaccctgctctactcctcggggacgacggggccaagcaagggcgtcgtcgccacgcaccggagcctcatctccatggtccagatcatcatgacgcgattccgcctcgagggctcggacaagacagagacattcctctgcacggtgcccatgttccacgtctacggcctcgtcgccttcgccacggggctgctcggttgcggcgccacggtggtcgtgctctccaagtacgagctcccggagatgctgcgctcgatcaacgcctacggggtgacctaccttccgctcgtgccgccgatcctggtcgccatggtggcgcacccgaagccgctcccgctcgggcagatgcgcaaggtgctatccggcggcgcgccgctgggcaaggagctgatcgaagggttcagggagaagtatccgcaggtggagatcctgcaggggtacgggctgacagagagcaccgccatcggcgcgtccacggactccgccgaggagagccgccggtacgggacggccgggcttctgtctcccaataccgaggctaagattgtcgacccagattccggcgaggcgctgccggtaaaccgcaccggcgagctctggatccgtggaccgtacgtcatgaaagttgcaagcatatttattcagaatgagtttcatggaatcagctacttcaagaacgcagaggcaacacagtcaacgctgacaccagatggatggctaaagaccggtgatctctgctacatagatgaggatggatatctcttcgtagtggaccgcctcaaggagttgatcaaatacaaaggttaccaggtgcctccggcagaactggaagctcttttgttgacgcacccagaggttacggatgttgccgttataccgtttcctgatagggaggtcggccagttcccgatggcctatatagtgaggaagaaaggaagcaacttgtcagagcgcgaggtgatggagtttgtggcaaaacaggttgcgccttacaagaaggttagaaaggtggcgtttgtgacggacattcccaagaatgcatccgggaagatactgaggaaggatcttattaagcttgccacatccaaactatga

SEQ ID NO: 29554 - protein, 565 aa, Oryza sativa (japonica cultivar-group)
MGRSPEMEVDARSGYCAATRTFRSRRADVPLPADPEVDVVSFLASRRHSGVVALVDAATGRRITFTELWRAVAGAASALAAHPVSLRKGHVALILSPNSVHFPVAALAAMSLGAVLTTANPLNTPAEIAKQVADARPVLAFTTRELLPKLPRAHDLRVVLLESARLPGDSSDPRIVATIEEISATTPDPARRKDRVTQDDPATLLYSSGTTGPSKGVVATHRSLISMVQIIMTRFRLEGSDKTETFLCTVPMFHVYGLVAFATGLLGCGATVVVLSKYELPEMLRSINAYGVTYLPLVPPILVAMVAHPKPLPLGQMRKVLSGGAPLGKELIEGFREKYPQVEILQGYGLTESTAIGASTDSAEESRRYGTAGLLSPNTEAKIVDPDSGEALPVNRTGELWIRGPYVMKVASIFIQNEFHGISYFKNAEATQSTLTPDGWLKTGDLCYIDEDGYLFVVDRLKELIKYKGYQVPPAELEALLLTHPEVTDVAVIPFPDREVGQFPMAYIVRKKGSNLSEREVMEFVAKQVAPYKKVRKVAFVTDIPKNASGKILRKDLIKLATSKL

SEQ ID NO: 29555 - DNA, 1668 bp, Oryza sativa (japonica cultivar-group)
  CDS (1)..(1668)
atgggcgacgccgcggtacccgccatggtggtggaggaggaggaacaggagcacgtgttccggagcaggttcccgccggtggccgtgccggacggcgtcaccgtgccggagttcgtgctggacggcgccgaggcctacgccgacagggtggcgctcgtggaggccgcggcgggcgggcggtcgtacacgtacggcgaggtggcgcgcgacacggcgcggttcgccagggcgctccggtcggtgggcgtccggaaggggcacgtcgtcgtcgtcgcgctcccaaacctcgccgtgtaccccgtcgtgtcgctcgggatcatgtcggcgggggccgtgttctccggcgtgaacccgcgcgcgctcgccgcggagatcaagaagcaggtggaggactccgaggcgaagctggtcgttgccaacgaggtcgcgttcgacaaggtgaaggacgccggcgtgccggtgatcggcgtcggcgacagggagcggatgcctggggcgatcagctgggacgggctcctcgccgcggcggaccgcaccggcgccggggtggtgccggtggacgcggcgcagcagtccgacctgtgcgcgctcccctactcctccggcaccaccggcgtgtccaagggcgtgatgctgagccaccgcaacctggtgtccaacctctgctcgtccatgttcgccgtggcgccggagacggccgggcaggtggtgacgctggggctcatgccgttcttccacatctacggcatcaccggcatctgctgcgccacgctccggcacaagggcacggtggtggtgatggaccgcttcgacctccgcacgttcctccgtgcgctcgtcgaccaccgcgtcatgttcgcgccgctggttccccccgtgatgctcgccatggtcaagagccccgtcgccgacgagttcgacctctccgacctcgccctcaagtccgtcatgaccgccgccgcgccgctcgcccccgacctcctcgccgcgttccagcgcaagttccccggcgtgcaggtggaggaagcctacggcctcaccgagcacagctgcatcaccctcacgcacgccgccggcgacggccacggccacgtcgccaagaagagctcggtggggttcatcctgccgaacctggaggtgaagttcgtggacccggacaccgggaggtcgctgccggcgaacacgccgggggagctgtgcgtgcggagccagagcgtgatgcaggggtactacaagaggaaggaggagacggagcgcacggtggacggcaaggggtggctgcacaccggcgacgttgggtacatcgacggcgacggcgacgtgttcatcgtggacaggatcaaggagctgatcaagtacaaggggtttcaggtcgcccccgccgagctcgaggccgtcctcctctcccacccctccgttgaggacgccgccgtcttcggggtgccggacgaggaggccggcgaggtgccggtggcgtgcgtggtgcggcggcacggtgcggaggagggggaggaggagatagtggcgtacgtggcggagagggtggcgtcgtacaagcgggtccgggtgctgcacatcgtcgacgccatccccaagtcggtgtccgggaagatcctgaggaggcagcttagggacgagttcatcaagaggatgaaaccgtcagcttga

SEQ ID NO: 29556 - protein, 555 aa, Oryza sativa (japonica cultivar-group)
MGDAAVPAMVVEEEEQEHVFRSRFPPVAVPDGVTVPEFVLDGAEAYADRVALVEAAAGGRSYTYGEVARDTARFARALRSVGVRKGHVVVVALPNLAVYPVVSLGIMSAGAVFSGVNPRALAAEIKKQVEDSEAKLVVANEVAFDKVKDAGVPVIGVGDRERMPGAISWDGLLAAADRTGAGVVPVDAAQQSDLCALPYSSGTTGVSKGVMLSHRNLVSNLCSSMFAVAPETAGQVVTLGLMPFFHIYGITGICCATLRHKGTVVVMDRFDLRTFLRALVDHRVMFAPLVPPVMLAMVKSPVADEFDLSDLALKSVMTAAAPLAPDLLAAFQRKFPGVQVEEAYGLTEHSCITLTHAAGDGHGHVAKKSSVGFILPNLEVKFVDPDTGRSLPANTPGELCVRSQSVMQGYYKRKEETERTVDGKGWLHTGDVGYIDGDGDVFIVDRIKELIKYKGFQVAPAELEAVLLSHPSVEDAAVFGVPDEEAGEVPVACVVRRHGAEEGEEEIVAYVAERVASYKRVRVLHIVDAIPKSVSGKILRRQLRDEFIKRMKPSA

SEQ ID NO: 29557 - DNA, 1557 bp, Oryza sativa (japonica cultivar-group)
  CDS (1)..(1557)
atggagaccccgactctgaccacgctgctcaaggcggcggtggccacgttcccctcgcgccgcgccctcgccgtcccgggcaaggtcgacctgtcgcacgcggcgctcgacgcgctcgtcgacgccgcggccgcgcgcctcgccgccgatgcgggcgtgctccccggccacgtcgtcgcgctcgccttccccaacaccgtcgagctggtgatcatgttcttggcggtgatccgagcgcgcgcggtggcggcgccgctgaacccggcgtacacgcaggaggagttcgagttctacctctccgactccggggcgcgtctcctcatcaccaaccccgagggcaacgtcgccgcgcaggcggccgcctccaagctgggcctcgcccacaccaccgccagcctcaaggacgccgccggccaagtccacctcgccggcttccccgcctccgccgccgccgcggccaaggacttcgccaacgacccgtccgacgtggcgctgttcctgcacacctccggcaccacgagccggcccaagggcgtgccgctcacgcagcgcaacctggcggcgtccgtccagaacatccgcgccgtgtaccgcctcaccgaggcggacgcgacggtgatcgtgctcccgctcttccacgtccacggcctcctctgcggcctcctcgcctccctggcgtccggcgcgtccgtgacgctcccggcggcggggcgcttctcggcgtccaccttctgggccgacatgcgcggcgccggcgcgacgtggtacacggcggtgccgacgatccaccagatcatcatcgaccggcacacctcgaagccggaggcggagtacccggcgctgcggttcatccgcagctgcagcgcgtcgctggcgccggcgatcatggagaagctggaggcggcgttcggggcgccggtggtggaggcgtacgcgatgacggaggcgtcgcacctgatgacgtcgaacccgctgccggaggacggggcgaggaaggccgggtcggtggggcgcgcggtgggtcaggagatggcgatcctggacgaggaagggcggcgggtggaggccgggaagagcggcgaggtgtgcgtgcgcggcgccaacgtgacgagcgggtacaaggggaacccggaggcgaacgaggcggcgttccggttcgggtggttccacaccggcgacatcggcgtcgtggacgaggaggggtacctgcggctggtggggcggatcaaggagctgatcaaccgcggcggcgagaagatatcgccgatcgaggtggactcggtgctgctcgggcacccggccatcgcgcaggccgtggcgttcggggtgcccgacgccaagtacggggaggagatcaactgcgcggtgatcccccgggagggcgtgtcgctcggggaagaggaggtgctggcctactgccggaggaacctggccgcgttcaaggtgcccaagaaggtgtacatcgccgacgagcttcccaagacggccaccggcaagatccagcgccgcatcgtcgcgcagcacttcgtcgtgccggtgctgcccaccaaggcgtaa

SEQ ID NO: 29558 - protein, 518 aa, Oryza sativa (japonica cultivar-group)
METPTLTTLLKAAVATFPSRRALAVPGKVDLSHAALDALVDAAAARLAADAGVLPGHVVALAFPNTVELVIMFLAVIRARAVAAPLNPAYTQEEFEFYLSDSGARLLITNPEGNVAAQAAASKLGLAHTTASLKDAAGQVHLAGFPASAAAAAKDFANDPSDVALFLHTSGTTSRPKGVPLTQRNLAASVQNIRAVYRLTEADATVIVLPLFHVHGLLCGLLASLASGASVTLPAAGRFSASTFWADMRGAGATWYTAVPTIHQIIIDRHTSKPEAEYPALRFIRSCSASLAPAIMEKLEAAFGAPVVEAYAMTEASHLMTSNPLPEDGARKAGSVGRAVGQEMAILDEEGRRVEAGKSGEVCVRGANVTSGYKGNPEANEAAFRFGWFHTGDIGVVDEEGYLRLVGRIKELINRGGEKISPIEVDSVLLGHPAIAQAVAFGVPDAKYGEEINCAVIPREGVSLGEEEVLAYCRRNLAAFKVPKKVYIADELPKTATGKIQRRIVAQHFVVPVLPTKA

SEQ ID NO: 29559 - DNA, 1620 bp, Oryza sativa (japonica cultivar-group)
  CDS (1)..(1620)
atgggttcgttgccggagcagttcgtcttccgctcgaggctccccgacatcgccatcccggaccacctcccgctgcacgactacgtgttcgagcgcctcgccgaccgccgcgaccgggcatgccttatcgatggcgccacgggggagacgctctcgttcggcgacgtcgacgcgctgtcgcgccgcgtggcggctgggttgagctcgattggtgtttgccatggtagtaccgtgatgctgctgctgccgaactccgtcgagttcgcggtggcgttcctcgcgtcgtcacggctcggggcggtcaccaccacggccaacccgctgcacaccccgccggagatcgccaagcaggtggcggcgtccggcgcgacggtggtggtcaccgagccggcgttcgtcgccaaggtgagcggcctcgcgggcgtgaccgtcgtcgccaccgggggcggcgccgagaggtgcgcgtcgttcgcgggcctcgccgccgccgacggctcggcgctgccggaggtcgccatcgacgtcgccaacgacgccgtggcgctgccctactcgtcgggcacgacggggctccccaagggggtgatgctgtcgcaccgcgggctggtgaccagcgtggcgcagctcgtcgacggcgagaacccgaacctccacctccgggaggacgacgtggtgctctgcgtgctccccatgttccacgtctactccctccactccatcctcctctgcgggatgcgcgccggcgccgccatcgtggtcatgaagcggttcgacaccgtcaagatgctgcagctggtggagcgccacggcgtcaccatcgcgccgctcgtccctcccatcgtcgtcgagatggccaagagcgacgccctcgaccgccacgacctctcctccatccgcatggtcatctccggcgccgcccccatgggcaaggagcttcaggacatcgtccacgccaagctccccaacgccgtcctcggacaggggtacgggatgacggaggcagggccggtgctatcaatgtgcatggcgttcgcgaaggagccgacgccggtgaagtccggcgcgtgcggcacggtggtgcggaacgccgagctgaagatcgtcgacccggacaccggcttgtcactcccgcgcaaccagccgggggagatttgcatcaggggaaaacaaatcatgaaaggatacctgaacaacccggaggcgaccgagaagacgatcgacaaggacgggtggctgcacactggcgacatcggcttcgtcgacgacgacgacgagatcttcatcgtggaccggctcaaggagctcatcaagtacaagggcttccaggtcgcccccgccgagctcgaggccatgctcatcgcccacgccgccgtcgccgacgccgccgtcgtcccaatgaaggacgattcctgcggcgagatcccagtggcgttcgtcgtcgcacgcgacggctcggggatcaccgacgacgagatcaagcagtacgtcgcaaagcaggtggtgttctacaagaggctgcacaagatcttcttcgtggacgcaatcccgaaggcgccgtcgggaaagattttgaggaaggatctgagagcaaagttggctgctggaattccggcgtgctga

SEQ ID NO: 29560 - protein, 539 aa, Oryza sativa (japonica cultivar-group)
MGSLPEQFVFRSRLPDIAIPDHLPLHDYVFERLADRRDRACLIDGATGETLSFGDVDALSRRVAAGLSSIGVCHGSTVMLLLPNSVEFAVAFLASSRLGAVTTTANPLHTPPEIAKQVAASGATVVVTEPAFVAKVSGLAGVTVVATGGGAERCASFAGLAAADGSALPEVAIDVANDAVALPYSSGTTGLPKGVMLSHRGLVTSVAQLVDGENPNLHLREDDVVLCVLPMFHVYSLHSILLCGMRAGAAIVVMKRFDTVKMLQLVERHGVTIAPLVPPIVVEMAKSDALDRHDLSSIRMVISGAAPMGKELQDIVHAKLPNAVLGQGYGMTEAGPVLSMCMAFAKEPTPVKSGACGTVVRNAELKIVDPDTGLSLPRNQPGEICIRGKQIMKGYLNNPEATEKTIDKDGWLHTGDIGFVDDDDEIFIVDRLKELIKYKGFQVAPAELEAMLIAHAAVADAAVVPMKDDSCGEIPVAFVVARDGSGITDDEIKQYVAKQVVFYKRLHKIFFVDAIPKAPSGKILRKDLRAKLAAGIPAC

SEQ ID NO: 29561 - DNA, 1848 bp, Mus musculus
  CDS (1)..(1848)
atggctgtctatcacgggatgctgcgcttcgggaggctgtgtatcgcgagcctgggggcgcggggcccccggacgctgctcactcgccctcggccgaactcgaagttgcagagtgtccgcgctctcagttctggaatggtgaactgcaccaaccccttgcccattggaggcctcagctacattcagggccacaccgactcccatcttgtgaacacaactgtgggcgagtgccttgacgccacagcgcagaggttccccgacagagaggctttggttatcctccatgaaaacatcaggctgaactttgcgcagctcaaggaggaggtggacaaagctgcttctggtcttctgagcattggcctccgcaagggtgaccggctgggcatgcagggacccaactcctatgcctgggtacttattcagctggctactgcccaggcaggcatcatcctggtgtctgtgaacccagcctaccagtcctcagaactggaatatgtcctcagaaaggtaggctgcaaaggtattgtgtttcccaaacaattcaagacccagcagtactacgacatcctgaagcaggtctgtcctgagctggaaaaggctcagccaggggccttgaagagtgagagactcccagacctgactacagtcatctccgtggatgcccctctgccggggaccctgctcctggataacatcgtggcagccggtggcaaggaacagaacctagcccagctgcggtacaaccagcggttcttgtcctgctacgaccccatcaacatccagttcacctcggggacaactggaaaccccaagggggccactctttcccaccacaacatcgtaaacaactccatgctgataggccagcgtctgaagatgcccacaaagactgcagaggagttgcgcgtggtcctgcccagtcccctgtaccactgcctgggctccgtggggggcacaatggtgtctatgatgcatggtgccactctcctcctgtcttttccaagcttcaatggcaagaaggcattggaagccatcagcagagagaaaggcaccctcctgtatggcacacccacgatgtttgtggatattctgaatcagccagacttctccagttatgatttcacaagcattcgtggaggtgtgattgctgggtccccagcacccccggaattgattcgagccatcatcaacaagatgaacatgaaggagctggtggttgtttatggaaccacagagaacagtcccgtgaccttcatgaactttcccgaggacaccctggagcagaaggctggaagtgtgggcagaattatgcctcacacgaaggcccagattgtgaatgtggagacgggtgagctgaccaacctgaacgtgcctggggagctgtatatccgagggtactgcgtcatgcagggctactggggtgagccacagaagaccttcgagacggtcggacaagacaagtggtatcggacaggagacattgcttcgatggatgaacaaggcttctgcaagatcgtcggccgatcaaaggatatgatcatccgtggcggtgagaacatctaccctgcagagctggaggacttcttcctcaagcacccacaggtgcaggaagcgcaggtggttggggtgaaggacaagcggatgggggaggaaatctgtgcttgcattccgctgaagagcggagagaccaccacggcggaggagatcaaagctttctgcaaagggaagatttcccactttaagattccccgatacatcgtgtttgttgaaggctatcctctcaccatctcaggaaagatccagaaattcaaactccgagagcagatggaacagcatctaaaactgtga

SEQ ID NO: 29562 - protein, 615 aa, Mus musculus
MAVYHGMLRFGRLCIASLGARGPRTLLTRPRPNSKLQSVRALSSGMVNCTNPLPIGGLSYIQGHTDSHLVNTTVGECLDATAQRFPDREALVILHENIRLNFAQLKEEVDKAASGLLSIGLRKGDRLGMQGPNSYAWVLIQLATAQAGIILVSVNPAYQSSELEYVLRKVGCKGIVFPKQFKTQQYYDILKQVCPELEKAQPGALKSERLPDLTTVISVDAPLPGTLLLDNIVAAGGKEQNLAQLRYNQRFLSCYDPINIQFTSGTTGNPKGATLSHHNIVNNSMLIGQRLKMPTKTAEELRVVLPSPLYHCLGSVGGTMVSMMHGATLLLSFPSFNGKKALEAISREKGTLLYGTPTMFVDILNQPDFSSYDFTSIRGGVIAGSPAPPELIRAIINKMNMKELVVVYGTTENSPVTFMNFPEDTLEQKAGSVGRIMPHTKAQIVNVETGELTNLNVPGELYIRGYCVMQGYWGEPQKTFETVGQDKWYRTGDIASMDEQGFCKIVGRSKDMIIRGGENIYPAELEDFFLKHPQVQEAQVVGVKDKRMGEEICACIPLKSGETTTAEEIKAFCKGKISHFKIPRYIVFVEGYPLTISGKIQKFKLREQMEQHLKL

SEQ ID NO: 29563 - DNA, 1647 bp, Thermus thermophilus HB27
  CDS (1)..(1647)
atgaagccctggtacgcccactacgatcccggggtccccaaggaggcccccgcgccccggctccttcccgaggccctggcggagacggcccgccgcttccccaagaaggtggccctggagttcctcgggcgaaggctcacctacgcggccctctggcgcgaggtggaggccttcgccaagggcctacaggaggcggggctaaagcccggggaccgggtggccctcatgctccccaactccccccagttcgtcatcgccttctacggcaccctcctcgccgggggcgtgggggtgaacaccaaccccatgtacaccccgcgggagcttcaccaccagctcagggacgccggggcccggttcctggtgatcctggaccagctcctcccccgctacctggaggtgaagggggaggtgcccgtggagaaggtggtgcgcacggggatccaggactacctccccttccccaagaacctcctctaccccctccttctcaggcggaaaggggaagcccccaaggccctcgagggcctcccctggcgggccttcctcaggcccggaacgccccgccccgtgcccctggacctggacgacctcgccctcctccagtacaccgggggcaccacgggcctcgccaagggggcgatgctcacccacaggaacctctccgccaacgccctccaggtgcgggcctggatccccgacttcagggagggggaggaggtggtcctcggggccatccccttcttccacgtctacgggatgaccgtggccatgaacctggccctcctgggcggggcgaagctcgtcctcctccccaggcccgagatcaaggccatcgtggaggccattgaaaaacaccaggtcaccctcttccccggcgtccccaccctctacgtggccttcaacaacttccccggcatagaaaggcgggacctcaagagcgtccgggcctgcatctccggctcggcgcccctccctttggaggtggccgagcgctttgagaggctcaccggggccaagctggtggagggctacggcctcacggaggcgagccccgtgacccactgcaaccccctttacggcgaaaggcgcctggggagcgtgggcctccccttccccggcgtggacgccaaggtggtggacgaggaaggaagggaactccccccaggcgaggtgggcgaactcgccgtcaaaggccccaacgtcatgaaaggctactggaaccgccccgaagaaacccaaaaaaccctcaaagacggctggctcttcaccggcgacctcgccaaaatggaccaagacggctacttctacatcgtagaccgcaaaaaagacatgatcatcgccggcggctacaacatctaccccagggaggtggaagaagtcctctaccagcacgaggccgtccaggaagccgccgtggtgggcgtcccagacccctaccgcggcgaaaccgtggccgccttcctcgtcctcaaacccgagtaccaaggcaaggtctcggaaaaggacatagagcgtttctgccgccaaaacctcgccgcctacaaggtcccccgcatcatccagttccgcgaaagcctccccaagtccagcgtggggaagatcctcaagcgggagctgcaaaaggaagtggcggcgaagcggtaa

SEQ ID NO: 29564 - protein, 548 aa, Thermus thermophilus HB27
MKPWYAHYDPGVPKEAPAPRLLPEALAETARRFPKKVALEFLGRRLTYAALWREVEAFAKGLQEAGLKPGDRVALMLPNSPQFVIAFYGTLLAGGVGVNTNPMYTPRELHHQLRDAGARFLVILDQLLPRYLEVKGEVPVEKVVRTGIQDYLPFPKNLLYPLLLRRKGEAPKALEGLPWRAFLRPGTPRPVPLDLDDLALLQYTGGTTGLAKGAMLTHRNLSANALQVRAWIPDFREGEEVVLGAIPFFHVYGMTVAMNLALLGGAKLVLLPRPEIKAIVEAIEKHQVTLFPGVPTLYVAFNNFPGIERRDLKSVRACISGSAPLPLEVAERFERLTGAKLVEGYGLTEASPVTHCNPLYGERRLGSVGLPFPGVDAKVVDEEGRELPPGEVGELAVKGPNVMKGYWNRPEETQKTLKDGWLFTGDLAKMDQDGYFYIVDRKKDMIIAGGYNIYPREVEEVLYQHEAVQEAAVVGVPDPYRGETVAAFLVLKPEYQGKVSEKDIERFCRQNLAAYKVPRIIQFRESLPKSSVGKILKRELQKEVAAKR

SEQ ID NO: 29565 - DNA, 1683 bp, Thermus thermophilus HB27
  CDS (1)..(1683)
atggaccaggtgcgcgagaaaccgtggctggcccactacgaccccggcgttccgccggagatccaggtccccgacattcccctctggcggttcctggaggaaagcgcccgccgcttcccccaaaacgtcgccctggagtttctggggaagaccctcagctaccaggagctatggggcctcgcccgccgcttcgcccaggggcttaaggacctgggggtgcggcccggggaccgggtggccatcatgctccccaactctccccagttcgtcatcgccttctacggcaccctcctcgccgggggcgtgggggtgaacgtcaaccccctctacacgcccagggaactccgccaccagcttgcggatgcgggggcggagaccctggtgatcctggaccacctcctcccccgctacctggaggtggaaaaggaggtcccggtgaagcgggtggtggtcacggggatcaaggacttcctccccttccccaagaacctcctctaccccctgaaggccaagcgggacggccttcccctgggcttccccaagcgggagggcttccacgccttcgccgaactcctcaagcgcccccccgccgagccccacgtccccgaccccgaggacctcgccctcctccagtacaccgggggcaccacgggcctctccaagggggcgatgctcacccacaaaaacctcgtggccaacgtcctccagattgacgcctgggaccccacctccaaggacctcgtgggcaagggggtcatgctcggggccctgcccttcttccacgtttacgggatgaccgtggccatgaactacggcctcttctcgggctacaagatcgtcctcctcccgaggcccgagatcaaggccatcgtggaggccattgaaaaacaccaggtcacccacttccccggcgtccccaccctctacgtggccttcaacaacttccccggcatagaaaaacggaacgtcaagagcatccgcatctgcctctccggagcggcccccctgcccgtggaggtggccaagcgctttgaagagctcaccggggcgaggctcattgaggggtacgggctctccgaggcgagccccgtaacccactccaaccccgtcctcggcctcatcaagaagggctccatcggcatgcccttccccagcgtggacgccaaggtggtggacgaggaaggaaaggaactccccccaggcgaggtgggcgaactcgccgtcaaaggccccaacgtcatgaaaggctactggaaccgccccgaagaaacccaaaaaaccctcaaagacggctggctcttcaccggcgacctcgccaaaatggacgaagacggctacttctacatcgtggaccgcaaaaaagacatgatcatcgccggcggctacaacatctaccccagggaggtggaagaagtcctctaccagcacgaagccgtccaggaagccgccgtggtgggcgtcccagacccctaccgcggcgaaaccgtggccgccttcctcgtcctcaaacccgagtaccaaggcaaggtctcggaaaaggacatagagcgcttctgccgccaaaacctcgccgcctacaaggtcccccgcatcatccagttccgcgaaagcctccccaagtccagcgtggggaagatcctgaggagggagcttagggaggagttcgccaaaaagcagggctag

SEQ ID NO: 29566 - protein, 560 aa, Thermus thermophilus HB27
MDQVREKPWLAHYDPGVPPEIQVPDIPLWRFLEESARRFPQNVALEFLGKTLSYQELWGLARRFAQGLKDLGVRPGDRVAIMLPNSPQFVIAFYGTLLAGGVGVNVNPLYTPRELRHQLADAGAETLVILDHLLPRYLEVEKEVPVKRVVVTGIKDFLPFPKNLLYPLKAKRDGLPLGFPKREGFHAFAELLKRPPAEPHVPDPEDLALLQYTGGTTGLSKGAMLTHKNLVANVLQIDAWDPTSKDLVGKGVMLGALPFFHVYGMTVAMNYGLFSGYKIVLLPRPEIKAIVEAIEKHQVTHFPGVPTLYVAFNNFPGIEKRNVKSIRICLSGAAPLPVEVAKRFEELTGARLIEGYGLSEASPVTHSNPVLGLIKKGSIGMPFPSVDAKVVDEEGKELPPGEVGELAVKGPNVMKGYWNRPEETQKTLKDGWLFTGDLAKMDEDGYFYIVDRKKDMIIAGGYNIYPREVEEVLYQHEAVQEAAVVGVPDPYRGETVAAFLVLKPEYQGKVSEKDIERFCRQNLAAYKVPRIIQFRESLPKSSVGKILRRELREEFAKKQG

SEQ ID NO: 29567 - DNA, 1653 bp, Desulfovibrio vulgaris subsp. vulgaris str. Hildenborough
  CDS (1)..(1653)
atggatacgttcgccatacgcgagatgacactcggccgcatactggatgagaccgccgcgaagtttcccgataacgacgccgtggtctatgtcgaccgcgactaccggcagacctaccgcgagttcgtctcggtggtggacgacctcgcgcgcgggctcatggcccttggcgtgaagcggggcgacaaggtggcgctctgggccaccaacgtgccgtactgggtggcgctgcagttcgccacggcgaaaatcggcgcggtgctgctcacggtcaacaccaactatcgcgagagtgaactgcgctacctgctcgagcagtccgagtgcgagaacctgttcatcatggacggcttccgcgaccacgacttcgtgcagaccatctatcaggtcattcccgaactcaggatgcagccccgcggccagttgcgctgcgaggggctgccgcacctcaagcgcgtgatgttcctcggtgcggagaagcaccggggcatgtactccgtgcccgagatcgtcagccttggcgtcatggtctccgatgaggagttccgccagcggcaggatgagctcgacccctacgacgtggtgaacatgcagtacacctcgggcacgacgggctttcccaagggcgtgatgctcacccatgtgggcatcggcaacaacggttactggataggccgcaatcagggcttcaccgaaaaggacagggtctgcctgcccgtgccgctgttccactgcttcgggtgtgttctgggtgtcatggccgccatcaaccacggtgccgcgctggtcatccttgagaacttcaaccccatgcatgtcatggcgtcggtcgaccaggagaagtgcaccgccctgtacggcgtgccgaccatgttccttgccgtgctggagcacaagctcttcgaccgcttcgacttcagttcgctgcgcacgggcatcatggcgggttcggtatgccccgaaccgctcatgcgccgggtcatcgagaagatgaacatgcgtgaaatcaccatctgctacggccttaccgaggggtcgcccgtcatgacccagacgctggtggacgattcactcgaacggcgtgtgcagaccgtggggcgcgccatgcccggcatcgaggtgcgcatcgtcgaccccgagaccaacgaggaggtgccgcacggtacccccggagaggtggtctgccgcggctacaacgtgatgaagggctactacaacatgcccgaggccacggccaaggccgtggacggcgacgggtggcttcattcgggcgacctcggcatcatggacgagcatggctacgtgcgcatcacagggcgcatcaaggacatgatcatccgtggcggcgagaacatctacccacgggaaatcgaagagttcctctatggcatggagggcgttcaggacgtacaggtggtcggcgtgcccagccgcaagtacggcgaggaggtgggagcgttcatcatccccaaggaggggtacgacctcgcccccgaggatgtccgtgaccactgccgcgggcgcatctcgtggtacaaggtgcctcgccacatcgcgttcgtctccgaattccccatgaccgccagcgccaagatacagaagtacaagctgcgcgagatggctgcggagttgttccccgacgccatgaagtag

SEQ ID NO: 29568 - protein, 550 aa, Desulfovibrio vulgaris subsp. vulgaris str. Hildenborough
MDTFAIREMTLGRILDETAAKFPDNDAVVYVDRDYRQTYREFVSVVDDLARGLMALGVKRGDKVALWATNVPYWVALQFATAKIGAVLLTVNTNYRESELRYLLEQSECENLFIMDGFRDHDFVQTIYQVIPELRMQPRGQLRCEGLPHLKRVMFLGAEKHRGMYSVPEIVSLGVMVSDEEFRQRQDELDPYDVVNMQYTSGTTGFPKGVMLTHVGIGNNGYWIGRNQGFTEKDRVCLPVPLFHCFGCVLGVMAAINHGAALVILENFNPMHVMASVDQEKCTALYGVPTMFLAVLEHKLFDRFDFSSLRTGIMAGSVCPEPLMRRVIEKMNMREITICYGLTEGSPVMTQTLVDDSLERRVQTVGRAMPGIEVRIVDPETNEEVPHGTPGEVVCRGYNVMKGYYNMPEATAKAVDGDGWLHSGDLGIMDEHGYVRITGRIKDMIIRGGENIYPREIEEFLYGMEGVQDVQVVGVPSRKYGEEVGAFIIPKEGYDLAPEDVRDHCRGRISWYKVPRHIAFVSEFPMTASAKIQKYKLREMAAELFPDAMK

SEQ ID NO: 29569 - DNA, 1719 bp, Desulfotalea psychrophila LSv54
  CDS (1)..(1719)
ttgtgccttatagattattttgttttgagtggagctgagatgagcaattcgttgttaaatggagtctctttggttcagggagatcaaagtgctcctttaaaggaaaaaacaatagcagaggaattgctagccgctgtctcttcttggggggatcgtgaattcctctatttttataaacaggatattagattgacctatagggagttctcggagcgggtcgataatcttgcccgtggcttggcggaacttggtctgaagaaaggtgaaagggtaggcatttggtcacagaacaggttggagtgggttctggtccaatttgccacggcaagattagggcttgttttagtgaatattaatcccgcctgtcgtttgcgggaattggatcatattctctctcaggtcgattgttcggcaattattttttcggaccgatcaaagttcaccaattattttgagatggttacaactctgatcccgcagctactggatgactccctctctcctcatctcaattattcgtctcttcgctttgtcattcgtatgggtaacgagctcataggcaatatactcagtttacaaaaaattatagcagacggtgaggagtctcattatcccctggatgatattttaccccttttgcatagggatgatcctgttaatatccaatttaccagcgggacaaccggccaagccaagggtgctaccctgagccattttaatattttaaataatgccagtaatgtcacagccaggatgaacttcggccctggtgatcgtctctgtcttccggtgccgctctaccactgttttggtatggttctgggggtgcttggttgtcttagcaagggtgccagtatcgtatttcctgccgagcgttttactcctaaaacgaccctgaaggtgatagaacaggaggcctgtacggctctctatggtgttccggccatgtatatttctatgctcagtgtgcctagctttgctttatttaatctttcttcgctgcgaacagggattatggccggcgccccatgtcccatagaggtgatgcgagaagttgttgggaggatgcatctctctgagataactatcgcctacggaatgacagagacctcacctgtctcctttcaaagtgaagtttctgattctctgaaaaatcgagttacaacggtgggccgtgttcatcctcatgtacaggtaaagttggtgagcaaggagggcaagactgttcctgttggcgtgacaggagagctgtggacccgtggctattcggtaatgtgtggatattgggccgatcctgagagaacagcagagtcaattcaggatggttggatgcgtaccggcgatcttgctgtccttgatgaagagggttactgttccattgttggtaggctgagtgacatgattcttcgttgcggagaaaatatttatccccgtgaaatagaaaattatctctatggccatccggcaattcaggaggtgcaggtctttggcattcctgatccacgactgggcgaggagctttgtgcctggattattgttcggcctgaacattcactggaaaagagtgatatacgtcaattttgtcgggggaagattgcctcttataaaattccccatcatatatcatttgtggatgagatgcccatgtcggtgacggggaaaccgcaaaaatttaagatgcgcgcccaaatgtgtgctcagttgggcttgactgtttga

SEQ ID NO: 29570 - protein, 572 aa, Desulfotalea psychrophila LSv54
MCLIDYFVLSGAEMSNSLLNGVSLVQGDQSAPLKEKTIAEELLAAVSSWGDREFLYFYKQDIRLTYREFSERVDNLARGLAELGLKKGERVGIWSQNRLEWVLVQFATARLGLVLVNINPACRLRELDHILSQVDCSAIIFSDRSKFTNYFEMVTTLIPQLLDDSLSPHLNYSSLRFVIRMGNELIGNILSLQKIIADGEESHYPLDDILPLLHRDDPVNIQFTSGTTGQAKGATLSHFNILNNASNVTARMNFGPGDRLCLPVPLYHCFGMVLGVLGCLSKGASIVFPAERFTPKTTLKVIEQEACTALYGVPAMYISMLSVPSFALFNLSSLRTGIMAGAPCPIEVMREVVGRMHLSEITIAYGMTETSPVSFQSEVSDSLKNRVTTVGRVHPHVQVKLVSKEGKTVPVGVTGELWTRGYSVMCGYWADPERTAESIQDGWMRTGDLAVLDEEGYCSIVGRLSDMILRCGENIYPREIENYLYGHPAIQEVQVFGIPDPRLGEELCAWIIVRPEHSLEKSDIRQFCRGKIASYKIPHHISFVDEMPMSVTGKPQKFKMRAQMCAQLGLTV

SEQ ID NO: 29571 - DNA, 1707 bp, Desulfotalea psychrophila LSv54
  CDS (1)..(1707)
atggtgctgaaaatgaaaagttactatcattgcggcggcatggagcccctacggggagggaccattgccgaacattttgcagatgttgtcaggcgttttcctgaacaggaggctattgtctccctgcctcaagaaaaacgcttaagctatagagagctggccgatgcagttgatgaactggcaaagggccttttaggcattggctttactaagggcgatcgtatagggctgtggtcaaccaataatattgaatggttactggtgcagatggccatagcccatattggtgctgttctggtaaatattaaccctgcttatcgtcttcaggaattggcctatgccctcaagctctccgaggtacagggtatctttaccatccctgcctttcgcagtagcgattatgtcgccatcttggtggaactgcttcctgaattaaagctgacccagagagaagagctggctaatgccgatctaccgtttttgcgtagggtcattgtctatgatcctgccgatcctgggcagagccaacggccgtatgccggtttcaccacctggcctgaggttataggcgccggtaagggtattactatggaaaggctgaatgagattagcggagcattggatagagatgatccgatcaatattcagtatacctccggtaccaccggttttcccaaggctgtagccctgacccatcacaacatccttaataacgcctggttttcagcgcaggccctccatcttactgaagcggacaggctctgtgtgccggtacccttctatcactgttttggcacggtattggcgaatctcttatgtctgtccgtgggcgcctgcattgttataccggcggaacacttcgatgccctggctaccctcaaggccattgaagaagaaagctgtacagcaatacatggggttcccaccatgtttatcgccgaactggaacatccagactttaaaaacttcgatatgtccactctgcgtaccggcatcatggccggagcaccctgtttaccccaattgatgaaacgggtcatggaggatatgcactgccctgaaatacttattggttatggggaaaccgaggcctcgccaatcacccatttgaccacccgtgctgatagcatggagctacgcactgaaaccgtgggtaaaaatctgccccatcaggaggtgaaaattgtccatctggctaccggcgctaccgtgcccttgggcgaaataggtgaaatctgttttcgcggttatcatattatgcagggatattatggtcaggcggataagacggccgaggtcattgataaaaatggctggttatactccggtgatctgggcaccatggatgctcatggttatgtgcgtatcaccggacgatgtaaggagatgattattcgtggcggcgaaaatatttatccaaaggagatcgaagactttttgtttagtcatcccggcgtcatccaggtggcagtgtttggggtgccggatgaatattatggtgaagagatcatggcctggattcaattacggccagatgaaatttgtagcgaagaggagattcgcaactattgccgggataagatctcccattttaagatcccaaaatatatccgctttgtggatgagtttccgatgacggtgaccggcaagttgcagaaatttcgtatgcgggaaatggccattgtcaggatgggattaaaggcctaa

SEQ ID NO: 29572 - protein, 568 aa, Desulfotalea psychrophila LSv54
MVLKMKSYYHCGGMEPLRGGTIAEHFADVVRRFPEQEAIVSLPQEKRLSYRELADAVDELAKGLLGIGFTKGDRIGLWSTNNIEWLLVQMAIAHIGAVLVNINPAYRLQELAYALKLSEVQGIFTIPAFRSSDYVAILVELLPELKLTQREELANADLPFLRRVIVYDPADPGQSQRPYAGFTTWPEVIGAGKGITMERLNEISGALDRDDPINIQYTSGTTGFPKAVALTHHNILNNAWFSAQALHLTEADRLCVPVPFYHCFGTVLANLLCLSVGACIVIPAEHFDALATLKAIEEESCTAIHGVPTMFIAELEHPDFKNFDMSTLRTGIMAGAPCLPQLMKRVMEDMHCPEILIGYGETEASPITHLTTRADSMELRTETVGKNLPHQEVKIVHLATGATVPLGEIGEICFRGYHIMQGYYGQADKTAEVIDKNGWLYSGDLGTMDAHGYVRITGRCKEMIIRGGENIYPKEIEDFLFSHPGVIQVAVFGVPDEYYGEEIMAWIQLRPDEICSEEEIRNYCRDKISHFKIPKYIRFVDEFPMTVTGKLQKFRMREMAIVRMGLKA

SEQ ID NO: 29573 - DNA, 1572 bp, Symbiobacterium thermophilum IAM 14863
  CDS (1)..(1572)
atgaccatcccaaccgaatgcgaggtgagcggtgtgtacgagatcagctactgggtcgaggcgcaggcgtggatgcgccccgacaaggtcgccctggtgggcagccgggagctgtggacctaccgggacctgcacgaccgggtcgtgcgcctcagccgggccttccggaaccggctggggctggagcccggcggccggattgccatctacagcggcaactgcctggagtacctcctggtgctgctggcggcgtcccgggcggggctcgtcctggtccccctcaactggcggctgacgccgggcgaactggagtatcaactgcgggacagcggcaccaggcggatcctgtgcagcgcggagtacgcggccgcggccgccgagctgaccggccgcatcggcctggagccgcccgtgcggatcacgcccgcggccgagccggactcgctgccggacctggccgggctgctggacgccgaaccgagcgggctggagccgccgggcgagcgggacccccagccctgggaccggccgctcctgatctgctacacctccggcaccaccggccggcccaagggcgcggtgctgaactccgtcaacatgttcttcaacgccatcaacaacctgctgaccatcgacctgcgggcggatgacgtctgcatcaccctgttgcccctgttccacatcggcgggatcaacctcttcaccctgccggcgctcttcgcgggcggccgggtggtggtacccgaccggttcgacccggatcaggccgtacggctgattcaggaggagaaggtgaccgtggtcttcggcgtgcccaccgtacaccagcggctgctggaggccatcgaccggctgaagcccgacctctcccacgtccggatgttctacagcggcggcgccccgtgccccgttccgctgatccgggccttccaggagcggggctaccggttcggccagggctacgggcttacggagaccgcacccaccgtcttcatgctgctggaggacgacttcgcccggaagcccggcagcatcgggcggccggcgccgttcaaccgggtgcgggtcatcgacccggccaccgggcagcccgtgccgccgggcggcgtgggcgagatcacggtccgggggcccaacgtcttcaccgcctactggcagaacgaaaaggccacggccgaagccatccggaacggctggttccacaccggggacctcgcccggatcgacgaggagggcttcgtcaccatcgccggacggctgaaggagatgatcatctccggcggcgagaacatctacccggtcgaggtggaacaggcgatccagacccatccggccgtggtggaggcggccgtcttcggcgtgccgcacccggagtggggcgaggtgccccatgcggccgttctgctggagcccggcgcgtcggtcaccgaggaggagctcagggcccactgcctcgcccggctcggcaagtacaagatccccaggcggttcttcatcctggatgaactgccccgcaacgcggcgggcaaggtggtcaagagccgcctggccgagatcacccgcgacatgtga

SEQ ID NO: 29574 - protein, 523 aa, Symbiobacterium thermophilum IAM 14863
MTIPTECEVSGVYEISYWVEAQAWMRPDKVALVGSRELWTYRDLHDRVVRLSRAFRNRLGLEPGGRIAIYSGNCLEYLLVLLAASRAGLVLVPLNWRLTPGELEYQLRDSGTRRILCSAEYAAAAAELTGRIGLEPPVRITPAAEPDSLPDLAGLLDAEPSGLEPPGERDPQPWDRPLLICYTSGTTGRPKGAVLNSVNMFFNAINNLLTIDLRADDVCITLLPLFHIGGINLFTLPALFAGGRVVVPDRFDPDQAVRLIQEEKVTVVFGVPTVHQRLLEAIDRLKPDLSHVRMFYSGGAPCPVPLIRAFQERGYRFGQGYGLTETAPTVFMLLEDDFARKPGSIGRPAPFNRVRVIDPATGQPVPPGGVGEITVRGPNVFTAYWQNEKATAEAIRNGWFHTGDLARIDEEGFVTIAGRLKEMIISGGENIYPVEVEQAIQTHPAVVEAAVFGVPHPEWGEVPHAAVLLEPGASVTEEELRAHCLARLGKYKIPRRFFILDELPRNAAGKVVKSRLAEITRDM

SEQ ID NO: 29575 - DNA, 1557 bp, Bacillus cereus ZK
  CDS (1)..(1557)
atgtacatgacggtagggagaatttttgatttatctgttggtaagtatccgaataaagaggcgttagtggagccagaaaaaaatattcgctggacgtataaacagtgggatgagcaaataaataaaacggcgcacgctctattagaagaaggagtaagaaagggcgatactgtatctgtttacttatataactgccgtgaatttgtaaacgtttacttagcctgtgcgaaaattggagcgatctttaacccaattaatttccgcttaaaagcaaaagaagtatcttatattcttcaggatgcatcctcgaaagtcgttgtttttgaaaaagcagttgaatcaactgtcgctatcattgaacgagatttcccaaattcgtctttttggtatgtagaagacgatacaccttcttatgcaagttcctaccatgaaaaagtgaatgtagcatcttctaagaaaatagatatcgaaattaatgaaatggattattgttcgatgctgtatacgagcggtacgactggtcatccgaaaggtgtattacatcgccatcgtgaaatggctgagcatagtatgatttgtacgtatttcctaaaatataatcgagatagtgtcgggcttgtcgttgcacctttatatcactgcggtgagctgaatgctggaattattccgcgcattcaagttggcggaaagaatgttattttacatcattttgatacggaaacagtattacatacaattcaagaagagaagattacgacgttctttgcagcaccgacaatgtggaatatgctgttgcaaaaagatttaacgcagtatgatttaacgtcaatgaagatcggtatatacggcggagccgcgatggcgccagcattagtgaaggaatgtaaagaacgtctttatattgatcttgttcaaatatacggaatgacagaaatgggaccagttgttgcgtttctcgtagaagaagatcaaattacgaaagctggttcagcgggaacaccatgctttagtcatgaaattcgaattgtaaaaccaagcgaagatgcaccggcagaaccggatgatgtattgcctccttatgaagtaggagagattattttgcgcggcccaactatgatggctggttatcataaccgagaagaagcaaatgtaaaatcgatgtataaaggatggtatcattcaggtgatttaggctacttcgataaagacggttatttattcgttgcagatcgcgtggatgatatggtgattagtggcggcgttaatatttatccacgtgaaattgaagatttcctccatagtcatcctggtatattagatgttgccgtgcttggtgagccagatgaattatggggagagcgtgttgtggcggtcgttgtaaagaaagataaaaatatttcagaggcagatttagaaacgtattgtaaagaaagtgacgaattagcagattataaacgtccacgccactatttatttgtggatgaattgcctcgtaatgcgagtgggaaattacagaagtttgtgctgagagagtctttaaaaggggcaaaaaaatag

SEQ ID NO: 29576 - protein, 518 aa, Bacillus cereus ZK
MYMTVGRIFDLSVGKYPNKEALVEPEKNIRWTYKQWDEQINKTAHALLEEGVRKGDTVSVYLYNCREFVNVYLACAKIGAIFNPINFRLKAKEVSYILQDASSKVVVFEKAVESTVAIIERDFPNSSFWYVEDDTPSYASSYHEKVNVASSKKIDIEINEMDYCSMLYTSGTTGHPKGVLHRHREMAEHSMICTYFLKYNRDSVGLVVAPLYHCGELNAGIIPRIQVGGKNVILHHFDTETVLHTIQEEKITTFFAAPTMWNMLLQKDLTQYDLTSMKIGIYGGAAMAPALVKECKERLYIDLVQIYGMTEMGPVVAFLVEEDQITKAGSAGTPCFSHEIRIVKPSEDAPAEPDDVLPPYEVGEIILRGPTMMAGYHNREEANVKSMYKGWYHSGDLGYFDKDGYLFVADRVDDMVISGGVNIYPREIEDFLHSHPGILDVAVLGEPDELWGERVVAVVVKKDKNISEADLETYCKESDELADYKRPRHYLFVDELPRNASGKLQKFVLRESLKGAKK

SEQ ID NO: 29577 - DNA, 1542 bp, Bacillus licheniformis DSM 13
  CDS (1)..(1542)
atgaatttagtttcaaaattaggggaaacagctcaatcaaagcctgacagaaccgcttatatttttggagagcaaacggaaacatacgggggattgcagcagaaaattgattgctttgccgaagggctgcgcgaaatcggggtggaaaagggagatcatgtcgctttgctactcggcaatacaccgcattttgtgattgcgttttacggcgcgctgaaggccggggctgtcgtcataccgatcaatccggcctatacgccgactgagatcggctatatgctgacaaatggcgatgcaaaagtgatcgtggctctgggacagctgcttccgctttacgaaaaggtgcatgaatcccttccgaaagtcggctgcgtcgtgctttgcgaaactggagagccgcttcaggaaccggaaaacacagaggttaagatgaaattgaaatcgtttacaagcattatgaaacctcctgtccggccgtttcctgaaatcgatgacgaagatacggccgccatcctctatacgtcaggcaccacgggaagaccaaaaggggcgatgctcacacatcaaaatctattttcgaatgcaaatgatacagcccgctatctgacaatgaatgaatctgaccttgtcgtcgccgccctgccgatgttccacgttttttgtttaacggtctgcatgaatgcaccgctcatgaacggcgcagcgattttgatcgtgccgaaattcagtcccgccgaggttttcaagctgattaaaaagcatcaggcgacgatcttctcaggcgttccgacaatgtacaattacctgtaccagtatgaaggagcggatgaaacaggctttcggtccatcaggctttgcatctcaggcggagcggccatgcctgtcgctctcctgaaaagctttgaagaaaggttcggcgtcctcgttttagaaggctacggcttgtcggaggcttctcctgttacatgctttaacccgttcagcaccggccgcaagccaggatcgatcggcacgaacattctcaatgtgaaaaacaaagtcgtcaatgaactcggggaagagctgcctgccggccaagtcggcgagctgatcgttaaagggcctaatgtcatgaaagggtactacaaaatgccggatgagacggcccatacgataaaagacggatggctgtatacaggtgatttggcaaaacgggatgaagacggttatttttatatcgtcgacagaaaaaaagatatgattatcgtcggcggctataatgtctatccgagggaaatcgaagaggtgctctacctccatccaaaaatcgcagaagcggttgtgatcggagtgcccgatccgaatacgggagaagccgttcattgctatgtcgttccgaaggataaaacgctgacagaggaggatgtcttgtcgcactgcaaaaagcatcttgccaaatacaagcgcccgtcggcgatcgttttcatggatgaaattccgaaaaactcgaccggcaaaattttaaggcgcgctttaaaagacattctgacaaacaaatcttga

SEQ ID NO: 29578 - protein, 513 aa, Bacillus licheniformis DSM 13
MNLVSKLGETAQSKPDRTAYIFGEQTETYGGLQQKIDCFAEGLREIGVEKGDHVALLLGNTPHFVIAFYGALKAGAVVIPINPAYTPTEIGYMLTNGDAKVIVALGQLLPLYEKVHESLPKVGCVVLCETGEPLQEPENTEVKMKLKSFTSIMKPPVRPFPEIDDEDTAAILYTSGTTGRPKGAMLTHQNLFSNANDTARYLTMNESDLVVAALPMFHVFCLTVCMNAPLMNGAAILIVPKFSPAEVFKLIKKHQATIFSGVPTMYNYLYQYEGADETGFRSIRLCISGGAAMPVALLKSFEERFGVLVLEGYGLSEASPVTCFNPFSTGRKPGSIGTNILNVKNKVVNELGEELPAGQVGELIVKGPNVMKGYYKMPDETAHTIKDGWLYTGDLAKRDEDGYFYIVDRKKDMIIVGGYNVYPREIEEVLYLHPKIAEAVVIGVPDPNTGEAVHCYVVPKDKTLTEEDVLSHCKKHLAKYKRPSAIVFMDEIPKNSTGKILRRALKDILTNKS

SEQ ID NO: 29579 - DNA, 1620 bp, Bacillus licheniformis DSM 13
  CDS (1)..(1620)
atggttacattaaaaaaacaaacgatcggcgggcttttaaaatcaaccgccggccggtttccgaatcatgaagcggttgtatattctgagctcgatttaagatactcgtatcaggagcttgttgaagaaacttctaaaattgcaaaagggctgctcgcgctcggcattcaaaaaggggagcatgtcgccatctgggcatccaatattccggaatggattctgctccagtttgctacggcaagaatcggcgctgtgctcgtcaccgtcaatacgagctatcaggcgagagaactcgagtacttattggaacattccgattccaccaccctctttctgatggacggctacaaaggaacatcctatatcaatatgatcgatgagatcatgaaaaatcctgaaaagctgccgaagctgaaaaatctcgtctaccttggcaagaacgagacccctgaacatatgacggcttttgccgagatcgctaaaatgggcgaaacggtctctgatgccgacctttttgaacgagagcagtcactcacacacgatgatgtgattaatatgcagtatacgtcgggaacgaccggctttccaaaaggtgttatgctgactcactacaatatcgtcaacaatgcggcgatcgttgccgacagaatggggctgacgagcgaagacaggctgtgcatcccggttcctctttttcattgcttcggctgtgtgttaagcacgcttgcctgcgtcgcgtcaggcgcggccatgctgccaatcatcgaattcaagccggacatcgtcctgcaaacggtcgaaaaagaaagatgtacagggctgcagggtgtaccgacaatgtttatcgccgagctcacccaccccgatttcgcaaactatgacctctcttctctgcggaccgggatcatggcaggctccccgtgccctagagaagtcatgaaaaaagtgatgaagcaaatgaatatgacggatatcacaatcgcatacggacagacggagtcttcacccgtgattacgcagacaaccgtcaccgacacgatcgaacgccgcgtcgagaccgtcggaaaagtgcatccgcatgtagaaatgaaaatcgtcgatcctgacaccggggaaacgctcggcccggatgagcagggcgaactgtgcacaagaggatacctcgtcatgaaaggctactataaaatggatgaagccacaaaaaaggccatcgatgaagacggctggctccataccggagatttggcagaaatggaccgggacggatacgtgaggattaccgggcgcttaaaagatatgatcgtccgcggcggggaaaacatttacccgcgtgaaatagaggaattcctttatgaacatgaggatattgtcgatgtacaggttgtcggcgttccggatgaaaagtacggggaaaaaacggctgcctttattaaatgcaggccgggcaaaaagctgacgctcgaagacgtcagagatttttgcaaaggacagctttcgtattataaaattccggagtacgtatttctgatcgacgaatacccgctgaccgcatccggaaaagttcaaaaatatgtgctgcgcgaccgcgcagcagaactgcttgcgagcccggtgcagtaa

SEQ ID NO: 29580 - protein, 539 aa, Bacillus licheniformis DSM 13
MVTLKKQTIGGLLKSTAGRFPNHEAVVYSELDLRYSYQELVEETSKIAKGLLALGIQKGEHVAIWASNIPEWILLQFATARIGAVLVTVNTSYQARELEYLLEHSDSTTLFLMDGYKGTSYINMIDEIMKNPEKLPKLKNLVYLGKNETPEHMTAFAEIAKMGETVSDADLFEREQSLTHDDVINMQYTSGTTGFPKGVMLTHYNIVNNAAIVADRMGLTSEDRLCIPVPLFHCFGCVLSTLACVASGAAMLPIIEFKPDIVLQTVEKERCTGLQGVPTMFIAELTHPDFANYDLSSLRTGIMAGSPCPREVMKKVMKQMNMTDITIAYGQTESSPVITQTTVTDTIERRVETVGKVHPHVEMKIVDPDTGETLGPDEQGELCTRGYLVMKGYYKMDEATKKAIDEDGWLHTGDLAEMDRDGYVRITGRLKDMIVRGGENIYPREIEEFLYEHEDIVDVQVVGVPDEKYGEKTAAFIKCRPGKKLTLEDVRDFCKGQLSYYKIPEYVFLIDEYPLTASGKVQKYVLRDRAAELLASPVQ

SEQ ID NO: 29581 - DNA, 1638 bp, Bacillus licheniformis DSM 13
  CDS (1)..(1638)
ttggcagagctgctccatttgacaattggaaagttattggagaaaaccgcggcagacgcccctgatcacgaggctgtcgtctatccggaccgcggcctgcgttatacgtaccgggaatttgaccagttgtgcagaaaagtcgcaaaaggactgatggcgctcggtattgataaaggtgaacatgtcgcaatttgggcttccaatactccggaatggctcaccgcccagtttgcttcggcaaaagcgggtgctgtactagtcacagccaacacgaactatcaattatcagagcttgaatatgtgctgaaacagtcagatgccacaacactcattttaatggaatcataccggggcacttcctacattgatatcctttgcaaactgattcctgaattaaaggagggcgaaccgggcaggcttgcatctgaaagactgcctttcttaaaaaatattattttgctgggggatcaaaggcatcccggcatgtacctatgggatgatttattaaagctctcagggtcagtaagcgaaaaagcgcttgatcgcaggatggaacggctcaaagagcatgatgtcattaatatgcaatatacatcaggtacgacaggctttccgaaaggcgtgatgctcacccattccaatttggcaaacaatgcggcaaatattgcggaatgcatgaatttatcgaaaaaagacagaatgtgcatccccgttccgtttttccactgcttcggctgtgtactggggactctcgcttgcgtcaccgccggcgcgacgatggtgccggtacaagaattcagtccgaaagaagtgctttcagccgtcgaaacggaaaaatgcacggcgcttcacggtgtaccgaccatgttcatcgccgaactgaatgatccagatttcgcatcatatgacctgtcttctttaagaacgggcatcatggccggttcaaactgtccgatcgaagtcatgaaaaaagtgatcgataacatggggatgtctgaaataacgattgcatacggacagacggaagcctcaccggtcattacccagactagggtcaacgattcgctcaaaagaagggtcgaaaccgtagggcgcgctttgccgaatgtagaagtcaaaataactgaaccgggtacgaaccgggaggttgaaagaggcgttcaaggcgagctgtgcacacgcggctaccatgttatgaaaggctactacaaaaatcctgaggccacggcagcggtcatcgatgaggatggatttttgcatacgggagatttagccgtaatggatgaagaaggctactgccggattaccgggagattaaaagacatgatcatcagaggcggtgaaaacatatatccgcgggaaatagaagagtttttatacaagcatcccgacattctcgacgtccaaattgtcggagtgcctgacgaaacattcggcgaagaggtatcggcctggatcaaactgaaaagcggagcatcgatgacggctgacgaattaaaagaatactgcaaaggcaaaatcgcccgctataagattccgcgctatatcgcatttgtagaagagttcccgatgacggcatcagggaaagtgcaaaaattcaagttaagggagcaggcgcttgagcattttcaattgtaa

SEQ ID NO: 29582 - protein, 545 aa, Bacillus licheniformis DSM 13
MAELLHLTIGKLLEKTAADAPDHEAVVYPDRGLRYTYREFDQLCRKVAKGLMALGIDKGEHVAIWASNTPEWLTAQFASAKAGAVLVTANTNYQLSELEYVLKQSDATTLILMESYRGTSYIDILCKLIPELKEGEPGRLASERLPFLKNIILLGDQRHPGMYLWDDLLKLSGSVSEKALDRRMERLKEHDVINMQYTSGTTGFPKGVMLTHSNLANNAANIAECMNLSKKDRMCIPVPFFHCFGCVLGTLACVTAGATMVPVQEFSPKEVLSAVETEKCTALHGVPTMFIAELNDPDFASYDLSSLRTGIMAGSNCPIEVMKKVIDNMGMSEITIAYGQTEASPVITQTRVNDSLKRRVETVGRALPNVEVKITEPGTNREVERGVQGELCTRGYHVMKGYYKNPEATAAVIDEDGFLHTGDLAVMDEEGYCRITGRLKDMIIRGGENIYPREIEEFLYKHPDILDVQIVGVPDETFGEEVSAWIKLKSGASMTADELKEYCKGKIARYKIPRYIAFVEEFPMTASGKVQKFKLREQALEHFQL

SEQ ID NO: 29583 - DNA, 1650 bp, Bacteroides fragilis YCH46
  CDS (1)..(1650)
atgcaactatacgaaagaacactcggacaatggcttgaacattgggccgaaacaacaccggacaaagaatatattgtatactccgaccgcaacttgcgcttcacctggaagcaattcaacaagcgggtagacgatatggcgaaaggattgattgccatcggagtggaaagaggtacccacgtcggaatctgggcagcaaacgtaccggactggcttaccttattatatgcctgcgcgaagataggtgcagtctacgtaacggtaaacaccaactataaacaggccgaactggaatacttgtgcgagaactcggatatgcatacgctctgcattgtcaacggcgaaaaagacagcgactttgtacagatgacctacaccatgcttccggaactgaaaacctgcgaacgaggacatctgaaaagcgagcgttttccttatatgaagaacgtaatctacgtaggacaggagaaacatcgcggaatgtacaacacacaggagatcctgttgctaggcgataacatagaagacaccgagctcaacgaactcaagtcgcaggtcgattgccacgatgtggtaaacatgcaatatacatcaggaacaaccggatttcccaaaggggttatgctgacacattacaatatcagcaataatggtttcctgaccggagaacacatgaaattcacgggcaatgataaactctgctgttgtgttccattgttccactgcttcggtgtagtgctggccaccatgaactgtctgactcatggttgtactcaagtgatggtggaacgttttgacccgctgatcgtattagcctctatccataaagagaaatgtacagcactttatggagtacccactatgtttattgccgaactgaaccatccgatgttcgatatgttcgatatgtcgagcctccgcaccggtatcatggccggctcactctgcccggtagaattgatgaagcaagtggaagagaaaatgtatatgaaggttaccagtgtatacggactgacagaagcagcccccggaatgactgctacacgcattgacgatccgtttgacgtacgttgtaacaccgtagggcgtgactttgaatttacggaggtaaaagtgctcgatcctgaaactggtgaagaatgcccggtcggcgtacagggggaaatgtgcaaccggggatataacaccatgaaaggatattacaagaatccacaagctacggctgaagtgatagacaaaaacaatttcctacactcaggagacttgggaatcaaggacgaagatgggaattatcgtatcacaggacgtatcaaagatatgatcatccgtggtggagagaatatctatccccgtgagatagaggaattcctctataagctcgacggagtgaaggacgtacaggtatcgggcatcccatctaaaaaatatggagaggcagtaggggctttcatcattttgcacgaaggagtaaccatgcaggcttcggacgtacaagacttctgccggaataaaatctcccgctacaaaatccctaaatacattttcttcattgacgaatttcccatgaccgggagcggtaagatacaaaaattcaaactgaaggatttaggactgaagctctgtgaggagcaaggtattcagattatataa

SEQ ID NO: 29584 - protein, 549 aa, Bacteroides fragilis YCH46
MQLYERTLGQWLEHWAETTPDKEYIVYSDRNLRFTWKQFNKRVDDMAKGLIAIGVERGTHVGIWAANVPDWLTLLYACAKIGAVYVTVNTNYKQAELEYLCENSDMHTLCIVNGEKDSDFVQMTYTMLPELKTCERGHLKSERFPYMKNVIYVGQEKHRGMYNTQEILLLGDNIEDTELNELKSQVDCHDVVNMQYTSGTTGFPKGVMLTHYNISNNGFLTGEHMKFTGNDKLCCCVPLFHCFGVVLATMNCLTHGCTQVMVERFDPLIVLASIHKEKCTALYGVPTMFIAELNHPMFDMFDMSSLRTGIMAGSLCPVELMKQVEEKMYMKVTSVYGLTEAAPGMTATRIDDPFDVRCNTVGRDFEFTEVKVLDPETGEECPVGVQGEMCNRGYNTMKGYYKNPQATAEVIDKNNFLHSGDLGIKDEDGNYRITGRIKDMIIRGGENIYPREIEEFLYKLDGVKDVQVSGIPSKKYGEAVGAFIILHEGVTMQASDVQDFCRNKISRYKIPKYIFFIDEFPMTGSGKIQKFKLKDLGLKLCEEQGIQII

SEQ ID NO: 29585 - DNA, 1731 bp, Burkholderia mallei ATCC 23344
  CDS (1)..(1731)
atggcagcagattcaggcatgggcgcgctgatcgcgccgatgcacgggctttcgtacgtacgcggcccggcggatgtcccattgagcgacgcgacgatcgggcagttcctgctcgatacggtcgcccgctttcccgatcgcgtggcggtcgtgttccgcgagcaaggcgtgcgctggacgtggcgcgagttcgcggacgaagtcgacgcgctcgccgccgcgctgatcgagctcggcatcgcgcgcggtgaccgggtcggcatctggtcgccgaaccgcgccgaatggctgctcacgcaatttgcaaccgcgcgtatcggcgcggtgctcgtcaacgtcaatcccgcctatcggctggccgagctcgaatacgcgctgaacaaggtcggctgcaagctgttgatcgccgcggagcgcttcaagacgtccgcgtacgcggagatgatcgcggaaatcgcgccggagctcgcgacgacgcgcgcgggcgacgtgctgtgcgccgcgcgcgtgccgagtttgcgcacggtcgtgacgatgagcgatgcggcgcacgcgggcatgctgagcttcgcggacgtgctcgcgcgcgggcgggcggcgctcgcttccgcgcggctcgacgcgatcggcgcgacgctcgattgccgcgatccgatcaacatccagttcacgagcggcacgacgggcagcccgaagggcgcgacgctcacgcaccgcaacgtcgtcaacaacgcgcgctcgatcgcgaacgtgatgcggctgaccgaggccgatgcgatgtgcattccggtgccgctctatcactgcttcgggatggtgctgtcggtgctcgcgtgcgtatcggcgggcgcgaagatggtgtttcccggcgcggcgttcgagccgggtgcgacgctcgcggcggtgtccgacgagcgctgcaccgcgctgcagggcgtgccgacgatgttcatcgccgagctcgatcatccggatttcgaccgtttcgacctgagcacgctgcgcacgggcatcatggcgggttcgccgtgcccgatcgagacgatgaagcgcgtggtcgcgaagatgcacatgtccgaggtgacgatcgcctacgggatgacggagacgagccccgtgtcgttccagagcgcgacgacggattcgctcgagaagcgcacgacgacagtcggccggatccagccgcatctggaggcgaagatcgtcgacgcgacgggcgcgatcgtgcccgtcggcgagacgggcgagctgtgcacgcgcggctattcggtgatgctcggctattgggacgacgaggccaggacgcgcgaggcggtggtcgatggctggatgcgcacgggcgacctcgcgacgctcgacgaagaaggcttttgcaacatcgtcgggcgcctgaaggacatgctgattcgcggcggcgagaacgtgtacccgcgcgagatcgaggagtttctgttccggcatccgaagatccagagcgtgcaggtgttcggcgtgcccgattcgaagtacggcgaggaagtatgcgcgtggatcgtgctgcgcgcgggcgagacgatgacggacgacgagctgcgcgagttctgcagcggccagatcgcgcactacaaggtgccgcgctacgtgcgcttcgtcgacgaactgccgatgaccgtgacggggaaggtgcagaagttcgtgatgcgcgaacgaatgatcgacgaacttggtttgagcgtgcagcagacggcttga

SEQ ID NO: 29586 - protein, 576 aa, Burkholderia mallei ATCC 23344
MAADSGMGALIAPMHGLSYVRGPADVPLSDATIGQFLLDTVARFPDRVAVVFREQGVRWTWREFADEVDALAAALIELGIARGDRVGIWSPNRAEWLLTQFATARIGAVLVNVNPAYRLAELEYALNKVGCKLLIAAERFKTSAYAEMIAEIAPELATTRAGDVLCAARVPSLRTVVTMSDAAHAGMLSFADVLARGRAALASARLDAIGATLDCRDPINIQFTSGTTGSPKGATLTHRNVVNNARSIANVMRLTEADAMCIPVPLYHCFGMVLSVLACVSAGAKMVFPGAAFEPGATLAAVSDERCTALQGVPTMFIAELDHPDFDRFDLSTLRTGIMAGSPCPIETMKRVVAKMHMSEVTIAYGMTETSPVSFQSATTDSLEKRTTTVGRIQPHLEAKIVDATGAIVPVGETGELCTRGYSVMLGYWDDEARTREAVVDGWMRTGDLATLDEEGFCNIVGRLKDMLIRGGENVYPREIEEFLFRHPKIQSVQVFGVPDSKYGEEVCAWIVLRAGETMTDDELREFCSGQIAHYKVPRYVRFVDELPMTVTGKVQKFVMRERMIDELGLSVQQTA

SEQ ID NO: 29587 - DNA, 1533 bp, Methylococcus capsulatus str. Bath
  CDS (1)..(1533)
atgcaagcatcgctcccggcggcgctccggctggcggccgaccgtttttcgtcccttcccgccatcttgaccgacgaacgacgcgtcgatttcgccgaattcgaccgcgcgtccgatgccatcgccgccggactcgccgtccggggcgtcgccaagggtgagcgcatcggtctctactgcatcaattcggtggagttcaccctggcctatgccggcatcgtcaaggccggcgccgtcgtcgtgcccatcaacctgttgctcagcgctgaagaggtgcattacaacctcgccgacgccggggtcagcgggctgatctatcacggtcaggtctcggcaaacgcggccgccgtggcggaccggctttccggactcaaggtccgcgccggcatcggcctcgatgatcaggatggagatgtctggcgcgccctgttggaagaatcggcagagcccccctccatcgaattcgatgcagtggaagacctggcggcgatcctctacacctccggcacgaccgggcatcccaagggcgcaatgctgacccacggcaacctgttggcgaataccacgagcgtgcgggaggccctggattggcgccctggcgaggaccgggtcttggtggtgctgccgatgtttcatgccttcgcggccaccgtcggcatgctcacgccactcctccacggctgtgccctgataccactggcgaaattcgagccggatcgggtggccgacaccatcggccgccaccgcgcgactctgttcctcggcgtgcccagcatgtatgccctgctgtgccggctgggggaggagcggatcgcccggttcggaaccgtccggctctgcgtgtccggcggcgcggccttgccgcccagcgtgatggagcagtttcaggcacgtttcggcttgcccatacacgagggcgatggtccgaccgaatgttcgccggtgacctgcgtcaatccggtagccggccccgtcaaacgtggcacggtcggtctgccggtaccgggagtcgaaatgaagatcctcggcgaggacggcgtcgaactccccaggggcgaactgggcgaaatcgcggtgcgaggcgccaatgtgttcaaaggatactggaaccaaccggaggcgacgcgggaatgcttccgcgacggctggttcctcaccggggatctgggccaagtggacgacgacggctatttcagcatcgtcgatcgcaagaaggatctgatcatcgtcaacggcatgaacgtctatccgagggtgatcgaagaggtcctgtgccggcatcctgcggtccgggaggtcgccgtggtcggcgacccggatccgttgcacggtgaacgggtggtggcctatgtcgtactggacgcgcccgccagcgaagccgaaatccgcgcctggtgcaagccttatctggggcggcacgaaattccacgccaggtcaaggctctccagcagttgccccgtaatgccgccggcaaaatagtgaagcggcagctgcggcggcagggtgaagtggagcgcggggtggatgcctga

SEQ ID NO: 29588 - protein, 510 aa, Methylococcus capsulatus str. Bath
MQASLPAALRLAADRFSSLPAILTDERRVDFAEFDRASDAIAAGLAVRGVAKGERIGLYCINSVEFTLAYAGIVKAGAVVVPINLLLSAEEVHYNLADAGVSGLIYHGQVSANAAAVADRLSGLKVRAGIGLDDQDGDVWRALLEESAEPPSIEFDAVEDLAAILYTSGTTGHPKGAMLTHGNLLANTTSVREALDWRPGEDRVLVVLPMFHAFAATVGMLTPLLHGCALIPLAKFEPDRVADTIGRHRATLFLGVPSMYALLCRLGEERIARFGTVRLCVSGGAALPPSVMEQFQARFGLPIHEGDGPTECSPVTCVNPVAGPVKRGTVGLPVPGVEMKILGEDGVELPRGELGEIAVRGANVFKGYWNQPEATRECFRDGWFLTGDLGQVDDDGYFSIVDRKKDLIIVNGMNVYPRVIEEVLCRHPAVREVAVVGDPDPLHGERVVAYVVLDAPASEAEIRAWCKPYLGRHEIPRQVKALQQLPRNAAGKIVKRQLRRQGEVERGVDA

SEQ ID NO: 29589 - DNA, 1611 bp, Nocardia farcinica IFM 10152
  CDS (1)..(1611)
gtgacgacaaccaccgaccatcgggacggctacgtgcccttccccgccgagacggccgaggcgtaccgggccgcgggctattggaccggcaggccgctgggcgacctgttgcgcgccaccgcgagcgcccatcccggccgcaccgccctgctcaccgacgacggcgcgcgcgactacgcctgggtcgacgccgaggccgaccggatggcccacggcctgctcgcgctgggcatcgccccgggcgaccgggtggtcgtccagctccccaacgtgcccgaattcctcaccgtgctgttcggtctgctccgtgccggcatcatcccggtgctgaccctgcccgcccatcgccgggccgagatcgagcacctggccacgctgtcggaggccgtcgcctacatcatcgccgaccggcagggcgatttcgactaccgcgaactggccgcgaccgtgtgcgacaacgtcccgagcctgcggcacgtgctcgtcctcggcgacgcgggcccgttcaccgacctgagcggcattgcccgcgacggcgattcgctgcccgagatcgacccgagcgacatcgcgctgatgctggtctccggcggcaccaccggcctgccgaagctgatcgcgcgcacccacgacgactacgtctacaacgccaccgccagcgccgagctctgcgaactcaccgccgaggacgtctacctggcgaccctgcccgccgcgcacaacttcccgctggcctgccccggcatcctgggcagcgtgagcgtcggcgcggcggtcgccttcgtcaccgatcccagcccggagaacgccttcgccgtcatcgaacgccaccgggtgaccgtcaccgccgtggtgccgccgctggcccagttgtggtgcgcggccgtggaatgggaggaggccgacctcggttcgctgcggctgctgcaggtgggcggcgcgcgcctggccgacgtgaacgccagggaggtcacccccgcgctgggcgcgacgttgcagcaggtgttcggcatggccgagggcctgctcaactacacccgtctcgacgaccccgaggacctgatctgcaccacgcagggccgcccgctctcccccgccgacgaggtgcgcgtcgtcgacggcgagggcaacgacgtggcgcccggcgaggagggtgagctgctgacccgcggcccctacaccattcgcggctattaccgcgcccccgagcacaacgcccgcgcgttcacccccgacggctactaccgcagcggggacctggtgcgggtgctgccgtcgggacacctgatcgtctccgggcggatcaaggacgtcatcaaccgcggcggggagaacatctcctgcgacgagctcgaggagcacctgctcgcgtacccggccgtgcggcacgcggccgcggtcgggctgcccgatgccgccctgggcgaaaaggtctgcgcggtactggtcgtcgacggtgacatgccgagtctggcggaggtcaagaagttcctgctcggccgcggcctggccaccttcaagttgcccgacgtgctgcgccaggccgacaccctgccgctcaccgcggtcggcaagatcgacaagaaggtgctgcgggccacccagtcctga

SEQ ID NO: 29590 - protein, 536 aa, Nocardia farcinica IFM 10152
MTTTTDHRDGYVPFPAETAEAYRAAGYWTGRPLGDLLRATASAHPGRTALLTDDGARDYAWVDAEADRMAHGLLALGIAPGDRVVVQLPNVPEFLTVLFGLLRAGIIPVLTLPAHRRAEIEHLATLSEAVAYIIADRQGDFDYRELAATVCDNVPSLRHVLVLGDAGPFTDLSGIARDGDSLPEIDPSDIALMLVSGGTTGLPKLIARTHDDYVYNATASAELCELTAEDVYLATLPAAHNFPLACPGILGSVSVGAAVAFVTDPSPENAFAVIERHRVTVTAVVPPLAQLWCAAVEWEEADLGSLRLLQVGGARLADVNAREVTPALGATLQQVFGMAEGLLNYTRLDDPEDLICTTQGRPLSPADEVRVVDGEGNDVAPGEEGELLTRGPYTIRGYYRAPEHNARAFTPDGYYRSGDLVRVLPSGHLIVSGRIKDVINRGGENISCDELEEHLLAYPAVRHAAAVGLPDAALGEKVCAVLVVDGDMPSLAEVKKFLLGRGLATFKLPDVLRQADTLPLTAVGKIDKKVLRATQS

SEQ ID NO: 29591 - DNA, 1668 bp, Nocardia farcinica IFM 10152
  CDS (1)..(1668)
atgacgacggcgacaacgacgacggcgacgagagcactgccgagttatgactccggcccgtctcccaccccgctgctcggcgacacgatcggcgcgaacctcgaccgcaccgcggccgcgcatccggatcgggaagcggtggtggacattccgtcgggccgccgctggacctaccgcgaactcgtcgccgcggtcgacgcgctggccgcgggcctggacgcacgcggtatccgcaagggtgaccgcgtcggcatctgggcgccgaactgtgccgagtggttcctcacccagtacgcgaccgcgaagatcggcgcgatcctggtcaatatcaatccggcctatcgcaccagcgaactggcctatgtgctgcgccaggcgggcgtgcgcatgctgatcgcggcgcgcgagttcaagacctccgattacgtcgccatgatcgacgaggtgcgcggggagtgtccggggctcgagcaggtgctcatcctcggcgacgaccagtggcagcaggtgacgagcaccacgcccgacccggtccggttggccgagctcggcgccgagctcaccatggacgatccgatcaacatccaatacacctcgggcacaacgggtttccccaagggtgccacgctcagccaccacaacatcctcaacaacggcttcttcgtcggcgagctgtgcggctacaccgagcaggaccgcatctgcgtgccggtgcccttctaccactgcttcggcatggtcatgggcaatctcgcggccaccagccacggcgcggcgatcgtgatcccggcgccgtcgttcgatccggccgccaccctggccgccgtcgccgccgagaagtgcacctcgctctacggggtgccgacgatgttcatcgccgtgctcgccgaactcgacaccgagctggagaagtccggcgccgcaccggatctgagcaccctgcgcaccggcatcatggcaggctcaccgtgcccggtggaggtgatgaagcgggtcatcgaccggctcggcatgagcgaggtctgcatctgctacggcatgaccgagaccagcccggtctccacccagacccgccgcgacgacgacatcgaccgcaggaccgccaccgtcggccgggtcggcccgcacctcgaggtcaagatcgtcgacccggcgaccggccgcaccgtgccgcgcggcgagcccggcgagctgtgcacccgcggctactcggtgatgctcggctactgggacgagcccgagaagaccgccgaggccatcgatgccgcccgctggatgcacaccggcgacatcggcgtgatggacgaggacggctatgtcgcggtgaccggccgcatcaaggacatggtgatccgcggcggcgagaacatctacccgcgcgagatcgaagaattcctctacacccatcccgacatcctcgacgcccaggtcatcggcgtgcccgacgaacgctacggcgaggagctgatggcctggatccggatgcgcgagggcgccgaaccgttggacgcggcggccgtgcgggagttctgcaccggcaaactcgcgcacttcaagatcccgcggtacgtgcacgtcgtcgaggagttcccgatgacggtcaccggcaaggtgcgcaaggccgagatgcgcgagctggcccgcgaaatgctgcagtccggcacgtga

SEQ ID NO: 29592 - protein, 555 aa, Nocardia farcinica IFM 10152
MTTATTTTATRALPSYDSGPSPTPLLGDTIGANLDRTAAAHPDREAVVDIPSGRRWTYRELVAAVDALAAGLDARGIRKGDRVGIWAPNCAEWFLTQYATAKIGAILVNINPAYRTSELAYVLRQAGVRMLIAAREFKTSDYVAMIDEVRGECPGLEQVLILGDDQWQQVTSTTPDPVRLAELGAELTMDDPINIQYTSGTTGFPKGATLSHHNILNNGFFVGELCGYTEQDRICVPVPFYHCFGMVMGNLAATSHGAAIVIPAPSFDPAATLAAVAAEKCTSLYGVPTMFIAVLAELDTELEKSGAAPDLSTLRTGIMAGSPCPVEVMKRVIDRLGMSEVCICYGMTETSPVSTQTRRDDDIDRRTATVGRVGPHLEVKIVDPATGRTVPRGEPGELCTRGYSVMLGYWDEPEKTAEAIDAARWMHTGDIGVMDEDGYVAVTGRIKDMVIRGGENIYPREIEEFLYTHPDILDAQVIGVPDERYGEELMAWIRMREGAEPLDAAAVREFCTGKLAHFKIPRYVHVVEEFPMTVTGKVRKAEMRELAREMLQSGT

SEQ ID NO: 29593 - DNA, 1656 bp, Photobacterium profundum SS9
  CDS (1)..(1656)
atgactattccgtttaccccttggcctgctgaatttactgaacgatatattgaaaaagggtattggattgacttaccgctgaccgatattgtggcgcgccattgtgctgattcaacgtctgcgtcacgtactgcattaatttgtcaccagcgtcagtttagctatgccgagcttaattgcttgtcgaatatactagcccatcatttgcaggctcaaggttttcaagcgggtgaaactgctgttgtgcagttaccgaatgtggctgaattttatatcgtttttcttgctctattgaaagttggcatcgttcccgtcaatgcgctatttaatcataaacagcttgaactgcgtgcttatatagaacaagtacagcccgcattgatggttgtttctaacggccatcaactgtttcatgacgatcgttttgtttctgaattaaatgctgatacgccgacgattcgtcactggttagttgaaggtgaagcaacatttggtacgtcaataacagagctattgatggctcagcaggaagcgccaaacaagaaggcagttgaattcacatctacccccacttcagaagtggctttctttcaactctccggtggcagtacaggcactccaaaactgattccgcgaacgcacaatgactactattacagtgtccgtgccagcgctgaaatttgtcaattagatagcgataccgtgtatttgtgcgcattgcctgcaccgcataatttctcgcttagttcgccaggggcatttggtgtgttttatgtcggcggtactgtggtgttggctacagatcctagtgccatgagctgttttccattaattcaccaacatcgcgtaaccatgacggctttggttccccccgcagtaacattgtggttgcaagcggcgagtgattataaacatcaccttgtcagcttgaatgtgttgcaagtgggtggagcacgtttgagcgaatcgttagcgaagcagatcactcccgttttagggtgccagttacagcaagtatttggtatggccgagggcttggtgaattacacccgattcgatgatgacagctggcacgtgttcaatacccaaggtcgtccaatcagtaacgatgatgaaattaaaattgttgatgaacatggtaatgaagtgcctgacggcatagcgggagcgttacttacacgtggtccgtataccttccgcggctacttcaatagcccagcccataatgcgagtgcttttgatgccgatggcttttacctttctggcgatatagtgaaacgtactactacgggctacttgattgtggtggggcgcgataaagatcagatcaaccgtggtggcgaaaaaattgcggctgaagaagtcgaaaatcaattattagcccacgaggcggttactaacgcagccttggtctcgatgccagataccgtaatgggagagaaaagctgtgcctttgtgattacgactaatccggcattaaaagccatcacccttcgtaaacatcttcgtgcccgaggcgttgcggaatataagttgcccgaccgtgttgagtttgttgctcacttaccaatgaccccagtcgggaaagtcgataaaaaacagttacgtcagaccattcaacagacattaataattaaaaaagaaaaggacgtttaa

SEQ ID NO: 29594 - protein, 551 aa, Photobacterium profundum SS9
MTIPFTPWPAEFTERYIEKGYWIDLPLTDIVARHCADSTSASRTALICHQRQFSYAELNCLSNILAHHLQAQGFQAGETAVVQLPNVAEFYIVFLALLKVGIVPVNALFNHKQLELRAYIEQVQPALMVVSNGHQLFHDDRFVSELNADTPTIRHWLVEGEATFGTSITELLMAQQEAPNKKAVEFTSTPTSEVAFFQLSGGSTGTPKLIPRTHNDYYYSVRASAEICQLDSDTVYLCALPAPHNFSLSSPGAFGVFYVGGTVVLATDPSAMSCFPLIHQHRVTMTALVPPAVTLWLQAASDYKHHLVSLNVLQVGGARLSESLAKQITPVLGCQLQQVFGMAEGLVNYTRFDDDSWHVFNTQGRPISNDDEIKIVDEHGNEVPDGIAGALLTRGPYTFRGYFNSPAHNASAFDADGFYLSGDIVKRTTTGYLIVVGRDKDQINRGGEKIAAEEVENQLLAHEAVTNAALVSMPDTVMGEKSCAFVITTNPALKAITLRKHLRARGVAEYKLPDRVEFVAHLPMTPVGKVDKKQLRQTIQQTLIIKKEKDV

SEQ ID NO: 29595 - DNA, 1689 bp, Pseudomonas syringae pv. syringae B728a
  CDS (1)..(1689)
atgcaagctgacttctgggatgacaagcgtccggcgggtgtcgacgccgaggtggatctgcagacctaccaatcggtcgtcgatgtgttcgagcgctgctgcaggaaattcgccgaccgacctgcgttcagcaacatgggcgtgacgctgacctacgcggagctcgagcgtcactctgccgccttcgccgcgtatttgcagcagcacacgcaactggtgccgggtgaccgcattgccgtacagatgcccaatatcctgcagtatccgatcgccgtattcggtgcgatgcgtgccggtctgacggtggtcaataccaacccgctgtacaccgcgcgcgagatgcgccatcaattcaaggactccggtgcccgggcgctggtttacctcaacctgttcggcaagctggtgcaggaagtgctgccggacacggccatcgaatacctgatcgaagtgaaaatgggcgacatgcagtcggcggccaagggctggctggtcaataccatcgtcgacaaggtcaagaagatggtccctgaattccatctgcctcaggccgtcggcttcaagcgggcgctgcgcctggggcgtgacagccgcatgcaggtcgtaccgcgaggtctgcaggatgttgccgttctgcagtacaccggtggcaccacggggctggccaagggcgcgatgctcacccatggcaatctggtcgccaacatgcagcaggtctacgcctgcatgcgtcagcaagggccgcgaggcggatcgctgtttgaagaaggcaaagaggtgatgatcgcgccgctgccgctctatcacatctacgcgttcacggcgaactgcatgtgcatgatgatcagcggcaatcacaacatcctgatcaccaatcctcgcgatatcggcggcttcatcaaggaactgggcaagtggcagttcaccgccatgatcggcctcaacacgctgttcgtggcgctcatgaaccatccggaattcaaaaaactggatttctcggcgctgaaaagcaccaactccggcggcactgcactggtcaaggccacggccgagcgctgggcgcagatcaccggctgcacgatcgtcgaaggttacggcctgaccgagacgtcgcctgttgccagtgccaatccctacggcactatggcgcgtctgggaaccgtgggcattcccgtgcccggcaccgccatgaaagtcatcgatgacaatggcgtcgagttgcctttcggcgagcgtggcgagctgtgcatcaaggggccgcaggtcatgaaaggctactggaaccagcctgatgccacggccgagtgcctggatgccgaaggctggttcaagaccggtgatattgccgtgattggcgctgacgggtttgtcagtatcgtcgaccgcaagaaagacctgatcatcgtgtccggtttcaacgtctaccccaacgaaatcgaagacgtggtcatggctcatccgaaagtcgccaactgcgcctgtatcggcgtgccggacgagcgctcgggggaggctgtgaagctgttcgtggtggcgcgagacccggggctgagcattgaagagctcaaggccttctgcaaagagaatttcaccggctacaaggtgcccaggcagatcgttctgcgtgattcattgccgatgaccccggtgggcaaggttctgcgccgcgagcttcgtgacatcgcctga

SEQ ID NO: 29596 - protein, 562 aa, Pseudomonas syringae pv. syringae B728a
MQADFWDDKRPAGVDAEVDLQTYQSVVDVFERCCRKFADRPAFSNMGVTLTYAELERHSAAFAAYLQQHTQLVPGDRIAVQMPNILQYPIAVFGAMRAGLTVVNTNPLYTAREMRHQFKDSGARALVYLNLFGKLVQEVLPDTAIEYLIEVKMGDMQSAAKGWLVNTIVDKVKKMVPEFHLPQAVGFKRALRLGRDSRMQVVPRGLQDVAVLQYTGGTTGLAKGAMLTHGNLVANMQQVYACMRQQGPRGGSLFEEGKEVMIAPLPLYHIYAFTANCMCMMISGNHNILITNPRDIGGFIKELGKWQFTAMIGLNTLFVALMNHPEFKKLDFSALKSTNSGGTALVKATAERWAQITGCTIVEGYGLTETSPVASANPYGTMARLGTVGIPVPGTAMKVIDDNGVELPFGERGELCIKGPQVMKGYWNQPDATAECLDAEGWFKTGDIAVIGADGFVSIVDRKKDLIIVSGFNVYPNEIEDVVMAHPKVANCACIGVPDERSGEAVKLFVVARDPGLSIEELKAFCKENFTGYKVPRQIVLRDSLPMTPVGKVLRRELRDIA

SEQ ID NO: 29597 - DNA, 1650 bp, Desulfovibrio desulfuricans G20
  CDS (1)..(1650)
atggaaaattttgagcttcgcgaatggactctcggtcagattctggatcatgccgtggccaactggcccgacaatgaagccgtggtatacgtagaccgcgactaccgccagacctaccgcgagttcggcaaggtggttgacgatcttgccagagggctgatggctctcggggtgaaacatggcgaaaaggtggccgtatggtccaccaacgtgccgtactgggtggccctgcagtttgccacggcaaaaatcggcgccgtgctgctgacggtcaacaccaactaccgtaaaagcgagctacaatacctgctaacccagtccgaatgcgaaaacctgttcattatggacgggtaccgcgaccatgattatctgcagaccatttacgacctgatgccggagctgaaaaatcagccccgcggcaacctgaatctgaacggctttcctcatctcagaagggtcatgtttctgggcgtggaaaagcaccgcggcatgtattccgtgccggaaatcatcagcctcggggttatggtttccgatcaggagtatgccgaacgccagcgcatgctcagccccggagacgtggtcaacatgcagtacacatccggcaccacgggctttcccaaaggggttatgctgacgcatgtgggcatagggcttaacgggtactggataggccgcaaccagaacttcacacacaaggacaggttgtgcctgcccgtgccgcttttccattgtttcggctgtgtgctgggtgttctggctgccgtgaatcacggagccacgctggttattctggaaaacttcaaccccgtgcatgtgatggcgtcggtggatcaggaaaactgcaccgccctgtacggtgtacccaccatgtttcttgccgtgctggagcacaagctgttcgaaaagttcgatttcagctcgctgcgcaccggcatcatggccgggtcggtatgtccggaaccgcttatgcgccgtgtcatcgaaaatatgaacatgaccgaagtcactatctgctacggtctgaccgaaggttcgccggtgatgacgcagacgctgcccacagacagctttgagcgccgtacccgcaccgtgggcaaggccatgcccggcatcgaagtgcaggtggtggaccccgacacgggtgaagaactgccgcatggctcgcagggcgaggttgtctgccgcgggtacaacgtgatgaaaggctactacaatatgcccgaggccacgcagaaagccgtggacgctgacggctggctgcattccggtgatctgggcattatggacgaacacggatacgtgaccataaccggccgcatcaaagatatgatcatccgtggcggagaaaatatctacccgcgcgaaatagaagagtttctgtacgggatggaaggcgtgcaggacgtgcaggtggtgggagtgcccagccgccggtacggtgaagaagtgggggcgttcatcattgcgaaagagggtgctgatctggctccggaagatgtgcgcgattactgcagggggcagatagcgtggtacaaggtgccgcgtcatatcgcctttgtggaggaatatcccatgaccgccagcggcaagattcagaaatttaagctgcgcgaaatgtgcgcggagctgtttcccgacgtgcgctga

SEQ ID NO: 29598 - protein, 549 aa, Desulfovibrio desulfuricans G20
MENFELREWTLGQILDHAVANWPDNEAVVYVDRDYRQTYREFGKVVDDLARGLMALGVKHGEKVAVWSTNVPYWVALQFATAKIGAVLLTVNTNYRKSELQYLLTQSECENLFIMDGYRDHDYLQTIYDLMPELKNQPRGNLNLNGFPHLRRVMFLGVEKHRGMYSVPEIISLGVMVSDQEYAERQRMLSPGDVVNMQYTSGTTGFPKGVMLTHVGIGLNGYWIGRNQNFTHKDRLCLPVPLFHCFGCVLGVLAAVNHGATLVILENFNPVHVMASVDQENCTALYGVPTMFLAVLEHKLFEKFDFSSLRTGIMAGSVCPEPLMRRVIENMNMTEVTICYGLTEGSPVMTQTLPTDSFERRTRTVGKAMPGIEVQVVDPDTGEELPHGSQGEVVCRGYNVMKGYYNMPEATQKAVDADGWLHSGDLGIMDEHGYVTITGRIKDMIIRGGENIYPREIEEFLYGMEGVQDVQVVGVPSRRYGEEVGAFIIAKEGADLAPEDVRDYCRGQIAWYKVPRHIAFVEEYPMTASGKIQKFKLREMCAELFPDVR

SEQ ID NO: 29599 - DNA, 1701 bp, Psychrobacter sp. 273-4
  CDS (1)..(1701)
atgggcgcacgctcggcaaatgccccactgactcatagctatgataaaggtcctgatgtaccgctgattgaagcgaccatcggcgatttctttgatgccatcgcctccaaatatcctgaacgtgaagctctggtcgtctgtcatcaaaacatccgctggacttatcgtgaactgcaacagcaagtcaatcaactcgcgagcagcatgattgagatggggtttgagattggtgatcgcatcggcatctggtcgcacaacaacgctgaatggcttttgatgcaattagcaaccgcaaaggtcggtgtcatcttagtaaatatcaaccccgcttaccgtgtctttgagcttcaatatgccctaaataaacttggttgctcggcactgctattgatgcgccattttaaaagcagtgactatgcgcagttgattcgtgagatgtgtcctgagatttaccacaaaaactacactcagctggatttggttgaaataccaacgattgagcgcatcatttggattgatgagccagacagtgatgaagagtttgggtttatgcagaagttttctgcatggatggcggaaggtgatgccaatgatccacgtatcgccgagcgtcaagcccagcttaaaaacactgacgccattaacgtacagtttaccagtggtacgacgggcacacccaaaggcgcgactttaagccatcgaaatatcttaaataacggctacttcatcggtgaggctatgaatttcactgaagaggacagactatgtattccagtgcctttgtatcattgctttggtatggtgcttggtaatttagccattcttactcatggcggttgtatcgtttatccaaatgatggttttgagccgttatcggttttgcaagcagtcgaagccgaaaaatgtacgggtctacatggcgtgccaacgatgtttatcgccgagcttgaccatcctgaatttaaaaactttgatttatcgaccttgcgtaccggcattatggcaggctctagctgtccgattgaggtgatgcgtcgcgtcatcgatgagatgcacatgaaagaagtcaccattgcgtatggcatgacagaaaccagtccagtatcttgtcagaccaatgagcatacgccacttgataaacaagtctcgaccgtgggacttgtgcagccagcgcttgaagtaaaagtcgttgatgccgaaacaggtgagattgtgcccttaggcgaaacgggcgagctgctgactcgtggttattcggtgatgaaaggttattggggcagtcgttttaaaacccgtgaagccattcaagatggctggatgcacactggtgatttggcgactatggatgaagatggctatgtcaaaatcgtcggtcgcagtaaagatatggtcatccgcggcggtgagaatatctatccagttgaaatcgaaaactatttataccgtcatcctaaaatccgtgatgtacaaatcgttggtataccggataagcgttatggcgaggtattggcggcttggattattcctaaagaagctggcagcttaactgaagaagaagtgcgtcagttctgtagtgagcacattgcccattataaagtaccgacctattatcgctttgtgactgaatatccaatgaccatcactggcaaaattcagaaatataaaattattgagcagatgaaagaagagcttggtttataa

SEQ ID NO: 29600 - protein, 566 aa, Psychrobacter sp. 273-4
MGARSANAPLTHSYDKGPDVPLIEATIGDFFDAIASKYPEREALVVCHQNIRWTYRELQQQVNQLASSMIEMGFEIGDRIGIWSHNNAEWLLMQLATAKVGVILVNINPAYRVFELQYALNKLGCSALLLMRHFKSSDYAQLIREMCPEIYHKNYTQLDLVEIPTIERIIWIDEPDSDEEFGFMQKFSAWMAEGDANDPRIAERQAQLKNTDAINVQFTSGTTGTPKGATLSHRNILNNGYFIGEAMNFTEEDRLCIPVPLYHCFGMVLGNLAILTHGGCIVYPNDGFEPLSVLQAVEAEKCTGLHGVPTMFIAELDHPEFKNFDLSTLRTGIMAGSSCPIEVMRRVIDEMHMKEVTIAYGMTETSPVSCQTNEHTPLDKQVSTVGLVQPALEVKVVDAETGEIVPLGETGELLTRGYSVMKGYWGSRFKTREAIQDGWMHTGDLATMDEDGYVKIVGRSKDMVIRGGENIYPVEIENYLYRHPKIRDVQIVGIPDKRYGEVLAAWIIPKEAGSLTEEEVRQFCSEHIAHYKVPTYYRFVTEYPMTITGKIQKYKIIEQMKEELGL

SEQ ID NO: 29601 - DNA, 1644 bp, Methanococcoides burtonii DSM 6242
  CDS (1)..(1644)
atgtcaatgccatttactaaagctaccattggagaattttttgaagaacaggccagaaaggacccaaaccgagactttatcgtctatcctgatcgaaatttaagattctcgtacagtgaattcaatgatagggtcgatgatcttgcgaatggacttatatccatcggcatcacaaaaggcgatcatgttgggatctgggcacgaaatgtgcctgactggctgaccttcctttttgcaacagcaaggatcggtgcggtactggttaccgtaaatactgcatacaaaagccatgaacttgcatatgtgatgaagcaatcagatatgaaggcaattgctattgttgataggttcagggatgttgactatgtggaaacgatctatgagctggtacccgaactaaaaacatgtaaaagagggaaccttaacagtaaagggtatccaaaacttgaaagtgttatctttatcggtcaggaaaagcacaggggaatgtacaacacagcagaaatgcttctacttggaaagcattctgaaagtgaagaacttgacagcctcaaaggaacactggactgcaaagatgtcatcaacatgcaatacacatcaggaaccaccggattcccgaaaggtgttatgctgacacatgagaatatccttaacaacggatattacatcggagaaagacaaaaattcacagaagatgatcgattgtgtctccccgtcccattgttccattgttttggaatagtacttggagttcttgcaactctcacacatggcggtacgcttgtaatgatagaactttttgatccgcttctggtgttggccgcagtacagaaagaaaagtgtactgccctttatggagttcccacaatgttcattgcagaattctcacacccgatgttcaaaatgttcgatatgtcatcactgagaacaggtatcatggcagggtcaccatgccctatagaggccatgaaaaaagttatcgatgaaatgaactgcaaggatatcaccatagcttatggccttacagaagcttctcctgtatttacccagacaagcacaaatgatcccattgaacgccgtgtgagcacggtaggaacatcactggaacatatcgatgtaaagatagtggactccgaaactggtgaaattgtaggaccaaacgagcagggagagatatgctgtcgtggttacaatgtcatgaaagggtactacaagatgcctgaaatgaccaatagggccatcgacaaggatggatggctgcacagcggagacctcgctaccgttgatgaggatggttattaccgcattaccggaaggataaaggatatgatcatccgtggcggagaaaatatctacccaagggagatagaggaattcctttacaccatcgaaggaattaaagatgcacaggtaattggaatacctgatgaaaaatacggtgagatagtaggggcttttgttgtgctcaaagaaggttcaaagctcacaccagaagatatcagggatttcagcatcacaaagatagcacgctataaagtgccaaaacacatatttatcgtagatgaatatccacttacagcaagtggaaaagttcagaagttcaagcttagggaaatggccgtcgagttgatggaggaaaactga

SEQ ID NO: 29602 - protein, 547 aa, Methanococcoides burtonii DSM 6242
MSMPFTKATIGEFFEEQARKDPNRDFIVYPDRNLRFSYSEFNDRVDDLANGLISIGITKGDHVGIWARNVPDWLTFLFATARIGAVLVTVNTAYKSHELAYVMKQSDMKAIAIVDRFRDVDYVETIYELVPELKTCKRGNLNSKGYPKLESVIFIGQEKHRGMYNTAEMLLLGKHSESEELDSLKGTLDCKDVINMQYTSGTTGFPKGVMLTHENILNNGYYIGERQKFTEDDRLCLPVPLFHCFGIVLGVLATLTHGGTLVMIELFDPLLVLAAVQKEKCTALYGVPTMFIAEFSHPMFKMFDMSSLRTGIMAGSPCPIEAMKKVIDEMNCKDITIAYGLTEASPVFTQTSTNDPIERRVSTVGTSLEHIDVKIVDSETGEIVGPNEQGEICCRGYNVMKGYYKMPEMTNRAIDKDGWLHSGDLATVDEDGYYRITGRIKDMIIRGGENIYPREIEEFLYTIEGIKDAQVIGIPDEKYGEIVGAFVVLKEGSKLTPEDIRDFSITKIARYKVPKHIFIVDEYPLTASGKVQKFKLREMAVELMEEN

SEQ ID NO: 29603 - DNA, 1650 bp, Ralstonia eutropha JMP134
  CDS (1)..(1650)
atggatttcgacgcggtactgattgcgccgcgccgcgcggcgagcgtggcggcagggctgtggcgtgaccgcaccatcaacgattatttcgacgccactgtggcgcgtgcgcccgacggcccggcgctcacgtcgctgcaggtggaaagcggggcggtgcggcatttcacgtggcgtcagctcgatgctatggtcacgcgcattgctgtcgggctgcgccggctcggcatcgaacgcaatgacgtggtgtcgtgccagcttcccaatggctgggaggtcacggctctgtatctggcctgcgcgcgcatcggcgcggtgctcaatccgctgatgccgatcttccgcgagcgcgagctgtcgttcatgctggcgcacgcggacagcaaagtcgtggtcgtgccgcagcggttccgtgggtttgatcatgcggggatgctggcaggcttgcgcgattcgttgccggcgctgcgtcatgtcgtgatcaccggaagcgatggtcccgacgggtttgaggccatgctgtgcggcgccgatcgcgacagcgacccggatgctgccgccatcctgaggcgcgaccgccccagccccgatgacgtcacccagctcatctatacctcgggcacgacgggcgagcccaagggcgtgatgcataccgcgaacacgctgctgtccaacatccttccctatgccgagcggctgcgccttggtgccggcgatgtggtgctgatggcctcgcccatggcgcaccagaccggtttcatgtacgggctgatgatgcccgtggtgctcggcgcgcatgcggtgcttcaggacatctggaatccggtacaggcggccaggctgatccgcgagaccggcgtcacgttcacgatggggtcgacgccattcctcaccgatcttgcgcgcacggtggaggagtccggccagcctgtgccgagcctgcgtacgttcctgtgcgcgggtgcgccgattcccggagcgctcgtggagcgagcgcgcaccgcgctgggcgcgagcatcgtttcggcctgggggatgagcgagaacggcgcggtaacgacaacgttgcccgatgacagcgaggagcgtgcctcgacgacggacggcttgccgttgcccggcgtagaggtgaaggtggtggatgcgcaggatgcttccgtgctggcgggcgaggttggacgcctgctcgtgcgtgcgtgctcgaacttcggcggttacctgaagcggccacaactgaacgcgacggatgccgagggatggttcgataccggcgatctggcgaagctcgacgcagagggctacgtgcgcatcgccgggcgcagcaaggacgtgatcatccgcggtggcgagaacatcccggtggtcgagatcgagacgctgctgtaccggcatcctgccgtagcgcaggtcgccatcgtcgcgtatcccgatgagcggctgggcgagcgtgcgtgtgccgtggtcgtgcccaggcaagggcagggcttcgacaagccggcgatggtggatttcctgaaggcgcagaaggtggcgctgcagtacatccccgaacggctgatcgtgcaggacgccttgccggcgacgccggccggcaagatccagaagttcaggctgcgggaaatgcttcgggaacaggctgccgagaggtaa

SEQ ID NO: 29604 - protein, 549 aa, Ralstonia eutropha JMP134
MDFDAVLIAPRRAASVAAGLWRDRTINDYFDATVARAPDGPALTSLQVESGAVRHFTWRQLDAMVTRIAVGLRRLGIERNDVVSCQLPNGWEVTALYLACARIGAVLNPLMPIFRERELSFMLAHADSKVVVVPQRFRGFDHAGMLAGLRDSLPALRHVVITGSDGPDGFEAMLCGADRDSDPDAAAILRRDRPSPDDVTQLIYTSGTTGEPKGVMHTANTLLSNILPYAERLRLGAGDVVLMASPMAHQTGFMYGLMMPVVLGAHAVLQDIWNPVQAARLIRETGVTFTMGSTPFLTDLARTVEESGQPVPSLRTFLCAGAPIPGALVERARTALGASIVSAWGMSENGAVTTTLPDDSEERASTTDGLPLPGVEVKVVDAQDASVLAGEVGRLLVRACSNFGGYLKRPQLNATDAEGWFDTGDLAKLDAEGYVRIAGRSKDVIIRGGENIPVVEIETLLYRHPAVAQVAIVAYPDERLGERACAVVVPRQGQGFDKPAMVDFLKAQKVALQYIPERLIVQDALPATPAGKIQKFRLREMLREQAAER

SEQ ID NO: 29605 - DNA, 1578 bp, Ralstonia eutropha JMP134
  CDS (1)..(1578)
atgaacgtggaccatttggccacactgccgcgcgccgtgcagcatctggcgcgcgtgcagaagacgcagatcgcctatgtattcgaaggcagggaaaccacatacggcgcattcggcacgcatacggaccgcgtcgccaacggcctgctggctgcggggctggcaccgggcgaccgcattgcgtacctgggcaagaactgcgaccactacttcgagctgctgatcggcgctgccaaggcgggcgtcgtgataacgccgatcagctggcggctcgccgcgccggaggtggagtacatcgccgccgattgcgatgcggcgctgctgttcgttggcaacgaatcggtcgaactcgcacagtcgatcgcatcgcagctgcccgcgctgcgcggagtagtagccatggaagacgccgtggtcgactggcccgcataccaggactggcgcgacggacaggccaccacgccgccgacgcacgtcagccggcctgacgacgtcgtgctgcagctctacacgtcgggcaccaccggccgcccgaagggcgcgatgctcacgcaccgcaacctgaccgtcagcgcgatcatcgccgagcgcgagaacatcgcctggctgcgctgggtgcccgacgatgtctcgctcgtggccatgccggtcgcccacatcggcggcacaggctggggcctgcgcggactgctggcgggcgccaagggtatcgtggtccgcgacttcgatccgcgccgcgtgctcgacttcatcgccaacgaccgcatcagcaagctgttcctggtgccgtcggcaattcagatcgtgctgcgcgatccacgtgcgcggcaggtgaactattcgcgcttgcgctacctgatctacggttccgcgccgatgccggccgacttgctgcgcgaaggcatggaagtgttcggctgcggcttcgtgcagacctatggcatgaccgagaccaccggcagcgtgaccggattgatgccggaggaccatgcgagcggcaacaccgcgctgctgcgcgccgccggccgggcactgccgtgggccgaagtggcggtggtcgacgcggcgggcaaacacgtgccgcctggcgaagtcggcgaggtcatcgtgcgttccttgcagaccatggccggctactggaagcagcccgaagagaccgcacgcgcgatcgatgccgacggctggctgcgcactggcgatgctggctacatggacgcggacgactacctctatatccacgatcgcgtaaaggacatgatcatcagcggcggcgagaacgtctaccccgcggaagtcgagaacgcgatctatggccacccgcatgtagccgaagtcgccgtgatcggcgtgcccgacgcccgatggggcgaggcggtgaaggccatcgtcgtgccgcgcgacggcgccacgccagatgcgcgagacatcctgcagtgggcgcgcgaacggctggcgggattcaagttgcccaagagcatcgatttcgtcgatgcgctgccgcgcaatccgtcgggcaaggtgctgcggcgccaattgcgcgaaccgtactggcaaggctatacgcgccgggtcaactga

SEQ ID NO: 29606 - protein, 525 aa, Ralstonia eutropha JMP134
MNVDHLATLPRAVQHLARVQKTQIAYVFEGRETTYGAFGTHTDRVANGLLAAGLAPGDRIAYLGKNCDHYFELLIGAAKAGVVITPISWRLAAPEVEYIAADCDAALLFVGNESVELAQSIASQLPALRGVVAMEDAVVDWPAYQDWRDGQATTPPTHVSRPDDVVLQLYTSGTTGRPKGAMLTHRNLTVSAIIAERENIAWLRWVPDDVSLVAMPVAHIGGTGWGLRGLLAGAKGIVVRDFDPRRVLDFIANDRISKLFLVPSAIQIVLRDPRARQVNYSRLRYLIYGSAPMPADLLREGMEVFGCGFVQTYGMTETTGSVTGLMPEDHASGNTALLRAAGRALPWAEVAVVDAAGKHVPPGEVGEVIVRSLQTMAGYWKQPEETARAIDADGWLRTGDAGYMDADDYLYIHDRVKDMIISGGENVYPAEVENAIYGHPHVAEVAVIGVPDARWGEAVKAIVVPRDGATPDARDILQWARERLAGFKLPKSIDFVDALPRNPSGKVLRRQLREPYWQGYTRRVN

SEQ ID NO: 29607 - DNA, 1560 bp, Ralstonia eutropha JMP134
  CDS (1)..(1560)
atgcagtcagagcagcagcgcgccctgcgcaataccatccctgacgccgtcggccgcgccgtccggcgcgatcccgacaagactgccatccgcttcggcgcccgtagctggaccttccggcaactggacgaagccgcggcatgcgtggcgggtgcgctcgcgcagtggggcctgcggcccggcgaccgcgtcgcggccttcggcaaaaactccgatgcctacgtgctgctgtggctcgcgtgcttgcgatccggcctgatccacgtaccggtgaacttctcgatgacgcgaagcgaagccgagtacatcgtcacgcaatccggtgccagcgcgatctttgccgatcctgcactggccgaacgcgtgcaagggctaccctgccgggtgagcggcacgctgcatggtggcggtgatcacgacatcctgatggcagccgcgcaagggcccgcggcaccggtgctcgcggaactggccgacgacacgccggcgcagattctgtacacgtccggcaccacttccgcaccgaagggcgccgtgcttacgcatcgcgcgctgctggccgagtacgtgagcaccatcgcggcatgcgacgtgcgtgcatcggattattcgctcgcagcgctgccgctctaccactcggcgcagatgcacgtattcctgatgccgctgctgctgagcggtggcaccacgctcatcgccgacagccccgaggccggcttctgcctgcgcaccatccacgacgaagagatcacgagcttctttgcgccgcccacggtgtggatcgcgctgctgcggcatgccgatttcgatcccgcgcggctcggcacgctgaccaaggcgtactacggcgcctcgatcatgccggtgccggtgctgctcgaactgcaggcgaagctgccggcgctgcgcttctacaactgctacggccagagcgagatcggcccgctcgccacggtgctcggtcccgacgagcatgcggagcgcccggcctctgcgggacggcccgtgctcaatgtggaaacccgcatcgtcgacgagaagatgaacgacgtcgcgcccggcacgcttggtgaaatcgtgcaccgctcgcctcagttgctgaccgaatactgggacaagccggaacagaccgccgaggcattcgccggtggctggttccattccggcgacctcggctacatggatgtcgcgggctacctgtatgtggtggaccgcatcaaggacgtgatcaactcgggcggcgtgctggtgtcgagccgcgaagtcgaggagtgcctgtacacccatcccgctgtggccgaggtggcggtgttcgcgctgtcgcacccgaagtgggtggaagccgtgaccgcttgcgtggtgctcaagcgcgatactgcagccaccgaagaaacactggtcgcgcatgcacgcgatgcgctggcaccgttcaaggtgcccaagcgcgtggtgttcgtggccgacctgccgcgcaatacggcaggcaagctgctcaagcggaagctgcgtgaagactatgcggcgctgttcagcgacgagacaggcggaacgggacgatag

SEQ ID NO: 29608 - protein, 519 aa, Ralstonia eutropha JMP134
MQSEQQRALRNTIPDAVGRAVRRDPDKTAIRFGARSWTFRQLDEAAACVAGALAQWGLRPGDRVAAFGKNSDAYVLLWLACLRSGLIHVPVNFSMTRSEAEYIVTQSGASAIFADPALAERVQGLPCRVSGTLHGGGDHDILMAAAQGPAAPVLAELADDTPAQILYTSGTTSAPKGAVLTHRALLAEYVSTIAACDVRASDYSLAALPLYHSAQMHVFLMPLLLSGGTTLIADSPEAGFCLRTIHDEEITSFFAPPTVWIALLRHADFDPARLGTLTKAYYGASIMPVPVLLELQAKLPALRFYNCYGQSEIGPLATVLGPDEHAERPASAGRPVLNVETRIVDEKMNDVAPGTLGEIVHRSPQLLTEYWDKPEQTAEAFAGGWFHSGDLGYMDVAGYLYVVDRIKDVINSGGVLVSSREVEECLYTHPAVAEVAVFALSHPKWVEAVTACVVLKRDTAATEETLVAHARDALAPFKVPKRVVFVADLPRNTAGKLLKRKLREDYAALFSDETGGTGR

SEQ ID NO: 29609 - DNA, 1620 bp, Ralstonia eutropha JMP134
  CDS (1)..(1620)
atgctggccgacacggtcgcccgcttcggccagcgcccggcggtcgtgttccgcgagcagggcatccgctggacctggcaggaattcgcggcggccgtcgatgcactggcagccagcttccacgcgctgggcctgcgccgtggcgatcgcgtcggcatctggtcgccgaaccgcgtggaatggctgctgacccagttcgccaccgcgcgcgtcggcctcgtcatggtcaatatcaacccggcctaccgcctgtcggagcttgaatatgcgctgaacaaggttggctgcaaggcggtcatcgcgccggagtcgttcaagacgtcgcgttatctggagatgctccagacgctggccccggagctgcagcagagcgaaccgggcgcgctgcaggcggcgcgcctgccggaactacgctgggtcatccgcatggagaacaagccgacacccggcatgctgacctggcaggaactgcacgcgcgcggcgccggcctccccgtatccgagctcgacgcgattacggcgcaactcgaccgccatgacccgatcaacgtccagttcaccagcggcaccacgggcgcgcccaagggtgccacgctgacgcaccggaacatcctcaacaatgcgcgccacatcgccgccgcgatgcgcttcaccgagcaggacaagctctgcattccggtgccgctgtaccactgcttcggcatggtgctggccgtgctggcgtgcgtgtccaccggcgcatgcatggtcttcccgggcgaggcgtttgaacccgtcgcgaccatgtcggccgtcagcgaggaacgctgcaccgccctgcacggcgtgccgaccatgttcatcgcgcagctcgaccatccggaattcagccgcttcgatttctcgacgctgcgcaccggcatcatggccggttcgccctgcccgatcgaggtcatgaaacgcgtcgtcgccgacatgcacatggccgaggtcaccattgcctacggcatgaccgagacgagccctgtgtcgttccagagttccaccaatgatccgctcgacaagcgcgtctccacggtcggccgtgtgcagccgcacctggaatgcaaggtggtcgatgccacgggccagatcgtgccagtcggcgaaaccggcgaactgtgcacgcgcggttactccgtcatgctcggctactgggacgacgaagcacgcaccagcgaagcgatccgcgacggctggatgcacaccggcgacctggccacgatcgacgccgagggctattgcaatatcgtcggccgcgtcaaggacatgctgatccgcggcggcgagaacgtctacccgcgcgagatcgaggaatttctgttccgccaccccaaagtccaggccgtgcaggtgttcggcgtgccggaccagaagtacggtgaggaaatctgtgcatgggtcgtgctcaagcctggccagaccgcgacggaagacgagatccgtgcgttctgccgcgaccagatcgcccactacaagatcccgcgctatatccgcttcgtcgacgaaatgccgatgaccatcacgggcaaggtgcagaagttcgtcatgcgcgaacgcatgacgaaggaactgaacctcaccgaaagcaagaccgcctga

SEQ ID NO: 29610 - protein, 539 aa, Ralstonia eutropha JMP134
MLADTVARFGQRPAVVFREQGIRWTWQEFAAAVDALAASFHALGLRRGDRVGIWSPNRVEWLLTQFATARVGLVMVNINPAYRLSELEYALNKVGCKAVIAPESFKTSRYLEMLQTLAPELQQSEPGALQAARLPELRWVIRMENKPTPGMLTWQELHARGAGLPVSELDAITAQLDRHDPINVQFTSGTTGAPKGATLTHRNILNNARHIAAAMRFTEQDKLCIPVPLYHCFGMVLAVLACVSTGACMVFPGEAFEPVATMSAVSEERCTALHGVPTMFIAQLDHPEFSRFDFSTLRTGIMAGSPCPIEVMKRVVADMHMAEVTIAYGMTETSPVSFQSSTNDPLDKRVSTVGRVQPHLECKVVDATGQIVPVGETGELCTRGYSVMLGYWDDEARTSEAIRDGWMHTGDLATIDAEGYCNIVGRVKDMLIRGGENVYPREIEEFLFRHPKVQAVQVFGVPDQKYGEEICAWVVLKPGQTATEDEIRAFCRDQIAHYKIPRYIRFVDEMPMTITGKVQKFVMRERMTKELNLTESKTA

SEQ ID NO: 29611 - DNA, 1563 bp, Rubrobacter xylanophilus DSM 9941
  CDS (1)..(1563)
atggagggctacccgaacgccaactggcgcaagctcatactcggcgagatgctcgccagggtctcccgcaagcagccggaaaagctcgcgctcgtcttcgaggggacgcgcctcaccttcgccgacctcgacgggcgggtgaatcgcctcgccaacgccctcgctagcaggggcgtggccaagggggacaaagtcgccgtgctctcgtacaactcccaccgggtggtcgaagcctacttcgcctgccacaagctcggcgccgtggccgtcccggtcaacttccgcatggtcgaaggagaggtccgctacgtcctctccgactccggcgcgcgcaccctgctcttcggcgagggcttcggcggcatggcggagagcatcgtgggcgacggcgccgtcgccctggcggtggacatggacggcgacgccggagggttcgccgagggctacgagcggctcgtctccaccgccggtcccggcgagccggcggtggaggtggacgacgacgatgacgccttcatcatgtacacctccgggaccacgggcttcccgaagggggccgtcctcacgcacaaaaacctgtggatgaacacggccaactggatcatggagatgcaggtgaccgggggctcggtgtggctctcggggctgccgctcttccacatcggcggcgtaaacggcgtgctgccctttatctacctcggcggcaccaacgtcatcaccccgagcggtggcttcgacccggaggcgatgctgcgtctcatggagaaggagagggtcacccactgctacttcgtccccgcgcagtggcagcagttcctcgagctcgacctctcccgctacgacctcggcagcctgcgcaaggcgctctggggtgcctcgctcgcgccgatgcgggtgctggaggggatggcggaggccttcccttcggtcgagatcgtcaacgccttcggccagaccgagatgtcctccaacaccaccttcctgaagggcgaggacgcggtgaggaagatgggctccgtcgggcttcccgccgtcaacgtcgaggtccggatcgtggacgacgagaacagggacgtgcccgagggggaggtcggggagatcgtctaccgcggccccaccgtgttcaagggctaccacaacgaccccgaggccacggcggaggccttcgagggcgggtggttccactccggggacctggtgcgccgggacggggagggctacatctacgtggtggaccgcaaaaaagacatgttcataagcggcggcgagaacatctaccccgccgaggtggagcgtgtgatctccacgcaccccgcggtcgcggaggtcgccgtgataggcgtgccgcacgagaagtggggcgagacgcccaaggccctcgtcgtccccagggagggccagaggctcaccagagaagaggtcatagagcactgccgcaagcacctcgccggctacaagaagcccacctacgttgccttcgtggaggagcttccgcgcaacgccgcgggcaaggtgctcaagcgggagctgaggcggctgcacggcggaagcgacgacgcgtag

SEQ ID NO: 29612 - protein, 520 aa, Rubrobacter xylanophilus DSM 9941
MEGYPNANWRKLILGEMLARVSRKQPEKLALVFEGTRLTFADLDGRVNRLANALASRGVAKGDKVAVLSYNSHRVVEAYFACHKLGAVAVPVNFRMVEGEVRYVLSDSGARTLLFGEGFGGMAESIVGDGAVALAVDMDGDAGGFAEGYERLVSTAGPGEPAVEVDDDDDAFIMYTSGTTGFPKGAVLTHKNLWMNTANWIMEMQVTGGSVWLSGLPLFHIGGVNGVLPFIYLGGTNVITPSGGFDPEAMLRLMEKERVTHCYFVPAQWQQFLELDLSRYDLGSLRKALWGASLAPMRVLEGMAEAFPSVEIVNAFGQTEMSSNTTFLKGEDAVRKMGSVGLPAVNVEVRIVDDENRDVPEGEVGEIVYRGPTVFKGYHNDPEATAEAFEGGWFHSGDLVRRDGEGYIYVVDRKKDMFISGGENIYPAEVERVISTHPAVAEVAVIGVPHEKWGETPKALVVPREGQRLTREEVIEHCRKHLAGYKKPTYVAFVEELPRNAAGKVLKRELRRLHGGSDDA

SEQ ID NO: 29613 - DNA, 1680 bp, Burkholderia cepacia R18194
  CDS (1)..(1680)
ttgtcgtacgtacgcggcacgaccgacgtaccgctgtccgaagcgacgatcggccggttcctgctggatacggccggccgctttcccgatcgtccggccgtcgtgttccgcgagcagcaggtgcgctggacctggcgcgaattcgcgaacgaggtcgatgtgctggcgtccggcctggcctcgctcggcatcgtgaagggcgatcgcgtcggcatctggtcgccgaaccgcagcgaatggctgctcacgcagttcgcgaccgcgcggatcggcgcggtgctcgtcaacatcaatccggcctaccggctgtcggagctcgaatacgcgctgaacaaggtcggctgcaaggccgtgatcgccgccgagcgcttcaagacgtccgcgtatgtcgagatgctgcagaccatcgcgccggagctcgcaaccgcgacgccgggcgacctgcatgcggtgcgcgtgccgagcctgcgcacggtcgtctcgatgggcgacgtcgcgccggccggcatgttccgcttcgcggacgtgatggcgcgcggccgccaggccgtcgaccccgcgttgctcgatgcgatcggcgcgacgctcgcggccaccgagccgatcaacatccagttcacgagcggcacgaccggcagcccgaagggcgcaacgctcacgcatcgcaacgtcgtcaacaacgggcgctcgatcgcgacggcgatgcggttcaccgagcaggacacgctgtgcatcccggtgccgctgtatcactgtttcgggatggtgctcgcggtgctcgcgtgcgtgtcgaagggcgcggcgatggtgttcccgggcgaagcgttcgacccggtcgcgacgctcgcggcggtggccgacgagcgctgcaccgcgctgcatggcgtgccgacgatgttcatcgccgagctcgatcaccccgagttcgcgaaattcgacctgtcgacgctacgcaccgggatcatggccggctcgccgtgcccgatcgagacgatgaagcgcgtcgtgtcgcagatgcacctgtcggagatcacgatcgcgtacgggatgacggagacgagccccgtgtcgttccagagctccaccgacgatccgctcgagaagcgcacgacgacggtcgggcgcattcagccgcatctggaagtgaaggtcgtcgatccgagcggcggcatcgtgccggtcggcgcgacgggcgagctgtgcacgaagggctattcggtgatgctcggctactgggacgacgacacgaagacgcgcgaggtgctggtggacggctggatgcatacgggcgacctcgcgacgctcgatgcggacggctactgcaatatcgtcggccggctgaaggacatggtgattcgcggcggcgagaacgtctatccgcgcgagatcgaggaattcctgtttcggcatccgaagatccagagcgcgcaggtattcggcgtgcccgatacgaagtacggcgaagagctgtgcgcatggatcgtgctgcgcgccgacgagcagatgaccgaggacgacgtgcgtgcgttctgcaacgggcagatcgcgcactacaagattccgcgctacatccgcttcgtcgacgagctgccgatgacggtgacgggcaaggtgcagaagttcgtgatgcgtgaccggatgatcgaggagctgaaactggacgtgcagaagaccgcgtag

SEQ ID NO: 29614 - protein, 559 aa, Burkholderia cepacia R18194
MSYVRGTTDVPLSEATIGRFLLDTAGRFPDRPAVVFREQQVRWTWREFANEVDVLASGLASLGIVKGDRVGIWSPNRSEWLLTQFATARIGAVLVNINPAYRLSELEYALNKVGCKAVIAAERFKTSAYVEMLQTIAPELATATPGDLHAVRVPSLRTVVSMGDVAPAGMFRFADVMARGRQAVDPALLDAIGATLAATEPINIQFTSGTTGSPKGATLTHRNVVNNGRSIATAMRFTEQDTLCIPVPLYHCFGMVLAVLACVSKGAAMVFPGEAFDPVATLAAVADERCTALHGVPTMFIAELDHPEFAKFDLSTLRTGIMAGSPCPIETMKRVVSQMHLSEITIAYGMTETSPVSFQSSTDDPLEKRTTTVGRIQPHLEVKVVDPSGGIVPVGATGELCTKGYSVMLGYWDDDTKTREVLVDGWMHTGDLATLDADGYCNIVGRLKDMVIRGGENVYPREIEEFLFRHPKIQSAQVFGVPDTKYGEELCAWIVLRADEQMTEDDVRAFCNGQIAHYKIPRYIRFVDELPMTVTGKVQKFVMRDRMIEELKLDVQKTA

SEQ ID NO: 29615 - DNA, 1587 bp, Burkholderia cepacia R18194
  CDS (1)..(1587)
atgacgatggacaacgaaatcctgaccacgcccgcgctgatcgcgcgggcagccgcgcgccacggcgcgcatccggcgatcgagtcggagcatggccggctgacctacgcggaactcgacgcggcccgcctcgatgcggcccgcgcgctgctcgcgagtggcatcgcggccggcgaccgcatcgcggtgtgggcgccgaacctgccgcaatggatcgtcgcggcgctggcgatccacaccgtcggcgcgatcctcgtgccggtcaatacgcggatgaaggggatggaggtgggcggcatcctgcacgacggcggcgcgcggctgctgttctgctgcggcaccttcctcggcgaatcctatccggcgatgctcgcgccgcaccggcccgcgacgctcgagcgcgtcgtcgtgttcgacggtgagccgccttcaggcgcgtacgacgaaacctggagcgcgttcctcgcgcgcggcgccgaggtaccgctggtcgcggtgcgcgaacgcgaggcacaggtgacgcccgacaccgtgatggacctgatgttcacgtccggcacgacgggccgcccgaagggcgtgatgaccgcgcacggccagaacctgcgcgctgcgcaggcatgggcggcaatcgcaggcgtgcggcccgacgaccgctacctgatcgtcaatccgtttttccacacgttcggctacaaggccggctggctcgccgcgctgtcgagcggcgcgaccgtgctgccgcatctcgtgttccagccggccgacgtgctgcgccgcgtcgccgacgatcgcgtctcggtgctgcccggcccgccgacgctgtactacgcgctgctcgacgcgcccgatcgcgcgacgcgcgacctgtcgtcgctgcggatcgcggtgacgggcgcggcggcgatcgcgccgagcctgatcgagcggatgcgcgcggagctcggcttcgagacggtgctgaccggctacgggctgaccgaatcgtgcggcttcgcgacgctgtgccggcaaggcgacgatgcggagacggtcgcctatacgtcgggccggccgatgccggatgtcgagctgcgcatcgcggggccgggcggtgaaccactcgggccggacgagaccggcgagatctgggtgcgcggctacaacgtgatgcgcggctacttcaaccagccggacgcgacgcgcgagaccgtcgacgccgatggctggctgcatacgggcgatctcggctgcgtcgatgcgaacggcaacctgaagatcaccgatcgcatcaaggacatgttcatcgtcggcggcttcaactgctatccggccgagatcgaacggctgcttgcagcgcatcctgcgattgcgcaggtggcgctggtcggcgtgcccgatacgcggctcggggaggtcgggcacgcgtatgtcgtgctgcggccgggcgcgcaagcggacgccgacgaactgaacgactgggcgcgccgcaacatggcgaactacaaggtgccgcggcatttcacgttcgtcgaacaactgccgacgagcgcggccggcaaggtgctgaagtaccgcctgcgggcggggaccgaggcggcggcctga

SEQ ID NO: 29616 - protein, 528 aa, Burkholderia cepacia R18194
MTMDNEILTTPALIARAAARHGAHPAIESEHGRLTYAELDAARLDAARALLASGIAAGDRIAVWAPNLPQWIVAALAIHTVGAILVPVNTRMKGMEVGGILHDGGARLLFCCGTFLGESYPAMLAPHRPATLERVVVFDGEPPSGAYDETWSAFLARGAEVPLVAVREREAQVTPDTVMDLMFTSGTTGRPKGVMTAHGQNLRAAQAWAAIAGVRPDDRYLIVNPFFHTFGYKAGWLAALSSGATVLPHLVFQPADVLRRVADDRVSVLPGPPTLYYALLDAPDRATRDLSSLRIAVTGAAAIAPSLIERMRAELGFETVLTGYGLTESCGFATLCRQGDDAETVAYTSGRPMPDVELRIAGPGGEPLGPDETGEIWVRGYNVMRGYFNQPDATRETVDADGWLHTGDLGCVDANGNLKITDRIKDMFIVGGFNCYPAEIERLLAAHPAIAQVALVGVPDTRLGEVGHAYVVLRPGAQADADELNDWARRNMANYKVPRHFTFVEQLPTSAAGKVLKYRLRAGTEAAA

SEQ ID NO: 29617 - DNA, 1710 bp, Burkholderia cepacia R1808
  CDS (1)..(1710)
atgcgggcgctgatcgcgcccgaaaacggactctcgtacgtgcgcggcgcaaccgacgtgccgctatccgaagcgacgatcggccgcttcctgctcgacacggccggccgctttccggaccgcccggcggtcgtgttccgcgagcagcaggtgcgctggagctggcgcgaattcgcgcacgaggtcgacgtgctggcggccggcctcgtcgagctcgggatcgtgaagggcgatcgcgtcggcatctggtcgccgaaccgcagcgaatggctgctgacgcagttcgcgaccgcgcgcatcggcgcggtgctcgtcaacatcaacccggcctaccggctcgcggaactcgaatacgcgctcaacaaggtgggctgcaaggccgtgatcgcggccgagcgcttcaagagctccgcctatgtcgagatgctgcagacgatcgcacccgaactcgcgagcgcgacgcccggcgatctgcacgcggcgcgcgtgccgagcctgcgcacggtcgtgtcgatgggagacgtcgcgcctgccggcatgttccgcttcgcggacgtgatggcgcgcggccgcgacacgctcgatgccgcgcggctcgatgcgatcggcgcgacgctcgcggccggcgaggcgatcaacatccagttcacgagcggcaccacgggaagccccaagggtgcgacgctcacgcaccgcaacgtcgtcaacaacgcgcgctcgatcgcgatggcgatgcgcttcaccgaacaggacgcgctctgcattcccgtgccgctgtatcactgcttcgggatggtgctggcggtgctcgcgtgcgtgtcgacgggcgcggcgatggtgttccccggcgaggcgttcgatccggtcgcgacgctcgcggccgtggccgacgagcgatgcaccgcgctgcacggcgtgccgacgatgttcatcgccgaactcgatcatcccgagttcaagacgttcgacctgtcgacgctgcgcaccgggatcatggccggttcgccttgcccgatcgagacgatgaagcgcgtcgtgtcgcagatgcatctgtcggagatcacgatcgcgtacgggatgaccgaaacgagccccgtgtcgttccagagctcgaccgacgatccgctcgagaagcgcacgacgacggtcgggcggattcagccgcatctcgaggtgaagatcgtcgacccgggcggcgacatcgtgccggtcggcgcgaccggcgagctgtgcacgaagggctattcggtgatgctcggctactgggacgacgacgcgaagacgcgcgaggtgctgatcgacggctggatgcacacgggcgatctcgcgacgctcgacgggcagggctactgcaacatcgtcggccggctgaaggacatggtgattcgcggcggcgagaacgtgtatccgcgcgagatcgaagaattcctgttcaggcatccgaagattcagagcgcgcaggtgttcggcctgcccgatgcgaaatacggcgaggagctgtgcgcgtggatcgtgctgcgcgccggcgagcagatgaccgacgacgacgtgcgcgcgttctgccaaggccagatcgcgcactacaagattccgcgctacatccgcttcgtcgacgaactgccgatgacggtgaccggcaaggtgcagaaattcgtgatgcgcgaacggatgatcgaagagttgaagctcgacgtgcagaagaccgcgtga

SEQ ID NO: 29618 - protein, 569 aa, Burkholderia cepacia R1808
MRALIAPENGLSYVRGATDVPLSEATIGRFLLDTAGRFPDRPAVVFREQQVRWSWREFAHEVDVLAAGLVELGIVKGDRVGIWSPNRSEWLLTQFATARIGAVLVNINPAYRLAELEYALNKVGCKAVIAAERFKSSAYVEMLQTIAPELASATPGDLHAARVPSLRTVVSMGDVAPAGMFRFADVMARGRDTLDAARLDAIGATLAAGEAINIQFTSGTTGSPKGATLTHRNVVNNARSIAMAMRFTEQDALCIPVPLYHCFGMVLAVLACVSTGAAMVFPGEAFDPVATLAAVADERCTALHGVPTMFIAELDHPEFKTFDLSTLRTGIMAGSPCPIETMKRVVSQMHLSEITIAYGMTETSPVSFQSSTDDPLEKRTTTVGRIQPHLEVKIVDPGGDIVPVGATGELCTKGYSVMLGYWDDDAKTREVLIDGWMHTGDLATLDGQGYCNIVGRLKDMVIRGGENVYPREIEEFLFRHPKIQSAQVFGLPDAKYGEELCAWIVLRAGEQMTDDDVRAFCQGQIAHYKIPRYIRFVDELPMTVTGKVQKFVMRERMIEELKLDVQKTA

SEQ ID NO: 29619 - DNA, 1536 bp, Rubrivivax gelatinosus PM1
  CDS (1)..(1536)
atgaagaacgacaacctgttcgtcgcgttgcgcgccggcttcccggccgatctggacggcgtggcgatcgaggccgacggggggctggtctaccgctggcgcgacatcgagcgcgccaccgcgatgatcgccaacctactggtgtcgctggaactgccgaccggcgcccgcatcgccgtgcacaccgacaaatcggtcgaggcgctgctgctttatctggccacgctgcgcgccggcttcgtctacctgccgctcaacaatggctaccagcaggccgagctcgactacttcatcgagaacgccgagccggacgtggtggtgtgcgctacccgcaacttcccctggatcagcaagctggcgttccggcggggtgtgggtcatgtgttcacgctgaacgacgaccgcagcggcacgctgctggagcgtgccgcgcagcaggacgaccggcacgagccggcgcgggtgggcaccgacgaagtggccgccatcctgtacacctccgggacgaccgggcgcagcaagggcgcgatgctcagccacggcaacctgctgagcaacgcgcgcacgctgcagcgctactgggactggcggcccgacgacgtgctggtccacgcgctgccgatcttccacgtgcacggcctgttcgtcgcctgccacggcgccctgctgaacggcagccggatgctgtggctgaaccgcttcgatcccgccgcggtgatcgagcgcttgccgcgtgccaccgtgttcatgggtgtgccgacgctctatgtgcggctgctgcaggaccccgcgctgacacgcgccgcctgcgcccggatgcggttgtgcatctccggctcggcgccgctgttgatcgagaccttccgggactggcaatcgcgcaccggcctgacgatcctcgaacgctacggcatgagcgagacggcgatgctcacctccaatccctgccgtccggaagacggcgaccgcatcggcggcaccgtcggccggccgctgccgggcgtggcgttgcgcgtggtcgacgatgccggcaaggactgtccggcgggcgaggtgggcggggtcgaggtgcgggggccgaatgtgttcaagggctactggcgcatgcccgacaagacagccgaggagttcaccgcggacggctggttcaggaccggcgacgttgggcggctcgacgagcggggctacttgacgatcgtcggccgcagcaaggacctgatcatcagcggtggctacaacgtctatccggccgaggtggagggttacctcaacgaactgccgggcgtcgcggagtcggcggtgatcggcgtgccgcatccggatttcggggaggcggtagtggccgtcgtggtggcgcggtcggacgccggggtggacggggcgcaattggtgacgcaactcaagtcgcgcattgccgcgttcaagctgcccaagcgggtgttcgtcatggccgaactgccgcgcaacgcgatgggcaaggtgcagaagaacctgctgcgccagcagcatgccggggtgttcgtgagcgccgcctga

SEQ ID NO: 29620 - protein, 511 aa, Rubrivivax gelatinosus PM1
MKNDNLFVALRAGFPADLDGVAIEADGGLVYRWRDIERATAMIANLLVSLELPTGARIAVHTDKSVEALLLYLATLRAGFVYLPLNNGYQQAELDYFIENAEPDVVVCATRNFPWISKLAFRRGVGHVFTLNDDRSGTLLERAAQQDDRHEPARVGTDEVAAILYTSGTTGRSKGAMLSHGNLLSNARTLQRYWDWRPDDVLVHALPIFHVHGLFVACHGALLNGSRMLWLNRFDPAAVIERLPRATVFMGVPTLYVRLLQDPALTRAACARMRLCISGSAPLLIETFRDWQSRTGLTILERYGMSETAMLTSNPCRPEDGDRIGGTVGRPLPGVALRVVDDAGKDCPAGEVGGVEVRGPNVFKGYWRMPDKTAEEFTADGWFRTGDVGRLDERGYLTIVGRSKDLIISGGYNVYPAEVEGYLNELPGVAESAVIGVPHPDFGEAVVAVVVARSDAGVDGAQLVTQLKSRIAAFKLPKRVFVMAELPRNAMGKVQKNLLRQQHAGVFVSAA

SEQ ID NO: 29621 - DNA, 1698 bp, Pseudomonas fluorescens PfO-1
  CDS (1)..(1698)
atggatcaacccagtgcaaacccacagcgcagctacacccgtggttcccaggacaaagccttgctggcgatgaccatcgggcagaagttcgacgagaccgtcgcgcagtacccggacggcgaggcgctggtggtgcgccaccagcagctgcgttacacctggcggcaactggccgacgcggtggacgtgcatgccagagcgctgctggcgttgggtttgcaggccggtgatcggctcggcatctgggcgccgaattgcgcgcagtggtgcatcactcagtttgccaccgcgaagctcggcgtgattctggtcaacatcaacccggcctaccgcagctctgaactcgaatacgtgctcaaacaatccggttgccaatggttggtctgcgccggcgccttcaaatcttcgaactatcacggcatgctgcaaggcttgctgccggaactggccgagcaatccatcggcgaactgcgcagcgagcgcctgccggagctgcgcgggttgatcagccttgatccccagccgccttcgggttttctcccgtggtcgcaactggcagatctggccgccagtgtctctccagaacaattgcgtgaacgcagcgacagcctgcacttcgatcagcccgtcaacattcagtacacctccggcaccaccggcttccccaagggcgcgaccctcagtcactacaacatcctcaacaacggttacatggtcggcgaaagcctcggcctgaccgccgctgatcggctggtgatcccggtgccgttgtatcactgcttcggtatggtcatgggcaacctcggctgtatcacccacggcagcacgatgatttatcccaacgatgccttcgatccgctgctgaccctgagcacggtcgccgaagaaaaggccaccgcgctgtacggcgtgccgaccatgttcatcgccatgctcgatcagccgcagcgcgccgagttcgacctgtcgaccctgcgcaccgggatcatggccggcgccacctgcccgatcgaagtgatgcgacgggtcatcaacgaaatgcacatgagcgaagtgcagatcgcctacggcatgaccgaaaccagcccggtgtcgctgcagaccggcccatccgacgaactggaactgcgcgtcaccaccgtcggccgcacccagccgcaactcgaaagcaaaatcatcgacgaggccggcaatccggtaccacgcggcaccatcggcgagctgtgcacccgtggttacagcgtgatgcttggctactggaacaacccgaatgccaccgccgaagccatcgacgcggcgggctggatgcacaccggcgacctagcgagcatgaacgacgagggttacgtgtgcatcgccgggcgtaacaaggacatgatcatccgtggcggcgaaaacatttacccgcgtgaactggaggagttcttcttcacccacccagcggtggcggacgtgcaggtgatcggcattccctgctcacgttacggcgaagaaatcgtcgcctggatcaaattccatcccggccacagcgccaccgagcaagaactgcaagcgtggtgcaaggagcgtatcgcccacttcaagacgccgaggtacttcaagtttgtggaggagtttccgatgacggtgaccggcaagatccagaagttccggatgcgcgagatcagtattgaggagttgcgcagtaacgagggttga

SEQ ID NO: 29622 - protein, 565 aa, Pseudomonas fluorescens PfO-1
MDQPSANPQRSYTRGSQDKALLAMTIGQKFDETVAQYPDGEALVVRHQQLRYTWRQLADAVDVHARALLALGLQAGDRLGIWAPNCAQWCITQFATAKLGVILVNINPAYRSSELEYVLKQSGCQWLVCAGAFKSSNYHGMLQGLLPELAEQSIGELRSERLPELRGLISLDPQPPSGFLPWSQLADLAASVSPEQLRERSDSLHFDQPVNIQYTSGTTGFPKGATLSHYNILNNGYMVGESLGLTAADRLVIPVPLYHCFGMVMGNLGCITHGSTMIYPNDAFDPLLTLSTVAEEKATALYGVPTMFIAMLDQPQRAEFDLSTLRTGIMAGATCPIEVMRRVINEMHMSEVQIAYGMTETSPVSLQTGPSDELELRVTTVGRTQPQLESKIIDEAGNPVPRGTIGELCTRGYSVMLGYWNNPNATAEAIDAAGWMHTGDLASMNDEGYVCIAGRNKDMIIRGGENIYPRELEEFFFTHPAVADVQVIGIPCSRYGEEIVAWIKFHPGHSATEQELQAWCKERIAHFKTPRYFKFVEEFPMTVTGKIQKFRMREISIEELRSNEG

SEQ ID NO: 29623 - DNA, 1689 bp, Pseudomonas fluorescens PfO-1
  CDS (1)..(1689)
atgcaacctgatttctggaatgacaaacgcccggcgggcgtacccctggacatcgatgcgggtgagttcaagtcggtgatcgaggtgttcgagcgttcctgcaagaaattcgctgatcgcccggcgttcagcaacatgggcgtgaccctgacctacgccgagctggagcgccagagcgccgccttcgccggttatctgcaagcccacaccgacctggtgccgggggatcgcatcgcggtgcagatgcccaacgtcctgcattatccgattgccgtgttcggtgctctgcgcgccgggctgatcgtggtcaacaccaacccgctgtacaccgcgcgggagatgcgtcaccagttcaaggactccggtgcccgggcgctggtgtacctgaacatgttcggtcagaaggtccaggaagtgctggcggacaccgacattcagtacctgattgaagcgaagatgggcgacctgatgcccaccgccaagggctggctggtcaacactgtggtcagcaaagtgaagaaaatggtcccggcgtactcgctgccccaggcgatttccttcaagagcgcgttgcgcatgggccggggcctgggcatcaagccgctgaaggtcggcctggatgacatcgccgtgctgcaatacaccggcggcaccaccggcctggccaagggcgcaatgctgacccacggcaatctggtggcgaacatgcaacaggtgcgcgcctgtctcggccagttcggcagcgacggccagccgctgctgcgcgaagggcaggaggtaatgatcgcgccgctgccgctgtaccacatctatgccttcaccgcgaattgcatgtgcatgatggtgtcgggcaaccacaacgtattgatcaccaacccgcgtgacatcggcggcttcatcaaggagctgaagaactggaagttttcggcgctgctggggctcaacacgctgtttgtcgcgttgatggatcatccggacttcaagaccttggatttctccaccctcaagctcaccaactccggcggcaccgcgctggtcaaggccaccgccgagcgttgggagcagatcaccggttgccggatcaccgaaggctatgggctgactgaaacctcgccggtggcctgcaccaatccgtacggcgagctgtcgcggatcggaacggtcggcctgccggtgccgggcaccttgttgaaagtcatcaacgacgacggcgtcgagcagccgctgggcgagcgtggcgaactgtgcatcaagggcccgcagatcatgaagggctactggaacaagcccgaggccaccgccgaagtgctggatgccgagggctggttcaagtccggcgacattgcagtcattgacccggacgggttcgtgcgcatcgtcgaccgcaagaaagacatgatcattgtctccggtttcaacgtgtacccgaacgagatcgaagacgtggtgatggcccacccgaaagtcgccaactgcgcggtgatcggggtgccggacgagcgctcaggcgaggcagtgaagctgtttgtggtggcgcgggaaaccggcgtgagcctggaagaactgaaggcttactgcaaagagaatttcacggcgtacaaggtgccgaaacatatcgtgctgcgcgagtcgttgccgatgacgcctgtcgggaaaattctgcggcgggagttgcgcgatatcgcataa

SEQ ID NO: 29624 - protein, 562 aa, Pseudomonas fluorescens PfO-1
MQPDFWNDKRPAGVPLDIDAGEFKSVIEVFERSCKKFADRPAFSNMGVTLTYAELERQSAAFAGYLQAHTDLVPGDRIAVQMPNVLHYPIAVFGALRAGLIVVNTNPLYTAREMRHQFKDSGARALVYLNMFGQKVQEVLADTDIQYLIEAKMGDLMPTAKGWLVNTVVSKVKKMVPAYSLPQAISFKSALRMGRGLGIKPLKVGLDDIAVLQYTGGTTGLAKGAMLTHGNLVANMQQVRACLGQFGSDGQPLLREGQEVMIAPLPLYHIYAFTANCMCMMVSGNHNVLITNPRDIGGFIKELKNWKFSALLGLNTLFVALMDHPDFKTLDFSTLKLTNSGGTALVKATAERWEQITGCRITEGYGLTETSPVACTNPYGELSRIGTVGLPVPGTLLKVINDDGVEQPLGERGELCIKGPQIMKGYWNKPEATAEVLDAEGWFKSGDIAVIDPDGFVRIVDRKKDMIIVSGFNVYPNEIEDVVMAHPKVANCAVIGVPDERSGEAVKLFVVARETGVSLEELKAYCKENFTAYKVPKHIVLRESLPMTPVGKILRRELRDIA

SEQ ID NO: 29625 - DNA, 1668 bp, Ralstonia metallidurans CH34
  CDS (1)..(1668)
atgacgccctatgaccgcaagccctggctgtcgagctacgagccgggcaagccccacgcgatcacgcccgagttcaccgacgcgctgagcctgttccgtgccgcggtagcgcgcgcgccgtcgctgccagccattctctacttcgacggcagcctgagctacgccgaactcgacacgcaatccgacgcgctcgcctgcgcgtggcaagaccgcggcatcacgcgcggagaacgcgtggccatttacctgcagaacatcccgcagttcgtcatcgctctggtggcgacgtggaagctgggcgccattgccgtgcccgtcaacccgatgaaccgcgcgcgcgaactgcgcgtgatcctggcggattcgggcgctcgcctgctggtttgctccgagactctgtacgtcgatatcgtccgccccctgcttgccgaagaagccaatgcggaaaacggcgtgctgcctctggtgatgacgacatccgaactggagtaccaacggcgccacgacccacggctgttcgccaatacgagccgacaggagacaccgggcgcggaatccctgtcggcagtgatcgcagccaacgccggccgccatcctccgccagcggcgctggggccgaacgacatcgccatgctggtgtacacctccggcaccaccggcgtgcccaagggcgcgatgaacacccacggcaacgtagccttcaacgcccaggtctaccgcgactggatcacgctgggcgaaggcgagcccatcctcggcgtcgcgcccctgtttcatatcaccgggctgatcggccatatcggcgccgccttcatgtgcgccgccccgctggtgctggcctgtcgcttcgaaccgggcgtgatgctcgacacgctgcgcgaacatcgccccgccttcaccatcggcgccatcaccgtgttcatcgcgctgatgaaccacccgaacgccacgcgcgattgcttcgcgtcgctgaccaagatctactccggcggcgcgccgattccgcccagcgtggtggaggcctttcgcgagcgcttcggtcactacatccacaacggctacggcctgaccgagaccaactcgccaacgcacgtggtgccgcgcggggtcgaggcgcctgtggacccggcctccggcacccttgccgtgggcgtgccggcctacaacgtcgagtcctatattggcgacgacgaaggcaagccgatggcggttggcgaagtcggcgagatcatttcgcgtgggccgatgatcgtgccgggatactggaacaagccgcaggagagcgccaaggccatcgtcgatggttacttccgcacgggggatgtcgggttcatggacgaacgcggctggttctacctcgtggaccgcaagaaggacatgatcaacgccagcggctacaaggtctggccacgcgaggtggaggacgtgctgtacacccatcccgccgtgcgggaggccgccgtggttggcgtacctgatgcctaccgtggcgagacggtgaaagccgtggtcagcctcaagcccgggacgaacgtcacgccggaagaactggcggagtactgcaaggcccggatggcggcgtacaagtatccccgcgtggtgatgatcatggacgagcttcccaagaccgttaccgggaagatcttgcgacgggagttgcgggggtaa

SEQ ID NO: 29626 - protein, 555 aa, Ralstonia metallidurans CH34
MTPYDRKPWLSSYEPGKPHAITPEFTDALSLFRAAVARAPSLPAILYFDGSLSYAELDTQSDALACAWQDRGITRGERVAIYLQNIPQFVIALVATWKLGAIAVPVNPMNRARELRVILADSGARLLVCSETLYVDIVRPLLAEEANAENGVLPLVMTTSELEYQRRHDPRLFANTSRQETPGAESLSAVIAANAGRHPPPAALGPNDIAMLVYTSGTTGVPKGAMNTHGNVAFNAQVYRDWITLGEGEPILGVAPLFHITGLIGHIGAAFMCAAPLVLACRFEPGVMLDTLREHRPAFTIGAITVFIALMNHPNATRDCFASLTKIYSGGAPIPPSVVEAFRERFGHYIHNGYGLTETNSPTHVVPRGVEAPVDPASGTLAVGVPAYNVESYIGDDEGKPMAVGEVGEIISRGPMIVPGYWNKPQESAKAIVDGYFRTGDVGFMDERGWFYLVDRKKDMINASGYKVWPREVEDVLYTHPAVREAAVVGVPDAYRGETVKAVVSLKPGTNVTPEELAEYCKARMAAYKYPRVVMIMDELPKTVTGKILRRELRG

SEQ ID NO: 29627 - DNA, 1551 bp, Ralstonia metallidurans CH34
  CDS (1)..(1551)
atgtatatgacccaggcgctgcaccgctcgatgcagcagcgaccagacaaggtcgcagtacgttttaacggccgtgcgctgacctacgccgaaatcggggatcgcgtcgcgcggctggccggtgcgctgcgcaagctgggcgtggccgaaggcgaacgtgtagcaatgttctcgcttaactcggcgcgctacatcgagtattacatggcggtaccgtgggcaggcgccgtgctcaaccctgtcaacttccgctggagtgcggcagagatcgcgtattcgttcaaggactccggcactgcggtgctgattgtcgacgacccgttcaccgaggttgcgcagaaggtcgcggccgagtgcacgaccgtgcgccacgtcatctatgccggtgacggagagaccccggcaggcatgctgaactatgaaaccctgattgcggacagcgctccgatggaagacgcctaccgtcacggcgacgacctggcggggattttctacaccggaggcaccaccggcttcccgaagggggtgatgctcagccatgcgaacctgatctcgtcggcatgcaaccagccgatgtcgggcacggtggatgaatccatcgtgatgatgcatgtgatgccgatgttccacctggcatgcttcgcgtcgatcaacgctgtgttcctcgtcggtggcacgcatgtggcgatatccgccttcgatcctggccgcatgatggaggggattgcgcaggacagggtgacggccgtcctgctggcgccgaccatgatccagatggggctggactggatggaccggcatccggggcgcgcggccgagctggacctgtcgtcgctgaacagcctgcgctatggcgcctcgccgatgacccctgcgctgctggagcgcaccaggcagaccttcccagcggtgcgcttttcgcagggctatggcatgaccgagctggcaccggtggccacaatgcttggcccggagtatcacgacgcggcggcgcaggcgagcggcaagatgtattcagtcggccgcccggcgcataccgttgaggtcaaggtggtcgactccaggggcaacgaggtcccgcgcggtaccgtgggcgagatcatcgtacgtggcccgaatgtgatgctcggctactggaaccagccgcaggctaccgcggaggcgatccgcaatggctggatgcataccggcgacggtgggtacatggacaaggacggcttcctgttcctggtcgaccgcctgaaggacatgatcatcagcggtggcgagaacgtctattccgccgaggtggagaaggcgctggcgagtcatccggccgtcgcgcagtcgtctgtgatcggtgtgccccacgagaagtggggtgagtccgtgcatgcggtggtggttctccggcagggcgagagcgctacgctcgagtcgatccagtcccattgccgtgagcggattgccggctacaagatcccacgcagcgtcgagttcgtcgatgcgctgccgttgtcgagcgtcggcaaggtgctcaagaacgagctgcgcaagcgccattggaagtaa

SEQ ID NO: 29628 - protein, 516 aa, Ralstonia metallidurans CH34
MYMTQALHRSMQQRPDKVAVRFNGRALTYAEIGDRVARLAGALRKLGVAEGERVAMFSLNSARYIEYYMAVPWAGAVLNPVNFRWSAAEIAYSFKDSGTAVLIVDDPFTEVAQKVAAECTTVRHVIYAGDGETPAGMLNYETLIADSAPMEDAYRHGDDLAGIFYTGGTTGFPKGVMLSHANLISSACNQPMSGTVDESIVMMHVMPMFHLACFASINAVFLVGGTHVAISAFDPGRMMEGIAQDRVTAVLLAPTMIQMGLDWMDRHPGRAAELDLSSLNSLRYGASPMTPALLERTRQTFPAVRFSQGYGMTELAPVATMLGPEYHDAAAQASGKMYSVGRPAHTVEVKVVDSRGNEVPRGTVGEIIVRGPNVMLGYWNQPQATAEAIRNGWMHTGDGGYMDKDGFLFLVDRLKDMIISGGENVYSAEVEKALASHPAVAQSSVIGVPHEKWGESVHAVVVLRQGESATLESIQSHCRERIAGYKIPRSVEFVDALPLSSVGKVLKNELRKRHWK

SEQ ID NO: 29629 - DNA, 1548 bp, Ralstonia metallidurans CH34
  CDS (1)..(1548)
atgtatctgacacaggctctgcacaaggcattccgcgaaaacccgtctggcgtcgcgacgatttttgcgcaacgcagcacgacgttctcccagctcatcgaccgggttgcaagactggccagcgccttgcgtggccagggcgttgctgcgggcgaccgggtcgccatgctggcgctcaactccgaccgctacgtcgagtacatcttcggcacgctctgggccggcgcggcgctgaaccccgtcaacacccggtggagcgtcgcggaaatcgcctactcgatggaggattgcggcaccagcgtgctgctcgtggatgacaacttcctggatctgatcgggccactgcgcgagcgttgcccctgcatccagaccgtcatctattgcggcgacgccgagaccccggcaggcatgatcgactacgagcaactggtgcggtcgagcgcgccgattgccgacagcctgcgcagtggccacgatcttgccgcagtgctctacaccggcggcaccaccggcgcacccaagggcgtcatgctgtcgcacgccaatatcgccagcaacgtgctgtcgtcactggcagcggcatcgcgcccgccagtgacgtcgatcctgcagatggcaccgatgttccatatcgcggcgctcagcttcgtctttcaggccgtgacgcgcctcgccacgcaggtgatcctgcccgggttcgaccccaaggcagcgattcgcgacctcagccgctaccgcatcaacgaggttttcaccgtcccgacgatgctgaagatgatgctcgacgatcccacgttcgccgaccatgacctgagcagtctcaggaacatcatctacggcgctgccccgattgacggcgcactgctgcagcgcgccatggcgcagattccgtccagccagttcctgcaggcctatgggatgacggagacctcgcctgtctcggcgatactggcggccgattgtcacgtcgtcggcagtccgaggctgaaggcggccggccgcccggcgcccgcgtgcgaagtgcgcatcgtcgatccggcaacggacgaagactgcccgacgggcacggtgggcgaggtcgcggtgcgcggcccgggcgtgatgctgggctactggaacaagccggaagaaaccgcccgcgcgttgcgcaatggctggatgcacaccggcgatgccggatacctggatgcggacggctttctatacgtcaccgatcgcatcaaggacatgatcatcagcggcggcgagaacgtctattcgaccgaagtcgagaatgcgatcctcacgcaccccgcggtgcagctgtgcgcggtgatcggcatccctgacgagaaatggggggaagctgtgcatgcggtcatcgtggtccgccccggtcacgagctgtctgtcgatgcggtgcacgcgcattgccgcgagcggatcgccagctataaatgcccccgcagtgtcgagttccgcgccgacatgccgctctcggcggcgggcaagctcctcaagtacaagctgcgtgaagtctactggcagtcgcgcgaccggcggatctga

SEQ ID NO: 29630 - protein, 515 aa, Ralstonia metallidurans CH34
MYLTQALHKAFRENPSGVATIFAQRSTTFSQLIDRVARLASALRGQGVAAGDRVAMLALNSDRYVEYIFGTLWAGAALNPVNTRWSVAEIAYSMEDCGTSVLLVDDNFLDLIGPLRERCPCIQTVIYCGDAETPAGMIDYEQLVRSSAPIADSLRSGHDLAAVLYTGGTTGAPKGVMLSHANIASNVLSSLAAASRPPVTSILQMAPMFHIAALSFVFQAVTRLATQVILPGFDPKAAIRDLSRYRINEVFTVPTMLKMMLDDPTFADHDLSSLRNIIYGAAPIDGALLQRAMAQIPSSQFLQAYGMTETSPVSAILAADCHVVGSPRLKAAGRPAPACEVRIVDPATDEDCPTGTVGEVAVRGPGVMLGYWNKPEETARALRNGWMHTGDAGYLDADGFLYVTDRIKDMIISGGENVYSTEVENAILTHPAVQLCAVIGIPDEKWGEAVHAVIVVRPGHELSVDAVHAHCRERIASYKCPRSVEFRADMPLSAAGKLLKYKLREVYWQSRDRRI

SEQ ID NO: 29631 - DNA, 1713 bp, Ralstonia metallidurans CH34
  CDS (1)..(1713)
atggcgatgcaaccgggaacctccctgcccattggggggctgtcttacgtgaaaggggccgacaccccaccactcagcgaactgacggtgcctgcgctgctggcgaacactgccgcgctccacggcagccggccggcggtggtattccgggagcagaacatccgctggacctggaatgaattcagcgccgaagtggacaggatggcctccggcctccacgcgctgggcctgcgcaagggcgaccgggtcggcatctggtcccctaaccgcttcgagtggctgctgacgcagtttgctacggcccgggttggcctggtcatggtcaacatcaacccggcgtaccgccttgcggaactcgaatacgcgctgaacaaggttggctgcaaggcgatcatcgcgccggaagcattcaagacctcgcgctacctggacatgctggcaacactggcccccgagttggccaaagccgaaccgggcgcgctgaacgccgcccggctgccgctgctgcgctgggttatccgcatggaagacgtgccgacgcccggcatgctgaccttccgcgagttgctggcgcgcggcgcaaacgtgccaaagactgagctcgacgagatcaccgccggactcgacgcgcgcgaccccatcaatatccagttcaccagcggcaccaccggcgcgcccaagggcgccacgctcacgcaccgcaacatcgtcaacaacggccgttcgatcgcgggcgcgatgcggttttccgaacaggacaagctctgcatcccggtgccgttctaccactgcttcggcatggtgctgggcgtgctggcctgcgtgtccaccggggccagcatggtgttcccgggtgaggcattccaccccggcgccacgatggccgccgtcagcgaggaacgctgcacggccctgcatggcgtgccgaccatgttcatcgcgcaactcgacgaccccgacttctcgaagtacgacttttccagcctgcgcaccggcatcatggccggcgcgccctgcccggtggaagtcatgaagcgcgtcatggcggacatgcacctggccgagatcaccattgcctatggcatgaccgaaaccagcccggtgtcgttccagagcgccaccgacgatccgatcgacaagcgggtgtcgacggtcggccgcgtgcagccgcatctggaatgcaaggtggtcgacgtggatggccagacgctgcccatcggcgccaccggtgaactctgcacgcgcggctactcggtgatgcttggctactgggacgacgaggaacgcacgcgcgaggcaatccgcgacggctggatgcacaccggcgacctggccacgatcgacgaagagggctactgcaacatcgtcggccgcgtgaaggacatgctgatccgcggcggcgagaacgtctacccgcgcgagatcgaggaattcctgttccggcacccgaaagtccagtccgtgcaggtcttcggcgtgcccgacgagaagtacggcgaggaagtctgcgcctggatcgtcctgaagccgggccagagcgccaccgacgaggaaatccggaattactgccgcgaccagattgcccactacaagatcccccgttacattcgctttgtagacgagatgcccatgacgatcaccggcaaggtgcagaagttcgtcatgcgggaccagatgacccaggaactcggaatcagccccaaggccaagtga

SEQ ID NO: 29632 - protein, 570 aa, Ralstonia metallidurans CH34
MAMQPGTSLPIGGLSYVKGADTPPLSELTVPALLANTAALHGSRPAVVFREQNIRWTWNEFSAEVDRMASGLHALGLRKGDRVGIWSPNRFEWLLTQFATARVGLVMVNINPAYRLAELEYALNKVGCKAIIAPEAFKTSRYLDMLATLAPELAKAEPGALNAARLPLLRWVIRMEDVPTPGMLTFRELLARGANVPKTELDEITAGLDARDPINIQFTSGTTGAPKGATLTHRNIVNNGRSIAGAMRFSEQDKLCIPVPFYHCFGMVLGVLACVSTGASMVFPGEAFHPGATMAAVSEERCTALHGVPTMFIAQLDDPDFSKYDFSSLRTGIMAGAPCPVEVMKRVMADMHLAEITIAYGMTETSPVSFQSATDDPIDKRVSTVGRVQPHLECKVVDVDGQTLPIGATGELCTRGYSVMLGYWDDEERTREAIRDGWMHTGDLATIDEEGYCNIVGRVKDMLIRGGENVYPREIEEFLFRHPKVQSVQVFGVPDEKYGEEVCAWIVLKPGQSATDEEIRNYCRDQIAHYKIPRYIRFVDEMPMTITGKVQKFVMRDQMTQELGISPKAK

SEQ ID NO: 29633 - DNA, 1515 bp, Burkholderia fungorum LB400
  CDS (1)..(1515)
atggtttcattgagcgacagcgtcgcctggtgggcgcgcacgaatccgtcccgtaccgcattgatgtacggcaatcagtcaatttcgtatggcgatctgcagcggcgcgtcgaggccaccgccgggatgttgaagggtacccgaatccgtcgtggcgatatcgtcgcgttgctgatgaagaacagcgcggccttcgtcgagatcatgctggcggtctcgcaggcaggcgccgtcattcttcccatcaactatcggctaggtccggacgaggtggcctatattctccagcattcgggtgcgaaactgctgtttcacgatgaggagttcgaagtgccccccggccttgtgcattcgcaggccgtgaccggcgcggcgcagtcggacacgagtgtgcttgccgccggtcacgaaccctgtacggaagcttatccgtcccgccccgacgatctgtatcgactgatgtacacctccggcacgacggatcgccccaaaggggtgatgcattcctacggcaacgtggcgtggaaaagcttcgatcacatcgccgcgttgggtatcacgaaagacgacaggcttctcgtagtcggcccgctttatcacgtcggtgcgtgcgatctgccggggcttgccgtgctcgcgcaaggcggcatgctgcgcatcatgcgcgatttcgacgcgcaggctgtgctggaagcgatcgagcgcgagcgtctgaccggcgcgtggctggcacctgtcatgctgagccgcattctggcattgcccgaacgataccgcttcgacctgggcagtttgcgctgggtggtcggcgggggcgagcgtacgccggaacaacgcattcgtgagttcggatccctattcacgggcgcccgctatatcgacgcttacggactgacggaaagttgttccggcgatacgctgatggagcaggggcgcgagctcgacaagatcggctccacggggcgggcgctggctcacgtgcaactggcgatcatgagcgacgatggccggatgcttgcgcccggcatgcaaggcgaaatctgcgtgcgcggtccaaaagtcacccaaggttactggaaagacccggaaaaaaccgcaagaagcttcgttgacggatggtttcgcaccggcgacgtcggctatatggacgaggaaggcttcctgtatctcaccgaccgcaagaaggacatgatcatcagcggcggcgagaacatcgcctcttccgaagtggagcgggtgatctatcagcttgccgaggtggcggaggccgcggtgatcggtgcacccgatccgcgttggggcgaacaggtgacagccgtcgtggtgctgcgagccggagcgacactgacgctggacgcgctgcggacccactgcgaaggccgtctcggcggattcaaaacgcctcggcaactgatcctgcgcgacgcactgccgcgcaatccttctggaaaggtcctcaagcgcgtgctgcgcgacgaactgctcaaggagagcgaccatgacggccagcgctga

SEQ ID NO: 29634 - protein, 504 aa, Burkholderia fungorum LB400
MVSLSDSVAWWARTNPSRTALMYGNQSISYGDLQRRVEATAGMLKGTRIRRGDIVALLMKNSAAFVEIMLAVSQAGAVILPINYRLGPDEVAYILQHSGAKLLFHDEEFEVPPGLVHSQAVTGAAQSDTSVLAAGHEPCTEAYPSRPDDLYRLMYTSGTTDRPKGVMHSYGNVAWKSFDHIAALGITKDDRLLVVGPLYHVGACDLPGLAVLAQGGMLRIMRDFDAQAVLEAIERERLTGAWLAPVMLSRILALPERYRFDLGSLRWVVGGGERTPEQRIREFGSLFTGARYIDAYGLTESCSGDTLMEQGRELDKIGSTGRALAHVQLAIMSDDGRMLAPGMQGEICVRGPKVTQGYWKDPEKTARSFVDGWFRTGDVGYMDEEGFLYLTDRKKDMIISGGENIASSEVERVIYQLAEVAEAAVIGAPDPRWGEQVTAVVVLRAGATLTLDALRTHCEGRLGGFKTPRQLILRDALPRNPSGKVLKRVLRDELLKESDHDGQR

SEQ ID NO: 29635 - DNA, 1650 bp, Burkholderia fungorum LB400
  CDS (1)..(1650)
atggaggaagtgaacacaatgaatgatctgaacgaattcacctatccgcacttcctcgcgcggcagaggcgcgagcgacccgagggtctggcggtgagcacccccgggcaccaggccacgtggcggcaactcgccatcgacgtcgagcggcacggcgcggcgttgcagtcgcttggcattattgcgggcgcgaaggtcggcattctcatgccgaacggttatgagtgggttgtatgggcttatgccgccgcaagcattggcgcggtcgtcgtcccgctcaatacgcgctttctcgccgctgagctcgcctaccagcttgccacggcggatatcgagattctggtgctttcgccgatcatcggcgacacggatttcctggccatcgttgcagcgatggttcctgcgttgagcgaagcacaaccaggcgcctggcgaagcgagacgctgcctcgcctgcgccatatcgtgacgacaggcacgagcacaactttcgtgggcgaactgagtgcggggagcctgacggcctcgcccatcgaccctgcggcaatcatccgggtgcacgaagcggcagcgaaggtgaagcctgacgatcccgtgctgatccagttcacatcgggctccactgcgctgccgaaaggcgcgatgctcagccatcaaagcacgttgcgtaacgcgcacgacgttgcggctcgccttcacatcacgcacgccgatcgcatcttcgtgccggggccgttctttcacgttggcggactgacgctcggtatgctgctgggtttgtcgaccggtgcgccgatccatacactcgcgcgcttcgatccggccgccgtcctggcgaccatcgcgcgcgagcaaatcaccgtctatagcggcgtcgattcgctattcatcacgctttacaagtatcccgggttccgtcgcgaggcgatcgcgtcggtaaccaaaggctggatcgccagcagccccgacattgtgcgcatggtgcagacggagatgggactgaccggcatcagcaacgtattcggcatcagcgaggcgtcgccgaacgtgacgatcggcgacctcgacgagccgcccgcattgcgggcagcgacttgcggccggcctcatcccgggtgcgaggtgaagatcgtcgacccggcgacaggtgaaaccgtacccgcgggcgaatccggcgaaattctctaccgtggctactcgctgatgttgggttactacaacaaccccgcggcgaccgcaaaagcgatcgatgtcgacggctggctgcacacaggcgaccggggcatcctgcgtgcgagcggtcacctcgaatatcacggtcgcatcaaggacatgctgcgtgtcggcggagagaacctggcgccggccgaggtcgaagaagcgctgtgccgccatccaaaggtgcgccaggcggctgtcatcggtttgcccgacgagcgcctcgtggaagtgcccgccgccgtcgtcgaactgaaggaaggcgaaacctgttccgcggaagagatcaccgcgtggtgcgcggcgcggcttgccgcgttcaaggtaccgcgtgtgatcgcgttcgtcgaacagatgccgatgacgggcagcggcaagatacagaagacccgaatgaaacaagaagtattcggcatctcaacctctcaatag

SEQ ID NO: 29636 - protein, 549 aa, Burkholderia fungorum LB400
MEEVNTMNDLNEFTYPHFLARQRRERPEGLAVSTPGHQATWRQLAIDVERHGAALQSLGIIAGAKVGILMPNGYEWVVWAYAAASIGAVVVPLNTRFLAAELAYQLATADIEILVLSPIIGDTDFLAIVAAMVPALSEAQPGAWRSETLPRLRHIVTTGTSTTFVGELSAGSLTASPIDPAAIIRVHEAAAKVKPDDPVLIQFTSGSTALPKGAMLSHQSTLRNAHDVAARLHITHADRIFVPGPFFHVGGLTLGMLLGLSTGAPIHTLARFDPAAVLATIAREQITVYSGVDSLFITLYKYPGFRREAIASVTKGWIASSPDIVRMVQTEMGLTGISNVFGISEASPNVTIGDLDEPPALRAATCGRPHPGCEVKIVDPATGETVPAGESGEILYRGYSLMLGYYNNPAATAKAIDVDGWLHTGDRGILRASGHLEYHGRIKDMLRVGGENLAPAEVEEALCRHPKVRQAAVIGLPDERLVEVPAAVVELKEGETCSAEEITAWCAARLAAFKVPRVIAFVEQMPMTGSGKIQKTRMKQEVFGISTSQ

SEQ ID NO: 29637 - DNA, 1593 bp, Burkholderia fungorum LB400
  CDS (1)..(1593)
atggaaatgtgcgtcggggacgcgctggatgaggcggcgcgaaagtggccggagcgcacaggttgggtttttgaggaagagcatatctcctatcagcagatgaaggagcatgtcgaccgggtcgcccgtgcgttgctcgcgagcgggatcgagcgcggcgacgtggttgcagtgtggatgccgaatcttccgcatttcgcgttcattgagctcgcctgcgcaaagattggcgcgattatcggcgcgatcaatacgcgttcgaaggtcttcgaggtcgagcattttatgaagcatagcgaggcgaagctcctcgtgatggtcgaccgttttatcaagcatgatttcgtcgcaacgctgaacgaggtttgcagaggcgaagcgaggcaaattggtggtgacgttgcggccggcggagtcgggcagttgcgcaaggtggtgagcgtgtcgtcggcgcctgatagtcgtgctcaatcgtggaccgccttcatcgcacttggggagtccgtcacggccgaggcactcgcgacgattcagcgtcagcagaacattgacgatccgattcttatccagtacacctcgggcacgacatcgcttcccaaaggtgcgctctgcaaccaccgttacgtcctgaacttcggtggggtgctgatgcagagactcggcatggaggaaggcgacgcgtttctcaatacccaaccgttttaccatgttgggggatcctgcggcgccgtgcccgctccccttacgctggggtgtacggtcgtcagcgccgaatactacgaggtcgagcgcatcctctcgctaatcgagcgtgagcgctgtgtggcccgctcggggtatggcgcgatgtatatcatggagatgaatcatccgcgttttcgcgagttcgatctgtcgagcctgaaggcaggatggtgtgtcggtacggccgagctgatgaaccgagttcgcaacgagatgaacatccctggtctgctgcagatctacggtgcgacggaggtaggcggtacgagcgcgtgggtcgatgatccgtgggagttgcgctctagcagttgcggctcgccaatctacggcaccgaattgaagatcgtcgatccggccactggcgcgacgcttgcgtccggcgagatcggcgagatctgcatgcgcggttggtggaagatgaacggctatctcaagcagccggccgagacggctagcacggtcgacgctgacggatgggtgcacactggcgatctcgggcatgtcgacgaggctggcaatctttatttttccagccggctgaaggacatgctgaagatcggtggcgagaatgtctcggcgcaggaagtggaagcggtgctactcagtcatccgcgcatcgcacaggttgcggtgatcggcgcgcccgacgagcgtctgaccgaagtggtcatggcgatcgttgagccgcgtcataacgagcaggtcacggaagaagaagtgattgcatattgcgcgcagcggatggccaacttccgcgtgccacgttatgtgcgcattacgcaaacgtggccgcttaccgatagcggaaaaattcagaaacacaagttgcgcgagcaatatctcgtctga

SEQ ID NO: 29638 - protein, 530 aa, Burkholderia fungorum LB400
MEMCVGDALDEAARKWPERTGWVFEEEHISYQQMKEHVDRVARALLASGIERGDVVAVWMPNLPHFAFIELACAKIGAIIGAINTRSKVFEVEHFMKHSEAKLLVMVDRFIKHDFVATLNEVCRGEARQIGGDVAAGGVGQLRKVVSVSSAPDSRAQSWTAFIALGESVTAEALATIQRQQNIDDPILIQYTSGTTSLPKGALCNHRYVLNFGGVLMQRLGMEEGDAFLNTQPFYHVGGSCGAVPAPLTLGCTVVSAEYYEVERILSLIERERCVARSGYGAMYIMEMNHPRFREFDLSSLKAGWCVGTAELMNRVRNEMNIPGLLQIYGATEVGGTSAWVDDPWELRSSSCGSPIYGTELKIVDPATGATLASGEIGEICMRGWWKMNGYLKQPAETASTVDADGWVHTGDLGHVDEAGNLYFSSRLKDMLKIGGENVSAQEVEAVLLSHPRIAQVAVIGAPDERLTEVVMAIVEPRHNEQVTEEEVIAYCAQRMANFRVPRYVRITQTWPLTDSGKIQKHKLREQYLV

SEQ ID NO: 29639 - DNA, 1632 bp, Thermobifida fusca
  CDS (1)..(1632)
atgctcgacggctgcaccccctggcccgcggagttcgccgtccgctaccgcgaggcggggtactggaccggggagactttcagcgacttcgtcaccgaccgcacccgccgtttcgccgaccgcctcgccgtggtcggcgcgggccagcgctggacctatgccgaactgggggagcgctccgcggtcctcgccaccgggctggcccggctcggcattgccgcgggcgaccgcgtcgtcgtccaactccccaacatcccagaactgttcgaagtggtcttcgcgctgttccggctcggcgcgctgccggtgtacgcgctccccgcccaccgggcccacgaaatcacccacctgtgcaccacggcccaggcgaaagcactcatcatccctgaccggcacgccggtttcgactaccggaccatggccgcgcagctgcgccacgccggcactgcccccgaacacgtggtggtcgtcggggagccgggcggcttcaccccgctggccgagctccgtgccgaccggcccgaccccggcgtcttcactcggcccgaggcgagcgacgcggccttcctccaactctccggcggcaccaccgggctgcccaagctcatcccccggacccacgacgactacctgtactcggtgcgggccagcgcggagatctgcgccctcggcaccgacaccgtctaccttgcggcgctgcccgccgtgcacaacttcccgatgagctcccccggcttcctcggcacctttcacgctggaggcaccgtcgtgctcgcccccaacccttcccctgacaccgcgttctccctcatcgaaaccgagcgggtcacgatcaccgcggtcgtccccccgatcgcgctgcagtggctggacgcggtggagcacggctcccagagccaccgggacctctcttcactgcgcgtcctgcaagtcggcggcgccaagttcgccccggaagcggcccgccgggtccgccccgtcctcggctgcaccctccagcaggtgttcggcatggccgaagggctggtcaactacacccggctcgacgaccccgacgacatcatcaccaccacccaggggcggccgatcagcccggacgacgagatccgcatcgtcgacgaggccgaccggccggtgcccgacggcgaagtcggccacctgctcacccgcggcccctacaccatccgcggctactaccgggccgaggagcacaacgccaccgcgttcacccccgacggcttctaccgcaccggggacctggtgcgccgcacccccaccggccacctcgtcgtcgaaggccgcgccaaagaccagatcaaccggggcggcgagaaggtctccgcggaagaagtggagaaccacatcctggcccaccctgccgtccacgacgcggccgtggtcggcatgagcgacccctacctgggggaacgcgtctgcgcctacgtcatcgcgcgcaccgaaccacccagccggagcgaactgctgcgcttcctccgcgaacggggcctggcctcctacaagatccccgaccgggtcgaattcgtggaccgcttccccgtcaccggcgtcggaaagatctcccgcagcgaactccgccgggaactcgcacgtagattggacaccacccgatga

SEQ ID NO: 29640 - protein, 543 aa, Thermobifida fusca
MLDGCTPWPAEFAVRYREAGYWTGETFSDFVTDRTRRFADRLAVVGAGQRWTYAELGERSAVLATGLARLGIAAGDRVVVQLPNIPELFEVVFALFRLGALPVYALPAHRAHEITHLCTTAQAKALIIPDRHAGFDYRTMAAQLRHAGTAPEHVVVVGEPGGFTPLAELRADRPDPGVFTRPEASDAAFLQLSGGTTGLPKLIPRTHDDYLYSVRASAEICALGTDTVYLAALPAVHNFPMSSPGFLGTFHAGGTVVLAPNPSPDTAFSLIETERVTITAVVPPIALQWLDAVEHGSQSHRDLSSLRVLQVGGAKFAPEAARRVRPVLGCTLQQVFGMAEGLVNYTRLDDPDDIITTTQGRPISPDDEIRIVDEADRPVPDGEVGHLLTRGPYTIRGYYRAEEHNATAFTPDGFYRTGDLVRRTPTGHLVVEGRAKDQINRGGEKVSAEEVENHILAHPAVHDAAVVGMSDPYLGERVCAYVIARTEPPSRSELLRFLRERGLASYKIPDRVEFVDRFPVTGVGKISRSELRRELARRLDTTR

SEQ ID NO: 29641 - DNA, 1659 bp, Methanosarcina barkeri str. fusaro
  CDS (1)..(1659)
atgcatcttatagaagagtccctcggtaattactttgaaaaacaggtggctgtagaccctgaccacgagtttataatctatcctgaccgcaaccttcgttttacctatgggcagttcaacgaacgggtcaataaccttgcaaaagggctgctagctatagggataacaaaaggggatcatgtaggaatctgggcaaaaaatgttcctgattggcttaccttcatgtttgccacggcaaagataggagcagtacttgttactgtgaatactgcctacaagagccatgaggtcgaatatgtattaaaacagtccgatatgaaggctctggctatgattgatagttacagagacgttgattatctcgaaataattaatgaactggtccctgagctcaaaacctctgagagggggagactgaaaagcaaaaactttccctatcttaagagtataatttatgtaggacaggaaaagcaccggggtatgtataacacaaatgagcttatgcttcttggcagtcattatcccgatgacaagctccgcgagattatgaccagcgtcgactgtgacgatgttgtcaatatgcagtatacatcaggtactaccgggtttcctaaaggagtcatgctgacccataaaaatatcctgaataacgggctttctattggagaccgccagaggtttacctatgtagacaaactctgttttcccgtgccactttttcactgttttgggatagtactaggagttatggccgttctgactcacagagcaacgcttgttatgctcgaagtttttgatcctctattagtacttgccgctgtccataaagagaaatgtacagcgctttacggcgtgccaacaatgtttattgccgagtatacacatcccatgttcgacatgtttgacctatcatctctcaggacaggaattatggcgggttcgacctgccccgtggaagccatgaaaaaggtcgtaaacgatatgcactgctatcagattaccagtgtttacgggcttacggaagcatcccctggtatgacccaaactgctgtagacgatcctctagaactcagggtcgaaactgttggtaagcatttcccgagcgtagaggtcagggttgttgatcccgataccaatgagcctgtgcccctaaatactgtaggagagatatgttgtcgcgggtataacgtaatgaaaggttactataagatgcctgaagaaacgaaaaaagttatcgatgaagacggttggcttcacagtggagaccttggaacctgtgacgaaaacggttactacagaatcacaggcaggattaaggacatgattatccggggaggagaaaacatatatccaagggaaattgaggaactcctgcttaccatgcccgaaattacagacgttcaggttgtgggcatccctgacaaaaaatacggggaaattgtaggtgcctttgtgattctcaaaaaaggtgcagactttacagaagtcgatatcagagattatgctttaagcaaggtcgctcgctataaggttccaaaacacatattcattgtagatgaattcccactgacagcaagcggtaagattcaaaaatacaggctaagggaactggctgtggagcttcttaatgagcaaggtgaaaaaatagcaattgagtaa

SEQ ID NO: 29642 - protein, 552 aa, Methanosarcina barkeri str. fusaro
MHLIEESLGNYFEKQVAVDPDHEFIIYPDRNLRFTYGQFNERVNNLAKGLLAIGITKGDHVGIWAKNVPDWLTFMFATAKIGAVLVTVNTAYKSHEVEYVLKQSDMKALAMIDSYRDVDYLEIINELVPELKTSERGRLKSKNFPYLKSIIYVGQEKHRGMYNTNELMLLGSHYPDDKLREIMTSVDCDDVVNMQYTSGTTGFPKGVMLTHKNILNNGLSIGDRQRFTYVDKLCFPVPLFHCFGIVLGVMAVLTHRATLVMLEVFDPLLVLAAVHKEKCTALYGVPTMFIAEYTHPMFDMFDLSSLRTGIMAGSTCPVEAMKKVVNDMHCYQITSVYGLTEASPGMTQTAVDDPLELRVETVGKHFPSVEVRVVDPDTNEPVPLNTVGEICCRGYNVMKGYYKMPEETKKVIDEDGWLHSGDLGTCDENGYYRITGRIKDMIIRGGENIYPREIEELLLTMPEITDVQVVGIPDKKYGEIVGAFVILKKGADFTEVDIRDYALSKVARYKVPKHIFIVDEFPLTASGKIQKYRLRELAVELLNEQGEKIAIE

SEQ ID NO: 29643 - DNA, 1659 bp, Geobacter metallireducens GS-15
  CDS (1)..(1659)
atggcgcaacatcttgattttacgatcggtggactgctcgaccacatggctgtaacgtttcccgacaatgatgcccttgtctacccggaacgggggctccggtactcctaccggcagttcaatgatatctgccgccaggtggccaaggggttgctgaagctcggcgtcaggaagggagaccacgtggccatctgggcctacaacgttcccgagtgggtcattctccagttcgccaccgccaagatcggcgtcgttctggtgacggtcaacactgcctacaagtcggcggaactggaatacctccttgaccagtccgattccaccactctcttcatggtccggtcctggaaggacacggactatgtggcgaccctttccgaggtggtgccagagctggcatcggccgaagcgggtctcctcactactcccaagctccccttcctgaaaagagttgtctttatcggtgaggatacgccggcagggatgctcaatttcgagaagatcgcggagatggggaaagaggtgcccgatgagcagctggcggcagttgagtcctcccttgatgtccacgatgtcatcaatatgcagtacacttccggcaccaccggctttcccaagggggtcatgctgacccactacaacctggtcaacaacggctatcacattggcgagtgcatgaagttcacggataaggaccggctctgcatccccgttcccttcttccactgctttggctctgtgctggctgtcatggccagcgttactcacgccaccgccatggtgccggtggagattttcgacccgctcaaggttcttcagaccgttgaaaaggagcgctgcaccgccgttcatggcgtgccgaccatgtttattgctgagctggagcatccggatttcgcgaagttcgatctctccaccctccgcaccggcatcatggccggctcggtctgtcccatcgaggtcatgaaacggtgcgtcaaggatatgaacctgaccgagcttaccagtgtctatgggcagaccgaatcctccccgggaatcacccagacccgcaccgaggattcggttgagctgcgcgtctccactgtcgggcgggcgctccccggcgccgaagtaaagaccgtcgatatcgagaccggcgccacgctgccgcccgggaagcagggcgagctctgcgcccggggctacatggtcatgaagggttactacaagatgccggaagagaccgccaaggtcatcgatgccgatggctggctccataccggcgacctggcagtgatggacgagaacggctactgcaagatcaccggtcgcatcaagcagatgatcatccgcggcggtgagaatatataccccaaggagatcgaggagtttctctacacccacccgaagatctccgacgtgcagatctacggcgtgccggatcgcaagtacggcgagcaggtcatggctgccatcatcctgaaaaacggggtggagatgaccgaggacgaggtcaaggagttctgccgggggaaaattgccaactataaaattcccaagtacgtgaagtttgtggctggctatcccatgactgccagcggcaagatccagaagttcaagctgcgggaaatggccatcaaggaactgggcctcgaaggtgccggcgatgccgcgtag

SEQ ID NO: 29644 - protein, 552 aa, Geobacter metallireducens GS-15
MAQHLDFTIGGLLDHMAVTFPDNDALVYPERGLRYSYRQFNDICRQVAKGLLKLGVRKGDHVAIWAYNVPEWVILQFATAKIGVVLVTVNTAYKSAELEYLLDQSDSTTLFMVRSWKDTDYVATLSEVVPELASAEAGLLTTPKLPFLKRVVFIGEDTPAGMLNFEKIAEMGKEVPDEQLAAVESSLDVHDVINMQYTSGTTGFPKGVMLTHYNLVNNGYHIGECMKFTDKDRLCIPVPFFHCFGSVLAVMASVTHATAMVPVEIFDPLKVLQTVEKERCTAVHGVPTMFIAELEHPDFAKFDLSTLRTGIMAGSVCPIEVMKRCVKDMNLTELTSVYGQTESSPGITQTRTEDSVELRVSTVGRALPGAEVKTVDIETGATLPPGKQGELCARGYMVMKGYYKMPEETAKVIDADGWLHTGDLAVMDENGYCKITGRIKQMIIRGGENIYPKEIEEFLYTHPKISDVQIYGVPDRKYGEQVMAAIILKNGVEMTEDEVKEFCRGKIANYKIPKYVKFVAGYPMTASGKIQKFKLREMAIKELGLEGAGDAA

SEQ ID NO: 29645 - DNA, 1623 bp, Novosphingobium aromaticivorans DSM 12444
  CDS (1)..(1623)
atgaacgagaacacttcgaagccctgggactggctgccgattcccgcccctcaccagcaggccttcgcgcaacgcggggcctggaacctgcggacgctggcagacctcgcgcgcgaacgggcggcgtcagatcccgatttcgtctgcttcgtcgatggcgaaggccaatataccttcgcgcaggtcctggcagaagcggaagcgctttccgcgtcgttgcacgcgcgtgggtttcgcgccggcgatgtcatcgcattccaggtgccgaactggcgcgaggccgccgtcatcaacctgtcggcggcgatgtctggcttcgtggtcaatccgatcgtgccgatctatcgcgatgccgaagtcacgatgatgcttggcgattgccgggccgccgcgatcttcgtgccgcaggtgttccgcaaggtcgactacgccgaaatggcgcgtcgctgccagaaggcgctgcccgatcttgcgcacgtcttcaccgtgcggggcgaggggccggacgatttcgccactctcgtcgcacaggggcgcgctctttccttcgaagtgccaacggtcgatccgatgggcgtcaagatggtgctctatacctcgggcacgaccggtcggcccaagggcgtcctgcacagccattgcacgttgcagcgcatcgtcgcggaaagcgggcggcactggggcctcggggcaggggaggcgacgctgatgccttcgccggtcacgcacgtctcgggatatgccaatggcctcgaagcgccgttcatctgcggcatccgctcggttctcatggaagcgtggaacgcccaggatgcgctggccctgatcgagaagcacgaccttgtcggcacggttgctgcaacgcccttcctggtcgaacttgcggcagcggcgcgagcggcgggcaccggcctgccaagcttccgcttcttcgcctgcggcggtgcggcggtgccggcggaccttatcccggccgccaacgccgccttcgagaactgccgggcctttcgcgtcttcggcgcgtccgaagttccgctcgttaccttcggctggccgcacgacgagcgccttgccgcgaccaccgatggcgaggtggtggactacgaagtccgcatcgtcgaccacgaggacaatgatcttccgcgcggtgtcgaaggcgaaatccttgcgcgcggtcccggcatgatgatgggctatgccgacgccgcgcagaccgcagaggcgatcacgcccgacggcttcttccgcaccggcgacctgggcgtgctgtccgaagagggtgcggtaacgatcaccgggcgcaagaaggacctcatcatccgcggcggagagaacatctcggccaaggaaatcgaggacgtgctgcacagccatgacgcggtgaaggaagcctcggtcgtcgccatgccgcacgaacgccttggcgagggcatctgcgcctatgtgatcctgtccgccgcagtcgacgcggcggtgcttgccgcgcatgttgccgcttcgggcatggcgaagcagaagatccccgaacgcttcgaattcgtagaggactttccccgcaccgctagcggcaaggtccgcaaggaccagctgcgggcgatgatccgggagaaagtggggggctga

SEQ ID NO: 29646 - protein, 540 aa, Novosphingobium aromaticivorans DSM 12444
MNENTSKPWDWLPIPAPHQQAFAQRGAWNLRTLADLARERAASDPDFVCFVDGEGQYTFAQVLAEAEALSASLHARGFRAGDVIAFQVPNWREAAVINLSAAMSGFVVNPIVPIYRDAEVTMMLGDCRAAAIFVPQVFRKVDYAEMARRCQKALPDLAHVFTVRGEGPDDFATLVAQGRALSFEVPTVDPMGVKMVLYTSGTTGRPKGVLHSHCTLQRIVAESGRHWGLGAGEATLMPSPVTHVSGYANGLEAPFICGIRSVLMEAWNAQDALALIEKHDLVGTVAATPFLVELAAAARAAGTGLPSFRFFACGGAAVPADLIPAANAAFENCRAFRVFGASEVPLVTFGWPHDERLAATTDGEVVDYEVRIVDHEDNDLPRGVEGEILARGPGMMMGYADAAQTAEAITPDGFFRTGDLGVLSEEGAVTITGRKKDLIIRGGENISAKEIEDVLHSHDAVKEASVVAMPHERLGEGICAYVILSAAVDAAVLAAHVAASGMAKQKIPERFEFVEDFPRTASGKVRKDQLRAMIREKVGG

SEQ ID NO: 29647 - DNA, 1632 bp, Novosphingobium aromaticivorans DSM 12444
  CDS (1)..(1632)
atgacgcagttgtcctacgcgaaggggcccgccgacgagccccttcttgaaaagaccatcggccaggcactgcgcgatgcggcggcgctctggggcgacgagcttgccctggtatcgcgccaccagcagatccgctggacctgggcccagctcgacgcagaggtcgatcgtatcgccacgggcctgctcgacaggggcgtggccaagggcgaccgtgtcggcatatgggcgccgaactgcgcggaatggaccgtcctccagttcgcgaccgcgcggatcggtgcgatcctcgttaccatcaatcccgcctatcgcaccagcgaggtcgagtacgcgctgaacaaggtcggctgcaccttccttgtcaccgccgcgcgcttcaagaccagcgactatgtggcgatgctgcgcgaactggggccggacaagctgccgggcgtaagctgcatggtcgtgctcggcgcggatcgccacgacggcttcgagccatgggaggccctgcgtgccgaaccggacgccgcacgccttgccgccgccgaggctgcgctgaaccagaacgatgcgatcaacatccagttcaccagcggcaccaccggctttcccaagggcgccacgctcacccatcgcaacatcctcaacaacggccatttcaccgcccgcacgatcaagctgacccagcgcgaccgcatctgcatcccggtgccgctctaccactgcttcggcatggtcctgggcaatcttgccgcgctcgccagcggggcggcgatggtctaccccggcgaggcctacgatccgcagcttgcgctcgcggcggtggccgaggagggctgcaccgcgctctatggcgtgccgacgatgttcatcaccatcctcgcgcagccggaccttgaccgctacgacgtatcgaccttgcgcaccggcatcatggccggctcgccttgcccggtcagcacgatgcgccaggtcatggaccgcctcaacatgaccgaggtgaccatcggctatggcatgaccgagaccagtccgctcaccacccagacagcgaccgacgatccgctggaagagcgcgtcggcactgtcggccgtgtccatccccatgccgaggcgaagatcgtcgggctcgatggcgaaacgctgcccatcggccagcagggcgaatactgctcgcgcggatatgccgtcatgctgggttactgggacgatccggaaaagacagcagaagccatcgacggcgagggctggatgcattccggcgatctcgcgacgatggacgaacatggctatgtccgtatcaccggccgcatcaaggacatgatcatccgcggcggtgagaatatctacccgcgtgaaattgaggagtttctcctcacccatcccgccgttcaggatgcgcaggtcttcggcgtttcggacgagaagttcggcgaggaagtctgcgcctgggtcatcgcgcggtccggccacgcgctctcgcacgacgatatcctcgcccactgcaagggccgcatcgcacactacaaggtgccgcgccatgtccgcgtggtcgaagccttcgccatgacagtcaccggcaaggcgcagaagttcgagatgcgcaagatgatggaagccgaactcacgcgcacgggctga

SEQ ID NO: 29648 - protein, 543 aa, Novosphingobium aromaticivorans DSM 12444
MTQLSYAKGPADEPLLEKTIGQALRDAAALWGDELALVSRHQQIRWTWAQLDAEVDRIATGLLDRGVAKGDRVGIWAPNCAEWTVLQFATARIGAILVTINPAYRTSEVEYALNKVGCTFLVTAARFKTSDYVAMLRELGPDKLPGVSCMVVLGADRHDGFEPWEALRAEPDAARLAAAEAALNQNDAINIQFTSGTTGFPKGATLTHRNILNNGHFTARTIKLTQRDRICIPVPLYHCFGMVLGNLAALASGAAMVYPGEAYDPQLALAAVAEEGCTALYGVPTMFITILAQPDLDRYDVSTLRTGIMAGSPCPVSTMRQVMDRLNMTEVTIGYGMTETSPLTTQTATDDPLEERVGTVGRVHPHAEAKIVGLDGETLPIGQQGEYCSRGYAVMLGYWDDPEKTAEAIDGEGWMHSGDLATMDEHGYVRITGRIKDMIIRGGENIYPREIEEFLLTHPAVQDAQVFGVSDEKFGEEVCAWVIARSGHALSHDDILAHCKGRIAHYKVPRHVRVVEAFAMTVTGKAQKFEMRKMMEAELTRTG

SEQ ID NO: 29649 - DNA, 1617 bp, Moorella thermoacetica ATCC 39073
  CDS (1)..(1617)
atgcagggggtgattattatggagttcgcctcggtaaaagagctggtaataaccaggggcacccagtaccgcgggaggatatttctttcctcaccggaagatggcgtggatttaacttatgacgcctacctgctggccgtcaggagactggaaaaagcactgctggcgttaggtatgcgcaagggagaaagggtggcccttctcatggcgaacggcctgaattacgccgtcacctttaccggggtgatggcctccggaggcgtagtcgtacccatcaacccgcatttaaaaccggcagaggtgacccggctcctgggagatgccgggaccagcctggttttaactgacgacggatggtacagagtattttaccccctcctgaaggggttacctgttcgccgcttggacctgggggtgcagggcggcaggttgctggccctggagctggcatccgggagtaagggggatgacagagcagttgaggcgtcccctcttggcaggaacgacttagccctcctcctgtacacctccggtactaccggaaagcctaaaggggtgatgctaacccacggtaatttgctggccgaggcgaggtatatccagaaaggacaccggttaacgccggaagatactgccctgtgtatcctgcccctgtatcatataaatggggaagttgtgaccctgatcacccccatcttttccggcgggcgggtagtgatgccccataaattcagggccagcaggttctgggactgggtccggaactaccgggttacatggttcagcgccgttcccaccatcctgtccatccttctttcccatcctctgccggatagatcggccctctcttctttgcgttttgcgcgctccgcctcggcacctttaccggtagccgtcctgcgggaatttgaagcccggttcgccgtccctgttatcgaggcttacggcctgtcggaaaccgccagccaggtaaccaccaatcccctgcccccggcggtgagaaagccgggttccgtggggctgcctgttggcaatcaggtacgggtggtgaacgaaaatggagagaccgtacctgccggtgtcaccggcgaagtcgtagttcgcggggaaaatgtctgccggggttactttcataatgaagaggctactgccgcttctttcaaaggaggctggttttataccggcgaccttggctaccttgatgccgatgggtacctgttccttaccggacggcgcaaagaacttatcaaccggggtggggagaagttttctccccgggagatcgacgagatcttataccgtttacccgaagtagaattagcggcagcagtaggtgtccccgatcccctctacggtgaagaggtggtagccttcatccaactgcgcccgggaaaaagcctggcggaagatcgggtaatatccttcttaagagattacctggcggattttaaggtcccccgggaggtcatctttatccgggattttccccgggggccgagcggaaagattcagcgcctgaagctggtggacctgtatcttaaaaaattccagggagccgcccatggggctggggctggcacccgccccataaatggtgaggaggttgctaaaagatga

SEQ ID NO: 29650 - protein, 538 aa, Moorella thermoacetica ATCC 39073
MQGVIIMEFASVKELVITRGTQYRGRIFLSSPEDGVDLTYDAYLLAVRRLEKALLALGMRKGERVALLMANGLNYAVTFTGVMASGGVVVPINPHLKPAEVTRLLGDAGTSLVLTDDGWYRVFYPLLKGLPVRRLDLGVQGGRLLALELASGSKGDDRAVEASPLGRNDLALLLYTSGTTGKPKGVMLTHGNLLAEARYIQKGHRLTPEDTALCILPLYHINGEVVTLITPIFSGGRVVMPHKFRASRFWDWVRNYRVTWFSAVPTILSILLSHPLPDRSALSSLRFARSASAPLPVAVLREFEARFAVPVIEAYGLSETASQVTTNPLPPAVRKPGSVGLPVGNQVRVVNENGETVPAGVTGEVVVRGENVCRGYFHNEEATAASFKGGWFYTGDLGYLDADGYLFLTGRRKELINRGGEKFSPREIDEILYRLPEVELAAAVGVPDPLYGEEVVAFIQLRPGKSLAEDRVISFLRDYLADFKVPREVIFIRDFPRGPSGKIQRLKLVDLYLKKFQGAAHGAGAGTRPINGEEVAKR

SEQ ID NO: 29651 - DNA, 1590 bp, Desulfitobacterium hafniense DCB-2
  CDS (1)..(1590)
atgagttacagtgatttgggcaataaagttgaacgcctggcaggttccctgcaaaagctgggtattgatcccggggatcgggtggcccttttgctggctaattgtccccaatacgtgattgcttattacgctatccttgccattggcggggtggtcgttcctgtcaatcctctcagtaccgaatcagaattattgcatatttttcgggatgctcaggtcaaagcagccatttgtctggaccttctggccgagcggctggaaaatgtgagagacatttgtcatcaggccggagagacccaattgctgaagcataccttctatacggctctcaatgagtatatgccttttcctcttaaatttctttatccattcacacggaagctgtccccgggaggtaaggaacgcctcaaagttgccgggaggtttaaggatctgctgaatgagggcaacggtcccgtgctaaaagattatccgtcccaaaaagtggatgttcgtaaggatatagcggtcctcatctataccggcggcactaccggacgccccaagggagtgatgctttcccattatggtttgcttgccaatgcttatcaggcgatagcctgggttcaaatgggcagcaaggatcgtttggtcactgttctcccggcctttcatgggtttggcatgtccgtgtgcatgaatgctcccttattctccggagcttcaacgattctgattccccgctttgaagcgaaagatgtcctgaaagccattcacaagcataagcccacgtattttgccggagttccgacgatgtatataggcatgattaattacccccaattaaaacgctatagcctttcctccttagtggggtgtttcgtgggggcggctgctctggcccccgaggttaaacgaagcttcgaagagcttaccggagccaggctgatggagggatacggtctcactgaaggggtcaatgccctctgctgcaatcccttgcggggggaaaacagaaccggcagcatcggttttcctttcccggatgtggactttaaaatcagggacattgacaccggtgaagaggagctgcctcccggtgaatcgggagaactggtgattcagtgtccggacttaatgctgggctactataaccggccggaagagacggcctacgctttaagggatggctggctatacaccggagatatcgcgaccatggatgaagacgggtatttttatcttgtggaccgtaaaaaggatatgattatcaccggtggcttcaatgtctatccccgggaagtagaggatgtgctgtatgaacacccggcagtcagggaggcctgtgtgatcggggttaaggacggttacagcggggaaaaggtagtggcttttgtcagccttaaagatggagctgccgctacagagcaggatgtcatcgccttttgccgcaaacacctggtcccttataaagttcctaaaaccgtagaattccgtaccgatttacctaagacggctattggcaagatcctgcgccgggccttacgggatactcctcctgcagaaggggaagcaaaacagagtgccaaggaagcggcagcgacgaagtag

SEQ ID NO: 29652 - protein, 529 aa, Desulfitobacterium hafniense DCB-2
MSYSDLGNKVERLAGSLQKLGIDPGDRVALLLANCPQYVIAYYAILAIGGVVVPVNPLSTESELLHIFRDAQVKAAICLDLLAERLENVRDICHQAGETQLLKHTFYTALNEYMPFPLKFLYPFTRKLSPGGKERLKVAGRFKDLLNEGNGPVLKDYPSQKVDVRKDIAVLIYTGGTTGRPKGVMLSHYGLLANAYQAIAWVQMGSKDRLVTVLPAFHGFGMSVCMNAPLFSGASTILIPRFEAKDVLKAIHKHKPTYFAGVPTMYIGMINYPQLKRYSLSSLVGCFVGAAALAPEVKRSFEELTGARLMEGYGLTEGVNALCCNPLRGENRTGSIGFPFPDVDFKIRDIDTGEEELPPGESGELVIQCPDLMLGYYNRPEETAYALRDGWLYTGDIATMDEDGYFYLVDRKKDMIITGGFNVYPREVEDVLYEHPAVREACVIGVKDGYSGEKVVAFVSLKDGAAATEQDVIAFCRKHLVPYKVPKTVEFRTDLPKTAIGKILRRALRDTPPAEGEAKQSAKEAAATK

SEQ ID NO: 29653 - DNA, 1989 bp, Anabaena variabilis ATCC 29413
  CDS (1)..(1989)
atgaatatttcccaaaatgtggagcgtggttgctgcctttttcctaacaaaccagcgctcatttttgaaggtttatattttacttataaacaactcaatgaaatggcaaatcgcgttgccaatgctttactggggttggggattgaacgtggcgatcgcatagcattattattaccaaatattcctgaatttgtgatttcctatctagggattctcaagattggggcgatcgcagtttctattaacccaaatctgcaaagcgatgaactcaagtttattctcaatgactgtggagcagctgtactcgtaaccacagaaacgctgcgagaaaaattgcccaaagtcgatttaccccacctcaagcacatcataattgctgaggggcaagcaggtgaggcgatcgccttgagtgaattcatggccaatgcttcccctaacgcccgtgctgtggagatagaacgtgatgagccagcagcgattctttatacttctggtacaacaggttttcctaaaggcgctactttatctcatggcaatgtgatttccaatatgcactccatgaagcactgttgtgaaatgcgccctaatgatcaaattttactatttttaccgatgttccactgttttgggcagaacgcagttctcaatagtggactgaatacctgtgcaacgatcattttacagcgatcgttcgacccagaaacggtactgacaaccatcagcgaatataatattacaatcttttttggtgttcccactacttttattcttttatgtgataaagcatctatccgcgatttggattcagtgcgttactacttctctgcggccgcaggtttgcctgtagaaattgccaaacgttggcaagacaagtttggtaaagtcatcaaccaagggtatggtctgacagaaacatcaccattagctagttataaccacgaattgaggtacaaactcggttctattggttcaccaattgaaaatgtcgagatgaagattgtcagcctggatgatggttgcgaagttgcccctggtgaactcggtgaaatcgtgattcgcggtgtcaatgtcatgctaggttactggaatcgcccggctgaaactgccaaagccatgaagaacggatggtttcacaccggtgacattggtcaaatagacgaattaggctacttttacatcgttgaccgcctcaaagatatgatcaacaacggtggattaaaagtatacccagccgaagttgaaaatgttatttaccagcatccaggtattgcagaggtagctgtctacggtgtaccagattcagtactaggtgaacaggtgaaagctagtattgtcctcaaaccagaccaagcggttacagaagcagaaatcattgccttctgttaccagaaactagctcaatataaagttcctagtgccgtcgaatttgtctcctccatccccaagaaccccacaggcaaaatactcaagcggctacttcggcaagaaaattctgctgcgccttcccatactgtggttagcaaaacgcaaacatctgcgtcggtaaaagtctcttaccaaactgcagaattgatcgaaaactggattatcgattgggtagtgagaaaattggcagtagcagcccagtcaatcgaccaaagtaagtcatttgcagattatggattagattccgtcagggctgtcaagttagcccaagaattgagtgaatggttgggatatcccttagaagcaactatagtctggaacttctcgaccatcgaatctttagcacgccacctagccagtcaaaaaattacccaaccgacagaattagccaagacaaagccagagtctaatctgcacacagaaaatctgttggtgtctgtagaattgccgacaaacaacgcagaaccgaccgaatcagcagacttaaaagcactctcagacgcggaaatagctgaattactcaccaaagaaattgccacagttaaacaaaggagattagtatga

SEQ ID NO: 29654 - protein, 662 aa, Anabaena variabilis ATCC 29413
MNISQNVERGCCLFPNKPALIFEGLYFTYKQLNEMANRVANALLGLGIERGDRIALLLPNIPEFVISYLGILKIGAIAVSINPNLQSDELKFILNDCGAAVLVTTETLREKLPKVDLPHLKHIIIAEGQAGEAIALSEFMANASPNARAVEIERDEPAAILYTSGTTGFPKGATLSHGNVISNMHSMKHCCEMRPNDQILLFLPMFHCFGQNAVLNSGLNTCATIILQRSFDPETVLTTISEYNITIFFGVPTTFILLCDKASIRDLDSVRYYFSAAAGLPVEIAKRWQDKFGKVINQGYGLTETSPLASYNHELRYKLGSIGSPIENVEMKIVSLDDGCEVAPGELGEIVIRGVNVMLGYWNRPAETAKAMKNGWFHTGDIGQIDELGYFYIVDRLKDMINNGGLKVYPAEVENVIYQHPGIAEVAVYGVPDSVLGEQVKASIVLKPDQAVTEAEIIAFCYQKLAQYKVPSAVEFVSSIPKNPTGKILKRLLRQENSAAPSHTVVSKTQTSASVKVSYQTAELIENWIIDWVVRKLAVAAQSIDQSKSFADYGLDSVRAVKLAQELSEWLGYPLEATIVWNFSTIESLARHLASQKITQPTELAKTKPESNLHTENLLVSVELPTNNAEPTESADLKALSDAEIAELLTKEIATVKQRRLV

SEQ ID NO: 29655 - DNA, 1650 bp, Polaromonas sp. JS666
  CDS (1)..(1650)
atgatcgaatcccaactgagcccccaactggttcaacaagcccgggccggcggccactggcacaacaagaccctgctcgacttcctggatgaagtcgcgcccagccgcctcgacaaagtggccgtgaccgacctcaacagcatgaccgggcaggcgaacaccttgtcgtaccggcaactgctgcgcctgtccaaacgcatcgcgctcggtctggcggcgctgggcgtgcagcggggcgatgtggtctcgtaccagttgcccaactggtggcagttcgtggcactgcacctggcctgcctgcgtatcggcgcggtcaccaacccggtgatgccgatctttcgccatcacgagttgaccttcatgctggggctggccgaatcgaaggtcatgatcgtgccgcgcgagtttcgcggttttgaccatgccgcgatgctgcgcgaaattcagccggcgctgccgcagctcaagcatatctttgcaattggcggcgaaggcgacatgtcgttcgagaagcacttcatcgagcgccgctgggagcaggaaacgcccgatgccgaccaggtgctggccgagcgccgcctgcgcccggacgaagtgatgcagttgctgtacacctccggcaccaccggtgagcccaagggcgcgctgcacacctccaacacccatttcgcgaacatcgtcgaggttgtcaagcgttgcggcctgacggccgagcatgtgtgcttcatgccctcaccgatggcgcaccagacgggttttgccatcggcatggaactgccgcttatgctgggcgccaaaatggtgctgcaagacatctgggagccggaactggccctgacgcggattcaggacgaaggcgtgaacttcatgatggcggccacccccttcctggccgacctgacggatcatccggacctgccgcgctatgacatttccacgctggatgttttcatctcggctggcgcgcccatcccccgcacactggtcgagcgcgccactgagcgcctgaaggcgcacatcgtgtcggcatggggcatgacagagaatatcctggtcaccggcacacgactggacgatgttcccgagaaggtgttcggcaccgacggcgtgccagtgccgggcatggaaatccgcgtcgtcgatgccgcggggcaggcgctggccgtggaccaggagggcgagctgcaatcgcgggggccgagccacttcgtgggctacctcaagcgccccgaacgctacgacatggatgatcagggctggttcaagaccggcgacctggcgcgcatcgacgccgacggctgcgtgcgcatcaccggccgggccaaggacatcatcatccggggcggcgagaacgtgccggtggtcgaggtcgagcagatgctgcaccgccatctggccatacagacggccgccgtggtcggcgtgcccgatgcgcggctgggcgagcgcgcggtggcctatgtcacgctcaggccgggtcacggtctcacgttcgagcagatgaagcgctttcttgaagagcagcgcatgaccaagcagtattggccggaaaccttgatcgtcctggacgacttgccgcgcacacccaccggaaagatccagaagttccgcttgcgcgagatggcgcgtgctgaaaacaagaccgattga

SEQ ID NO: 29656 - protein, 549 aa, Polaromonas sp. JS666
MIESQLSPQLVQQARAGGHWHNKTLLDFLDEVAPSRLDKVAVTDLNSMTGQANTLSYRQLLRLSKRIALGLAALGVQRGDVVSYQLPNWWQFVALHLACLRIGAVTNPVMPIFRHHELTFMLGLAESKVMIVPREFRGFDHAAMLREIQPALPQLKHIFAIGGEGDMSFEKHFIERRWEQETPDADQVLAERRLRPDEVMQLLYTSGTTGEPKGALHTSNTHFANIVEVVKRCGLTAEHVCFMPSPMAHQTGFAIGMELPLMLGAKMVLQDIWEPELALTRIQDEGVNFMMAATPFLADLTDHPDLPRYDISTLDVFISAGAPIPRTLVERATERLKAHIVSAWGMTENILVTGTRLDDVPEKVFGTDGVPVPGMEIRVVDAAGQALAVDQEGELQSRGPSHFVGYLKRPERYDMDDQGWFKTGDLARIDADGCVRITGRAKDIIIRGGENVPVVEVEQMLHRHLAIQTAAVVGVPDARLGERAVAYVTLRPGHGLTFEQMKRFLEEQRMTKQYWPETLIVLDDLPRTPTGKIQKFRLREMARAENKTD

SEQ ID NO: 29657 - DNA, 1746 bp, Polaromonas sp. JS666
  CDS (1)..(1746)
atggagacagacatgacgcaaaccccctcggccccaaccggcctgagcctggcgtgcggcgccaccgaggtgccgctgatagcgcagaccctgggcgacttttttgatgccatggtggagcgccagcccggagccgaggccctggtcagcgttcaccagaagctgcgctatacctatcgcgaactgcaaaccgaggccaaccggctggccagcgcgttgctcgggctgggtctgctgtccggcgaccgcgtgggcatctggtcgcacaacaatgcacagtgggtgctgatgcagctggccacggccaaggtcgggctgatcctggtcaacatcaatcccgcctaccgtgtggccgagctcgagtacgcgctcaacaaggtgggctgcaaggcgctggtcaccatggcgcgcttcaagaccagcgactacctcggcatgctgcgcgagctggcgccggaatgggcgcacgcgcagccgggccggctggagtcggccaggctgccccatttgcacaccgtggcctggatcgacgagccggggcagggcgccgagctggacgaggacttgcccggcctgctgcgcttttccgcgctgctggccagcggccagccgcaggacccgcggctggccgaggtggcccgcacgctcaaggctggcgacccgatcaacatccagttcaccagcggcaccacggggttcccgaagggcgcgacactgacgcaccgcaacatcctgaacaacggctttttcatcggcgaggccatgaagctcacgccggccgaccgcctgtgcattccggttccgctgtaccactgcttcggcatggtgctgggcaacctggcctgccttacgcatggcgcgaccatcgtctacccgaacgacggtttcgacccgctgagcgtgctgcaaaccgtgcaggacgagaaatgcacgggcctgcacggcgtgcccaccatgttcatcgccgagctcgaccatccgcgcttcaaggagttcgatctgtccacgctgcgcaccggcatcatggccggctcgccctgcccgatcgaggtcatgaagcgcgtggtcggtgagatgcacctgtctgaaatcacgatcgcctacggcatgaccgaaaccagcccggtcagctgccagagctcgaccgacacgccactggaaaagcgcgtggccaccgtgggcctggtgcagccgcacctggaagtcaagatcgtcgaccccgaaagcggcgagatcgtcgcgccgggcgtctcgggcgagctgtgcacgcgcggctattcggtcatgcacggctactgggaggacgaggccaggacggctgaggccatcgatgccgaaggctggatgcacaccggcgacctggccaccatggatgccgaaggctatgtcaatatcgtcggccgcatcaaggacatggtgatacgcggcggcgagaacatctacccgcgcgagatcgaggaattcctctaccgccaccccaaggtgcaggacgtgcaggtggtgggcgtgcccgacccgaaatacggcgaggagctctgcgcctggatcatcgtcaagcccggccagtctgtgaatgaggaagagattcgcgccttttgcaagggccagattgcgcactacaaggtaccgcgctacattcgttttgtgtcgggctttcccatgacggtgaccggcaaaatccagaagttcaagattcgcgacgaaatgaagcaccagctggggctggaagaagacaaaaccgcttga

SEQ ID NO: 29658 - protein, 581 aa, Polaromonas sp. JS666
METDMTQTPSAPTGLSLACGATEVPLIAQTLGDFFDAMVERQPGAEALVSVHQKLRYTYRELQTEANRLASALLGLGLLSGDRVGIWSHNNAQWVLMQLATAKVGLILVNINPAYRVAELEYALNKVGCKALVTMARFKTSDYLGMLRELAPEWAHAQPGRLESARLPHLHTVAWIDEPGQGAELDEDLPGLLRFSALLASGQPQDPRLAEVARTLKAGDPINIQFTSGTTGFPKGATLTHRNILNNGFFIGEAMKLTPADRLCIPVPLYHCFGMVLGNLACLTHGATIVYPNDGFDPLSVLQTVQDEKCTGLHGVPTMFIAELDHPRFKEFDLSTLRTGIMAGSPCPIEVMKRVVGEMHLSEITIAYGMTETSPVSCQSSTDTPLEKRVATVGLVQPHLEVKIVDPESGEIVAPGVSGELCTRGYSVMHGYWEDEARTAEAIDAEGWMHTGDLATMDAEGYVNIVGRIKDMVIRGGENIYPREIEEFLYRHPKVQDVQVVGVPDPKYGEELCAWIIVKPGQSVNEEEIRAFCKGQIAHYKVPRYIRFVSGFPMTVTGKIQKFKIRDEMKHQLGLEEDKTA

SEQ ID NO: 29659 - DNA, 1647 bp, Populus balsamifera subsp
  CDS (1)..(1647)
atggaggccaataaggatcaagtacaagaattcattttcaggtccaaactccctgacatctatatcccaaaccacctccctttacacacttattgcttcgaaaagctttcccaattcaaagacaacccttgcttgatcaatggccctaccggtgatatctacacttatgcggatgttgagctcacatcacgcaaagttgcctctggcctctacaagttaggcctccaacaaggcgatgttatattgctcttgctccaaaactcgccagaatttgtttttgcattccttggagcgtcgttcattggcgctattagctcaactgcaaaccctttctatacttcagctgagatcgcaaaacaagcaacagcatcaaaggcaaagctgataataacacatgcagcgtacgccgagaaagtgcaacagtttgctcaagaaaatgatcatgttaagataatgaccatcgattctcttacagaaaactgcttgcatttctcagagttgacaagctctgatgagaatgaaatccctactgtcaagattaagcctgatgatatcatggcactcccatattcgtcagggactacaggtctccctaaaggtgtcatgttgactcataaagggcttgttactagtgtggcacaacaagttgatggagagaaccctaatctctattttcacgagagggatgtgattctttgtgtgctgcctttgttccacatctattcactcaattccgtattcctttgtgggctaagagctggttcagcaattttggttatgcaaaaattcgatacggtttcattaatggaccttgtacagaaatataaggtgacaattgctccactcgtgccccctatctgtctggcaattgcaaaaagtccagtcgttgatcagtatgatctttcttcgatccggacagtactgtctggcgcagcacctttggggaaggagcttgaggatacagtcagagctaagctgcctaatgctaaacttggacagggatatggaatgacagaggcagggcccgtgatagcaatgtgcttagcttttgcaaaggaaccctttgagattaaatctggcgcatgtgggactgttgttagaaatgcagagatgaagattgtcgacccggaaaccggtgagtcccagccgcgaaataaaaccggcgagatttgcattaggggttgccaaataatgaaaggttatctaaatgatcctgaggcaactgaaaggacgatagacaaagatggatggttgcacacgggtgatattggatacattgatgaagatgaactctttatcgtggatcgtttgaaagaattgatcaaatacaaaggtttccaagtagcacctgctgagcttgaagcaatgttgattgctcatcccaacatctctgatgctgctgtagtacccatgaaagatgaagctgccggagaggttccggttgcttttgtggtgcgatcaaatggttccaagatcaccgaggatgaaatcaaacaatatatctcaaaacaggtgatcttttataagagaatcggtcgggttttcttcacggaggccatccccaaggccccgtcgggaaaaatcttgagaaaggacctcagagcaagggtttctgctggtgatcttccatgcacatcagattcctaa

SEQ ID NO: 29660 - protein, 548 aa, Populus balsamifera subsp; identical to SEQ ID NO: 14041

SEQ ID NO: 29661 - DNA, 1674 bp, Populus balsamifera subsp
  CDS (1)..(1674)
atggaggcgaaaaatgatcaagcacaagaattcattttcaggtccaaactccctgatatccacatcccaaaccacctccctttacacacttattgctttgaaaacctttcccgattcaaagacaatccctgtttgatcaatggccctaccggtgaaatccacacctacgcggaagttgaactcacatcacgcaaagtcgcttccggtctcaacaagttaggcatcaaacaaggcgatgttatattgctgttgctccaaaactcgccagaatttgtgtttgcgtttctcggagcatcaattattggtgctattagcacaaccgcaaaccccttctacactcccgctgaggtcgcaaaacaagcaacagcatcaaaggcaaagctgataattacacaggcagtttacgccgagaaagtgcaagaattcgtcaaggaaaatgtccatgtcaaaatagtgaccgttgactctccaccagaaaactacttgcatttttcagagttgacaaattctgatgaggatgatattcctgctgtcgagattaaccctgatgatgtcgtggcactcccttattcgtcagggacaacaggtctccctaaaggtgtcatgttgactcataaagggctcgttactagtgtggcacaacaagttgatggagagaaccctaacctctattttcacgagaaggatgtgattctttgtgtgttgcctttgttccacatctactcgctcaattccgtgttactttgtgggctaagggttggttcagcaattttgcttatgcaaaaattcgagattgttacgttaatggagcttgtacaaaaatataaggtgacaattgcgccatttgtcccccctgtcgtcctcgcagttgcaaaatgtccagtcgttgataagtatgatctttcttccattcggaccgtaatgtctggcgccgcaccaatggggaaggagcttgaggatacagtaagggctaagctgcctaatgctaaacttggacagggatacggaatgacagaggcagggcccgtgctatcgatgtgcttggcatttgcaaaggaaccctttgaaattaaatcaggtgcctgtgggactgttgttagaaacgccgagatgaagattgttgaccccgataccggtagatccctgccacgaaatcaatccggagagatttgcattagaggtagccaaatcatgaaaggttatctaaatgaccctgaggccactgaaaggactgtagacaatgatggatggttgcacaccggcgacattggatacatcgacggagatgatgagctctttatcgttgatcgactgaaagaattgattaaatacaagggttttcaagtagcacctgctgagcttgaagcaatgttgattgctcatcccgacatctctgattgtgctgtagtacccatgaaagatgaagctgccggagaggttcctattgcttttgtggtgcgagcaaatggttccaagattaccgaggacgaaatcaaacaatatatctcaaaacaggtggtcttttacaagagaattagtcgggtgttcttcacggaagcgattcccaaggctccatccggaaaaatcttgagaaaagacctaagagcaaggcttgcaactggcgacttcctcattaaattccaacatgacacatacatgcaaaaacagcagtag

SEQ ID NO: 29662 - protein, 557 aa, Populus balsamifera subsp; identical to SEQ ID NO: 14043

SEQ ID NO: 29663 - DNA, 1608 bp, Populus tremuloides
  CDS (1)..(1608)
atgaatccacaagaattcatctttcgctcaaaattaccagacatctacatcccgaaaaaccttcccctgcattcatacgttcttgagaacttgtctaaacattcatcaaaaccttgcctgataaatggcgcgaatggagatgtctacacctatgctgatgttgagctcacagcaagaagagttgcttctggtctgaacaagattggtattcaacaaggtgacgtgatcatgctcttcctaccaagttcacctgaattcgtgcttgctttcctaggcgcttcacacagaggtgccatgatcactgctgccaatcctttctccacccctgcagagctagcaaaacatgccaaggcctcgagagcaaagcttctgataacacaggcttgttactacgagaaggttaaagattttgcccgagaaagtgatgttaaggtcatgtgcgtggactctgccccggacggtgcttcacttttcagagctcacacacaggcagacgaaaatgaagtgcctcaggtcgacattagtcctgatgatgtcgtagcattgccttattcatcagggactacagggttgccaaaaggggtcatgttaacgcacaaagggctaataaccagtgtggctcaacaggtagatggagacaatcctaacctgtattttcacagtgaagatgtgattctgtgtgtgcttcctatgttccatatctatgctctgaattcaatgatgctctgtggtctgagagttggtgcctcgattttgataatgccaaagtttgagattggttctttgctgggattgattgagaagtacaaggtatctatagcaccagttgttccacctgtgatgatggcaattgctaagtcacctgatcttgacaagcatgacctgtcttctttgaggatgataaaatctggaggggctccattgggcaaggaacttgaagatactgtcagagctaagtttcctcaggctagacttggtcagggatatggaatgaccgaggcaggacctgttctagcaatgtgcttggcatttgccaaggaaccattcgacataaaaccaggtgcatgtggaactgtagtcaggaatgcagagatgaagattgttgacccagaaacaggggtctctctaccgaggaaccagcctggtgagatctgcatccggggtgatcagatcatgaaaggatatcttaatgaccccgaggcaacctcaagaacaatagacaaagaaggatggctgcacacaggcgatatcggctacattgatgatgatgatgagcttttcatcgttgacagattgaaggaattgatcaagtataaagggtttcaggttgctcctactgaactcgaagctttgttaatagcccatccagagatatccgatgctgctgtagtaggattgaaagatgaggatgcgggagaagttcctgttgcatttgtagtgaaatcagaaaagtctcaggccaccgaagatgaaattaagcagtatatttcaaaacaggtgatcttctacaagagaataaaacgagttttcttcattgaagcaattcccaaggcaccatcaggcaagatcctgaggaagaatctgaaagagaagttgccaggcatataa

SEQ ID NO: 29664 - protein, 535 aa, Populus tremuloides; identical to SEQ ID NO: 14053

SEQ ID NO: 29665 - DNA, 1713 bp, Populus tremuloides; identical to SEQ ID NO: 14054
  CDS (1)..(1713)

SEQ ID NO: 29666 - protein, 570 aa, Populus tremuloides; identical to SEQ ID NO: 14055

SEQ ID NO: 29667 - DNA, 1911 bp, Lithospermum erythrorhizon
  CDS (1)..(1911)
atggacactcaaaccaaaacagaccaaaaagacataatcttcagatcaaaactccctgatatatacatcccaaaacatctgccattgcattcttattgtggtgaaaacatttctcaattcagctcaagaccatgcttaataaatggctcaaatgatagagtatatacttatgcagaagttgaaataacttcaagaaaagttgcagcagggcttcataaacatgggatcaaacaaactgaaaccatcatgcttttgctcccaaattgccctgaatttgtttttgcatttcttggtgcttcatatataggagcagtctccacaacagccaacccatttttcacctcctctgaaatcatcaaacaagccaaagcatccaaaacaaagctcatcatcacagtatccaccactgtcccaaaactcaaggacttttctcaagaaaaccatgtcaagatcatgtgcattgatgataaaattgatggttgtctccatttctcatcagaccttgaaaattcagacgaaaccaccttgccagacgtcgaaatccgccccgacgacgtcgtggcattaccctattcgtcagggactacagggctaccaaaaggagtcatgcttactcacaaaggactagtaacaagtgttgcacaacaagttgatggagacaatgcaaacttgtatatgcatcacgaagatgttgtgatgtgcactttgcctctattccatatatattcaatgaattcaatcttgctttgtggattaagagttggggctgcaatattattaatgcataaatttgagattgtcacatttcttgaattgatacaaaggtataaggtgacaattggaccatttgtgcccccaattgtgttggctattgctaagagtaatgtggttgatcagtatgatttgtcgacggtgaggaccgtcatgtcaggggcggcaccgctagggagtgagcttgaagatgctgttagagcaaagttccctaatgcaaaacttggtcagggttatgggatgacagaagcagggccagtgttggctatgtgtctggcttttgcaaaagagccatttgagatcaaatcaggggcatgtggtacagtcgttagaaattcagagatgaaaatcatagacaccgaaactggtgcctctttgcctcgtaaccaatctggtgaaatttgcattaggggagaccaaattatgaaaggttatctgaacgatcccgaggcgacagagaggacaatagacaaagaggggtggttacatacaggtgatattgggtacattgatgatgatgatgagcttttcattgtggatcgtctgaaagagcttattaaatataaggggttccaagttgctcctcctgaacttgaagctcttcttgttcctcatcctaatgtctctgatgctgcagttgtctcaatgaaagatgagggggcaggagaggtgccagttgcatttgtcgtgaggtcaaatggttccacaaccactgaggatgaaatcaagcaattcgtatctaaacaggtgatattctacaagagaataaaccgtgtgtttggtgtggactcaattcctaagtctccatctggaaagattgtgaggaaagacttgagagccaagttggctgctagattcctcaatggtcctacaactaatgtggtgccaaatggtggtaatgtagctaaagataatgtgccaaatggggtgtccaacggcgtttcgaaggccaatggtggcgttgctaaagaaggggttgctaacggagtaccaactgacggcgactatggtgtagctacaaaaggagttgcaaatggtatttccaacggtgtttataaacaagtgtcaaatggtgttgtttcaaatggagtggcaaatgggattgtttcaaatgggattgcaaatggtgtacacaattag

SEQ ID NO: 29668 - protein, 636 aa, Lithospermum erythrorhizon; identical to SEQ ID NO: 14083

SEQ ID NO: 29669 - DNA, 1758 bp, Lithospermum erythrorhizon
  CDS (1)..(1758)
atgttgtctgtagcttcccctgaaacccaaaagccagagctttcctccattgctgcccccccttcttccaccccccaaaaccaatcctccatttctggagataacaactccaatgaaaccatcatcttcagatccaaactacctgatatacccatctccaataacctccctctccacacatactgcttccagaatgcttctgaataccccaacagaacatgcatcattgatagcaaaactggaaaacaatacactttttctgaaacagattcaatctgcagaaaagttgcagctggattatcaaatcttggcatccaaaaaggagatgtgatcatggtcctcctccaaaactgtgctgaattcgttttcaccttcatgggtgcttccataataggtgcagtcatcaccacaggaaaccccttctacacaactgcagaaatcttcaaacaagtcaacgtctccaacacaaaactcatcattactcaatccaactacgttgacaagctccgtaacaccaccataaacgaatccgacaacaaatatccaaaacttggagaggattttaaggtgatcacaattgatacccccccagaaaactgcctacccttttcactcctcattgaaaacacccaagaaaaccaagttacatcagtttccatcgactcaaacgacccaatagcattaccattttcctcaggcaccacagggttaccaaaaggagtgatcctaacacacaaaagcctcattacaagcgttgcacaacaagtagatggagacaacccaaacttgtacctaaaacatgatgatgtagtactatgtgtacttcctttgttccatatatactccctaaattcagtacttttgtgttcattaagagctggagcagcagtgttgatcatgcagaaatttgagataggggcattgttggaacttatacaaagccaccgtgtatcggtggcggcggtggtgcctccgctagtattggcgttggcaaagaatccaatggtggataaatatgatctgagttcgataagggtggtgttgtcgggggcggcgccgctggggagggagttggaactagcgttacttaatagagtcccacatgccatttttgggcagggttatggcatgactgaagctggaccagtactatcaatgtccccttcatttgcaaagcacccatacccagcaaaatccgggtcatgtggaactgtagttagaaatgcagacctcaaggtgattgaccccgaaaccggttcctccctcggccgaaaccaacctggagaaatttgcattcgtggcgaacagatcatgaaaggctatctcaacgaccccgaggcaactgccaggaccgttgacatcgaggggtggctccataccggtgacattggctatgtggacgacgatgatgaagtgttcattgttgatagggtgaaggaactcatcaaattcaaggggttccaagttccaccagctgagcttgaggctctcctcatttcccaccccaacattgctgatgctgctgttgtaccgcaaaaagatgctgctgctggagaagtccctgttgcttttgtggttccttctaatgatggctttgaattaacagaagaagctgtcaaagaattcatttctaaacaggttgtgttctacaaaaggttgcacaaggtgtactttgtccactctattccaaagtcgccgtccggcaagattttgaggaaagatctcagagccaaactggccgccgccgcctcctcttga

SEQ ID NO: 29670 - protein, 585 aa, Lithospermum erythrorhizon; identical to SEQ ID NO: 14085

SEQ ID NO: 29671 - DNA, 1629 bp, Nicotiana tabacum
  CDS (1)..(1629)
atggagaaagatacaaaacatggcgatataattttcagatcaaaactccctgatatttacatccctaatcatcttcctttacactcttactgctttgaaaacatttcagagttcagttctcgaccttgtttaatcaatggagccaacaaacaaatttatacgtatgctgatgttgaactcagttcaagaaaagttgctgctggtcttcacaaacaagggatccaacaaaaggatacaatcatgatcctattgcctaactccccagaatttgtgtttgctttcattggtgcatcgtaccttggagctatttctacaatggccaatcctttgtttacggccgctgaggttgtgaagcaagtcaaggcttctggtgctaagatcattgtcacacaagcgtgtcatgttaacaaagtgaaagattatgctttggagaataatgttaagatcatatgcatcgactcggcaccggagggttgtctccacttctccgtgctaactcaggccgatgagcacgatattcctgaggtagaaatccaacccgatgatgtggtggcgttgccctactcctctgggacgactggattacctaaaggagtgatgttgacacacaagggacttgtcacaagcgtggcacaacaagtcgatggtgaaaatcggaatttgtatatccatagcgaggacgtgttgctttgtgtcttgcccttgtttcatatctattccctcaactccgttttgctttgtggattaagggttggagcagcgattttgattatgcagaaatttgatattgttccattcttggagttgatacaaaattacaaggtgacaatagggccgtttgtaccgcctattgtcttggccattgctaagagtcctatggttgatgattatgatctttcatcagtaagaactgtcatgtctggggctgcaccattaggaaaggagcttgaagacactgttcgagccaaatttcctaatgctaaacttggtcagggttatggtatgacagaagctggaccagtgttggcaatgtgcttggcatttgcaaaagaaccctttgaaataaaatcaggggcatgtgggacagttgtgagaaatgctgagatgaaaattgtggatcctgaaactggtaattctcttcccaggaatcagtctggagaaatttgcataagaggagaccaaatcatgaaaggctacctgaatgatccagaggccacagcaagaacaatagacaaagaaggatggttatatacaggtgacattggctatattgatgatgacgacgagctttttattgtggatcgattgaaggagctgattaaatacaaaggatttcaagttgcacctgctgagctcgaagctctccttctcaaccatccaacattttctgatgctgctgttgtccccatgaaagacgaacaagcggaagaagttccagtggcttttgttgttagatccagtggatccaccattactgaagatgaagtcaaggatttcatctcaaagcaggtgatattttataagaggataaagcgggtatttttcgtggatgctgttcctaaatctccatctggcaaaatccttcgaaaagatttgagagctaaactggctgctgggcttccaaattaa

SEQ ID NO: 29672 - protein, 542 aa, Nicotiana tabacum
MEKDTKHGDIIFRSKLPDIYIPNHLPLHSYCFENISEFSSRPCLINGANKQIYTYADVELSSRKVAAGLHKQGIQQKDTIMILLPNSPEFVFAFIGASYLGAISTMANPLFTAAEVVKQVKASGAKIIVTQACHVNKVKDYALENNVKIICIDSAPEGCLHFSVLTQADEHDIPEVEIQPDDVVALPYSSGTTGLPKGVMLTHKGLVTSVAQQVDGENRNLYIHSEDVLLCVLPLFHIYSLNSVLLCGLRVGAAILIMQKFDIVPFLELIQNYKVTIGPFVPPIVLAIAKSPMVDDYDLSSVRTVMSGAAPLGKELEDTVRAKFPNAKLGQGYGMTEAGPVLAMCLAFAKEPFEIKSGACGTVVRNAEMKIVDPETGNSLPRNQSGEICIRGDQIMKGYLNDPEATARTIDKEGWLYTGDIGYIDDDDELFIVDRLKELIKYKGFQVAPAELEALLLNHPTFSDAAVVPMKDEQAEEVPVAFVVRSSGSTITEDEVKDFISKQVIFYKRIKRVFFVDAVPKSPSGKILRKDLRAKLAAGLPN

SEQ ID NO: 29673 - DNA, 1629 bp, Betula platyphylla
  CDS (1)..(1629)
atggctatccaagcaaaagagcaagaattcattttccggtctaaacttccggacatttacattccaaaacatctccccatccactcctattgcttcgaaaacatatccaaggtcggctcgcgcccgtgtttgatcaatggcttgaccggcaaggtatacacgtattatgatgttgagctcaccgcgcgtaaggtcgcttccggccttagcaagctcggcattcagaagggagatgttgtcatgcttttgctacccaactcgccggaattcgccttcgtattcctcggggcttcttatttaggggccatgaccacggctgccaaccctttctgcacagccggggaggtctcaaagcaagcgaaatcggccaacgcaaaaatcgttgtcacccaagcttgttactacgacagagtgaaggactacacaaatgaaaacggtgttaagattatctgcatcgactcgcccccagaagactgcttgcatttctcggagctaactaaggccgacgagaacgacgtcgccgaggtggatattagccccgacgacgtcgtggcgctgccgtactcttcggggacgactgggttgccaaaaggggtgatgttaacgcacaaagggctggtgactagcgtggctcaacaagtggacggagaaaacccaaacctctattatcacagcgaggacgtgatcctgtgcgttttgccgctgtttcacatttactctctcaactcggtcttcctttgcggcctgcgagcgggtgcttcgattctgatattgcccaagtttgagattgtttcgttgttgcagctgatacagaaacataaggttactgtcatgcccattgtcccgccgattgtgctggccataactaagttcccagatctcgataagtacgacctgtcgtcggtaaagatgctcaagtccggcggagcgccgctggggaaggagattgaagaaactgtgaaagccaagtttcccaatgctctatttggtcagggatacggaatgacagaggcaggtccagttttggcaatgtgcttggcatttgccaaagaaccaatggaggtgaaatcaggagcatgtggtactgttgtgaggaatgcagaaatgaaaattgtcgaccccgaaaccggtgcctctttgccccgaaaccaaccaggagaaatatgcattagaggagatcagatcatgaaaggttatattaatgatccggaagccacggcaagcaccatagacaaagaaggttggttacacaccggcgacattggcttaattgacgacaatgatgagctctttatcgttgaccggttgaaggagctgatcaaatacaaagggttccaggtagcccccgctgagcttgaggccttgttgctcacccacccaaacatctctgatgccgccgtcgtcccaatgaaggacgatctagctggagaggtccctgtggcatttgtggcgagatcaaacgggtctcaagtcacagaggatgaaattaagcagtttgtctctaaacaggtggtgttttataaaagaataagccgcgtatttttcatcgatgtggttcccaagtcaccatcagggaagatattacgcaaggagttgagggcaaaactggcagctggcttttcaaattga

SEQ ID NO: 29674 - protein, 542 aa, Betula platyphylla
MAIQAKEQEFIFRSKLPDIYIPKHLPIHSYCFENISKVGSRPCLINGLTGKVYTYYDVELTARKVASGLSKLGIQKGDVVMLLLPNSPEFAFVFLGASYLGAMTTAANPFCTAGEVSKQAKSANAKIVVTQACYYDRVKDYTNENGVKIICIDSPPEDCLHFSELTKADENDVAEVDISPDDVVALPYSSGTTGLPKGVMLTHKGLVTSVAQQVDGENPNLYYHSEDVILCVLPLFHIYSLNSVFLCGLRAGASILILPKFEIVSLLQLIQKHKVTVMPIVPPIVLAITKFPDLDKYDLSSVKMLKSGGAPLGKEIEETVKAKFPNALFGQGYGMTEAGPVLAMCLAFAKEPMEVKSGACGTVVRNAEMKIVDPETGASLPRNQPGEICIRGDQIMKGYINDPEATASTIDKEGWLHTGDIGLIDDNDELFIVDRLKELIKYKGFQVAPAELEALLLTHPNISDAAVVPMKDDLAGEVPVAFVARSNGSQVTEDEIKQFVSKQVVFYKRISRVFFIDVVPKSPSGKILRKELRAKLAAGFSN

SEQ ID NO: 29675 - DNA, 1683 bp, Thermus thermophilus HB8
  CDS (1)..(1683)
atggaccaggtgcgcgagaaaccgtggctggcccactacgaccccggcgttccgccggagatccaggtccccgacattcccctctggcggttcctggaggaaagcgcccgccgcttcccccaaaacgtcgccctggagtttctggggaagaccctcagctaccaggagctatggggcctcgcccgccgcttcgcccaggggcttaaggacctgggggtgcggcccggggaccgggtggccatcatgctccccaactctccccagttcgtcatcgccttctacggcaccctcctcgccgggggcgtgggggtgaacgtcaaccccctctacacgcccagggaactccgccaccagcttgcggatgcgggggcggagaccctggtgatcctggaccacctcctcccccgctacctggaggtggaaaaggaggtcccggtgaagcgggtggtggtcacggggatcaaggacttcctccccttccccaagaacctcctctaccccctgaaggccaagcgggacggccttcccctgggcttccccaagcgggagggcttccacgccttcgccgaactcctcaagcgcccccccgccgagccccacgtccccgaccccgaggacctcgccctcctccagtacaccgggggcaccacgggcctctccaagggggcgatgctcacccacagaaacctcgtggccaacgtcctccagattgacgcctgggaccccacctccaaggacctcgtgggcaagggggtcatgctcggggccctgcccttcttccacgtctacgggatgaccgtggccatgaactacggcctcttctcgggctacaagatcgtcctcctccccaggcccgagatcaaggccatcgtggaggccattgaaaaacaccaggtcacccacttccccggcgtccccaccctctacgtggccttcaacaacttccccggcatagaaaggcgggacctcaagagcgtccgggcctgcatctccggctcggcgcccctccctttggaggtggccgagcgctttgagaggctcaccggggccaagctggtggagggctacggcctcacggaggcgagccccgtgacccactgcaaccccctttacggcgaaaggcgcctggggagcgtgggcctccccttccccggcgtggacgccaaggtggtggacgaggaaggaaaggaactccccccaggcgaggtgggcgaactcgccgtcaaaggccccaacgtcatgaaaggctactggaaccgccccgaagaaacccaaaaaaccctcaaagacggctggctcttcaccggcgacctcgccaaaatggacgaagacggctacttctacatcgtggaccgcaaaaaagacatgatcatcgccggcggctacaacatctaccccagggaagtggaagaagtcctctaccagcacgaggccgtccaggaagccgccgtggtgggcgtcccagacccctaccgcggggaaaccgtggccgccttcctcgtcctcaaacccgagtaccaaggcaaggtctcggaaaaggacatagagcgcttctgccgccaaaacctcgccgcctacaaggtcccccgcatcatccagttccgcgaaagcctccccaagtccagcgtggggaagatcctgaggagggagcttagggaggagttcgccaaaaagcagggctag

SEQ ID NO: 29676 - protein, 560 aa, Thermus thermophilus HB8
MDQVREKPWLAHYDPGVPPEIQVPDIPLWRFLEESARRFPQNVALEFLGKTLSYQELWGLARRFAQGLKDLGVRPGDRVAIMLPNSPQFVIAFYGTLLAGGVGVNVNPLYTPRELRHQLADAGAETLVILDHLLPRYLEVEKEVPVKRVVVTGIKDFLPFPKNLLYPLKAKRDGLPLGFPKREGFHAFAELLKRPPAEPHVPDPEDLALLQYTGGTTGLSKGAMLTHRNLVANVLQIDAWDPTSKDLVGKGVMLGALPFFHVYGMTVAMNYGLFSGYKIVLLPRPEIKAIVEAIEKHQVTHFPGVPTLYVAFNNFPGIERRDLKSVRACISGSAPLPLEVAERFERLTGAKLVEGYGLTEASPVTHCNPLYGERRLGSVGLPFPGVDAKVVDEEGKELPPGEVGELAVKGPNVMKGYWNRPEETQKTLKDGWLFTGDLAKMDEDGYFYIVDRKKDMIIAGGYNIYPREVEEVLYQHEAVQEAAVVGVPDPYRGETVAAFLVLKPEYQGKVSEKDIERFCRQNLAAYKVPRIIQFRESLPKSSVGKILRRELREEFAKKQG

SEQ ID NO: 29677 - DNA, 1623 bp, Salvia miltiorrhiza
  CDS (1)..(1623)
atggaggttcccacgatgccggaagagatcgtattccgatccaagctccccgacatatacattccgaagcatctcccgttacactcatactgcttcgagaacatctccaagttcagctcgcggccgtgcattatcaacggcgcgacgggcgacgtgtacacgtacgaggaggtggagatgacggcgcgcaaggtggcgtcggggctgagccaggtgggcatccagcagggcgagacgatcatgctcctcctccccaacacgcccgagtacatcttcgcattcctcggcgcgtcctacataggcgcggtctccaccatggcgaatcccttcttcaccccggccgaggtgatcaagcaggccaaggcctccgcggccaagctcatcatcacgcaggcgtgctacgtggacaaggtgcgcgactacgcggcggaggccggggcgaaggtggtgtgcatcgacgcgccgccggccgggtgcctgacgttctcggagctgacggcggcggacgagcgggagatgccggcggtgaagatacacccggaggacgcggtggcgctgccgtattcgtcagggacgacggggctgccgaagggggtgatgctgacgcacaaggggctggtgacgagcgtggcgcagcaggtggacggggagaacccgaatttgtatatccatagcgaggacgtgatgctgtgcgtgctgccgctgtttcatatatactcgttgaactcggttttgctgtgcgggctgcgggtcggggcggccatcctcatcatgcagaagttcgagatcgtgccgtttctcgacctcatgcagaggtacaaagtcacgattgggcccttcgtgccgcccatagtgctggccatcgccaagagcccgctcgtcgccaaatacgacctttcctccgtgcggatggtcatgtccggcgccgcgccgctcgggaaggagctcgaggattctgtcaggaccaagtttcctaatgcaaaacttggacaggggtatgggatgactgaagcagggcctgtgctatcgatgtgcctagcgtttgcaaaagagccatttgagataaaatcaggagcatgtggaactgttgttagaaatgctgaaatgaaaatcattgatcctcaaactggtgtttctcttgggcgtaatcaatccggagagatttgcattagaggagaccagattatgaaaggttatctgaacgacccagagtcaacaaagaacaccatagacgaagacgggtggctgcacactggcgacatcggattcattgatgccgacgacgagctcttcatcgtggaccgattgaaggaaattataaaatacaaagggttccaagttgcgccagctgaaatcgaagccctcctcctcaataatccatacatctccgacgctgcagttgtctcaatgcaagatgagcaagctggagaagtcccagttgctttcgtcgtgagatcgaatggttctacaatcactgaggatgaaatcaagcaatttatctcgaaacaggttatcttctacaagagaataaatcgtgtatttttcattgatgcaattcccaagtctccatcaggaaaaatattgagaaaggatttgagagcaagattagcagctgcagtctaa

SEQ ID NO: 29678 - protein, 540 aa, Salvia miltiorrhiza
MEVPTMPEEIVFRSKLPDIYIPKHLPLHSYCFENISKFSSRPCIINGATGDVYTYEEVEMTARKVASGLSQVGIQQGETIMLLLPNTPEYIFAFLGASYIGAVSTMANPFFTPAEVIKQAKASAAKLIITQACYVDKVRDYAAEAGAKVVCIDAPPAGCLTFSELTAADEREMPAVKIHPEDAVALPYSSGTTGLPKGVMLTHKGLVTSVAQQVDGENPNLYIHSEDVMLCVLPLFHIYSLNSVLLCGLRVGAAILIMQKFEIVPFLDLMQRYKVTIGPFVPPIVLAIAKSPLVAKYDLSSVRMVMSGAAPLGKELEDSVRTKFPNAKLGQGYGMTEAGPVLSMCLAFAKEPFEIKSGACGTVVRNAEMKIIDPQTGVSLGRNQSGEICIRGDQIMKGYLNDPESTKNTIDEDGWLHTGDIGFIDADDELFIVDRLKEIIKYKGFQVAPAEIEALLLNNPYISDAAVVSMQDEQAGEVPVAFVVRSNGSTITEDEIKQFISKQVIFYKRINRVFFIDAIPKSPSGKILRKDLRARLAAAV

SEQ ID NO: 29679 - DNA, 1608 bp, Salvia miltiorrhiza
  CDS (1)..(1608)
atggagttgaaacaggaaagcgaacacatcttccgttcaaagcttccagacatcaatatacccacccatctccctctacacacatattgcttccaaaacctctccacccaccgggcccgcccctatctaatcaacgccgccaccggcgataccttcacccatgccggattcgagctcaccgcgcgcagagtcgccgccggcctccacaacctcggcatccgaaaatcggacgtcgtcacgcttctcctccacaactcgcccgaattcgcattcgcatttctcggcgcctccttcatcggcgcgatctccaccaccgccaatcctctctacaccgcatcggagatcgcgcttcaggctagaatctccagacctaagctcatagtcacccacgcttgccacgtggaaaaggtgaagcactacgccgccgaggccggcgccaaaatcgccacgatcgaccccccgccctcgccggagatcatccacttcgccgaactgaggagatccgacgagaagctgctcacgccgatcgagatccacgccgacgacacggtggcgctgccattctcctccggcaccaccggcctccccaagggagtaatgctgagccacaaaaacctagtcgcgtgcgtgtcgcagcaagtggacggcgagaatccggcagttcacatcgatcgtgaggatcggatgctctgcgtgttgccgctgttccacgtgtacagtatgatctcggtgatgctctgctgtctgcgtgtcggtgcggccgtggtgattatgcctaagtttgaaatcagtgagttaatggagttaatagagaaatacagggtgacgattgcaccatttgtgccaccgatattgctggcgattgcgaagagcccggcggcggcgaagttcgatttttcgtcggtgaggagagtcgtctgcggcgcggcgcccatggatagagaacttgagctagcactcaaagcgaagctccctaatgccgttattggccagggttatggtatgacagaagctggagtattatcgatgagcttagggttcgcgaagaggccattaaaattcaaagctggttcatgtggaactgtgattagaaacgcgcggatgaagatcgtggacccctccagcgccgcctctcttcctcggaatgagaccggggagatctgcatcaagggagacgctgtgatgaaagggtattacaatgatccggaggcgacgaggaggactattgatgaggaggggtggctgcacacgggcgatttagggttcgtggacgatgatgaggaagtgtacatcgtcgacaggttgaaggaattgatcaaatacaaaggctttcatattgcccctgctgaacttgaagctttgctcgtcgcacatccctctatatctgaagctgccgttgtgcctatggcggatgaggctgctggagaagttccagttgcatttgtagtgcgagcaaatgctgcatatattaccgagctacagatcaagagatatatagcgaaccaggtggcgccgtacaagcggatcaatcgtgtattttttaccgatacaattcctaaagcccccacgggtaaaattttaagaaaagatctacgagctagactttaa

SEQ ID NO: 29680 - protein, 535 aa, Salvia miltiorrhiza
MELKQESEHIFRSKLPDINIPTHLPLHTYCFQNLSTHRARPYLINAATGDTFTHAGFELTARRVAAGLHNLGIRKSDVVTLLLHNSPEFAFAFLGASFIGAISTTANPLYTASEIALQARISRPKLIVTHACHVEKVKHYAAEAGAKIATIDPPPSPEIIHFAELRRSDEKLLTPIEIHADDTVALPFSSGTTGLPKGVMLSHKNLVACVSQQVDGENPAVHIDREDRMLCVLPLFHVYSMISVMLCCLRVGAAVVIMPKFEISELMELIEKYRVTIAPFVPPILLAIAKSPAAAKFDFSSVRRVVCGAAPMDRELELALKAKLPNAVIGQGYGMTEAGVLSMSLGFAKRPLKFKAGSCGTVIRNARMKIVDPSSAASLPRNETGEICIKGDAVMKGYYNDPEATRRTIDEEGWLHTGDLGFVDDDEEVYIVDRLKELIKYKGFHIAPAELEALLVAHPSISEAAVVPMADEAAGEVPVAFVVRANAAYITELQIKRYIANQVAPYKRINRVFFTDTIPKAPTGKILRKDLRARL

SEQ ID NO: 29681 - DNA, 1665 bp, Oryza sativa
  CDS (1)..(1665)
atggggtcggtggcggcggaggaggtggtggtgttccggtcgaagctgccggacatcgagatcgacaacagcatgacgctgcaggagtactgcttcgcgaggatggcggaggtcggggcgcggccgtgcctgatcgacgggcagaccggggagtcgtacacgtacgcggaggtggagtccgcgtcgcggcgcgccgcggcggggctccggcggatgggggtgggcaagggcgacgtggtgatgagcctcctccgcaactgccccgagttcgccttctccttcctcggcgcggccaggctgggcgccgccaccacgacggcgaacccgttctacacgccgcacgaggtccaccgccaggcggaggccgcgggcgccagggtgatcgtcaccgaggcgtgcgccgtcgagaaggtgcgggagttcgccgcggagaggggcgtccccgtggtcaccgtggacggcgcgttcgacggctgcgtggagttccgcgaggtgctcgccgcggaggagctcgacgccgacgccgacgtccaccccgacgacgtcgtcgccctcccctactcctccggcaccaccggcctccccaagggcgtcatgctcacccaccgcagcctcatcaccagcgtcgcccagcaggtggatggagagaaccctaacctgtacttcagcaaggatgatgttatactatgcctgctgccactgttccacatctactcgctcaactccgtgctgctggctggcctgcgtgccgggtcgaccatcgtgatcatgcggaagtttgatcttggcgcgctcgtcgaccttgtgcgcaagcacaacatcaccatcgcccccttcgtgccccccatcgtggtggagatcgccaagagcccccgcgtcaccgcggaggacctcgcctccatccgcatggtcatgtccggtgccgcgcccatggggaaggaccttcaggatgcattcatggccaagatccccaatgccgtcctcggacagggttacggtatgactgaggctgggccagtgctggcaatgtgcctggcgtttgccaaggagcccttcaaggttaagtccgggtcgtgcggtacagtggtgcgcaacgcggagctgaagatcgtcgaccccgacaccggcacctccctcggccggaaccagtccggcgagatctgcatccgcggagaacagatcatgaaaggctatctgaatgatcctgaggcgaccaagaacaccatcgacgaggacgggtggctgcacaccggagacatcggcttcgtcgacgacgacgacgagatcttcatcgtggacaggctcaaggagatcatcaagtacaaggggttccaggtgccaccggccgagctggaggcgctgctcatcactcacccggagatcaaggacgccgccgtcgtctcgatgaaggatgatcttgccggtgaagtgccagtcgccttcattgtccggacagaaggctcagaaatcaccgaggatgagatcaagaaattcgttgcaaaagaggtggtgttctacaagaggatcaacaaggtgttcttcaccgattccatccccaagaacccttccggcaagatcctcaggaaggacttgagagccaggctcgccgccggcatccccgacgccgtcgccgccgccgccgccgatgcgcccaaaagcagctaa

SEQ ID NO: 29682 - protein, 554 aa, Oryza sativa
MGSVAAEEVVVFRSKLPDIEIDNSMTLQEYCFARMAEVGARPCLIDGQTGESYTYAEVESASRRAAAGLRRMGVGKGDVVMSLLRNCPEFAFSFLGAARLGAATTTANPFYTPHEVHRQAEAAGARVIVTEACAVEKVREFAAERGVPVVTVDGAFDGCVEFREVLAAEELDADADVHPDDVVALPYSSGTTGLPKGVMLTHRSLITSVAQQVDGENPNLYFSKDDVILCLLPLFHIYSLNSVLLAGLRAGSTIVIMRKFDLGALVDLVRKHNITIAPFVPPIVVEIAKSPRVTAEDLASIRMVMSGAAPMGKDLQDAFMAKIPNAVLGQGYGMTEAGPVLAMCLAFAKEPFKVKSGSCGTVVRNAELKIVDPDTGTSLGRNQSGEICIRGEQIMKGYLNDPEATKNTIDEDGWLHTGDIGFVDDDDEIFIVDRLKEIIKYKGFQVPPAELEALLITHPEIKDAAVVSMKDDLAGEVPVAFIVRTEGSEITEDEIKKFVAKEVVFYKRINKVFFTDSIPKNPSGKILRKDLRARLAAGIPDAVAAAAADAPKSS

SEQ ID NO: 29683 - DNA, 1668 bp, Zea mays
  CDS (1)..(1668): n means a or g or c or t/u
atgggttccgtagacgcggcgatcgcggtgccggtgccggcggcggaggagaaggcggtggaggagaaggcgatggtgttccggtccaagcttcccgacatcgagatcgacagcagcatggcgctgcacacctactgcttcgggaagatgggcgaggtggcggagcgggcgtgcctgatcgacgggctgacgggcgcgtcgtacacgtacgcggaggtggagtccctgtcccggcgcgccgcgtcggggctgcgcgccatgggggtgggcaagggcgacgtggtgatgagcctgctccgcaactgccccgagttcgccttcaccttcctgggcgccgcccgcctgggcgccgccaccaccacggccaacccgttctacaccccgcacgaggtgcaccgccaggcggaggcggccggcgcccggctcatcgtgaccgaggcctgcgccgtggagaaggtgcgggagttcgcggcggagcggggcatccccgtggtcaccgtcgacgggcgcttcgacggctgcgtggagttcgccgagctgatcgcggccgaggagctggaggctgacgccgacatccaccccgacgacgtcgtcgcgctgccntactcctccggcaccaccgggctgcccaagggcgtcatgctcacccaccgcagcctcatcaccagcgtcgcgcagcaggttgatggcgagaacccgaacctgtacttccgcaaggacgacgtggtgctgtgcctgctgccgctgttccacatctactcgctgaactcggtgctgctggccggcctgcgcgcgggctccaccatcgtgatcatgcgcaagttcgacctgggcgcgctggttgacctggtgcgcaggtacgtgatcaccatcgcgcccttcgtgccgcccatcgtggtggagatcgccaagagcccccgcgtgaccgccggcgacctcgcgtccatccgcatggtcatgtccggcgccgcgcccatgggcaaggagctccaggacgccttcatggccaagatccccaatgccgtgctcgggcaggggtacgggatgacggaggcaggccccgtgctggcgatgtgcctggccttcgccaaggagccgtacccggtcaagtccgggtcgtgcggcaccgtggtgcggaacgcggagctgaagatcgtcgaccccgacaccggcgccgccctcggccggaaccagcccggcgagatctgcatccgcggggagcagatcatgaaaggttacctgaacgaccccgagtcgacgaagaacaccatcgaccaggacggctggctgcacaccggcgacatcggctacgtggacgacgacgacgagatcttcatcgtcgacaggctcaaggagatcatcaagtacaagggcttccaggtgccgccggcggagctggaggcgctcctcatcacgcacccggagatcaaggacgccgccgtcgtctcaatgaacgacgaccttgctggtgaaatcccggtcgccttcatcgtgcggaccgaaggttctcaagtcaccgaggatgagatcaagcaattcgtcgccaaggaggtggttttctacaagaagatccacaaggtcttcttcaccgaatccatccccaagaacccgtcgggcaagatcctgaggaaggacttgagagccaggctcgccgccggtgttcactga

SEQ ID NO: 29684 - protein, 555 aa, Zea mays
MGSVDAAIAVPVPAAEEKAVEEKAMVFRSKLPDIEIDSSMALHTYCFGKMGEVAERACLIDGLTGASYTYAEVESLSRRAASGLRAMGVGKGDVVMSLLRNCPEFAFTFLGAARLGAATTTANPFYTPHEVHRQAEAAGARLIVTEACAVEKVREFAAERGIPVVTVDGRFDGCVEFAELIAAEELEADADIHPDDVVALPYSSGTTGLPKGVMLTHRSLITSVAQQVDGENPNLYFRKDDVVLCLLPLFHIYSLNSVLLAGLRAGSTIVIMRKFDLGALVDLVRRYVITIAPFVPPIVVEIAKSPRVTAGDLASIRMVMSGAAPMGKELQDAFMAKIPNAVLGQGYGMTEAGPVLAMCLAFAKEPYPVKSGSCGTVVRNAELKIVDPDTGAALGRNQPGEICIRGEQIMKGYLNDPESTKNTIDQDGWLHTGDIGYVDDDDEIFIVDRLKEIIKYKGFQVPPAELEALLITHPEIKDAAVVSMNDDLAGEIPVAFIVRTEGSQVTEDEIKQFVAKEVVFYKKIHKVFFTESIPKNPSGKILRKDLRARLAAGVH

SEQ ID NO: 29685 - DNA, 1626 bp, Allium cepa
  CDS (1)..(1626)
atgggttcaatatcaatggatcaagaaacgatattcaggtcgaaacttccggatatttacatccccgaccatctacctctccactcctactgcttccagcacattcaagagttctccgacaaaccctgcatcatagatggcataactgaaaaggtgtatacttacgcagacgtcgagctaacatcaaaacgtgtggcagtcggtctgcgcgacttgggcatcagaaaaggccatgtcatcatgatcctcctacccaactctccggagttcgccttctccttcctcggagcttcctacctcggcgccatgtccacaacagcgaatccttactacaccccagctgagatcaaaaagcaggcaatgggatccggcgttagggtcataataacagaatcctgctacgtgcccaagatcaaagacttagaacacaacgtaaagatcgtagtcatcgatgagttggtcgatgaacacagtacatgcatccccttttcacaactgtcttccgctgatgaaaggaagctcccggaggtggaaatcagtcctgacgatgtggtggcacttccttattcatcgggaactacagggctaccgaaaggagttatgctgacacatgaaggcttgattacaagcgtggctcagcaggtggatggagagaatccgaatttgtatttcagaagcgacgatgtgcttttgtgtgtattaccgctttttcacatatattcgctgaactcggttttgttgtgtggactgagggcggggtcgacgattttgttgatgaggaagtttgatttgactaaagtggtggagttggttggaaaatacagggtgacgatagcgccatttgtgcctcctatttgtattgaaattgctaagaatgacatggttggaatgtgtaatttgttgaacattaggatggttatgtcgggggcggcacccatggggaaggagttggaggataagttgaaggagaagatgcctaatgccgtacttggccagggttacggaatgactgaagcaggtcctgtaatatcaatgtgtcctggctttgcaaaacatccaactcaagccaaatccggatcatgtggaactatcgttagaaatgcagaactaaaagtgatggatccagaaacaggcttttctcttggccgcaaccttcctggagaaatttgcatccgtggtccccagataatgaaaggttatcttaatgaccctgaggcaacttcttcaactatagacttagaaggttggctacatactggagatattggttatgttgatgatgatgatgaagtattcattgttgacagagttaaggaactgatcaaatttaaagggtttcaggtaccgccggctgagctcgagtctctgcttgttagtcacccttgtattgcagatgcagctgtgattcctcaaaaagatgaagttgccggtgaggttcctgttgcatttgttgttaaagcgagtggttcagacattactgaagacgctgtgaaggaattcatttcaaagcaggtggtgttttacaagagattgcagacggtttattttgttcacgcaattccaaaatctccttcaggaaagatattaaggaaggatctgagagctcgactttcttcgtttacatag

SEQ ID NO: 29686 - protein, 541 aa, Allium cepa
MGSISMDQETIFRSKLPDIYIPDHLPLHSYCFQHIQEFSDKPCIIDGITEKVYTYADVELTSKRVAVGLRDLGIRKGHVIMILLPNSPEFAFSFLGASYLGAMSTTANPYYTPAEIKKQAMGSGVRVIITESCYVPKIKDLEHNVKIVVIDELVDEHSTCIPFSQLSSADERKLPEVEISPDDVVALPYSSGTTGLPKGVMLTHEGLITSVAQQVDGENPNLYFRSDDVLLCVLPLFHIYSLNSVLLCGLRAGSTILLMRKFDLTKVVELVGKYRVTIAPFVPPICIEIAKNDMVGMCNLLNIRMVMSGAAPMGKELEDKLKEKMPNAVLGQGYGMTEAGPVISMCPGFAKHPTQAKSGSCGTIVRNAELKVMDPETGFSLGRNLPGEICIRGPQIMKGYLNDPEATSSTIDLEGWLHTGDIGYVDDDDEVFIVDRVKELIKFKGFQVPPAELESLLVSHPCIADAAVIPQKDEVAGEVPVAFVVKASGSDITEDAVKEFISKQVVFYKRLQTVYFVHAIPKSPSGKILRKDLRARLSSFT

SEQ ID NO: 29687 - DNA, 1641 bp, Bacillus amyloliquefaciens; identical to SEQ ID NO: 14118
  CDS (1)..(1641)

SEQ ID NO: 29688 - protein, 546 aa, Bacillus amyloliquefaciens; identical to SEQ ID NO: 14119

SEQ ID NO: 29689 - DNA, 1665 bp, Acinetobacter baumannii
  CDS (1)..(1665)
atgacaacaataaagtatttagagggcgctgtaccatatccagaagaatttgccatggcttaccgtaaaaaaggctattggattgggcaaaatctgagtgactttttacgggaaagtgctcaaaagtatgcgaaaaatattgcaatttatgatggagataaagctgttagctatgaaaaatttgacaacttagttgactgttgtgcaagccatttatatcaatatggcttacgcgcgggtgataaagccgtcgtacaaatgccaaaccactatcagttctatgttctatttttcgccctgattcgattaggtgctttacctatcatgtcattgcctgcccatcgatatgctgaactcagtagcttttttaaacaaacgcaagcaaaagcttatttctgttctgattttggtgcacaaaaatttgactaccgagagcttgccggaaagcttcagcaaacagcagcttgcttagagtatgtatttgtacttggagatgctggcaattttgttgctatcgaaaatctattaaaagaaacagaaattctagcggaagcaatctcgccaactacagcagatcaagtggcttttttacagctttcggggggtagcacaggtgttccaaaactgattccacgtactcatgatgattatctatacagtgtgcgtgaaagtgccaaaatttgcgaactcaatcagacttcacgtttattgatggttttacctgcggcacataacttttcaatgagctcggctggttctttaggcattttttatgctggcggcgcggtggttttaggtacagatccaagccctgaaactgcattcccacttattaaaaaacacggtgtgacagatgcttgtttggttcctgccttggttcgaccgtggatggataaagcagccaaagatcaagattcaatattatcaactctacgttgcttgcaagtcggtggagcacgcttacccgatgctgctgccttacgtttaattgatgagtttaaggttagtttgcaacaagtctttggaatggctgaagggcttgtgaactacacccgttttggcatgtcaaaagaacaaattattcatacccaaggtttaaaaatctcgccagatgacgaaattttagtactagatgatcatgaccaacccgtagaagctggacaggtagggcatttgctcactcgtggcccctataccattcgcggctattaccaagcaccggagcataatgctcgttcttttacaccagacggtttttatcgcacaggcgatttagtccgtatccgtgaagatggctgcattgttgtggaagggcgttcaaaagaacaaattaatcgtgctggtgaaaaaattgcgactgaagaagtggaacaagcgttattaactcatccacaaatccgcttggcagcgctggttgctatgcccgatgaagttatgggtgaaaaaagttgtgctttcgtggcatggcaatcacaacctgatgatccaagtccaattcgccttgcgatgtcagttcgacaacatctgaaagactatgggcttgctacctacaaaattcctgatcgtgtcgaatttatcgagcagtttccatatacagcttttggaaaaatcaacaaaaaaagattacgtcaacaacttgaaactaaaaccaatgttcttgcctaa

SEQ ID NO: 29690 - protein, 554 aa, Acinetobacter baumannii
MTTIKYLEGAVPYPEEFAMAYRKKGYWIGQNLSDFLRESAQKYAKNIAIYDGDKAVSYEKFDNLVDCCASHLYQYGLRAGDKAVVQMPNHYQFYVLFFALIRLGALPIMSLPAHRYAELSSFFKQTQAKAYFCSDFGAQKFDYRELAGKLQQTAACLEYVFVLGDAGNFVAIENLLKETEILAEAISPTTADQVAFLQLSGGSTGVPKLIPRTHDDYLYSVRESAKICELNQTSRLLMVLPAAHNFSMSSAGSLGIFYAGGAVVLGTDPSPETAFPLIKKHGVTDACLVPALVRPWMDKAAKDQDSILSTLRCLQVGGARLPDAAALRLIDEFKVSLQQVFGMAEGLVNYTRFGMSKEQIIHTQGLKISPDDEILVLDDHDQPVEAGQVGHLLTRGPYTIRGYYQAPEHNARSFTPDGFYRTGDLVRIREDGCIVVEGRSKEQINRAGEKIATEEVEQALLTHPQIRLAALVAMPDEVMGEKSCAFVAWQSQPDDPSPIRLAMSVRQHLKDYGLATYKIPDRVEFIEQFPYTAFGKINKKRLRQQLETKTNVLA

SEQ ID NO: 29691 - DNA, 1677 bp, Streptomyces carzinostaticus subsp
  CDS (1)..(1677)
atgcacgagacagcagcagcaccggcccccgcaggattcgtcccctggcccgacgatgtggcagcccgctatacggccgccggccactgggagggacgctcgctggggacgcacctggcggaggccgcacggaaggtcccagaggccgtatgcctcgtcgacggtccggtccgtatgagctacagcgagttgatggcacgcgcggacggggcggccgtccgtatgagagggctcggcattcgcccggccgaccgggtggtggtgcagctacccaactgctgggagcacgtggtcgtgaccatggcgtgcctgcggctcggcgctctgccgatctgggcgctgccgcagtaccggcaccgcgaactgtcgggcgtggtgactcacgcccgggccagtgccctcgtcgtgcccgacgtgtaccgggagttcgaccaccaggcgctggcgcacgaagtggcggaggcgcagccgactgtccggcacgtcctcgtggcggggtccgacgtacggccggacagcgtcgatctgcgcgcgctgtgcgagcctctggacgcggacgaggccgcgcgggtcgcggccgagctcgaccggtccgcgccgcgtggtgaggaggtcgcgatgctcaagctgtccggcgggacgaccggactgcccaagctcgtggcacgcacgcacaacgacctcagctacatgatcaagcgcgctgcccaggtgtgcggcttcggacgggacacggtgtacttggccgtcctgccgctcggtcacggcttccccaacaccggtcccggagtcctcggcacgctcctggccggggggcgggtggtgatttccggatcgccggctcccgaggccgctttcgcgctgatggagcgggaacgggtgaccgccacgtccgtggtgccggccattgtcatgcggtggctccagtaccgggacgagcggccgggcgccgacctgggttcgctggagctcatgcaggtcggggcctcgcggctcgagccggaggtggcccggcaggtgggaccgaaactgggctgcaggctgcagcaggtgttcgggatggcggagggcctgctgtgcctgacccgcctggacgatccggacgacgtggtccactacacccagggacggccgatcagcccggacgacgagatccgggtggtggacccggagggcaggacagtgggtgtgggcgaacccggggcgttgctcacgcgggggccgtacacgccgcgcggctactacgattcgccctccgccaacgcgcgagcgttcacccccgacggctggtaccggaccggtgacctggtacgccggacgccggacggcaacctgatcgtggtcggcagggagaaggacctcatcaacaggggtggcgagaagatcaacgccgaggaggtggagggcttcgcggtgcaggtcgacggagttctgcaggcggctgccgtcggcctgccggacagcgaactcggcgagcggatctgtctgttcgtcgtgctggccgacggcacgcgggtggagctggcggacgtccggaaggtgatggagaacgccgagacggcgtcgttcaagcttccggagcgtctcatcacgcttccctccctgcccaccacaccgatgggcaagatcgacaagaaggcactgcgtgctgccgccggtcggatgtccgaaacctga

SEQ ID NO: 29692 - protein, 558 aa, Streptomyces carzinostaticus subsp
MHETAAAPAPAGFVPWPDDVAARYTAAGHWEGRSLGTHLAEAARKVPEAVCLVDGPVRMSYSELMARADGAAVRMRGLGIRPADRVVVQLPNCWEHVVVTMACLRLGALPIWALPQYRHRELSGVVTHARASALVVPDVYREFDHQALAHEVAEAQPTVRHVLVAGSDVRPDSVDLRALCEPLDADEAARVAAELDRSAPRGEEVAMLKLSGGTTGLPKLVARTHNDLSYMIKRAAQVCGFGRDTVYLAVLPLGHGFPNTGPGVLGTLLAGGRVVISGSPAPEAAFALMERERVTATSVVPAIVMRWLQYRDERPGADLGSLELMQVGASRLEPEVARQVGPKLGCRLQQVFGMAEGLLCLTRLDDPDDVVHYTQGRPISPDDEIRVVDPEGRTVGVGEPGALLTRGPYTPRGYYDSPSANARAFTPDGWYRTGDLVRRTPDGNLIVVGREKDLINRGGEKINAEEVEGFAVQVDGVLQAAAVGLPDSELGERICLFVVLADGTRVELADVRKVMENAETASFKLPERLITLPSLPTTPMGKIDKKALRAAAGRMSET

SEQ ID NO: 29693 - DNA, 1656 bp, Nicotiana sylvestris
  CDS (1)..(1656)
atgggaactcgtgcagtagaaagctcacagcagcaagaatgtgaacatattttccggagtagatatcctccggttcaagtaccggacaatgtgaccctcccggattttgtgcttcacaatgtagagttatacactgacaaaatggcatttgtggatgctaccactggcaaaggctacacttatggccaagttgcaagagacataaggaggttcgccaaggccttgagatcccttggcttaaggaaaggacgggtggtggtggtagttcttccaaatgtaccagaatatgctattgttgctcttggaatcatggctgctggtggcgtcttctccggtgcaaatccagcagctcattcatcagaaatcgtgaaacaagttgaatctgctgatggcaagcttattgtctctgatctaccaacctatcacaaggttaaagattgtgggctgccagtaataatactaggtgaagaacatgtagaaggaacaattcattgggatgaattgcttgaagctgcagagcgtgccggttccagaactgatcacataacaaaccatgaagatgaaatggtgcagcaaaatgatttatgtgcactgcccttctcgtcaggcactacggggctgtccaagggagtgatgttaacccacagaaatctagtagcaaacctctgctctacactcttcagtgttagcccagaaatggtaggccaagttacaacactgggtttgataccattcttccacatttatgggataactggaatctgttgtgcaaccattagaaacaaagggaaagtggtagtcttgcgtaggtacgaactgagggcatttctaaatgcactcattacacatgaagtcacatttgcaccaattgtgccacctatcatcttggcacttgttaagaatcctattgtggatgaatttgatctcagcaagcttaagcttagatccatcatgacagcggcagccccacttgcccctgagattcttaatgaatttgaaaagaaatttcccgatgttcaggtccaagaggcatatgggatgactgagcacagctgcattactctttctcatagtgaccagcatactgctaaaagaaattctgttggttttattctacctaatttggaggtaaagttcgttgatcctgataccggtagatctctccccaaaaacaaaccaggcgagatatgtgtcaaaagccaatgtgttatgaagggttactacaaaaatgaatttgagacttgccttaccattgataaggatggatggcttcagactggtgacattggctacattgacgatgatggagatatcttcctagtcgatcgtatcaaagagcttatcaagtacaagggattccaagttgctccagctgagttagaagggatccttctcacacatccttcagtagaagatgctgcagtagttgggctgccagatgaagaagcaggagagataccagtggcatgggtagtcttgaactcaaaagcaaaagaaagcgaagaggacattatcaactacattgcatcgactgttgcacagtataaacgagtgagagtggtgcagttcgttgatagtattccaaaatctccttctggaaaaatactgagaagacttatcaaggataagatgctagagagacttaagaatgcatag

SEQ ID NO: 29694 - protein, 551 aa, Nicotiana sylvestris
MGTRAVESSQQQECEHIFRSRYPPVQVPDNVTLPDFVLHNVELYTDKMAFVDATTGKGYTYGQVARDIRRFAKALRSLGLRKGRVVVVVLPNVPEYAIVALGIMAAGGVFSGANPAAHSSEIVKQVESADGKLIVSDLPTYHKVKDCGLPVIILGEEHVEGTIHWDELLEAAERAGSRTDHITNHEDEMVQQNDLCALPFSSGTTGLSKGVMLTHRNLVANLCSTLFSVSPEMVGQVTTLGLIPFFHIYGITGICCATIRNKGKVVVLRRYELRAFLNALITHEVTFAPIVPPIILALVKNPIVDEFDLSKLKLRSIMTAAAPLAPEILNEFEKKFPDVQVQEAYGMTEHSCITLSHSDQHTAKRNSVGFILPNLEVKFVDPDTGRSLPKNKPGEICVKSQCVMKGYYKNEFETCLTIDKDGWLQTGDIGYIDDDGDIFLVDRIKELIKYKGFQVAPAELEGILLTHPSVEDAAVVGLPDEEAGEIPVAWVVLNSKAKESEEDIINYIASTVAQYKRVRVVQFVDSIPKSPSGKILRRLIKDKMLERLKNA

SEQ ID NO: 29695 - DNA, 1641 bp, Arabidopsis thaliana
  CDS (1)..(1641)
atggcttcagtgaattctcgaagtggtttctgcaactcaaactcaacattctacagcaaacgaacaccaatcccactcccgccaaatccatcactcgacgtcactactttcatttcttcacaagctcatcgtggccgtatcgccttcatcgacgcttccacaggtcaaaacctcaccttcaccgagctatggcgtgccgtggaatccgtcgccgattgtctctccgagatagggattcgcaaaggccacgtcgtcctcctcctctccccaaactcaattttattccccgtcgtttgtctctccgtcatgtcactaggcgcaatcatcaccaccacgaatccactcaacacttcaaacgagatcgctaaacagattaaggattcaaatccagtcctcgccttcaccacatcgcagcttctcccgaaaatctccgccgccgcaaagaagctcccgatcgtgcttatggacgaggaacgagttgactcagtgggtgatgtgagaagattggtggagatgatgaagaaggaaccgagtgggaaccgagtcaaggagcgagttgaccaggatgatacggcgactttgctttactcttcaggaaccacgggaatgagcaaaggagtgatctcgtctcaccgtaacttaatcgcgatggttcaaaccatcgtgaatcgatttggatctgatgatggagagcaacgattcatctgcactgttcctatgtttcacatctacggtttaactgcgttcgctactggattactcgcttacggatctacgatcatcgttctctctaaattcgagatgcacgagatgatgtcagcgattggcaagtatcaagccacgtctttgcctctcgtgcctccgattcttgtggcgatggttaacggtgcagatcagattaaggctaagtatgatttgagctctatgcatactgttttatgcggcggagctccgttgagtaaggaagtgactgaaggattcgcggagaagtatccgacggttaagattttacaaggttatgggttgactgagtcaacgggtataggagcttctacggatactgttgaggaaagtcggagatacggtaccgctgggaaattgtcggcaagtatggaagggaggattgttgatccggttactggtcagattcttggaccgaaacaaaccggtgagctttggctcaagggtccttccataatgaaaggttatttcagcaatgaggaagctacgagttcgactcttgattctgaaggatggttaagaactggagatctttgctatatcgatgaagatggattcatattcgtggttgatcggttaaaggaactgatcaagtacaagggttatcaggttgctccagctgagctagaggctttgttgcttactcatcctgaaatcactgatgctgcagtgatcccgtttccggacaaagaagtggggcaatttccaatggcatacgtcgtaaggaaaactgggagcagcttatcagagaagacaataatggagtttgtagcgaaacaagtagcaccatacaagaggatacgaaaagttgctttcgtatcttcaataccaaagaacccttcaggcaagattctacgcaaagatctcatcaagatagcaacttccaactccaagctttga

SEQ ID NO: 29696 - protein, 546 aa, Arabidopsis thaliana
MASVNSRSGFCNSNSTFYSKRTPIPLPPNPSLDVTTFISSQAHRGRIAFIDASTGQNLTFTELWRAVESVADCLSEIGIRKGHVVLLLSPNSILFPVVCLSVMSLGAIITTTNPLNTSNEIAKQIKDSNPVLAFTTSQLLPKISAAAKKLPIVLMDEERVDSVGDVRRLVEMMKKEPSGNRVKERVDQDDTATLLYSSGTTGMSKGVISSHRNLIAMVQTIVNRFGSDDGEQRFICTVPMFHIYGLTAFATGLLAYGSTIIVLSKFEMHEMMSAIGKYQATSLPLVPPILVAMVNGADQIKAKYDLSSMHTVLCGGAPLSKEVTEGFAEKYPTVKILQGYGLTESTGIGASTDTVEESRRYGTAGKLSASMEGRIVDPVTGQILGPKQTGELWLKGPSIMKGYFSNEEATSSTLDSEGWLRTGDLCYIDEDGFIFVVDRLKELIKYKGYQVAPAELEALLLTHPEITDAAVIPFPDKEVGQFPMAYVVRKTGSSLSEKTIMEFVAKQVAPYKRIRKVAFVSSIPKNPSGKILRKDLIKIATSNSKL

SEQ ID NO: 29697 - DNA, 1713 bp, Arabidopsis thaliana
  CDS (1)..(1713)
atggtgctccaacaacaaacgcattttctcacaaagaagatagatcaagaagacgaagaagaagaaccttctcatgatttcattttccgatctaagcttcctgatatcttcatccctaaccacctccctctcaccgattacgtcttccaaaggttctccggcgatggcgacggagattcctcaacaacctgtatcatcgacggtgccactggccgtattttgacctacgccgatgtgcaaatcaacatgcggaggatagctaccggaatccaccggctcgggatccgccacggtgacgtcgtaatgcttctcctcccgaactcgccggagtttgctctgtcttttctagccgttgcataccttggagccgtttccactaccgcgaatccgttctacactcagccggagatcgctaaacaggctaaagcctccgccgcgaagatgatcatcacgaagaaatgtttagtcgataaactaacaaacctcaaaaacgacggcgttttgatcgtttgcctagacgatgacggtgacaacggcgttgtttcgtcgagtgatgatggttgcgtgagtttcacggaactgactcaagcggacgaaacagaacttctaaaacctaaaatatcgccggaagacacggtggcgatgccgtactcttccggaacaacgggacttccaaagggagtgatgattactcacaagggtttagttacaagcatcgctcagaaagtcgacggagaaaaccctaacctcaacttcacggccaatgacgtcatcctctgttttctcccaatgtttcacatttacgctctcgacgcgttgatgctttcggcgatgagaaccggtgcagcgttactgatcgtgccgaggttcgagttaaatctggtgatggagctgattcaaaggtacaaagtcacggttgttccggtggctcctccggtggttttagcattcattaaatcccctgagacggagagatacgacttgagctcggtgagaattatgctatcaggtgcagctacactaaagaaggagcttgaagacgccgtgcgactcaagtttcctaatgccatttttggtcagggttatggaatgaccgagtccggaacggtagctaagtcattagcgtttgcaaagaacccatttaaaaccaagtccggtgcatgtgggactgtgatcagaaacgccgagatgaaagtggtcgataccgaaaccggaatctccttgccgcgcaacaaatctggcgagatctgcgtccgaggtcatcagctcatgaaaggttatttgaatgatccggaagctactgcacgaaccatagacaaagacgggtggttacatacaggagatattgggtttgtggatgatgatgatgagatcttcattgttgatcggttgaaggaactgatcaaattcaaaggctaccaagtggctccagctgagcttgaagcattgcttatttctcatccttctatcgatgatgccgcagttgttgcaatgaaggatgaagtagctgatgaggttccagtagcatttgtagcaagatctcaagggtctcagttaactgaagatgatgtcaagagttacgtaaacaaacaggtggttcactacaagcggattaagatggtgtttttcatagaagttataccaaaagcagtttcgggcaagattctgaggaaggatctgcgagctaaattggaaaccatgtgctctaaatag

SEQ ID NO: 29698 - protein, 570 aa, Arabidopsis thaliana
MVLQQQTHFLTKKIDQEDEEEEPSHDFIFRSKLPDIFIPNHLPLTDYVFQRFSGDGDGDSSTTCIIDGATGRILTYADVQINMRRIATGIHRLGIRHGDVVMLLLPNSPEFALSFLAVAYLGAVSTTANPFYTQPEIAKQAKASAAKMIITKKCLVDKLTNLKNDGVLIVCLDDDGDNGVVSSSDDGCVSFTELTQADETELLKPKISPEDTVAMPYSSGTTGLPKGVMITHKGLVTSIAQKVDGENPNLNFTANDVILCFLPMFHIYALDALMLSAMRTGAALLIVPRFELNLVMELIQRYKVTVVPVAPPVVLAFIKSPETERYDLSSVRIMLSGAATLKKELEDAVRLKFPNAIFGQGYGMTESGTVAKSLAFAKNPFKTKSGACGTVIRNAEMKVVDTETGISLPRNKSGEICVRGHQLMKGYLNDPEATARTIDKDGWLHTGDIGFVDDDDEIFIVDRLKELIKFKGYQVAPAELEALLISHPSIDDAAVVAMKDEVADEVPVAFVARSQGSQLTEDDVKSYVNKQVVHYKRIKMVFFIEVIPKAVSGKILRKDLRAKLETMCSK

SEQ ID NO: 29699 - DNA, 1689 bp, Arabidopsis thaliana
  CDS (1)..(1689)
atgctgacgaaaaccaacgacagccgtttgattgaccggagctccggcttcgatcaacggacaggaatctatcacagtcttcgtccctctctttctctacctcctatagatcaacctctctccgccgccgaattcgcgctttctctcctactcaaatcctcaccacctgccaccgccgggaaaaacattgaagccttaacctacctagttaactcgagctctggtgataacctcacttatggagagcttcttcgtagagttcgttctcttgctgtatctctccgggagcgatttccttctcttgcctccagaaatgtcgcttttatcctctctccttcttcgttggacataccagtgctttacttagctttgatgtcgatcggtgttgttgtttcaccggcgaacccaatcggatctgaatcggaggtgagtcatcaagtcgaagtcagtgaaccagtaattgcgttcgcgacatcgcagacggttaagaagcttcaatcctcttctttgcctctcggaactgttctgatggactcgactgagtttctctcctggttaaatcgatcggattcttcatcggttaatccatttcaggttcaggtcaaccaatcggaccctgccgctatcctcttttcctctggaacaaccgggcgggtcaaaggcgttttgctcactcaccgtaacctaatcgcctcgaccgccgtatctcaccaacggactctccaagatccggttaattacgatcgcgttggactgttctcgcttccgctcttccacgtgtttggtttcatgatgatgattcgagccatctcgcttggagagacattggtgcttttagggagatttgaactcgaggcgatgtttaaggcggtggagaaatataaggttactggtatgcctgtctctcctccgttgattgtagcgttggtcaaatcggagctcacgaagaagtacgatctccggtcgttgcgttcccttggctgcggaggagctccactcggcaaagacatcgcagagaggtttaagcagaaattcccagatgtagatattgtacagggctatggcttgacagagagctcgggaccagctgcctcaacgtttggacctgaagagatggtaaaatatggctcagttggtcgtatctctgagaatatggaagccaaaattgttgatccatccaccggagaatccttgccaccgggaaaaactggtgaactctggctccgaggaccagtcatcatgaaaggttatgtgggaaacgagaaagcgagtgcggagacagtagacaaagaagggtggttaaagactggtgatctctgttattttgattcggaagattttctatatattgttgatcggctaaaggagctaatcaaatacaaggcttatcaggttccaccggtagagttggagcagattcttcactcgaatccagatgtgattgatgctgcagttgttccgttccctgacgaggatgcaggagagattccaatggctttcatagtgagaaaaccaggaagcaatctcaacgaagcgcaaatcattgatttcgtagctaaacaagttgctccgtacaagaaggtaagacgagttgcttttataaatgcaatcccaaaaaatcctgctggcaagattctgcgtcgggagcttactaaaatcgctgtggatggcaatgcatcaaaactttga

SEQ ID NO: 29700 - protein, 562 aa, Arabidopsis thaliana
MLTKTNDSRLIDRSSGFDQRTGIYHSLRPSLSLPPIDQPLSAAEFALSLLLKSSPPATAGKNIEALTYLVNSSSGDNLTYGELLRRVRSLAVSLRERFPSLASRNVAFILSPSSLDIPVLYLALMSIGVVVSPANPIGSESEVSHQVEVSEPVIAFATSQTVKKLQSSSLPLGTVLMDSTEFLSWLNRSDSSSVNPFQVQVNQSDPAAILFSSGTTGRVKGVLLTHRNLIASTAVSHQRTLQDPVNYDRVGLFSLPLFHVFGFMMMIRAISLGETLVLLGRFELEAMFKAVEKYKVTGMPVSPPLIVALVKSELTKKYDLRSLRSLGCGGAPLGKDIAERFKQKFPDVDIVQGYGLTESSGPAASTFGPEEMVKYGSVGRISENMEAKIVDPSTGESLPPGKTGELWLRGPVIMKGYVGNEKASAETVDKEGWLKTGDLCYFDSEDFLYIVDRLKELIKYKAYQVPPVELEQILHSNPDVIDAAVVPFPDEDAGEIPMAFIVRKPGSNLNEAQIIDFVAKQVAPYKKVRRVAFINAIPKNPAGKILRRELTKIAVDGNASKL

SEQ ID NO: 29701 - DNA, 1653 bp, Arabidopsis thaliana
  CDS (1)..(1653)
atggcgaattctcaaagatcatcatctctgatcgatccaaggaacggtttctgcacatcaaactccacattttacagtaaacgcaaaccattggcacttccttcaaaagaatcactcgacatcacaacattcatctcctcccaaacgtaccgtggcaaaaccgccttcatagacgcagccacggaccaccgcataagcttctccgatttatggagggccgtggatcgtgtcgccgactgtctcctccacgacgtgggaatacggagaggtgacgtggtcctagtcctctctcccaacaccatctccatccccattgtctgcctctccgtgatgtctcttggcgctgtcttaactaccgctaatcctctcaacaccgctagtgaaatcttaagacaaatcgcggatagcaatccaaaactcgccttcacaacaccggaactggctcccaaaatcgccagttccggtatctcyatcgtcctcgagcgcgtagaagacactctacgcgttccgagaggactcaaagtggttgggaatctaactgaaatgatgaagaaagaaccaagtggacaagcagtcagaaaccaagttcataaagacgacacggcgatgttgctttactcctcggggacgacgggacgaagcaaaggagtgaattcgtctcacgggaacttaatagcacacgtggcgagatacatcgcggagccattcgagcagccacaacagaccttcatttgcactgttccgttgttccacacttttggtttactaaacttcgttttggccaccttagcgttaggtacgaccgttgtcatcctcccgaggtttgacctcggagagatgatggcggctgtcgagaaatacagagcgacgactctgattctcgtgccgccagttttagtaactatgataaacaaagcggatcaaataatgaagaagtacgacgtgagcttcttgagaacggtgcggtgcggtggagcacctttgagcaaggaagttactcaagggtttatgaagaaatatccaacggttgatgtttatcaaggatacgcattgacggaatctaacggtgcaggagcttcgatagaatcagtggaggagagtcggaggtacggtgcggtrgggttgttgtcatgtggtgtagaagcgaggattgtggatccgaatacgggtcaggtcatgggtttgaaccaaacgggcgaactttggcttaaagggccttctatcgccaaaggttatttcaggaatgaagaagaaattataacttcagaaggatggcttaaaacaggagatctatgctatatagacaacgatggatttctttttatcgttgatcgattgaaagagcttatcaaatacaaaggttaccaggtacctccagctgaactagaggctctcttactaaaccatccagatattctcgatgcagccgttattccgtttccagataaagaagcaggacaatttccgatggcttacgtagcacgaaagcctgagagtaatctttgtgagaaaaaggttatcgactttatttctaaacaggtggcaccatataagaaaataagaaaagtcgcatttatagactctataccaaagactccatcgggcaaaacacttcgcaaggatctaatcaaatttgccatttcaaaaatttaa

SEQ ID NO: 29702 - protein, 550 aa, Arabidopsis thaliana
MANSQRSSSLIDPRNGFCTSNSTFYSKRKPLALPSKESLDITTFISSQTYRGKTAFIDAATDHRISFSDLWRAVDRVADCLLHDVGIRRGDVVLVLSPNTISIPIVCLSVMSLGAVLTTANPLNTASEILRQIADSNPKLAFTTPELAPKIASSGISIVLERVEDTLRVPRGLKVVGNLTEMMKKEPSGQAVRNQVHKDDTAMLLYSSGTTGRSKGVNSSHGNLIAHVARYIAEPFEQPQQTFICTVPLFHTFGLLNFVLATLALGTTVVILPRFDLGEMMAAVEKYRATTLILVPPVLVTMINKADQIMKKYDVSFLRTVRCGGAPLSKEVTQGFMKKYPTVDVYQGYALTESNGAGASIESVEESRRYGAVGLLSCGVEARIVDPNTGQVMGLNQTGELWLKGPSIAKGYFRNEEEIITSEGWLKTGDLCYIDNDGFLFIVDRLKELIKYKGYQVPPAELEALLLNHPDILDAAVIPFPDKEAGQFPMAYVARKPESNLCEKKVIDFISKQVAPYKKIRKVAFIDSIPKTPSGKTLRKDLIKFAISKI

SEQ ID NO: 29703 - DNA, 1620 bp, Bacillus subtilis
  CDS (1)..(1620)
atgctgaaaggatttacgccttggcctgatgagttagctgagacctatcgaaagaacggctgctgggccggtgagacgtttggagatttgttaagggaccgggcagccaaatatggtgatcgcattgccattacatgcggaaacacccattggagctatcgagagcttgacacaagggctgatcgcctggctgccggatttcaaaagctcggcattcaacagaaggatcgtgttgtggtgcagttgccaaatatcaaagagttttttgaagttattttcgcgctattccgtctgggggcgcttccagtcttcgcactgccttctcatcgaagcagtgaaattacatatttttgcgagtttgctgaagcggctgcatatatcattcccgacgcatattccggttttgactaccgttcgcttgccagacaggttcaaagcaagctgccgactttgaaaaacatcattgtcgcaggtgaggcagaggaatttttgccgctggaggatttgcatacagaacctgtaaaactgcctgaagtcaaatcttcagatgtggcgttcctccagctttctggcgggagcaccgggctatcgaaactgattccgaggacccacgatgactacatatacagcctgaagcggagtgtggaggtctgctggctcgaccacagcacggtgtacttggccgcgctgccgatggcacacaattatccgctgagctcacccggcgttctcggcgtattatacgctggaggaagagtggtattatctccttctccaagtccagagatcgcatttcctttaattgaacgggaaaaggtcacgataaccgctcttgttccgcctcttgcgatggtatggatggatgcggcatcctcacgccgtgacgatttatccagccttcaagtgttgcaggtcggcggtgccaagtttagtgctgaagccgcgcgcagggtaaaagctgttttcggctgcacgctgcagcaggtgttcggaatggcagagggtctcgtcaattatacgagattggatgatcctgaggagatcattgtcaacacccaaggaaaaccgatgtccccatatgatgaagtgcgtgtttgggatgatcatgatcgcgacgtaaaacctggtgaaacaggccatttgctgacgcggggaccgtatacaattcgaggttactataaggcagaagagcataacgccgcttcatttactgaggacggtttttaccgtacgggtgatatcgtcaggctgacacgagacgggtatattgtcgttgaaggccgggcgaaggatcaaattaaccgtggaggagaaaaggttgcggctgaagaggtggaaaatcatctgctggcgcatccggctgtccatgatgcggcaatggtctccatgcctgatcaatttcttggcgaaagatcttgtgtgttcattattccccgggatgaagccccaaaagccgcagagcttaaagcatttttgagagagcgcggactggcggcatataaaatccctgatcgagttgaatttgtcgaatccttcccgcagacaggagtaggaaaagtcagcaaaaaagcgctccgtgaagccatttccgagaagcttcttgcaggatttaaaaaataa

SEQ ID NO: 29704 - protein, 539 aa, Bacillus subtilis
MLKGFTPWPDELAETYRKNGCWAGETFGDLLRDRAAKYGDRIAITCGNTHWSYRELDTRADRLAAGFQKLGIQQKDRVVVQLPNIKEFFEVIFALFRLGALPVFALPSHRSSEITYFCEFAEAAAYIIPDAYSGFDYRSLARQVQSKLPTLKNIIVAGEAEEFLPLEDLHTEPVKLPEVKSSDVAFLQLSGGSTGLSKLIPRTHDDYIYSLKRSVEVCWLDHSTVYLAALPMAHNYPLSSPGVLGVLYAGGRVVLSPSPSPEIAFPLIEREKVTITALVPPLAMVWMDAASSRRDDLSSLQVLQVGGAKFSAEAARRVKAVFGCTLQQVFGMAEGLVNYTRLDDPEEIIVNTQGKPMSPYDEVRVWDDHDRDVKPGETGHLLTRGPYTIRGYYKAEEHNAASFTEDGFYRTGDIVRLTRDGYIVVEGRAKDQINRGGEKVAAEEVENHLLAHPAVHDAAMVSMPDQFLGERSCVFIIPRDEAPKAAELKAFLRERGLAAYKIPDRVEFVESFPQTGVGKVSKKALREAISEKLLAGFKK

SEQ ID NO: 29705 - DNA, 1626 bp, Agrobacterium tumefaciens
  CDS (1)..(1626)
atgacaatcgaatttgaacgctggcccgaggatttcgttcgccgataccgcgaacgcggctactggaccgaccggccgctgagcggcatcctcaccgaacaggtggagcgccggccggatgcgacggcgctgatctgcggcgaccgccgcttcagctatgccgatctcgaccggcaatcctccaatcttgccggacatctctccgccgcgggcgttggcaaaggtgacactgcgctagtgcaattgcctaacatcgccgagttttatctcgtctttttcgcgctgatgaaaatcggcgcagcccccgtcaacgcacttttcagccatcgccggctggaaatgacctcctatgcggagcagattgcaccgaagctggtgattgcctcgcgcagccacgagcttttcgccgatgacgcatttgtggagacgctgaaagcagtctccccgaagcttgcggtgaccctgctgctcggcgaagcggatccgcagcgcagccttgagcggatgcttgccaattccgccgaaaacccgcccgcctacgccccttcggcgtcagacgaggtggcgttgttccagctttccggcggcagcaccggaaccccgaaactgatcccgaggacgcacaacgactatgattacagcgcccgggccagcgcggagatttgcgaactctcgcctgagacccgtttcctttgcgccattccggtggcgcataattacccgatgagctcgcccggcgcgctcggcgttttccacgccggcggcaccgtggtcatggccgccaatccggagccgcttgcctgcttcgatctcatcgaaaaacacgagatcgacatggtgccgctggtgccgccggccgtggcgctgtggctgcaggctgcacccgcccatcgtgaacggctgaaatccctcaagctcctgcaggtcggcggcgcaagctttgccgaagccctggcccgccaggtgccagaagtgctgggctgcgacctgcagcaggtattcggcatggcggaagggctggtgaactacacccgcgccggtgatcccgaccatatcgttttcaccacgcaagggaggccgatcagcccggatgacgagatccgcatcgtcgacgaggacggcaacgatgtgcccgagggcgaagccggcatgctggcgacccgtggcccctatacgttccggggctattaccgcgcgcccgaacatagcgcccgggtcttcgacagggatgggttctattattccggcgatgtcgtgcagcgcacgcccgaaggttatctccgggtcgttggccgggtgaaggaccagatcaatcgcggcggcgaaaaggtcgcttcggaggaggtcgaaaaccttatcctgcggcatccggacgtcacccatgcagcactcgtggcgatgcacgacgagcttctaggtgagaaaagctgcgtcttcgtcgtttcacgcaatcccgcgctcaaggcgccggccatccgccagcatctcgccggtcttggcgtcgcggattacaagctgccggaccgtgtgcgcttcatcgaggccatgccgctcaccgccgtcggcaagatcgacaagaaacgtctgcgcgacctgcttgtgacacccgtcgccatcagcgcctga

SEQ ID NO: 29706 - protein, 541 aa, Agrobacterium tumefaciens
MTIEFERWPEDFVRRYRERGYWTDRPLSGILTEQVERRPDATALICGDRRFSYADLDRQSSNLAGHLSAAGVGKGDTALVQLPNIAEFYLVFFALMKIGAAPVNALFSHRRLEMTSYAEQIAPKLVIASRSHELFADDAFVETLKAVSPKLAVTLLLGEADPQRSLERMLANSAENPPAYAPSASDEVALFQLSGGSTGTPKLIPRTHNDYDYSARASAEICELSPETRFLCAIPVAHNYPMSSPGALGVFHAGGTVVMAANPEPLACFDLIEKHEIDMVPLVPPAVALWLQAAPAHRERLKSLKLLQVGGASFAEALARQVPEVLGCDLQQVFGMAEGLVNYTRAGDPDHIVFTTQGRPISPDDEIRIVDEDGNDVPEGEAGMLATRGPYTFRGYYRAPEHSARVFDRDGFYYSGDVVQRTPEGYLRVVGRVKDQINRGGEKVASEEVENLILRHPDVTHAALVAMHDELLGEKSCVFVVSRNPALKAPAIRQHLAGLGVADYKLPDRVRFIEAMPLTAVGKIDKKRLRDLLVTPVAISA

SEQ ID NO: 29707 - DNA, 1644 bp, Photorhabdus luminescens
  CDS (1)..(1644)
atgatagttgaatttaatcgttggccaaaagcgctggaacagcgctatcgtcaacttggttattggatagatctcccgcttagcgacatttttacccgtcagtcaaacaacgggaaaattgcgcttatctgtggagatcgtcagttcagctatgctgaacttaatctgctggtggatagtttagccgcagcattacaacgacaaggcgttaaacgaggacaaaccgccttagttcaattggggaatgaggccgagttttatattgttttctttgccttattacggcttggggtagttccggttaacgctatatatagccatcagcgtagtgaactttgtgcttatgctgatcagattaaccccgcattgttaattgccgatcgcaaccattccttgtttagcgacgacaattttattgatgaactcagagcctgtacgccgtctttgagtcacgttgtcttacgtggtgataatgacagtattttggattttgagacactattggcagaaggtgctggtgattttatcgctgatccaacaccggctgatgaagttgcatttttccaattgtcgggggggagtacggggacacctaaacttattccccgaacgcataatgattattactacagtattcgcgccagtgtggacatttgccagtttaatgctgaaactcgctatttatgtgcacttcctgctgcgcataactttcctatgagctcaccgggggcattaggggcgttttacagcgggggacaggtcattttagcgaataaccccagtgctgattgctgttttccgctaatccagcaacatcaggtgaatgttactgcattgataccgccagcagtcagtgtatggtttgaggcgatagcacttagtggtaaccgtgatgcactaaaaagcttgcgattgctacaggtcggtggggcaaggttaagcgaaagtctggcaagacgtattccaaaagagatgggatgccagctacaacaagttttcggtatggctgaaggattagtgaactatacccggctggatgatgacgaacagcatatttttacgacacaaggctgcccgaccagtcaggatgatgaagtttgggttgctgataatgatggcaatcctgttcctcccggcgtcgctggccggttgatgactcaggggccttataccttccgcggatattaccgcagtccacagcataatcagcaatgttttgatagtaatggattctactgttctggtgatctcgtcatcatggcacctgatggttatttacaagtcgtggggcgtgaaaaagatcaaatcaatcgcggtggggaaaaaattgcggctgaggaaattgagaatctgctgcttcggcaccctgatgtcatttatgctgcgctggtcgctattcctgatccgctaatgggtgaaaaaagctgtgcttttgtcgtattacgaaaaccgataaaagccgtagtcttacggcgttatctgcgtgagcagggaatagcagattataaattgcctgaccggtttgaacctgttccctcactgccgataacacctgtcggaaaaatagacaaaaaacaattacgtcaacttactaaacaatttgttcagccatcactcgttggagaaagaaatgagcattcctaa

SEQ ID NO: 29708 - protein, 547 aa, Photorhabdus luminescens
MIVEFNRWPKALEQRYRQLGYWIDLPLSDIFTRQSNNGKIALICGDRQFSYAELNLLVDSLAAALQRQGVKRGQTALVQLGNEAEFYIVFFALLRLGVVPVNAIYSHQRSELCAYADQINPALLIADRNHSLFSDDNFIDELRACTPSLSHVVLRGDNDSILDFETLLAEGAGDFIADPTPADEVAFFQLSGGSTGTPKLIPRTHNDYYYSIRASVDICQFNAETRYLCALPAAHNFPMSSPGALGAFYSGGQVILANNPSADCCFPLIQQHQVNVTALIPPAVSVWFEAIALSGNRDALKSLRLLQVGGARLSESLARRIPKEMGCQLQQVFGMAEGLVNYTRLDDDEQHIFTTQGCPTSQDDEVWVADNDGNPVPPGVAGRLMTQGPYTFRGYYRSPQHNQQCFDSNGFYCSGDLVIMAPDGYLQVVGREKDQINRGGEKIAAEEIENLLLRHPDVIYAALVAIPDPLMGEKSCAFVVLRKPIKAVVLRRYLREQGIADYKLPDRFEPVPSLPITPVGKIDKKQLRQLTKQFVQPSLVGERNEHS

SEQ ID NO: 29709 - DNA, 1545 bp, Arabidopsis thaliana
  CDS (1)..(1545)
atggatagcgatactctctcaggattattggaaaacgtcgccaaaaaattccccgatcgccgagctctctccgtttctggaaaattcaatctcactcacgcgcgtcttcacgatctaatcgaacgcgccgcttcacgccttgtctccgacgctggaatcaaacccggcgatgtcgttgctctcaccttccctaacaccgtcgagtttgttataatgtttttagcggtgataagagctagagccacggcggcgccgttgaacgcagcgtacacggcggaggaatttgagttttacctctccgattcagattcaaagctattgttaacctctaaagaaggaaacgcaccggctcaagaagcagcttcaaagctgaaaatctctcacgtcaccgctacgctgcttgacgctgtctcggaccttgtactatccgttgcggattcagattccgtcgttgactcagcgacggaactcgttaatcacccggacgacggtgctctcttcctccacacttctggcactacgagccgtccaaagggtgtaccgcttacgcagctcaatctagcttcatccgtcaagaacattaaagctgtgtacaagcttactgagtctgattctacggtgatttttctccctctgttccatgttcatggattgttagctgggttgcttagctcgcttggagctggtgctgctgtaactcttccagctgctggtagattctcagcaacaacattttggccagatatgaagaagtataacgctacatggtatactgctgtgccgaccattcatcagatcatattggaccgccacgcgagccaccctgagacggaatatcctaaactccggttcatcaggagttgcagtgcttctttggctccggtgatattgtccaggcttgaggaagcgtttggagcaccggtgctcgaggcctatgcaatgacagaggcaacacatttgatgagctcaaaccccttaccagaggaaggtccacacaagcctgggtctgttgggaaaccggtaggtcaagaaatggcgatccttaatgagaaaggcgagatccaagagccaaataacaaaggagaggtttgtataagaggtccaaatgtgaccaagggttacaagaataacccagaagccaacaaggcaggtttcgagtttgggtggttccacactggtgatatcggttactttgataccgatgggtatttgcatctggtgggtcggatcaaagagcttattaaccgtggaggtgagaagatatctccaattgaagtggatgcagtactcttaacgcatcctgacgtttctcagggtgttgcattcggtgttcctgatgagaaatatggggaagagattaactgtgcggtgattccaagagaaggaactactgtaaccgaagaggacattaaagcgttttgtaagaagaatttggcagctttcaaggtgccaaagagagtgttcatcactgataacctccccaaaactgcctctggtaagattcagcgccgtatcgtcgcacaacatttccttgagaagccctga

SEQ ID NO: 29710 - protein, 514 aa, Arabidopsis thaliana
MDSDTLSGLLENVAKKFPDRRALSVSGKFNLTHARLHDLIERAASRLVSDAGIKPGDVVALTFPNTVEFVIMFLAVIRARATAAPLNAAYTAEEFEFYLSDSDSKLLLTSKEGNAPAQEAASKLKISHVTATLLDAVSDLVLSVADSDSVVDSATELVNHPDDGALFLHTSGTTSRPKGVPLTQLNLASSVKNIKAVYKLTESDSTVIFLPLFHVHGLLAGLLSSLGAGAAVTLPAAGRFSATTFWPDMKKYNATWYTAVPTIHQIILDRHASHPETEYPKLRFIRSCSASLAPVILSRLEEAFGAPVLEAYAMTEATHLMSSNPLPEEGPHKPGSVGKPVGQEMAILNEKGEIQEPNNKGEVCIRGPNVTKGYKNNPEANKAGFEFGWFHTGDIGYFDTDGYLHLVGRIKELINRGGEKISPIEVDAVLLTHPDVSQGVAFGVPDEKYGEEINCAVIPREGTTVTEEDIKAFCKKNLAAFKVPKRVFITDNLPKTASGKIQRRIVAQHFLEKP

SEQ ID NO: 29711 - DNA, 1641 bp, Glycine max
  CDS (1)..(1641)
atggcaccttctccacaagaaatcatcttccgatccccactccccgatattccgatccccacacatctcccattgtactcttactgcttccaaaacttgtcacagttccatgaccgtccatgcctcatcgacggcgacaccggcgagaccctcacctacgccgacgtcgacctcgctgctcgccgcatcgcctccggcctccacaaaatcggcatccgccagggtgacgtcatcatgctcgtcctacgcaactgcccgcagttcgccctcgccttcctcggcgccacccaccgtggcgccgtcgtcaccacagccaaccccttctacacgccggcggagcttgcgaagcaagcgacggccacgaaaaccaggctcgtcataacgcaatccgcgtacgtagagaaaatcaagagtttcgcggacagcagcagcgatgtcatggtgatgtgcattgatgatgatttttcttatgaaaacgacggcgttttgcatttctcaacgctcagtaacgccgacgaaacggaagcccctgccgttaagattaaccctgacgagctcgttgcgcttccgttttcttctggcacgtctgggctccccaagggcgttatgttatcgcataaaaacttggtcaccacgatagcgcagttagttgacggcgaaaacccgcaccaatacactcacagcgaggatgtgctactctgtgtgttgcctatgtttcatatctatgcgctcaattccattttgctctgcgggattcgttccggtgcggccgtgcttattttgcagaagtttgagatcactactctgttggagctcatcgagaagtacaaggtgacggttgcgtcgtttgtgccgcccatcgttttggcgttggttaagagcggagagactcatcgctacgacctgtcgtctattcgcgctgtggtcaccggcgcggcacccttaggaggggaacttcaagaagccgttaaggctaggctaccacacgctacttttggacagggatatgggatgacagaagcaggaccacttgccattagcatggcatttgcaaaagtaccctctaagattaaaccaggtgcatgcggaaccgttgtgagaaacgccgagatgaaaatcgtggatacagaaacgggtgattcacttccaagaaacaaacacggtgaaatttgcataataggcacaaaggtcatgaaaggatatctaaatgacccagaggctacagagagaactgtagacaaagaaggatggttacacacaggagatattggtttcattgatgatgatgatgaactcttcattgttgatcggttaaaggaattgatcaaatacaaaggattccaagtggctcctgctgagcttgaagcattgttgattgcccacccaaacatttctgatgctgccgttgtaggcatgaaagatgaagctgcaggggaaattccagttgcatttgttgtaaggtcaaatggttctgagatagccgaggatgaaatcaagaaatacatttcacaacaggtggttttttacaagagaatatgtagagttttcttcacggactctattcctaaagcaccctcaggcaaaattctgcgaaaggtattaactgcaagacttaacgaaggtttggtggtggccaattag

SEQ ID NO: 29712 - protein, 546 aa, Glycine max; identical to SEQ ID NO: 14265

SEQ ID NO: 29713 - DNA, 1644 bp, Glycine max
  CDS (1)..(1644)
atggctgatgatggaagcaggagggaattgatattcaggtcgaagcttccggatatctacatccccaaacatatgcccctccactcttactgcttcgagaatttgagagagtgtggttcacgcccctgcctgatcaatgcccccacgggagacgtctacagctaccacgaggtggacagcaccgccagaaaggtggcgagggggctgaagaaagagggcgtggaacagggccaggtcatcatgatcctcctccccaattgccccgaattcgtcttctcgtttcttggcgcatcccaccgcggtgccatggccactgccgccaaccctttcttcacccccgccgagattgcaaagcaagcccatgcctccaatgccaagctcctcatcacccaggcctcttactacgacaaagtcaaggacctccgcgacatcaagctcgtattcgtcgactcttgtcccccccatacagaggagaagcagcatctccatttctcacatctgtgtgaggataacggtgacgctgatgttgatgttgatgttgatatcaagcccgatgacgtggttgcattgccttattcttcgggaacaactggtcttcccaagggagtgatgctgagccacaaggggctggtgaccagcattgctcagcaggttgacggtgataatcccaacctctattaccactgccacgacaccatcctctgcgtgcttcccctctttcacatttactctctcaactccgttcttctctgtggcttgcgtgccaaggctaccattctcctcatgcccaagttcgatattaactccttgcttgctctcattcacaagcacaaagtcactattgcccctgtcgtccctcccattgttctcgccatttccaaatcacccgatctccacaagtacgacctgtcttccatcagagtcttgaagtccgggggagcccctctgggtaaggaactcgaagacactctcagagctaaattccccaacgccaaacttggccagggatacggaatgactgaggcagggcctgtgctaacaatgtctttagcttttgctaaagaaccgatagacgtgaaaccaggtgcatgtggaaccgttgtaagaaatgcagagatgaagattgtcgatcctgaaaccggtcattctttacccagaaaccaatccggtgaaatttgcataagaggcgaccagattatgaaaggttatctaaatgatggagaggctacagagagaaccatagacaaagatggttggttgcacacaggtgacatcggttacatcgacgatgacgatgagttattcatcgttgacaggctcaaggaattgatcaaatacaaaggatttcaagtggctccagctgaacttgaagcccttcttctcactcatcctaagatctctgatgctgctgttgttccaatgaaggatgaagccgcgggagaggtacctgttgcatttgtggtcatatcaaatggttataccgacacaaccgaggatgaaattaagcagtttatctccaaacaggtggtgttttacaaaagaataaaccgagtattcttcattgatgcaattcccaagtcaccgtcaggcaaaatcttgcgcaaggatctaagagcaaagatagcggcaagtgttccaaaatga

SEQ ID NO: 29714 - protein, 547 aa, Glycine max
MADDGSRRELIFRSKLPDIYIPKHMPLHSYCFENLRECGSRPCLINAPTGDVYSYHEVDSTARKVARGLKKEGVEQGQVIMILLPNCPEFVFSFLGASHRGAMATAANPFFTPAEIAKQAHASNAKLLITQASYYDKVKDLRDIKLVFVDSCPPHTEEKQHLHFSHLCEDNGDADVDVDVDIKPDDVVALPYSSGTTGLPKGVMLSHKGLVTSIAQQVDGDNPNLYYHCHDTILCVLPLFHIYSLNSVLLCGLRAKATILLMPKFDINSLLALIHKHKVTIAPVVPPIVLAISKSPDLHKYDLSSIRVLKSGGAPLGKELEDTLRAKFPNAKLGQGYGMTEAGPVLTMSLAFAKEPIDVKPGACGTVVRNAEMKIVDPETGHSLPRNQSGEICIRGDQIMKGYLNDGEATERTIDKDGWLHTGDIGYIDDDDELFIVDRLKELIKYKGFQVAPAELEALLLTHPKISDAAVVPMKDEAAGEVPVAFVVISNGYTDTTEDEIKQFISKQVVFYKRINRVFFIDAIPKSPSGKILRKDLRAKIAASVPK

SEQ ID NO: 29715 - DNA, 1713 bp, Glycine max
  CDS (1)..(1713)
atgacaacggtagctgcttctcttgatgccaaagaggtgtctacctccaaaactgaccaaaaccaagtgtgtgactgtgatccccaaactagccatgtcttcaaatcaaaattaccagatatcccaatctccaaccacctccctctccacgcttactgctttcagaaactatcccaattctccgaccgcccatgcctcatcgtcggacccgccgccaaaacctacacctactccgagacacacctcatttcacgcaagattgccgccggattgtccaacctcggaatccgcaagggcgacgtggtcatgatccttctccagaactccgccgagttcgtcttctccttcctcgctgcctccatgatcggcgccgtcgccaccacagccaatccgttctacaccgccgcggagatcttcaagcagtttaccgtctccaagacgaagctgatcataacgcaggcaatgtacgtggacaagcttcgcaaccacgacgacggcgcgaagctcggcgaggacttcaaggttgtgaccgtcgacgacccgccggaaaattgcctccacttctcggtgctctcggaggcgaacgagagcgacgcgccggaggttgatatccaacccgacgacgcggtggcgatgccgttctcttccggcacgacgggtttacctaaaggagtggttctcacgcacaagagtttaacaaccagtgtggcgcaacaagttgacggagagaaccctaacctctacctcaccaccgaggacgtgctcctatgcgtgcttccgttgtttcacatattctccctcaacagtgtgcttttgtgcgcgcttagggccgggagtgcggttttgttgatgcagaagttcgagattgggacgctgttggagctcatacagcggcaccgcgtgtcggtggcgatggtggtgccgccgctggtgctggcgttggcgaagaatccgatggtggcggattttgacctgagttcaatacggttagtgctgtcgggagctgctcccttggggaaggagctcgtggaagctctccggaacagggtgcctcaagccgttttgggacaggggtacgggatgacagaagcaggaccagtgctgtccatgtgcttgggctttgcaaagcaacctttcccaacaaaatcaggctcttgtggtaccgtagtcagaaatgcagaactcagggttgttgaccctgaaactggtcgttctcttggctacaatcaacccggtgaaatttgcatcagagggcaacagatcatgaaaggatatctgaacgatgagaaagcgacagcattgaccatagattcagagggttggcttcacaccggtgatgttggctatgtagatgaagatgatgaaattttcattgttgacagggtgaaagaactcatcaaatataaaggcttccaggtgccccctgcagaacttgaagggcttcttgtaagccatccctccattgcagacgcagctgtagtcccacaaaaggatgttgctgctggtgaagttcctgttgccttcgttgtgagatcaaacggctttgatctaactgaagaggctgtaaaagagtttatagctaaacaggtagtgttttacaaaagactgcacaaagtttattttgtacatgctattcccaagtctccatcaggaaagatattaaggaaagacctcagagcaaagctagaaaccgccgccactcagacgccttaa

SEQ ID NO: 29716 - protein, 570 aa, Glycine max
MTTVAASLDAKEVSTSKTDQNQVCDCDPQTSHVFKSKLPDIPISNHLPLHAYCFQKLSQFSDRPCLIVGPAAKTYTYSETHLISRKIAAGLSNLGIRKGDVVMILLQNSAEFVFSFLAASMIGAVATTANPFYTAAEIFKQFTVSKTKLIITQAMYVDKLRNHDDGAKLGEDFKVVTVDDPPENCLHFSVLSEANESDAPEVDIQPDDAVAMPFSSGTTGLPKGVVLTHKSLTTSVAQQVDGENPNLYLTTEDVLLCVLPLFHIFSLNSVLLCALRAGSAVLLMQKFEIGTLLELIQRHRVSVAMVVPPLVLALAKNPMVADFDLSSIRLVLSGAAPLGKELVEALRNRVPQAVLGQGYGMTEAGPVLSMCLGFAKQPFPTKSGSCGTVVRNAELRVVDPETGRSLGYNQPGEICIRGQQIMKGYLNDEKATALTIDSEGWLHTGDVGYVDEDDEIFIVDRVKELIKYKGFQVPPAELEGLLVSHPSIADAAVVPQKDVAAGEVPVAFVVRSNGFDLTEEAVKEFIAKQVVFYKRLHKVYFVHAIPKSPSGKILRKDLRAKLETAATQTP

SEQ ID NO: 29717 - DNA, 1611 bp, Populus tomentosa
  CDS (1)..(1611)
atgaatccacaagaagaattcatctttcgctcaaaattaccagacatctacatcccgaaaaaccttcccctgcattcatacgttcttgaaaacttgtctaaacattcatcaaaaccttgcctgataaatggcgcgaatggagatgtctacacctgtgctgacgttgagctcacagcaagaagagttgcttctggtctcaacaagattggtattcaacaaggtgacgtgatcatgctcttcctaccaagttcacctgaattcgtgcttgctttcctaggcgcttcacacagaggtgccatcaccactgctgccaatcctttctccacccctgcagagctagcgaaacatgccaaggcctcgagagcaaagcttctgataacacaggcttgttactacgagaaggttaaagattttgccagagaaagtgatgttaaggtcatgtgcgtggactctgccccggatgggtgcttgcacttctcagagctaacacaggcagacgaaaatgaagcgcctcaggtcgacattagtcctgatgatgtcgtggcattgccttattcatcagggactacagggttgccaaaaggggtcatgttaacgcacaaagggctaataaccagtgtggctcaacaggtagatggagacaatcctaacctgtattttcacagtgaagatgtgattctgtgtgtgctccctatgttccatatctatgctctgaattcaataatgctgtgtgggctgagagtcggtgcctcgattttgataatgccaaagtttgagattggtactttgctgggattgattgagaagtacaaggtatctatagcaccggttgttccacctgtgatgttggcaattgctaggtcacctgatcttgacaagcatgacttgtcttctctgaggatgataaaatctggaggggctccattgggcaaggaacttgaagatactgtcagagctaagtttcctcaggctagacttggtcagggatatggaatgaccgaggcaggacctgttctagcaatgtgcttggcatttgccaaggaaccattcgacataaaaccaggtgcatgtgggactgtagtcaggaatgcagagatgaagattgttgacccagaaacaggggcctctctaccgaggaaccagcctggtgagatctgcatccggggtgatcagatcatgaaaggatatcttaatgaccctgaggcaacctcaagaacaatagacaaagaaggatggttgcacacaggcgatatcggctacattgatgatgatgatgagcttttcatcgttgacaggttgaaggaattgatcaagtataaagggtttcaggttgctcctgctgaactcgaagctttgttaatagcccatccagagatatccgatgctgctgtagtaggaatgaaagatgaggatgcaggagaagttcctgttgcatttgctgtgaaatcagaaaagtctcaggccaccgaagatgaaattaagcagtatatttcaaaacaggtgatattctacaagagaataaaacgagttttcttcattgaagctattcccaaggcaccatctggcaagatcctgaggaagaatctgaaagagaagttgccaggcatataa

SEQ ID NO: 29718 - protein, 536 aa, Populus tomentosa; identical to SEQ ID NO: 14273

SEQ ID NO: 29719 - DNA, 1623 bp, Amorpha fruticosa
  CDS (1)..(1623)
atggcatttgagacagaagaaccaaaggaattcatcttcaggtcaaaattaccagaaatcccaatctccaaacaccttccccttcactcttactgctttgagaacctctcagaattcgggtcacgtccatgcttgatcagtgccccaacaggggacgtgtacacctactatgacgtggaactcaccgctagaagagttgcctctggactcaacaaattgggtgtccaacaaggtgatgtcatcatgctccttcttcctaattcaccagaatttgtgttctccttcttgggtgcctcttaccgtggtgccatgatcactgctgccaacccattcttcacatccgctgagattgcaaaacaggccaaagcctccaacaccaagttgcttataacacaagcttcttactacgacaaggttaaggatttggatgtgaagttggtgttcgtggactctccccctgatgggcacatgcactattcagagctgcgtgaggctgatgagagtgacatgcctgaggtgaagaccaaccctgatgatgtggtggcacttccctattcgtcagggacaacagggttgcccaaaggggtgatgttatctcacaaagggttggcgaccagcatagcacaacaagttgatggggaaaaccccaacctctactttcacaatgaggatgtcatattgtgtgtgcttccactctttcatatatattctctcaattctgttctgttgtgtgggttgagagccaaggctgctattttgctgatgccaaagtttgagatcaatgccttgttgggtctcattcagaaacaccgagtaacaattgcccctattgtcccacccattgttttggccattgccaagtcaccggatcttgaaaagtatgatctctcttccattagggtgttgaaatctggaggggcttctctgggcaaagaactcgaagacactgtgagggctaaattccccaaggccaaacttggacagggatacggaatgactgaggcagggccagtgctaacaatgtgcttagcatttgctaaggaaccgatagatgtaaaaccaggtgcatgtggaaccgttgtaagaaatgcagagatgaagattgtggatcctgaaactggtaattcgttgccacgaaaccagtccggtgaaatttgcataagaggcgaccagatcatgaaaggttatctaaatgatcaagaggctacgcagagaaccatagacaaagaagggtggttgcatacaggtgacatcggctacatcgacgatgacgatgagttattcatcgttgacaggcttaaggaattgatcaaatacaaaggatttcaggtggctcctgctgaactcgaagcccttcttctctctcatcccaagatcaccgatgctgctgtggttccaatgaaggatgaagcagctggagaggtacctgttgcatttgtggtgagatcaaatggtcacacagacacaaccgaggatgaaattaagcagtttatctccaaacaggtggtgttttataaaagaataagcagagtattcttcattgatgcaattcccaagtcaccgtcaggtaaaatcttacgaaaggatctaagagcaaagcttgcagcaggtgttccaaattga

SEQ ID NO: 29720 - protein, 540 aa, Amorpha fruticosa; identical to SEQ ID NO: 14277

SEQ ID NO: 29721 - DNA, 1611 bp, Populus tomentosa
  CDS (1)..(1611)
atgaatccacaagaagaattcatctttcgctcaaaattaccagacatctacatcccgaaaaaccttcccctgcattcatacgttcttgaaaacttgtctaaccattcatcaaaaccttgcctgataaatggcgcgaatggagatgtctacacctatgctgacgttgagctcacagcaagaagagttgcttctggtctgaacaagattggtattcaacaaggtgacgtgatcatgctcttcctaccaagttcacctgaattcgtgcttgctttcctaggcgcttcacacagaggtgccattatcactgctgccaatcctttctccacccctgcagagctagcaaaacatgccaaggcctcgagagcaaagcttctgataacacaggcttgttactacgagaaggttaaagattttgcccgagaaagtgatgttaaggtcatgtgcgtggactctgccccggatggatgcttgcacttttcagagctaacacaggcagacgaaaatgaagcgcctcaggtcgacattagtcccgatgatgtcgtagcattgccttattcatcagggactacagggttgccaaaaggggtcatgttaacgcacaaagggctaataaccagtgttgctcaacaggtagatggagacaatcctaacctgtattttcacagtgaagatgtgattctgtgtgtgctgcctatgttccatatctatgctctgaattcaataatgctctgcgggctgagagtcggtgccccgattttgataatgccaaagtttgagattggttctttactgggattgattgagaagtacaaggtatctatagcaccggttgttccacctgtgatgatgtcaattgctaagtcacctgatcttgacaagcatgacttgtcttctttgaggatgataaaatctggaggggctccattgggcaaggaacttgaagatactgtcagagctaagtttcctcaggctagacttggtcagggatatggaatgaccgaggcaggacctgttctagcaatgtgcttggcatttgccaaggaaccattcgacataaaaccaggtgcatgtgggactgtagtcaggaatgcagagatgaagattgttgacccagaaacaggggcctctctaccgaggaaccagcctggtgagatctgcatccggggtgatcagatcatgaaaggatatcttaatgaccctgaggcaacctcaagaacaatagacaaagaaggatggctgcacacaggcgatatcggctacattgatgatgatgatgagcttttcatcgttgacagattgaaggaattgatcaagtataaagggtttcaggttgctcctgctgaactcgaagctttgttaatagcccatccagagatatccgatgctgctgtagtaggattgaaagatgaggatgcgggagaagttcctgttgcatttgtagtgaaatcagaaaagtctcaggccaccgaagatgaaattaagcagtatatttcaaaacaggtgatattctacaagagaataaaacgagttttcttcattgaagctattcccaaggcaccatctggcaagatcctgaggaagaatctgaaagaaaagttggcaggcatataa

SEQ ID NO: 29722 - protein, 536 aa, Populus tomentosa
MNPQEEFIFRSKLPDIYIPKNLPLHSYVLENLSNHSSKPCLINGANGDVYTYADVELTARRVASGLNKIGIQQGDVIMLFLPSSPEFVLAFLGASHRGAIITAANPFSTPAELAKHAKASRAKLLITQACYYEKVKDFARESDVKVMCVDSAPDGCLHFSELTQADENEAPQVDISPDDVVALPYSSGTTGLPKGVMLTHKGLITSVAQQVDGDNPNLYFHSEDVILCVLPMFHIYALNSIMLCGLRVGAPILIMPKFEIGSLLGLIEKYKVSIAPVVPPVMMSIAKSPDLDKHDLSSLRMIKSGGAPLGKELEDTVRAKFPQARLGQGYGMTEAGPVLAMCLAFAKEPFDIKPGACGTVVRNAEMKIVDPETGASLPRNQPGEICIRGDQIMKGYLNDPEATSRTIDKEGWLHTGDIGYIDDDDELFIVDRLKELIKYKGFQVAPAELEALLIAHPEISDAAVVGLKDEDAGEVPVAFVVKSEKSQATEDEIKQYISKQVIFYKRIKRVFFIEAIPKAPSGKILRKNLKEKLAGI

SEQ ID NO: 29723 - DNA, 1611 bp, Populus tomentosa
  CDS (1)..(1611)
atgaatccacaagaagaattcatctttcgctcaaaattaccagacatctacatcccgaaaaaccttcccctgcattcatacgttcttgaaaacttgtctaaccattcatcaaaaccttgcctgataaatggcgcgaatggagatgtctacacctatgctgacgttgagctcacagcaagaagagttgcttctggtctgaacaagattggtattcaacaaggtgacgtgatcatgctcttcctaccaagttcacctgaattcgtgcttgctttcctaggcgcttcacacagaggtgccattatcactgctgccaatcctttctccacccctgcagagctagcaaaacatgccaaggcctcgagagcaaagcttctgataacacaggcttgttactacgagaaggttaaagattttgcccgagaaagtgatgttaaggtcatgtgcgtggactctgccccggatgggtgcttgcacttttcagagctaacacaggcagacgaaaatgaagcgcctcaggtcgacattagtcccgatgatgtcgtagcattgccttattcatcagggactacagggttgccaaaaggggtcatgttaacgcacaaagggctaataaccagtgttgctcaacaggtagatggagacaatcctaacctgtattttcacagtgaagatgtgattctgtgtgtgctgcctatgttccatatctatgctctgaattcaataatgctctgcgggctgagagtcggtgcctcgattttgataatgccaaagtttgagattggttctttactgggattgattgagaagtacaaggtatctatagcaccggttgttccacctgtgatgatgtcaattgctaagtcacctgatcttgacaagcatgacttgtcttctttgaggatgataaaatctggaggggctccattgggcaaggaacttgaagatactgtcagagctaagtttcctcaggctagacttggtcagggatatggaatgaccgaggcaggacctgttctagcaatgtgcttggcatttgccaaggaaccattcgacataaaaccaggtgcatgtgggactgtagtcaggaatgcagagatgaagattgttgacccagaaacaggggcctctctaccgaggaaccagcctggtgagatctgcatccggggtgatcagatcatgaaaggatatcttaatgaccctgaggcaacctcaagaacaatagacaaagaaggatggctgcacacaggcgatatcggctacattgatgatgatgatgagcttttcatcgttgacagattgaaggaattgatcaagtataaagggtttcaggttgctcctgctgaactcgaagctttgttaatagcccatccagagatatccgatgctgctgtagtaggattgaaagatgaggatgcgggagaagttcctgttgcatttgtagtgaaatcagaaaagtctcaggccaccgaagatgaaattaagcagtatatttcaaaacaggtgatattctacaagagaataaaacgagttttcttcattgaagctattcccaaggcaccatctggcaagatcctgaggaagaatctgaaagaaaagttggcaggcatataa

SEQ ID NO: 29724 - protein, 536 aa, Populus tomentosa
MNPQEEFIFRSKLPDIYIPKNLPLHSYVLENLSNHSSKPCLINGANGDVYTYADVELTARRVASGLNKIGIQQGDVIMLFLPSSPEFVLAFLGASHRGAIITAANPFSTPAELAKHAKASRAKLLITQACYYEKVKDFARESDVKVMCVDSAPDGCLHFSELTQADENEAPQVDISPDDVVALPYSSGTTGLPKGVMLTHKGLITSVAQQVDGDNPNLYFHSEDVILCVLPMFHIYALNSIMLCGLRVGASILIMPKFEIGSLLGLIEKYKVSIAPVVPPVMMSIAKSPDLDKHDLSSLRMIKSGGAPLGKELEDTVRAKFPQARLGQGYGMTEAGPVLAMCLAFAKEPFDIKPGACGTVVRNAEMKIVDPETGASLPRNQPGEICIRGDQIMKGYLNDPEATSRTIDKEGWLHTGDIGYIDDDDELFIVDRLKELIKYKGFQVAPAELEALLIAHPEISDAAVVGLKDEDAGEVPVAFVVKSEKSQATEDEIKQYISKQVIFYKRIKRVFFIEAIPKAPSGKILRKNLKEKLAGI

SEQ ID NO: 29725 - DNA, 1572 bp, Capsicum annuum
  CDS (1)..(1572)
atggagtgtttgacgctaactggattcttgaaacatgtggctgaaaagtaccctagtcatcgtgcgatttccgtttccggcaggctcgatatcactcatgcacgccttcaacaactcgttgaacgtgccgcttctcagattgtagctgccggtgtaaagcctggcgatgtcgtcgctctcactttccccaacacaatcgagttcgtgatcatgtttttagctgtaattcgagctcgagctacagcagcgccactgaattcagcgtacatggcagaagaattcgagttttatttatctgattcagaatcgaaactcttattaactgcaaaagaaggaaacgaagcagctcaagctgctgcctccaagctaaaaatccctcgtattagtgtaactctctctcaacccgactctgatgtcgctttctccccagctccacccgaatcggaccttgaatcgatgtccaaaatcgttaacgaaccatcagatgttggacttttccttcatacatcaggcaccactagcaggccaaaaggtgttcctctggctcagctgaatttgttgtcttcagtaaacaatatcaaatcggtgtacaaactgagtgacacggattctactgtgattgtgttgccgttgtttcacgttcacgggttaattgcggggttactgagctcacttggagccggagcagccgtgacacttccagctgcagggagattttcagcttcgactttttggtcagacatgaaaaaatacaacgcaacatggtacacagctgtgcctactattcaccaaattctattggatcgtcacctcagcaaacccgaatcggattacccaaagcttcggttcattcggagctgtagtgcagcactggctccatcagtgatggcgcggctagaagaagcattcgcggctcctgttttggaggcgtatgcaatgactgaggcaacccatttgatggcttcgaaccccttacccgaggatggcccacatattcccgggtcagttgggaaacccgtgggtcaagagatgggcattttgaatgagaatggggagttacaagggcctaatgctaaaggggaagtttgtataaggggtccaaatgtgacaaagggatacaagaacaatccagaggcaaataaatcagctttccagtttggttggtttcacactggagatgtggggtatttggactctgatggatacttgcatttggttggaagaatcaaggagttgatcaaccgcggaggggagaaaatatcacctattgaattggatgcagtcctagtttctcatccagaaattgctcaggctgttgcttttggagtccctgacgacaagtatggtgaagagataaactgtgcagttattccaagagaagggtcaaacatcgatgaagcagaggtgctgagattttgcaagaagaatttggcagcctttaaggtcccaaagaaggtcttcatgactgattctcttccaaaaactgcatcaggaaaaattcaacgccgactcgttgcagagcacttccttgcacagatttcaactgctaaagtccccaagtttggagcatag

SEQ ID NO: 29726 - protein, 523 aa, Capsicum annuum
MECLTLTGFLKHVAEKYPSHRAISVSGRLDITHARLQQLVERAASQIVAAGVKPGDVVALTFPNTIEFVIMFLAVIRARATAAPLNSAYMAEEFEFYLSDSESKLLLTAKEGNEAAQAAASKLKIPRISVTLSQPDSDVAFSPAPPESDLESMSKIVNEPSDVGLFLHTSGTTSRPKGVPLAQLNLLSSVNNIKSVYKLSDTDSTVIVLPLFHVHGLIAGLLSSLGAGAAVTLPAAGRFSASTFWSDMKKYNATWYTAVPTIHQILLDRHLSKPESDYPKLRFIRSCSAALAPSVMARLEEAFAAPVLEAYAMTEATHLMASNPLPEDGPHIPGSVGKPVGQEMGILNENGELQGPNAKGEVCIRGPNVTKGYKNNPEANKSAFQFGWFHTGDVGYLDSDGYLHLVGRIKELINRGGEKISPIELDAVLVSHPEIAQAVAFGVPDDKYGEEINCAVIPREGSNIDEAEVLRFCKKNLAAFKVPKKVFMTDSLPKTASGKIQRRLVAEHFLAQISTAKVPKFGA

SEQ ID NO: 29727 - DNA, 1740 bp, Populus balsamifera subsp
  CDS (1)..(1740)
atgatgtccgtggccacggttgagcccccgaaaccggaactctcccccccacaaaaccaaaacgcaccatcctctcatgaaactgatcatattttcagatcaaaactaccagatataaccatctcgaaccacctccctctgcacgcatactgctttgaaaacctctctgatttctcagataggccatgcttgatttcaggttccacgggaaaaacctactcttttgccgaaactcacctaatatctcgaaaggtcgctgctgggttatccaatttgggcatcaagaaaggcgatgtaatcatgaccctgctccaaaactgcccagaattcgtcttctccttcatgggtgcttccatgattggtgcagtcaccaccactgtgaaccctttctacactccaggtgaaatattcaagcaattctctgcttctcgtgcgaaactgattatcacccagtctcaacatgtgaacaagctaagagatagtgattaccatgaaaacaaccaaaaaccggaggaagatttcatagtaatcaccattgatgacccaccagagaactgtctacatttcaatgtgcttgttgaggctaacgagagtgaaatgccaacagtttcaatccatccggatgatcctgtggcattaccattctcttcagggacaacagggctcccaaaaggagtgatactgactcacaagagcttgataacaagtgtggctcaacaagttgatggagagatcccaaatttatacttgaaacaagatgatgtcgttttatgcgttttacctttgtttcacatcttttcattgaacagcgtgttgttatgctcgttgagagccggttctgctgtacttttaatgcaaaagtttgagatcggatcactgctagagctcattcagaaacacaatgtttcggttgcggctgtggtgccaccactggtgctggcgttggccaagaacccaatggtggcgaacttcgacttgagttcgatcagggtagtcctctcaggggctgcgccactggggaaggagctcgaggaggccctcaggagcagggttccacaggccatcctgggacagggttatgggatgacagaggcggggccagtgctatcaatgtgcttagccttctcaaagcaacctttacccaccaagtctggatcatgtggaacagtggttagaaacgcagagctcaaggtcattgaccctgagaccggtagctctcttggtcgcaaccaacctggtgaaatctgcatccggggatcccaaatcatgaaaggatatttgaatgacgcggaagccacggcaaacatcatagacgttgagggttggctccacactggagatataggttatgtcgacgacgacgacgagattttcattgttgatagagtgaaggaaatcataaaattcaaaggcttccaggtgccgccagcggagcttgaggctctccttgtaaaccacccttcaattgcggatgcggctgttgttccccgagataacttgtatggaaacaacaggcaaaaagacgaggttgctggtgaagttcctgtcgcgtttgtggtccgctcaaatgatcttgaccttaatgaagaggctgtaaaagactacattgcaaagcaggtggtgttctacaagaaactgcacaaggtgttcttcgttcattctattcccaaatcggcttctggaaagattctaagaaaagacctcagagccaagcttgccacagccaccaccatgtcctag

SEQ ID NO: 29728 - protein, 579 aa, Populus balsamifera subsp
MMSVATVEPPKPELSPPQNQNAPSSHETDHIFRSKLPDITISNHLPLHAYCFENLSDFSDRPCLISGSTGKTYSFAETHLISRKVAAGLSNLGIKKGDVIMTLLQNCPEFVFSFMGASMIGAVTTTVNPFYTPGEIFKQFSASRAKLIITQSQHVNKLRDSDYHENNQKPEEDFIVITIDDPPENCLHFNVLVEANESEMPTVSIHPDDPVALPFSSGTTGLPKGVILTHKSLITSVAQQVDGEIPNLYLKQDDVVLCVLPLFHIFSLNSVLLCSLRAGSAVLLMQKFEIGSLLELIQKHNVSVAAVVPPLVLALAKNPMVANFDLSSIRVVLSGAAPLGKELEEALRSRVPQAILGQGYGMTEAGPVLSMCLAFSKQPLPTKSGSCGTVVRNAELKVIDPETGSSLGRNQPGEICIRGSQIMKGYLNDAEATANIIDVEGWLHTGDIGYVDDDDEIFIVDRVKEIIKFKGFQVPPAELEALLVNHPSIADAAVVPRDNLYGNNRQKDEVAGEVPVAFVVRSNDLDLNEEAVKDYIAKQVVFYKKLHKVFFVHSIPKSASGKILRKDLRAKLATATTMS

SEQ ID NO: 29729 - DNA, 1623 bp, Populus balsamifera subsp
  CDS (1)..(1623)
atggacgccataatgaattcacaagaagaattcatctttcgctcaaaattaccagacatctacatcccgaaaaaccttcctctgcattcatacgttcttgaaaacttgtctaaatattcatcaaaaccttgcctgataaatggcgcaaacggagatgtctacacctatgctgacgttgagctcacagcaagaagagttgcttctggtcttaacaagattggtattcaacaaggtgacgtgatcatgctcttcctaccaagttcacctgaattcgtgcttgctttcctaggcgcttcacacagaggtgccattgtcaccgctgccaatcctttctccacccctgcagagctagcaaaacatgccaagcctccaagaacaaagcttttgataacacaggcttgttactacgacaaggttaaagattttgcacgagaaagtgatgttaaggtcatgtgcgtagactctgccccagatgggtgcttgcacttttcagagctaacacaggctgacgaaaatgaagtgccccaggtcgactttagtcctgatgatgttgtagcattgccttattcatcagggactacagggttaccaaaaggggtcatgctaacgcacaaagggctaataaccagtgtggctcaacaagtagatggagacaatcctaacctgtattttcacagtgaagatgtgattttgtgtgtgttgcctatgttccatatctatgctctgaattcaataatgctttgtgggctgagagttggtgcctcgattttgataatgccaaagtttgatattggtactctgctgggattgattgagaagtacaaggtatctatagcaccagttgttccacctgtgatgttggcaattgctaagtcacctgattttgacaagcacgacttgtcttctttgaggatgataaaatctggaggggctccattgggcaaggaacttgaagatactgtcagagctaagtttcctcaggccagacttggtcagggatatggaatgaccgaggcaggacctgttctagcaatgtgcttggcatttgccaaggaaccatttgacataaaaccaggtgcatgtgggactgtcgtcaggaatgcagaaatgaagattgttgacccagaaacaggggcctctctacggaggaaccagcctggtgagatctgcatccggggtgatcagatcatgaaaggatatcttaatgaccctgaggcaacctcaagaacaatagacaaagaaggatggttgcacacaggcgatatcggctacattgatgacgatgatgagcttttcatcgttgacagattgaaggaattgatcaaatataaagggtttcaggttgctcctgctgaactcgaagctttgttactagcccatccacagatatccgatgctgctgtagtaggaatgaaagatgaggatgcaggagaagttcctgttgcatttgtagtgaaatcagaaaagtctcaggccaccgaagatgaaattaagcagtatatttcaaaacaggtgatattctacaagagaataaaacgagttttcttcattgaagcaattcccaaggcgccatcaggcaaaatccttaggaagaatctgagagaaacgttgccaggcatataa

SEQ ID NO: 29730 - protein, 540 aa, Populus balsamifera subsp; identical to SEQ ID NO: 14285

SEQ ID NO: 29731 - DNA, 1671 bp, Arabidopsis thaliana
  CDS (1)..(1671)
atgaaaatggagggaactatcaaatctccggccaactacgttcctctcactccgatcagcttcctcgatagatctgctgtcgtctacgctgacagagtctccatcgtttatggctccgtcaagtacacgtggcgccagactcgtgaccgctgcgtcagaatcgcctccgctctctcccagctcggaatctctaccggagatgtggtttcagtgttggctccaaacgttccagctatggttgaattgcattttggtgttcctatggctggagctttgctctgtacactcaacattcgtcatgattcatcacttgttgctgtcttgcttagacattcagggacaaaagtgatttttgcagatcatcagtttctccaaatagctgatggagcttgtgaaatcctctcaaataaaggtgacaaggtcccgattttggtcttgatcccagagcctcttactcaatctgtttcaaggaagaagagatctgaggaaatgatggaatacgaagatgttgtagcgatggggaaatcggacttcgaggttatacgaccaacagatgagtgtgatgctatatctgttaattacacatcaggtaccacttcaagccccaaaggtgttgtttatagtcacagaggtgcttatttgaattctctggctgcggttttactcaacgaaatgcactcctcgcctacttatctatggactaatcccatgtttcactgcaatggctggtgcttattgtggggtgttactgctattggtgggactaatatatgtttgaggaatgttacggccaaggctatatttgataatatttcccagcataaggtgactcatatgggaggtgcgccgacgatattgaatatgatcatcaatgcgcctgaatctgagcagaaaccgcttcccgggaaggtgtcttttataaccggtgctgcaccgccaccagctcatgtgattttcaagatggaagagttggggttttctatgtttcattcctatgggttaactgaaacttatggaccaggcacaatctgtacatggaagcctgagtgggactctttgcctagagaagaacaggcgaaaatgaaagctcgacaaggcgtgaatcatttagggctcgaggaaatacaagttaaagaccctgtaaccatgagaactttgccagctgatggtgtgactatgggtgaagttgtcttcagaggaaacacggtgatgaatggttacttaaagaaccctgaagcaaccaaggaagcttttaaaggaggttggttttggagtggcgacttaggtgttaaacaccctgacggatacatagagctgaaagacagatcgaaagacattataatctctggaggagaaaacattagctcgattgaagtcgagtctactctgttcactcacccttgtgttcttgaagcagctgtagttgcgaggcctgatgagtattggggtgagactgcttgtgcatttgtgaaacttaaagacgggtctaaggccagtgcggaggagcttattagctattgcagggaccggcttccacattatatggctccgaggagtattgtgtttgaggatcttcctaaaacatcgactggaaaagtccagaagtttgttctgaggaccaaggctaaggctttggtaagcttatcaaagaaaggcagaagcaagttatga

SEQ ID NO: 29732 - protein, 556 aa, Arabidopsis thaliana
MKMEGTIKSPANYVPLTPISFLDRSAVVYADRVSIVYGSVKYTWRQTRDRCVRIASALSQLGISTGDVVSVLAPNVPAMVELHFGVPMAGALLCTLNIRHDSSLVAVLLRHSGTKVIFADHQFLQIADGACEILSNKGDKVPILVLIPEPLTQSVSRKKRSEEMMEYEDVVAMGKSDFEVIRPTDECDAISVNYTSGTTSSPKGVVYSHRGAYLNSLAAVLLNEMHSSPTYLWTNPMFHCNGWCLLWGVTAIGGTNICLRNVTAKAIFDNISQHKVTHMGGAPTILNMIINAPESEQKPLPGKVSFITGAAPPPAHVIFKMEELGFSMFHSYGLTETYGPGTICTWKPEWDSLPREEQAKMKARQGVNHLGLEEIQVKDPVTMRTLPADGVTMGEVVFRGNTVMNGYLKNPEATKEAFKGGWFWSGDLGVKHPDGYIELKDRSKDIIISGGENISSIEVESTLFTHPCVLEAAVVARPDEYWGETACAFVKLKDGSKASAEELISYCRDRLPHYMAPRSIVFEDLPKTSTGKVQKFVLRTKAKALVSLSKKGRSKL

SEQ ID NO: 29733 - DNA, 1704 bp, Pseudomonas stutzeri
  CDS (1)..(1704)
atgggtaccgacatgactcagctcagctacacccgcggcccgcaggacaaccccctgctggccatgaccataggcgaagccttcgacgctacggtgcgcctgcacgcacgcagagaggcgctagtagtgcgccatcagaacctgcgttacagctggggcgaactagccgaggtagtcgagggctgcgcccgcggcctgctcgccctcggcctgctgccgggcgatcgggtcggcatctgggcaccgaactgcgccgagtggtgcatcgctcagttcgccatggcgaaggtcggcgcgatcctggtcaacatcaatccggcctaccgtcttagcgagctggagtacgtactgaagcagtccggctgccgctggctgatttgtgccgagcagttcaagagttccgactaccacgccatgctcgccgagctgatccccgagttggccgatagcccgcccggtgggctgcatgccacgcggcttgccgacctgcgcggagtgatcagcctggggcgcacgccgaccgccgggatgctcggctgggccaagctgcttggcctggccgggcagatctcccacgacgtgctgcgtcgccgccaggcccagttgcagttcgacgacccgatcaacatccagtacacctcgggcactaccggctttcccaagggtgcgacgctgagccactacaacatcctcaacaacggctacatggtcggcgagagcctgggcctgagcgagcacgaccgcctggtgatcccggtgccgctgtaccactgcttcggcatggtcatgggcaacctcggctgcctgacccacggcagcaccatgatctatccgggcgatgccttcgacccgctgagcaccctgcaggcggtggccgaggaacgcgccacggtgctgtatggcgtgccgaccatgtttatcgccgagctggatcatccgcgtcgcgccgaattcgatctgtccagcctgcgcacaggaatcatggccggtgccacctgcccgatcgaggtgatgaagcgggtgatcgagcagatgcatatggccgaggtgcagatcgcctatggcatgaccgagaccagcccggtgtcgacccagagcgccgccgacgatccgctggagctgcgcgtggccagtgtcggtcgcacccaaccgcacctggagaccaagctggtcgacgaacagggcaacgtggtgccgcgcgggcagatcggtgaactctgcacccgcggctacagcgtgatgctgggttactggaacaaccaggaggcgacccaggagagcatcgacgaggccaagtggatgcacagcggcgatctggcggtgatggacgaggcgggctacgtcagcatcgtcgggcgcaacaaggacatgatcatccgcggtggcgagaacgtgtacccgcgcgagatcgaggagttcctgttcggccacccggcggtggccgacgtgcaggtggtgggcattcccgacagcaagtacggcgaggaagtggccgcctgggtcaagctgcacccggatcaggcactcaccgccgaggcgctcgccgagtactgcaaggggcgcatcgcgcacttcaaggtgccgcgccacttccgcttcgtcgaggagttccccatgacagtaaccggcaaggtgcagaagtttcgcatgcgcgaactgatgcaggctgagctggcaccgccgctgcgcctggtcggccgctga

SEQ ID NO: 29734 - protein, 567 aa, Pseudomonas stutzeri
MGTDMTQLSYTRGPQDNPLLAMTIGEAFDATVRLHARREALVVRHQNLRYSWGELAEVVEGCARGLLALGLLPGDRVGIWAPNCAEWCIAQFAMAKVGAILVNINPAYRLSELEYVLKQSGCRWLICAEQFKSSDYHAMLAELIPELADSPPGGLHATRLADLRGVISLGRTPTAGMLGWAKLLGLAGQISHDVLRRRQAQLQFDDPINIQYTSGTTGFPKGATLSHYNILNNGYMVGESLGLSEHDRLVIPVPLYHCFGMVMGNLGCLTHGSTMIYPGDAFDPLSTLQAVAEERATVLYGVPTMFIAELDHPRRAEFDLSSLRTGIMAGATCPIEVMKRVIEQMHMAEVQIAYGMTETSPVSTQSAADDPLELRVASVGRTQPHLETKLVDEQGNVVPRGQIGELCTRGYSVMLGYWNNQEATQESIDEAKWMHSGDLAVMDEAGYVSIVGRNKDMIIRGGENVYPREIEEFLFGHPAVADVQVVGIPDSKYGEEVAAWVKLHPDQALTAEALAEYCKGRIAHFKVPRHFRFVEEFPMTVTGKVQKFRMRELMQAELAPPLRLVGR

SEQ ID NO: 29735 - DNA, 1632 bp, Vibrio cholerae
  CDS (1)..(1632)
atgacaaccgattttaccccttggccagaggcacttgccgctcaataccgtcagttaggctactggcaagataaaaccttgctcgattacttacagcaaagtgctgagcgtacccccaatgcgcttgcgctggtcggtgataatcagcagtggcgttaccaagccatgctcgaacgtattgagcagcttgctgccggatttaccgaacttgggctaggctgtggcgataacgtagtgctgcaattaggcaatgttgcggaattctatttatgctttttcgctttgctgcgccaaggcatacgaccgattctggcgctccccgctcaccgtttagcggaaattcgctatttttgtcagcacagccaagccaaagcttacctcattgatggcgctcagcgaccatttgactatcaagctttggcgcaagagctgcttgcttgctgcccaacactgcagactgtgattgtacgcggccaaactcgagtgacagatccaaaatttattgaactggcgagttgctactcggcatcatcttgtcaagcgaatgccgacccgaatcaaatcgcctttttccaactttccggtggcacaacggacacgcccaagctcatcccgcgtacccacaatgattacgcctacagcgtaaccgccagtgtcgaaatttgccgttttgatcagcatactcgctatctgtgcgtactgcccgcggcacataacttccctctcagctcccccggcgcactcggtgttttctgggcgggtggctgcgttgtcctcagtcaagatgcgtcaccccaacacgcgtttaaattgatagaacagcataaaattactgttaccgcgttggtgccgcctttagcactactctggatggatcacgcagaaaaaagcacctacgatctctcctcattgcactttgtgcaagtaggcggggcaaaatttagtgaagcggccgcaaggcgtctgccgaaagcgctaggctgccaattgcaacaagtgtttggaatggcagaaggcttggtcaattacactcgtttggatgacagtgcggaactgattgctacaactcaaggtcggcctatctccgctcacgatcaattactggtggttgatgagcagggtcaacctgtcgccagcggagaagaagggtatctgttaacccaaggtccctatacgattcgcggttactatcgagctgatcagcacaatcaacgagcgttcaatgcacaaggtttttacatcaccggcgataaagtcaaactcagtagcgaaggttacgtgattgtcaccggaagggccaaagatcagatcaatcgtggaggggaaaagattgccgccgaagaggtggaaaatcagcttttacatcatccagcagtgcatgatgccgctttaattgccatcagtgacgaatacctaggagagcgcagttgcgcggtgatcgtactcaaacccgagcagtcggtgaataccatccagctcaaacgttttttacaccaagcggggctcgccgattacaaaatcccagatcaaatccaatttatcgatcaactgcccaaaacatcggttggaaaaatcgataagaacgcgcttcgtcgtcgatttgacacgctcggcttagcgttaatgtcgtga

SEQ ID NO: 29736 - protein, 543 aa, Vibrio cholerae
MTTDFTPWPEALAAQYRQLGYWQDKTLLDYLQQSAERTPNALALVGDNQQWRYQAMLERIEQLAAGFTELGLGCGDNVVLQLGNVAEFYLCFFALLRQGIRPILALPAHRLAEIRYFCQHSQAKAYLIDGAQRPFDYQALAQELLACCPTLQTVIVRGQTRVTDPKFIELASCYSASSCQANADPNQIAFFQLSGGTTDTPKLIPRTHNDYAYSVTASVEICRFDQHTRYLCVLPAAHNFPLSSPGALGVFWAGGCVVLSQDASPQHAFKLIEQHKITVTALVPPLALLWMDHAEKSTYDLSSLHFVQVGGAKFSEAAARRLPKALGCQLQQVFGMAEGLVNYTRLDDSAELIATTQGRPISAHDQLLVVDEQGQPVASGEEGYLLTQGPYTIRGYYRADQHNQRAFNAQGFYITGDKVKLSSEGYVIVTGRAKDQINRGGEKIAAEEVENQLLHHPAVHDAALIAISDEYLGERSCAVIVLKPEQSVNTIQLKRFLHQAGLADYKIPDQIQFIDQLPKTSVGKIDKNALRRRFDTLGLALMS

SEQ ID NO: 29737 - DNA, 1635 bp, Arabidopsis thaliana
  CDS (1)..(1635)
atggcgaattctcaaagatcatcatctctgatcgatccaaggaacggtttctgcacatcaaactccacattttacagtaaacgcaaaccattggcacttccttcaaaagaatcactcgacatcacaacattcatctcctcccaaacgtaccgtggcaaaaccgccttcatagacgcagccacggaccaccgcataagcttctccgatttatggatggccgtggatcgtgtcgccgactgtctcctccacgacgtgggaatacggagaggtgacgtggtcctagtcctctctcccaacaccatctccatccccattgtctgcctctccgtgatgtctcttggcgctgtcttaactaccgctaatcctctcaacaccgctagtgaaatcttaagacaaatcgcggatagcaatccaaaactcgccttcacaacaccggaactggctcccaaaatcgccagttccggtatctctatcgtcctcgagcgcgtagaagacactctacgcgttccgagaggactcaaagtggttgggaatctaactgaaatgatgaagaaagaaccaagtggacaagcagtcagaaaccaagttcataaagacgacacggcgatgttgctttactcctcggggacgacgggacgaagcaaaggagtgaattcgtctcacgggaacttaatagcacacgtggcgagatacatcgcggagccattcgagcagccacaacagaccttcatttgcactgttccgttgttccacacttttggtttactaaacttcgttttggccaccttagcgttaggtacgaccgttgtcatcctcccgaggtttgacctcggagagatgatggcggctgtcgagaaatacagagcgacgactctgattctcgtgccgccagttttagtaactatgataaacaaagcggatcaaataatgaagaagtacgacgtgagcttcttgagaacggtgcggtgcggtggagcacctttgagcaaggaagttactcaagggtttatgaagaaatatccaacggttgatgtttatcaaggatacgcattgacggaatctaacggtgcaggagcttcgatagaatcagtggaggagagtcggaggtacggtgcggtggggttgttgtcatgtggtgtagaagcgaggattgtggatccgaatacgggtcaggtcatgggtttgaaccaaacgggcgaactttggcttaaagggccttctatcgccaaagaagaaattataacttcagaaggatggcttaaaacaggagatctatgctatatagacaacgatggatttctttttatcgttgatcgattgaaagagcttatcaaatacaaaggttaccaggtacctccagctgaactagaggctctcttactaaaccatccagatattctcgatgcagccgttattccgtttccagataaagaagcaggacaatttccgatggcttacgtagcacgaaagcctgagagtaatctttgtgagaaaaaggttatcgactttatttctaaacaggtggcaccatataagaaaataagaaaagtcgcatttatagactctataccaaagactccatcgggcaaaacacttcgcaaggatctaatcaaatttgccatttcaaaaatttaa

SEQ ID NO: 29738 - protein, 544 aa, Arabidopsis thaliana
MANSQRSSSLIDPRNGFCTSNSTFYSKRKPLALPSKESLDITTFISSQTYRGKTAFIDAATDHRISFSDLWMAVDRVADCLLHDVGIRRGDVVLVLSPNTISIPIVCLSVMSLGAVLTTANPLNTASEILRQIADSNPKLAFTTPELAPKIASSGISIVLERVEDTLRVPRGLKVVGNLTEMMKKEPSGQAVRNQVHKDDTAMLLYSSGTTGRSKGVNSSHGNLIAHVARYIAEPFEQPQQTFICTVPLFHTFGLLNFVLATLALGTTVVILPRFDLGEMMAAVEKYRATTLILVPPVLVTMINKADQIMKKYDVSFLRTVRCGGAPLSKEVTQGFMKKYPTVDVYQGYALTESNGAGASIESVEESRRYGAVGLLSCGVEARIVDPNTGQVMGLNQTGELWLKGPSIAKEEIITSEGWLKTGDLCYIDNDGFLFIVDRLKELIKYKGYQVPPAELEALLLNHPDILDAAVIPFPDKEAGQFPMAYVARKPESNLCEKKVIDFISKQVAPYKKIRKVAFIDSIPKTPSGKTLRKDLIKFAISKI

SEQ ID NO: 29739 - DNA, 1629 bp, Capsicum annuum
  CDS (1)..(1629)
atgccgatggaaaatgaaacaagagatttaatcttccgatctaaactccctgatatttacatccctaaacatttgcctttacattcttattgtttcgaaaacatttctgagtttaattcccgtccttgtttaattgatggtgcaaatgatcaaatctattcttatgccgaagttgaactgacttcgaggaaagttgctgttggtctgaataaattaggggtccaacagaaggatacgattatgattctcttgcctaattcccctgaattcgtttttgcttttatgggtgcttcgtatctaggtgcaatttccacaatggctaatcctcttttcactcctgcagaggttctcaagcaagctaaagcatcaagcgctaagattatcatcacgttagcttgctatattgggaaagtaaaggattacgctactgaaaatgatgtgaagttaatttgcatcgattctgcaccggaaggttgcattcatttctccgaattgacacaatcggacgaacacgaaatacctgatgtgaaaatccagcctgatgacgttgtcgccctgccgtattcctcagggactacagggctaccaaaaggagtcatgttgacacataaaggattagtcacgagcgtagcgcaacaagttgatggagaaaatgcaaatttgtatatgcacagtgaagacgtgttgatgtgttgcttgcctttgttccatatatactcactcaattctgtcttgctatgtggattgagaattggagcatccattttgattatgcagaaattcgacattgttcacttcttggagttgattcagaagtataaggtgacaattggaccatttgtacctcctattgttctagcaattgcaaagagtccattagttgaccactactatctttcgtcagtaaggacagtcatgtctggggctgcacctttaggaaaggaactcgaagacactgtccgaaccaaattccctaacgccaaacttggtcagggttatggaatgactgaagctggaccagtgctggcaatgtgtttggcctttgcaaaagaaccctttgaaattaaatcacgtgcatgtggtactggtgcaaggaatgctgaaatgaaaaatgtggatccggataccggttgttctttgccccgtaaccaacccggtgaaaattgcattcgaggtgatcagatcatgaaaggttacttgaaccatcttgagtccacaacgagaacaatagacaaaaaaggatgggtacacactggcgatatggggttcatcgacaacgatgacgagcttttcattgtggaccgattgaaggaattgattaaatacaaaggatttcaagtggcccctgctgagcttgaagcacttcttctcaaccatcccaacatttctgatgctgctgttgtcccaatgaaagacgagcaagctggggaagttccagtggcttttgttgtaaggtcaaatggatcaacaattactgaggatgaagtcaaggatttcgtttcgaagcaggtggtattctataagagaataaagcgtgtatttttcgtggaaacggtaccaaaatctccatcaggaaaaattctgagaaaggacttgagagctagactggctgctggtgtcacaaattaa

SEQ ID NO: 29740 - protein, 542 aa, Capsicum annuum
MPMENETRDLIFRSKLPDIYIPKHLPLHSYCFENISEFNSRPCLIDGANDQIYSYAEVELTSRKVAVGLNKLGVQQKDTIMILLPNSPEFVFAFMGASYLGAISTMANPLFTPAEVLKQAKASSAKIIITLACYIGKVKDYATENDVKLICIDSAPEGCIHFSELTQSDEHEIPDVKIQPDDVVALPYSSGTTGLPKGVMLTHKGLVTSVAQQVDGENANLYMHSEDVLMCCLPLFHIYSLNSVLLCGLRIGASILIMQKFDIVHFLELIQKYKVTIGPFVPPIVLAIAKSPLVDHYYLSSVRTVMSGAAPLGKELEDTVRTKFPNAKLGQGYGMTEAGPVLAMCLAFAKEPFEIKSRACGTGARNAEMKNVDPDTGCSLPRNQPGENCIRGDQIMKGYLNHLESTTRTIDKKGWVHTGDMGFIDNDDELFIVDRLKELIKYKGFQVAPAELEALLLNHPNISDAAVVPMKDEQAGEVPVAFVVRSNGSTITEDEVKDFVSKQVVFYKRIKRVFFVETVPKSPSGKILRKDLRARLAAGVTN

SEQ ID NO: 29741 - DNA, 1572 bp, Bacillus subtilis
  CDS (1)..(1572)
atgtccgaactcatccattgcacaatcggcaggctgctggaacaaacggcagcagcctatcctgatcaagaagcggttgtctatcccgaccggaatcttcgctacacgtacgtgcaattcaacaggctgtgccgccaaaccgctaaagggctcatggggatggggattgggaaaggagaccacgtggccatatgggcctcgaatatacctgaatggcttgctgctcaattcgccaccgcaaaaatcggggccgtgctcgttaccgtaaatacaaattaccaatcccaagagcttgattacttgctgagacaatcagatgcggatgcacttatcgtcatgaattcatatcgcggcacttcttatactgagatcctgaacagcttaattcccgagctgaaggaagcagagcccgggcatctgcaatcagaacgctatccgtgtttaaaaacattgatttatatcggtgaaaaacgtttacctggtatgtatcattgggacgatacagagatgttggcacagtcagtgtcagatgccgagctggaagcaagaatgagcagccttgaaaaagatgatgtcattaacatgcaatacacgtcaggaacgacaggatttcctaaaggagtgatgctgactcattttaatgtcatcaacaacgccgcaaataacgctgaatgtatgaaattaacctcatctgaccgcatgtgcatcccggttccgtttttccattgcttcggctgcgtgcttggcgttttggcatgtgtgtccgtcggagcagccatggtacctgttgtagaatttgaacctgccacagtccttacaacggttgaaaacgagacatgcacagcactgcacggtgttccgacgatgtttatcgcgcagcttcatcttcaagattttgattcttatgatctgtcatctttgcgaacaggcatcatggcaggatcatcctgtccgagtgaggtgatgaaagctgtcattgaaaaaatgggcatgacagacatcacaatcgcctacggacaaacggaaccttcgccggtgatcacacaaacaagagctaatgattccttccaaagaagagtggaaacaaccggccgagccttgccagaggtcgaagtgaaaattgtggagcccggcacgtttaatgaggttcaaagaggcgtacagggagagctttgcactcgcggctatcatgtgatgaagggctattataaagacgaagaagctacccaaaaggcaatcaacccagaaggatggctatttaccggtgatctcgctgtgatggatgaagacggatactgccgcgtcaccgggagattaaaagacatgctcatcagaggcggtgaaaacgtttatccgagagaaatagaagaatttttataccgtcatcctaatattttagatgtacaggtagttggtgtgcctgacgaaaaatacggggaggaggcagctgcctggattaagctgaaagagggaaaaacagcttcacccgaagagctgaaagcctattgcaaagggaaaatcgccgacacaaaattccgcgctatttcatctttacagacgagtatcctatga

SEQ ID NO: 29742 - protein, 523 aa, Bacillus subtilis
MSELIHCTIGRLLEQTAAAYPDQEAVVYPDRNLRYTYVQFNRLCRQTAKGLMGMGIGKGDHVAIWASNIPEWLAAQFATAKIGAVLVTVNTNYQSQELDYLLRQSDADALIVMNSYRGTSYTEILNSLIPELKEAEPGHLQSERYPCLKTLIYIGEKRLPGMYHWDDTEMLAQSVSDAELEARMSSLEKDDVINMQYTSGTTGFPKGVMLTHFNVINNAANNAECMKLTSSDRMCIPVPFFHCFGCVLGVLACVSVGAAMVPVVEFEPATVLTTVENETCTALHGVPTMFIAQLHLQDFDSYDLSSLRTGIMAGSSCPSEVMKAVIEKMGMTDITIAYGQTEPSPVITQTRANDSFQRRVETTGRALPEVEVKIVEPGTFNEVQRGVQGELCTRGYHVMKGYYKDEEATQKAINPEGWLFTGDLAVMDEDGYCRVTGRLKDMLIRGGENVYPREIEEFLYRHPNILDVQVVGVPDEKYGEEAAAWIKLKEGKTASPEELKAYCKGKIADTKFRAISSLQTSIL

SEQ ID NO: 29743 - DNA, 1632 bp, Rubus idaeus
  CDS (1)..(1632)
atggcggtccaaacacctcaacacaacatcgtctaccgctccaagctcccggacatccatatcccaaaccacctccctctccattcctacatattccaaaacaaatcccacctcacctcaaagccctgcatcatcaatggcactactggcgacatccacacctacgccaaattcaaactcaccgcccggaaagtcgcctccggcctcaacaagctcggcatcgagaaaggcgacgtcttcatgcttttgctccccaacacttccgaattcgtctttgccttcttgggagcctcgttctgcggagccatgatgacagccgccaaccctttcttcactccggcggaaatcgcgaaacaggccaaggcgtcgaaggcgaagctgatcatcactttcgcttgctattacgacaaagtaaaagacttatcatgcgacgaagtgaagttgatgtgcattgactcgccgccacctgactcgtcttgtcttcatttctccgaactgactcagtcagacgagaacgacgtgccggatgtggacatcagcccggacgacgtcgtggcgttaccttattcctccgggacgacgggactgccgaaaggggtgatgttgacgcacaaagggctggtgacgagcgtgtctcagcaggtggacggagagaatccgaatttgtactacagcagcgacgacgtcgttctgtgcgtgctgccgctgtttcatatttactcgctgaactcggtcttgctatgcgggttaagagccggagctgccattctgctgatgcagaagtttgagattgtgtcgcttttggagctgatgcagaagcatagggttagtgttgcgccgattgtgcctccgactgttttggcgatcgccaagtttccagatcttgacaagtatgatttgggatccataagggtgctgaagagtggaggagcaccattggggaaggagcttgaagatacagtcagagctaaatttcccaatgtcacactcggtcagggatatggaatgacagaggcaggtccggtgttgacaatgtcgttggcatttgcaaaggaacccttcgaggtgaaaccaggtgggtgtgggactgtcgtcagaaacgcagagttgaagatcgttgatcctgaaactggtgcctctttgccgcgcaaccaccctggtgagatttgcatcagaggccaccagatcatgaaaggttatcttaatgatccggaggccacaagaacaaccatagacaagcaaggttggctacacacaggtgacataggcttcattgatgacgatgaagagctcttcattgttgatcgattaaaggagctcatcaaatacaaaggctttcaggttgcccctgctgagcttgaagccttgctcgtcacccatcctaacatctctgatgctgccgttgtcccaatgaaggatgacgcagctggcgaggttccggttgcatttgtcgtgagtccaaagggctctcaaatcactgaggatgaaatcaagcaatttatttcaaaacaggttgtattctacaaaagaataaaacgagtatttttcattgaagccattcccaagtccccatcgggcaagatcttgcggaaggagttgagagcaaagcttgctgctggctttgcaaattga

SEQ ID NO: 29744 - protein, 543 aa, Rubus idaeus
MAVQTPQHNIVYRSKLPDIHIPNHLPLHSYIFQNKSHLTSKPCIINGTTGDIHTYAKFKLTARKVASGLNKLGIEKGDVFMLLLPNTSEFVFAFLGASFCGAMMTAANPFFTPAEIAKQAKASKAKLIITFACYYDKVKDLSCDEVKLMCIDSPPPDSSCLHFSELTQSDENDVPDVDISPDDVVALPYSSGTTGLPKGVMLTHKGLVTSVSQQVDGENPNLYYSSDDVVLCVLPLFHIYSLNSVLLCGLRAGAAILLMQKFEIVSLLELMQKHRVSVAPIVPPTVLAIAKFPDLDKYDLGSIRVLKSGGAPLGKELEDTVRAKFPNVTLGQGYGMTEAGPVLTMSLAFAKEPFEVKPGGCGTVVRNAELKIVDPETGASLPRNHPGEICIRGHQIMKGYLNDPEATRTTIDKQGWLHTGDIGFIDDDEELFIVDRLKELIKYKGFQVAPAELEALLVTHPNISDAAVVPMKDDAAGEVPVAFVVSPKGSQITEDEIKQFISKQVVFYKRIKRVFFIEAIPKSPSGKILRKELRAKLAAGFAN

SEQ ID NO: 29745 - DNA, 1635 bp, Rubus idaeus
  CDS (1)..(1635)
atggagaacaaacatcaagacgaccatgaattcattttccggtcaaagctgccggacatctacatcccgaaccacctccctctccacacctactgcttcgaaaacatctcccaatttcacgaccgcccctgcctgatcaacggaaacaccggcgagaccttcacctacgccgaggtcgagctcacctcccgcagagtcgccgccgggctcgacaagctaggcattcagcagaacgacgtcgtcatgctcctcctccagaactgtcccgaattcgccttcgcattcctcggcgcctcgtacatcggagccatgagcacaacagccaaccctttctacactccggccgaggtggccaagcaagccaaagcctccaacgccaagctcatcataactcagtcggcctacgtggacaaggttaaggacttcgcgaagctcaacgacgtgaaagtcatgtgcgtggacgaaacatcgtctgaggatgtcttgcatttttcggagttgatgtccgctgacgagagcgaaaccccggccgtcaaaatcaacccggacgacgtcgtcgcgctcccgtattcttcgggcaccacggggctgccgaaaggcgttatgctgacgcacaaggggctggtgacaagcgtggcgcagcaggtcgacggtgaaaacccaaatctgtactttcacaaggaggacgtgatcctctgcgtgctgcctctgttccacatctactccctcaactcggtcttcctctgcggactgcgcgtcggtgcggccatcctgatcatgcagaagttcgagatcaacaagttgctggagttggtggagaaagaaaaggtgacgattgcaccgtttgtgcctcccatcgttttgtctattgccaagtgtcccgacctgcaccgatacgacttgtcgtccattcggatggtcatgtccggcgctgctccgatggggaaggagctcgaggacactgtcagagctaaactgcctaatgccaaactcggacagggttatgggatgactgaggctggaccagttctatccatgtgtctggcatttgcaaaagagccatacgagataaaatcaggtgcatgcgggaccgtggtaagaaatgctgagatgaagatcatcgaccctgacaccaatgaatcccttccccgaaaccaatcaggggagatttgcatcagaggtagccaaatcatgaaaggttaccttaatgaccctgaggcgactgagaataccatagacaaagaaggatggttgcacactggtgatatagggtacattgacgacgacgatgagctcttcatcgttgacagattaaaagaactcatcaagtacaaaggtttccaagtcgccccggctgagctcgaagccatgttgatctcgcatcccaatctctccgatgctgccgttgtatcgatgaaggatgaggctgcaggagaggttcctgttgcatttgttgtaagatcaaacggttccaagatttctgaggatgatatcaagcaatacatctctaaacaggtggtgttctacaagagaataagtaaggttttcttcacagataaaatcccgaaagctccttctggaaaaatattgagaaaagacttgagagcaaggctggctgcaggtctacccaattag

SEQ ID NO: 29746 - protein, 544 aa, Rubus idaeus; identical to SEQ ID NO: 14307

SEQ ID NO: 29747 - DNA, 1776 bp, Rubus idaeus
  CDS (1)..(1776)
atgatatccattgcctctaataacaacaacaacaactctgttgttgttgagacgccaacaaagccggaaatctctcccaatatcatctccgacgtcatttctacctctcaaacccaaccggagcagaagcagcagccgccaacaaccacaactcatcatgtcttcaaatcaaagttaccggaccttcccaacatctccaatcacctcccactccacacctactgcttcgagaacatctccgacttctccgaaagaccctgtttgatcataggctccaccggaaaatcctacaccttctccgaaacccgcctcctttcccaaaagaccggagtgggcctatccaagctcggcatccacaaaggcgatgtggtcatgatccttctccagaactgcgccgagttcgtgttcgcattcatgggcgcttccatgatcggcgccgtcacgaccaccgccaaccctttctacaccgcctccgaaatcttcaagcagttggaggcatccaacgcgaagctcatcatcactcaatcccagtacgtagacaagctccgacagcccggccagcactttcaagtggtcaccatcgacgaccctcccgagaactgcttgcatttctccgtgctttccgacgccaacgaaaacgagcttccgcaggtttcgattgacccagatgaccctgtagctttacccttctcttccgggactacagggcttcccaaaggggtgattctaacgcacaagagcctcatcacaagtgtggctcagcaagtggacggagagaatcccaacctgtacttgaagggagacgacgtcgtcttgtgcgtgctgccgttgttccatattttctcgctcaacagtgtcctcttgtgctcgctccgagcaggggcggcggttttggtaatgcccaagtttgagattgggacgctgttggagctcatacagcggtacagggtgttctgtggcggcgggtggtgcctcgctggtgatagcgctggcgaagaatccatggtggcggactacgatcttagctctattagagttgtcttgtccggggcggcgccgctgggaaaggagctagaggaggcgttaaggaaccgagtgcctcaggcagtcttgggccagggttatgggatgacagaggcagggccggtgctatcaatgtgcctggcattcgcaaagcaaccgtttccaacaaagtcagggtcatgcggcagcgtggttcgaaatgcagagctcaaagtcgtcgaacccgaaactggtcgctccctcggctacaaccagcccggcgagatttgcgtccgcggctctcaaattatgaaaggatatttgaacgatggtgaggcgaccgcaaccacagtagatgttgagggttggcttcacactggggatattggttatgttgatgacgacgatgaggttttcattgttgacagagttaaggagctcatcaaatttaaaggcttccaagtgccaccagctgagcttgagtccctacttataagccacccatccatgcagatgcagcttgttgttccgcaaaaagatgatgctgcgggtgaagttccggtggcattcgtggttcgatctaatggcggcaatgagcttactgaagaggctgtcaaagaattcatagcaaaacaggttgtgttttacaagagactgcacaaggtctacttcgtccacgccattccgaaatctcccgctggaaaaatcttaagaaaagacctcagagccaagctagcagctgctgctactccaaatcctcatcatcccatctaa

SEQ ID NO: 29748 - protein, 591 aa, Rubus idaeus
MISIASNNNNNNSVVVETPTKPEISPNIISDVISTSQTQPEQKQQPPTTTTHHVFKSKLPDLPNISNHLPLHTYCFENISDFSERPCLIIGSTGKSYTFSETRLLSQKTGVGLSKLGIHKGDVVMILLQNCAEFVFAFMGASMIGAVTTTANPFYTASEIFKQLEASNAKLIITQSQYVDKLRQPGQHFQVVTIDDPPENCLHFSVLSDANENELPQVSIDPDDPVALPFSSGTTGLPKGVILTHKSLITSVAQQVDGENPNLYLKGDDVVLCVLPLFHIFSLNSVLLCSLRAGAAVLVMPKFEIGTLLELIQRYRVFCGGGWCLAGDSAGEESMVADYDLSSIRVVLSGAAPLGKELEEALRNRVPQAVLGQGYGMTEAGPVLSMCLAFAKQPFPTKSGSCGSVVRNAELKVVEPETGRSLGYNQPGEICVRGSQIMKGYLNDGEATATTVDVEGWLHTGDIGYVDDDDEVFIVDRVKELIKFKGFQVPPAELESLLISHPSMQMQLVVPQKDDAAGEVPVAFVVRSNGGNELTEEAVKEFIAKQVVFYKRLHKVYFVHAIPKSPAGKILRKDLRAKLAAAATPNPHHPI

SEQ ID NO: 29749 - DNA, 1743 bp, Arabidopsis thaliana
  CDS (1)..(1743)
atggcttcagtgaattctcgaagtggtttctgcaactcaaactcaacattctacagcaaacgaacaccaatcccactcccgccaaatccatcactcgacgtcactactttcatttcttcacaagctcatcgtggccgtatcgccttcatcgacgcttccacaggtcaaaacctcaccttcaccgagctatggcgtgccgtggaatccgtcgccgattgtctctccgagatagggattcgcaaaggccacgtcgtcctcctcctctccccaaactcaattttattccccgtcgtttgtctctccgtcatgtcactaggcgcaatcatcaccaccacgaatccactcaacacttcaaacgagatcgctaaacagattaaggattcaaatccagtcctcgccttcaccacatcgcagcttctcccgaaaatctccgccgccgcaaagaagctcccgatcgtgcttatggacgaggaacgagttgactcagtgggtgatgtgagaagattggtggagatgatgaagaaggaaccgagtgggaaccgagtcaaggagcgagttgaccaggatgatacggcgactttgctttactcttcaggaaccacgggaatgagcaaaggagtgatctcgtctcaccgtaacttaatcgcgatggttcaaaccatcgtgaatcgatttggatctgatgatggagagcaacgattcatctgcactgttcctatgtttcacatctacggtttagctgcgttcgctactggattactcgcttacggatctacgatcatcgttctctctaaattcgagatgcacgagatgatgtcagcgattggcaagtatcaagccacgtctttgcctctcgtgcctccgattcttgtggcgatggttaacggtgcagatcagattaaggctaagtatgatttgagctctatgcatactgttttatgcggcggagctccgttgagtaaggaagtgactgaaggattcgcggagaagtatccgacggttaagattttacaaggttatgggttgactgagtcaacgggtataggagcttctacggatactgttgaggaaagtcggagatacggtaccgctgggaaattgtcggcaagtatggaagggaggattgttgatccggttactggtcagattcttggaccgaaacaaaccggtgagctttggctcaagggtccttccataatgaaaggttatttcagcaatgaggaagctacgagttcgactcttgattctgaaggatggttaagaactggagatctttgctatatcgatgaagatggattcatattcgtggttgatcggttaaaggaactgatcaagtacaagggttatcagatttatagtccttttgaagcattagaaaatgctgatgagtcaaaaatcgtcttttgtgaactgatgatagagtctgcctgtagtgatatgctgatggatcatgttgctccagctgagctagaggctttgttgcttactcatcctgaaatcactgatgctgcagtgatcccgtttccggacaaagaagtggggcaatttccaatggcatacgtcgtaaggaaaactgggagcagcttatcagagaagacaataatggagtttgtagcgaaacaagtagcaccatacaagaggatacgaaaagttgctttcgtatcttcaataccaaagaacccttcaggcaagattctacgcaaagatctcatcaagatagcaacttccaactccaagctttga

SEQ ID NO: 29750 - protein, 580 aa, Arabidopsis thaliana
MASVNSRSGFCNSNSTFYSKRTPIPLPPNPSLDVTTFISSQAHRGRIAFIDASTGQNLTFTELWRAVESVADCLSEIGIRKGHVVLLLSPNSILFPVVCLSVMSLGAIITTTNPLNTSNEIAKQIKDSNPVLAFTTSQLLPKISAAAKKLPIVLMDEERVDSVGDVRRLVEMMKKEPSGNRVKERVDQDDTATLLYSSGTTGMSKGVISSHRNLIAMVQTIVNRFGSDDGEQRFICTVPMFHIYGLAAFATGLLAYGSTIIVLSKFEMHEMMSAIGKYQATSLPLVPPILVAMVNGADQIKAKYDLSSMHTVLCGGAPLSKEVTEGFAEKYPTVKILQGYGLTESTGIGASTDTVEESRRYGTAGKLSASMEGRIVDPVTGQILGPKQTGELWLKGPSIMKGYFSNEEATSSTLDSEGWLRTGDLCYIDEDGFIFVVDRLKELIKYKGYQIYSPFEALENADESKIVFCELMIESACSDMLMDHVAPAELEALLLTHPEITDAAVIPFPDKEVGQFPMAYVVRKTGSSLSEKTIMEFVAKQVAPYKRIRKVAFVSSIPKNPSGKILRKDLIKIATSNSKL

SEQ ID NO: 29751 - DNA, 1671 bp, Lolium perenne
  CDS (1)..(1671)
atgggctccatcgcggcggacgcgcctcccgcggagctggtgttccggtccaagctcccggacatcgagatcccgacccacctgacgctgcaggactactgcttccagcgcctgccggagctctccgcgcgcgcctgcctcatcgacggcgccacgggcgccgcgctcacctacggcgaggtggacgccctgtcccgccgctgcgccgcggggctgcgccgcctcggcgtcggcaagggcgacgtcgtcatggcgctcctccgcaactgccccgagttcgccttcgtgttcctcggcgcggcccggctcggcgccgccaccaccaccgccaacccgttctacacgccccacgagatccaccgccaggccaccgccgccggggccagggtcatcgtcaccgaggcctgcgccgtcgagaaggtgcgcgccttcgccgccgagagagggattcccgtcgtctccgtcgacgagggcgtcgacggcggctgcctcccgttcgccgagactctgctcggggaagaaagcggggagcggttcgtcgacgaggcggtcgaccccgacgacgtggtggcgctgccgtactcgtccggcaccaccggcctgcccaagggcgtcatgctcacccaccgcagcctcgtcaccagcgtcgcccagcaggtggacggtgagaacccgaacctgcacttcagctcgtcggacgtgctgctgtgcgtgctgccgctgttccacatctactcgctcaactcggtgctgctcgccggtctccgcgccgggtgcgcgatcgtgatcatgcgcaagttcgaccacggcgcgctggtggacctggtgcgcacgcacggcgtcaccgtggcgccattcgtgccgcccatcgtggtggagatcgccaagagcgcgcgggtgaccgccgcggacctggcgtccatccggctggtcatgtcgggggcggcgcccatgggcaaggagctgcaggacgcgttcatggccaagatccccaacgccgtgctcggccagggatatgggatgaccgaggccggccctgtgctggcgatgtgcctggccttcgccaaggagccgttcgcggtcaagtccggttcctgcggcaccgtcgtcaggaacgccgagctcaagatcgtcgaccccgacaccggcgcctccctcggccgcaacctgccgggggagatctgcatccgcggcaagcagatcatgaaaggttacctaaatgatccggtggccacaaagaacaccattgacaaggacggttggctgcatactggtgacattggttatgtcgatgatgacgacgagatctttattgtcgacagactgaaggagataattaaatataagggattccaagtacctccggcggaacttgaagcccttctcattacacaccctgaaatcaaggatgctgctgtcgtatcgatgcaagacgaacttgctggtgaagttccggttgcgtttgttgtgcggactgagggttcagagatcagcgaaaacgagatcaagcagttcgttgcaaaagaggttgttttctacaagaggatctgcaaagtgttcttcgcggattccattccaaagagtccatctggcaagatcctcaggaaggacctgagagcaaagctcgccgcaggcattcccagcagtaataccacacagtccaaaagctaa

SEQ ID NO: 29752 - protein, 556 aa, Lolium perenne
MGSIAADAPPAELVFRSKLPDIEIPTHLTLQDYCFQRLPELSARACLIDGATGAALTYGEVDALSRRCAAGLRRLGVGKGDVVMALLRNCPEFAFVFLGAARLGAATTTANPFYTPHEIHRQATAAGARVIVTEACAVEKVRAFAAERGIPVVSVDEGVDGGCLPFAETLLGEESGERFVDEAVDPDDVVALPYSSGTTGLPKGVMLTHRSLVTSVAQQVDGENPNLHFSSSDVLLCVLPLFHIYSLNSVLLAGLRAGCAIVIMRKFDHGALVDLVRTHGVTVAPFVPPIVVEIAKSARVTAADLASIRLVMSGAAPMGKELQDAFMAKIPNAVLGQGYGMTEAGPVLAMCLAFAKEPFAVKSGSCGTVVRNAELKIVDPDTGASLGRNLPGEICIRGKQIMKGYLNDPVATKNTIDKDGWLHTGDIGYVDDDDEIFIVDRLKEIIKYKGFQVPPAELEALLITHPEIKDAAVVSMQDELAGEVPVAFVVRTEGSEISENEIKQFVAKEVVFYKRICKVFFADSIPKSPSGKILRKDLRAKLAAGIPSSNTTQSKS

SEQ ID NO: 29753 - DNA, 1713 bp, Lolium perenne
  CDS (1)..(1713)
atgatcacggtggcggcgcccgaggtgcagcagccgcagatcgcggcggctgctgcggccgtggaggcggcggcaccggaggcgacgacgatcttccggtccaggctcccggacatcgacatcccgacccacatgcccctgcacgactattgcttcgcgacggcagcctcggccccggacgcgccgtgcctcatcaccgcggccacggggaagacctacacgttcgccgagacgcacctgctgtgccgcaaggccgcggcggcgctgcacgggctcggcgtgcgccacggggaccggatcatgctgctgctccagaactccgtggagttcgcgctcgccttcttcggcgcgtccatgctcggcgccgtcagcacggcggcgaacccgttctgcacgccgcaggagatccacaagcagctcgtggcctccggcgcgaagctggtcgtcacgcagtccgcctacgtcgacaagctccggcacgaggccttcccccgaatcggcgaggccctcaccgtgatcaccatcgacgaggacgacggcaccccggacggctgccagccgttctgggccctcgtgtcagccgccgacgagaacagcgtcccggagtctcccatctcgccggacgacgcggtggcgctgccctactcgtcgggcacgacggggctgcccaagggcgtggtgctgacgcacggggggctggtgtcgagcgtggcgcagcaggtggacggcgagaacccgaacctgcacatgcgggcgggggaggacgtggtgctctgcgtgctgccgctcttccacatcttctcgctcaactcggtgctgctgtgcgcgctgcgggcgggcgccgccgtgatgctgatgcctaggttcgagatgggggccatgctggagggcatcgagcggtggcgcgtcacggtggcggccgtggtgccgccgctggtgctcgcgctcgccaagaaccccggggtggagaagcacgacctcagctccattcggatcgtgctctccggcgccgcgccgctcggcaaggagctcgaggacgcgctacgtggccgcctgccgcaggccatcttcggacagggctacgggatgacggaggccgggccggtgctgtccatgtgcccggcgttcgcgcgggagccgacgccggccaagtccggctcgtgcggcaccgtggtgcgcaacgcccagctcaaggtggtcgaccccgacaccggcgtctccctcggccgcaacctccccggcgagatctgcatccgcggcccgcagatcatgaaaggatacttgaatgatcccgtggccacggccgcgaccatcgacgtcgaggggtggctccacaccggcgacatcggctacgtcgacgacgacgacgaggtcttcatcgtcgaccgcgtcaaggagctcatcaagttcaagggcttccaggtaccgccggccgagctcgaggctctgctcatcgcgcatccgtccatcgccgacgcggccgtcgtcccgcaaaaggatgatgccgccggcgaggtcccggttgccttcgtggtccgcgccgccgactccgacatcgccgaggaggccatcaaggagttcgtatccaagcaggtggtgttctacaagaggctgcacaaggtctacttcacccacgcgatacccaagtcggcgtcggggaagatactcaggaaagaactcagagctaaactcgccgccccggccactgcctga

SEQ ID NO: 29754 - protein, 570 aa, Lolium perenne
MITVAAPEVQQPQIAAAAAAVEAAAPEATTIFRSRLPDIDIPTHMPLHDYCFATAASAPDAPCLITAATGKTYTFAETHLLCRKAAAALHGLGVRHGDRIMLLLQNSVEFALAFFGASMLGAVSTAANPFCTPQEIHKQLVASGAKLVVTQSAYVDKLRHEAFPRIGEALTVITIDEDDGTPDGCQPFWALVSAADENSVPESPISPDDAVALPYSSGTTGLPKGVVLTHGGLVSSVAQQVDGENPNLHMRAGEDVVLCVLPLFHIFSLNSVLLCALRAGAAVMLMPRFEMGAMLEGIERWRVTVAAVVPPLVLALAKNPGVEKHDLSSIRIVLSGAAPLGKELEDALRGRLPQAIFGQGYGMTEAGPVLSMCPAFAREPTPAKSGSCGTVVRNAQLKVVDPDTGVSLGRNLPGEICIRGPQIMKGYLNDPVATAATIDVEGWLHTGDIGYVDDDDEVFIVDRVKELIKFKGFQVPPAELEALLIAHPSIADAAVVPQKDDAAGEVPVAFVVRAADSDIAEEAIKEFVSKQVVFYKRLHKVYFTHAIPKSASGKILRKELRAKLAAPATA

SEQ ID NO: 29755 - DNA, 1638 bp, Solanum tuberosum
  CDS (1)..(1638)
atgccgatggataccgaaacaaagcaatcaggagatttaatctttcgatctaaactccctgatatttacatccctaaacatttgcctttacattcttattgctttgaaaatctatcggagtttaattcccggccctgtttgattgatggtgcaaatgatcgaatctatacttatgctgaagttgaacttacttcgagaaaagttgctgttggtcttaacaaattggggatccaacagaaggatacaatcatgatccttttgcctaattgccctgaatttgtgtttgcgtttattggcgcatcgtatctaggagcaatttcaacaatggctaaccccctgtttacaccagcagaggtagtaaagcaagccaaagcctcaagtgctaagattattatcacgcaagcttgttttgcggggaaagtgaaggattacgcaattgaaaatgatttgaaggtaatatgcgtcgattcagcaccggaaggttgtgttcatttctccgaattgattcaatccgacgaacacgaaattcctgatgtgaaaatccagccggacgatgtcgtagcgctgccgtattcctccgggactaccgggctgccgaaaggggtgatgttgacacacaaaggattagtaacaagcgttgcacaacaagttgatggagaaaatgctaatttgtatatgcacagcgatgatgtgttgatgtgtgtgttgcctttgttccatatttactcactcaattctgttttgctctgtgcattgagagtcggagcagcaattttgattatgcagaaattcgacattgctcagtttttagagttgataccgaagcataaagtgacaattggaccatttgttccgcctattgttctcgccattgctaagagtccattagttcataactacgatctttcatcagtaagaacagtcatgtctggtgctgcaccattaggaaaggaacttgaagatgccgtccgagcaaaattccctaacgccaaactcggtcagggttatggaatgacggaagccggtactgtgctgacgatgtgtttggcatttgcgaaagaaccgtttgatattaaatcaggggcatgtggtactgttgtgaggaacgcggagatgaaaattgtggatccggatacgggttgctctctgccccgtaaccaacccggtgaaatttgcattagaggtgatcaaatcatgaaaggttatttgaatgatcctgaggccacagctagaacaatagaagaagaaggatggttacacactggcgatattggattcattgacgatgatgatgagcttttcattgtggaccgattgaaggaattgatcaaatacaaaggatttcaagtggcgcctgccgagcttgaagctcttcttatcaaccaccccgacatttctgatgctgctgttgtcccaatgatagatgaacaagcgggagaagttccagtggcttttgttgttagatcaaatggatctaccattactgaggatgaagtcaaggatttcatctccaagcaggtgatattctataagagaataaagcgtgtatttttcgtagagacggtaccaaaatctccgtcaggaaaaattctgagaaaagatttaagagctagactggctgctggtatttcaaattga

SEQ ID NO: 29756 - protein, 545 aa, Solanum tuberosum
MPMDTETKQSGDLIFRSKLPDIYIPKHLPLHSYCFENLSEFNSRPCLIDGANDRIYTYAEVELTSRKVAVGLNKLGIQQKDTIMILLPNCPEFVFAFIGASYLGAISTMANPLFTPAEVVKQAKASSAKIIITQACFAGKVKDYAIENDLKVICVDSAPEGCVHFSELIQSDEHEIPDVKIQPDDVVALPYSSGTTGLPKGVMLTHKGLVTSVAQQVDGENANLYMHSDDVLMCVLPLFHIYSLNSVLLCALRVGAAILIMQKFDIAQFLELIPKHKVTIGPFVPPIVLAIAKSPLVHNYDLSSVRTVMSGAAPLGKELEDAVRAKFPNAKLGQGYGMTEAGTVLTMCLAFAKEPFDIKSGACGTVVRNAEMKIVDPDTGCSLPRNQPGEICIRGDQIMKGYLNDPEATARTIEEEGWLHTGDIGFIDDDDELFIVDRLKELIKYKGFQVAPAELEALLINHPDISDAAVVPMIDEQAGEVPVAFVVRSNGSTITEDEVKDFISKQVIFYKRIKRVFFVETVPKSPSGKILRKDLRARLAAGISN

SEQ ID NO: 29757 - DNA, 1695 bp, Pseudomonas stutzeri KC
  CDS (1)..(1695)
atgaacaacgctggcatcatcgacctggttcctgctgaggaacgccaacgttgggtgcaggacggtacctacccgaaccagcccgtattcacgctgtttgccgccaaagccgaagcgcatcccgacaagaaggccgtgctgtcgccgcaaggtgacgtgacctacggcgagctcctcgatgcagccctgcggatggctcacagcctgcgtgattcggggatcgtggccggcgacgtggtggcttaccagctcaccaaccactggttgtgctgcgcaatcgacctggcagtggcagcgctcggtgccatcgtcgcccccttccctccgggacgcggcaagctggatatccaatcgctggttcgccgctgcgacgcgcgagcggtgatcgtcccgcaagcgtacgaaggcatcgatctgtgcgaggttatcgagtcactgcgccccaccctgctatccatgcgccgcctgattgttcagggcaagcctcgcgaaggatggattacgctcgatgagctgatgagcaccgagccgctggatctcgccagcctacccagggtgtgcccgaactcgccggtgcgtctgctggtgtcttcaggcaccgagtcggagcccaagctggtggcgtactcgcacaatgcgttggttggtggtcgcgggcgcttcctgcagcgcatcgcgtccgatggcgaagattttcgcggcatgtacctcgttccgctgggttcgtccttcggctccactgccaccttcggtgtgttgtgctggctgggtggttcgctggtcgtattgcccaagttcgacgtggatgaagccatcaaggcgattgcggcatttcggccgggcttcattctcggcgtacccaccatgctgcaacgcatcgccgctcaaccggcgttggagagcatcgacaaatccagcctgcgtggtttgatcgtcggcggctcggtcatcgacgaggccaccgtgcgcaaatgccgtgatgcgtttggctgcggcttcatcagcctctacggttccgccgacggcgtgaactgccataacaccctggacgaccccatcgaagttgtgctgaccagcgtcggcaagcccaatccggcggtctgcgcgattcgtctggtggacgacgaaggccgggaggtccggcaaggcgaggttggcgaaatcaccgcccgcgggccattgactccaatgcagtacgtcaacgcgccggagctggacgagcgttaccgcgacccgcaaggctgggtgaagaccggagatctgggctacatcaacgacaagggttatctggtcctagccggtcgcaagaaggacgtcatcatccgtgggggcgccaatatcagcccgacccagattgaaggcctggtcatggcgcatcccgatgtcgtgaccgttgcgtgcattcctgttcccgatgatgatctcgggcagcgggtgtgcctttccgtcaccttgcgcgagggtgcagcgaagttttccctgaaagcgatcaccgacttcctgcgcgaactgggactggaggtgaacaagctccccgagtacctacgcttctaccgcgctctgcctctgacaccggcgggaaagatcgataaaaaagcgctaaccgaggaagcccgcgagctgggcacctcgggcatttgtcccgctgggccggggcagtcgactcccgagcgcagcttacgggagtacgcatga

SEQ ID NO: 29758 - protein, 564 aa, Pseudomonas stutzeri KC
MNNAGIIDLVPAEERQRWVQDGTYPNQPVFTLFAAKAEAHPDKKAVLSPQGDVTYGELLDAALRMAHSLRDSGIVAGDVVAYQLTNHWLCCAIDLAVAALGAIVAPFPPGRGKLDIQSLVRRCDARAVIVPQAYEGIDLCEVIESLRPTLLSMRRLIVQGKPREGWITLDELMSTEPLDLASLPRVCPNSPVRLLVSSGTESEPKLVAYSHNALVGGRGRFLQRIASDGEDFRGMYLVPLGSSFGSTATFGVLCWLGGSLVVLPKFDVDEAIKAIAAFRPGFILGVPTMLQRIAAQPALESIDKSSLRGLIVGGSVIDEATVRKCRDAFGCGFISLYGSADGVNCHNTLDDPIEVVLTSVGKPNPAVCAIRLVDDEGREVRQGEVGEITARGPLTPMQYVNAPELDERYRDPQGWVKTGDLGYINDKGYLVLAGRKKDVIIRGGANISPTQIEGLVMAHPDVVTVACIPVPDDDLGQRVCLSVTLREGAAKFSLKAITDFLRELGLEVNKLPEYLRFYRALPLTPAGKIDKKALTEEARELGTSGICPAGPGQSTPERSLREYA

SEQ ID NO: 29759 - DNA, 1686 bp, Arabidopsis thaliana
  CDS (1)..(1686)
atggcgccacaagaacaagcagtttctcaggtgatggagaaacagagcaacaacaacaacagtgacgtcattttccgatcaaagttaccggatatttacatcccgaaccacctatctctccacgactacatcttccaaaacatctccgaattcgccactaagccttgcctaatcaacggaccaaccggccacgtgtacacttactccgacgtccacgtcatctcccgccaaatcgccgccaattttcacaaactcggcgttaaccaaaacgacgtcgtcatgctcctcctcccaaactgtcccgaattcgtcctctctttcctcgccgcctccttccgcggcgcaaccgccaccgccgcaaaccctttcttcactccggcggagatagctaaacaagccaaagcctccaacaccaaactcataatcaccgaagctcgttacgtcgacaaaatcaaaccacttcaaaacgacgacggagtagtcatcgtctgcatcgacgacaacgaatccgtgccaatccctgaaggctgcctccgcttcaccgagttgactcagtcgacaaccgaggcatcagaagtcatcgactcggtggagatttcaccggacgacgtggtggcactaccttactcctctggcacgacgggattaccaaaaggagtgatgctgactcacaagggactagtcacgagcgttgctcagcaagtcgacggcgagaacccgaatctttatttccacagcgatgacgtcatactctgtgttttgcccatgtttcatatctacgctttgaactcgatcatgttgtgtggtcttagagttggtgcggcgattctgataatgccgaagtttgagatcaatctgctattggagctgatccagaggtgtaaagtgacggtggctccgatggttccgccgattgtgttggccattgcgaagtcttcggagacggagaagtatgatttgagctcgataagagtggtgaaatctggtgctgctcctcttggtaaagaacttgaagatgccgttaatgccaagtttcctaatgccaaactcggtcagggatacggaatgacggaagcaggtccagtgctagcaatgtcgttaggttttgcaaaggaaccttttccggttaagtcaggagcttgtggtactgttgtaagaaatgctgagatgaaaatagttgatccagacaccggagattctctttcgaggaatcaacccggtgagatttgtattcgtggtcaccagatcatgaaaggttacctcaacaatccggcagctacagcagagaccattgataaagacggttggcttcatactggagatattggattgatcgatgacgatgacgagcttttcatcgttgatcgattgaaagaacttatcaagtataaaggttttcaggtagctccggctgagctagaggctttgctcatcggtcatcctgacattactgatgttgctgttgtcgcaatgaaagaagaagcagctggtgaagttcctgttgcatttgtggtgaaatcgaaggattcggagttatcagaagatgatgtgaagcaattcgtgtcgaaacaggttgtgttttacaagagaatcaacaaagtgttcttcactgaatccattcctaaagctccatcagggaagatattgaggaaagatctgagggcaaaactagcaaatggattgtga

SEQ ID NO: 29760 - protein, 561 aa, Arabidopsis thaliana; identical to SEQ ID NO: 14027

SEQ ID NO: 29761 - DNA, 1635 bp, Petroselinum crispum
  CDS (1)..(1635)
atgggagattgtgtagcacccaaagaagaccttattttccgatcgaaactccctgatatttacatcccgaaacaccttccgttacatacttattgtttcgaaaacatctcgaaagttggcgacaagtcctgtttaataaatggcgctacaggcgaaacgttcacttattctcaagttgagctcctttccaggaaagttgcatcagggttaaacaaactcggcattcaacagggcgataccatcatgcttttgctccctaactcccctgagtattttttcgctttcttaggcgcatcgtatcgtggtgcaatttctactatggccaatccgtttttcacttctgctgaggtgatcaaacagctcaaagcatcccaagctaagctcataattacgcaagcttgttacgtagacaaagtgaaagactacgcagcagagaaaaatatacagatcatttgcatcgatgatgctcctcaggattgtttacatttctccaaacttatggaagctgatgaatcagaaatgccggaggttgtgatcaattcagacgatgtcgtcgcgttaccttattcatcgggtactacaggactaccgaaaggtgttatgttgacacacaaaggacttgttactagcgtggcacaacaagttgatggagacaatccgaatttatatatgcatagcgaggatgtgatgatctgcatattgcctttgtttcatatttattcgcttaacgcggtgttgtgctgtggactcagagcaggggtgacgatcttgattatgcagaaatttgatattgtgccatttttggaactgatacaaaaatataaagttacaattggaccgtttgtgccaccaattgtgttggcaattgcgaaaagtccagtggtggataaatatgacttgtcgtcggtgaggacggttatgtctggagctgctccgttagggaaggagcttgaagatgctgttagagctaagtttcctaatgccaaacttggtcagggatatggaatgacagaggcagggccagttttagcaatgtgcctggcgtttgcaaaggaaccatacgagatcaaatcgggtgcctgtggaactgttgtgaggaatgctgaaatgaaaattgtggatcctgagaccaacgcctctcttccacgaaaccaacgcggagagatttgcattcgaggtgaccaaattatgaaaggctacctcaatgatcctgaatcaacaaggacaacaatagacgaagaaggctggttgcacacaggagatataggcttcattgacgacgatgatgagctatttattgttgatagacttaaggaaataatcaaatacaaaggcttccaggttgcccctgctgaacttgaagctctgctacttactcatcctaccatttccgatgctgcagttgttcccatgatagatgagaaagcaggagaggtgcctgtggcttttgttgtgagaacaaacggtttcaccaccactgaggaagaaatcaagcaattcgtctcgaaacaggtggtgttctacaagagaatatttcgtgtattttttgttgatgcaattccgaaatcaccatctggaaagattcttcgaaaggacttgagagcaagaatagcatccggtgatcttcccaaataa

SEQ ID NO: 29762 - protein, 544 aa, Petroselinum crispum
MGDCVAPKEDLIFRSKLPDIYIPKHLPLHTYCFENISKVGDKSCLINGATGETFTYSQVELLSRKVASGLNKLGIQQGDTIMLLLPNSPEYFFAFLGASYRGAISTMANPFFTSAEVIKQLKASQAKLIITQACYVDKVKDYAAEKNIQIICIDDAPQDCLHFSKLMEADESEMPEVVINSDDVVALPYSSGTTGLPKGVMLTHKGLVTSVAQQVDGDNPNLYMHSEDVMICILPLFHIYSLNAVLCCGLRAGVTILIMQKFDIVPFLELIQKYKVTIGPFVPPIVLAIAKSPVVDKYDLSSVRTVMSGAAPLGKELEDAVRAKFPNAKLGQGYGMTEAGPVLAMCLAFAKEPYEIKSGACGTVVRNAEMKIVDPETNASLPRNQRGEICIRGDQIMKGYLNDPESTRTTIDEEGWLHTGDIGFIDDDDELFIVDRLKEIIKYKGFQVAPAELEALLLTHPTISDAAVVPMIDEKAGEVPVAFVVRTNGFTTTEEEIKQFVSKQVVFYKRIFRVFFVDAIPKSPSGKILRKDLRARIASGDLPK

SEQ ID NO: 29763 - DNA, 1638 bp, Solanum tuberosum
  CDS (1)..(1638)
atgccgatggataccgaaacaaagcaatcaggagatttaatctttcgatctaaactccctgatatttacatccctaaacatttgcctttacattcttattgctttgaaaatctatcggagtttaattcccggccctgtttgattgatggtgcaaatgatcgaatctatacttatgctgaagttgaacttacttcgagaaaagttgctgttggtcttaacaaattggggatccaacagaaggatacaatcatgatccttttgcctaattgccctgaatttgtgtttgcgtttattggcgcatcgtatctaggagcaatttcaacaatggctaatcctctgtttacaccagcagaggtagtaaagcaagccaaagcctcaagtgctaagattgttatcacgcaagcttgttttgcggggaaagtgaaggactacgcaattgaaaatgatttgaaggtaatatgcgtcgattcagtaccggaaggttgtgttcatttctccgaattgattcaatccgacgaacacgaaattcctgatgtgaaaatccagccggacgatgtcgtagctctgccgtattcctccgggactaccgggctgccgaaaggggtgatgttgacacacaaaggattagtaacaagcgttgcacaacaagttgatggagaaaatgctaatttgtatatgcacagcgatgatgtgttgatgtgtgtgttgcctttgttccatatttactcactcaattctgttttgctctgtgcattgagagtcggagcagcaattttgattatgcagaaattcgacattgctcagtttttagagttgataccgaagcataaagtgacaattggaccatttgttccgcctattgttctcgccattgctaagagtccattagttgataactacgatctttcatcagtaagaacagtcatgtctggtgctgcaccattaggaaaggaacttgaagatgccgtccgagcaaaattccctaacgccaaactcggtcagggttatggaatgacggaagccggtcctgtgctggcgatgtgtttggcatttgcgaaagaaccgtttgatattaaatcaggggcatgtggtactgttgtgaggaacgcggagatgaaaattgtggatccggatacgggttgctctctgccccgtaaccaacccggtgaaatttgcattagaggtgatcaaatcatgaaaggttacttgaatgatcccgaggccacagctagaacaatagaaaaagaaggatggttacacactggcgatattggattcattgacgatgatgatgagcttttcattgtggaccgattgaaggaattgatcaaatacaaaggatttcaagtggcgcctgccgagcttgaagctcttcttatcaaccaccccgacatttctgatgctgctgttgtcccaatgatagatgaacaagcgggagaagttccagtggcttttgttgttagatcaaatggatctaccattactgaggatgaagtcaaggatttcatctccaagcaggtgatattctataagagaataaagcgtgtatttttcgtagagacggtaccaaaatctccgtcaggaaaaattctgagaaaagatttaagagctagactggctgctggtatttcaaattga

SEQ ID NO: 29764 - protein, 545 aa, Solanum tuberosum
MPMDTETKQSGDLIFRSKLPDIYIPKHLPLHSYCFENLSEFNSRPCLIDGANDRIYTYAEVELTSRKVAVGLNKLGIQQKDTIMILLPNCPEFVFAFIGASYLGAISTMANPLFTPAEVVKQAKASSAKIVITQACFAGKVKDYAIENDLKVICVDSVPEGCVHFSELIQSDEHEIPDVKIQPDDVVALPYSSGTTGLPKGVMLTHKGLVTSVAQQVDGENANLYMHSDDVLMCVLPLFHIYSLNSVLLCALRVGAAILIMQKFDIAQFLELIPKHKVTIGPFVPPIVLAIAKSPLVDNYDLSSVRTVMSGAAPLGKELEDAVRAKFPNAKLGQGYGMTEAGPVLAMCLAFAKEPFDIKSGACGTVVRNAEMKIVDPDTGCSLPRNQPGEICIRGDQIMKGYLNDPEATARTIEKEGWLHTGDIGFIDDDDELFIVDRLKELIKYKGFQVAPAELEALLINHPDISDAAVVPMIDEQAGEVPVAFVVRSNGSTITEDEVKDFISKQVIFYKRIKRVFFVETVPKSPSGKILRKDLRARLAAGISN

SEQ ID NO: 29765 - DNA, 1644 bp, Nicotiana tabacum
  CDS (1)..(1644)
atgccaatggagactactacagaaacaaagcaatcaggagatttaattttccgatcaaaactccctgatatttacatccctaaacatttacctttacattcttattgttttgaaaacatttcggagtttagttctcgtccctgtttgattaatggagccaacgatcaaatttatacttatgctgaggttgagctcacttgcagaaaagttgcagttggtcttaacaagttagggatccaacaaaaggacacgattatgatccttttgccgaattcccctgaatttgtgtttgcttttatgggcgcttcatatttaggagccatttctacaatggccaatcctctgtttacacctgcagaggttgtaaaacaagccaaagcctcaagtgctaagattattataactcaatcgtgctttgtgggcaaagtgaaggattacgcaagtgaaaatgatgtgaaggtcatttgtattgactctgcaccggaaggttgtcttcatttctcagaattgacacaatccgatgagcatgaaattcctgaggtgaaaatccagccagacgacgtcgttgcgctgccgtattcctctggtactacagggctgccgaaaggtgtgatgttgacgcacaagggattagtcacgagcgttgcacaacaagttgacggtgaaaatgcgaatttgtatatgcacagtgaggatgtattgatgtgtgtgttgcctttgttccatatatactcactcaattccattttgctttgtggattgagagtcggtgcagcgattttgattatgcagaaatttgacattgctccgttcctggagttaatacagaagtataaggtgtcaattgggccatttgtgccgcctattgttctggctattgctaagagtccaattgttgatagctatgatctttcctcagtaaggactgtcatgtctggggctgcaccattaggaaaagaactcgaagacgctgtgagaaccaaattccctaacgctaaacttggccagggttatggaatgacggaagctgggccggtgttggcaatgtgtttggcatttgcaaaagaaccctttgatattaaatcaggggcatgtggtactgttgtgaggaacgccgagatgaaaattgtagatccggatacgggttgctctcttcctcgtaaccaacccggtgagatttgcattagaggtgaccagatcatgaaaggttacctgaatgatcccgaggccacaacgagaacaatagacaaagaaggatggttacacactggcgacattgggttcattgacgaggatgacgagcttttcattgtggatcgattgaaggaattgatcaaatacaaaggatttcaagtggcacctgcagaaattgaagcccttcttctcaaccatcccaacatttctgatgctgctgttgtccccatgaaagatgagcaagcaggagaagttccagtggcttttgttgttaggtcaaatggatctgccatcactgaggatgaagtcaaggatttcatctctaaacaggtgatattttataagagagtaaagcgtgtatttttcgtggagacggtacccaaatctccgtcgggaaaaattcttagaaaggacttgagagctagactggctgctggtgttccaaattaa

SEQ ID NO: 29766 - protein, 547 aa, Nicotiana tabacum; identical to SEQ ID NO: 14335

SEQ ID NO: 29767 - DNA, 1671 bp, Arabidopsis thaliana
  CDS (1)..(1671)
atgacgacacaagatgtgatagtcaatgatcagaatgatcagaaacagtgtagtaatgacgtcattttccgatcgagattgcctgatatatacatccctaaccacctcccactccacgactacatcttcgaaaatatctcagagttcgccgctaagccatgcttgatcaacggtcccaccggcgaagtatacacctacgccgatgtccacgtaacatctcggaaactcgccgccggtcttcataacctcggcgtgaagcaacacgacgttgtaatgatcctcctcccgaactctcctgaagtagtcctcactttccttgccgcctccttcatcggcgcaatcaccacctccgcgaacccgttcttcactccggcggagatttctaaacaagccaaagcctccgcggcgaaactcatcgtcactcaatcccgttacgtcgataaaatcaagaacctccaaaacgacggcgttttgatcgtcaccaccgactccgacgccatccccgaaaactgcctccgtttctccgagttaactcagtccgaagaaccacgagtggactcaataccggagaagatttcgccagaagacgtcgtggcgcttcctttctcatccggcacgacgggtctccccaaaggagtgatgctaacacacaaaggtctagtcacgagcgtggcgcagcaagtcgacggcgagaatccgaatctttacttcaacagagacgacgtgatcctctgtgtctggcctatgttccatatatacgctctcaactccatcatgctctgtagtctcagaattggtgccacgatcttgataatgcctaagttcgaaatcactctcttgttagagcagatacaaaggtgtaaagtcacggtggctatggtcgtgccaccgatcgttttagctatcgcgaagtcgccggagacggagaagtatgatctgagctcggttaggatggttaagtctggagcagctcctcttggtaaggagcttgaagatgctattagtgctaagtttcctaacgccaagcttggtcagggctatgggatgacagaagcaggtccggtgctagcaatgtcgttagggtttgctaaagagccgtttccagtgaagtcaggagcatgtggtacggtggtgaggaacgccgagatgaagatacttgatccagacacaggagattctttgcctaggaacaaacccggcgaaatatgcatccgtggcaaccaaatcatgaaaggctatctcaatgaccccttggccacggcatcgacgatcgataaagatggttggcttcacactggagacgtcggatttatcgatgatgacgacgagcttttcattgtggatagattgaaagaactcatcaagtacaaaggatttcaagtggctccagctgagctagagtctctcctcataggtcatccagaaatcaatgatgttgctgtcgtcgccatgaaggaagaagatgctggtgaggttcctgttgcgtttgtggtgagatcgaaagattcaaatatatccgaagatgaaatcaagcaattcgtgtcaaaacaggttgtgttttataagagaatcaacaaagtgttcttcactgactctattcctaaagctccatcagggaagatattgaggaaggatctaagagcaagactagcaaatggattaatgaactag

SEQ ID NO: 29768 - protein, 556 aa, Arabidopsis thaliana
MTTQDVIVNDQNDQKQCSNDVIFRSRLPDIYIPNHLPLHDYIFENISEFAAKPCLINGPTGEVYTYADVHVTSRKLAAGLHNLGVKQHDVVMILLPNSPEVVLTFLAASFIGAITTSANPFFTPAEISKQAKASAAKLIVTQSRYVDKIKNLQNDGVLIVTTDSDAIPENCLRFSELTQSEEPRVDSIPEKISPEDVVALPFSSGTTGLPKGVMLTHKGLVTSVAQQVDGENPNLYFNRDDVILCVWPMFHIYALNSIMLCSLRIGATILIMPKFEITLLLEQIQRCKVTVAMVVPPIVLAIAKSPETEKYDLSSVRMVKSGAAPLGKELEDAISAKFPNAKLGQGYGMTEAGPVLAMSLGFAKEPFPVKSGACGTVVRNAEMKILDPDTGDSLPRNKPGEICIRGNQIMKGYLNDPLATASTIDKDGWLHTGDVGFIDDDDELFIVDRLKELIKYKGFQVAPAELESLLIGHPEINDVAVVAMKEEDAGEVPVAFVVRSKDSNISEDEIKQFVSKQVVFYKRINKVFFTDSIPKAPSGKILRKDLRARLANGLMN

SEQ ID NO: 29769 - DNA, 1710 bp, Oryza sativa
  CDS (1)..(1710)
atgatcacggtggcggcaccggaggcgcagccgcaggtggcggcggcggtcgatgaggcgccgccggaggcggtgacggtgttccggtccaagcttccggacatcgacatccccagccacctgcccctgcacgagtactgcttcgccagggcggccgagctccccgacgcgccgtgcctcatcgcggcggccacggggaggacgtacacgttcgccgagacgcgcctgctgtgccgcagggccgccgcggcgctgcaccggctgggcgtcggccacggcgaccgcgtcatggtgctgctccagaactgcgtggagttcgccgtggcgttcttcgccgcgtcgttcctcggcgcggtcaccaccgccgccaacccgttctgcacgccgcaggagatccacaagcagttcaagggctccggcgtgaagctcatcctcacccagtccgtctacgtcgacaagctccggcagcacgaggcgttcccaaggatcgacgcctgcaccgtcggcgacgacacgctcaccgtgatcaccatcgacgacgacgaggcgacgccgaaagcgtgcctgccgttctgggacctgatcgcggacgccgacgaggggtccgtcccggaggtggccatctcgccggacgaccccgtggcgctgccgttctcgtcgggcacgacggggcttgccaagggcgtggtgctgacgcacaggagcgtcgtgtcgggcgtggcgcacgaggtggacggcgagaacccgaacctgcacatgggtgccggcgacgtggcgctgtgcgtgctgccgctgttccacatcttctcgctcaactccgtgctgctgtcgcgggtgcggccggcgccggcggtggcgctgatgcccaggttcgagatgggcgccatgctgggggccatcgagcggtggcgcgtgacggtcggggccgtcgtgccgccgctcgtcgtcgcgctcgccaagaacccgttcgtggagcgccacgacctcagctccatccgcatcgtgctctccggcgccgccccgctcggcaaggagctcgaggacgccctccgcgcccgcctgcctcaggccatcttcggacagggatacgggatgacggaggcggggccggtgctgtcgatgtgccccgcgttcgccaaggagccgacgccggcgaagtccgggtcgtgcgggacggtggtgcggaacgcggagctcaaggtggtcgacccggacacgggcttctccctcggccgcaacctccccggcgagatctgcatccgcggcccacagatcatgaaaggttacctgaacgatcccgaggcgaccgccgcgacgatcgacgtcgaggggtggctgcacaccggcaacatcggctacgtcgacgacgacgacgaggtcttcatcgtcgaccgtgtcaaggagctcatcaaattcaaggggttccaggtgccgccggccgagctggagtcgctgctcatcgctcacccgtccatccgtgacgccgccgtcgtcccgcaaaaggatgacgtcgccggcgaggtcccggtcgcgttcgtggtccgcgccgccgactccgacatcacggaggagtccatcaaggaattcatatccaagcaggtggtgttctacaagaggctacacaaggtgcacttcatccatgcgatccccaagtcggcgtctgggaagatactgaggagagagctcagagccaagctcgcggcgtgctga

SEQ ID NO: 29770 - protein, 569 aa, Oryza sativa
MITVAAPEAQPQVAAAVDEAPPEAVTVFRSKLPDIDIPSHLPLHEYCFARAAELPDAPCLIAAATGRTYTFAETRLLCRRAAAALHRLGVGHGDRVMVLLQNCVEFAVAFFAASFLGAVTTAANPFCTPQEIHKQFKGSGVKLILTQSVYVDKLRQHEAFPRIDACTVGDDTLTVITIDDDEATPKACLPFWDLIADADEGSVPEVAISPDDPVALPFSSGTTGLAKGVVLTHRSVVSGVAHEVDGENPNLHMGAGDVALCVLPLFHIFSLNSVLLSRVRPAPAVALMPRFEMGAMLGAIERWRVTVGAVVPPLVVALAKNPFVERHDLSSIRIVLSGAAPLGKELEDALRARLPQAIFGQGYGMTEAGPVLSMCPAFAKEPTPAKSGSCGTVVRNAELKVVDPDTGFSLGRNLPGEICIRGPQIMKGYLNDPEATAATIDVEGWLHTGNIGYVDDDDEVFIVDRVKELIKFKGFQVPPAELESLLIAHPSIRDAAVVPQKDDVAGEVPVAFVVRAADSDITEESIKEFISKQVVFYKRLHKVHFIHAIPKSASGKILRRELRAKLAAC

SEQ ID NO: 29771 - DNA, 1635 bp, Petroselinum crispum
  CDS (1)..(1635)
atgggagactgtgtagcacccaaagaagaccttattttccgatcgaaactccctgatatttacatcccgaaacaccttccgttacatacttattgtttcgaaaacatctcgaaagttggcgacaagtcctgtttaataaatggcgctacaggcgaaacgttcacttattctcaagttgagctcctttccaggaaagttgcatcagggttaaacaaactcggcattcaacagggcgataccatcatgcttttgctccccaactcccctgagtattttttcgctttcttaggcgcatcgtatcgtggtgcaatttctactatggccaatccgtttttcacttctgctgaggtgatcaaacagctcaaagcatccctagctaagctcataattacgcaagcttgttacgtagacaaagtgaaagactacgcagcagagaaaaatatacagatcatttgcatcgatgatgctcctcaggattgtttacatttctccaaacttatggaagctgatgaatcagaaatgcccgaggtagtgatcgattcagacgatgtcgtcgcgttaccttactcatcgggtactacaggactaccgaaaggtgttatgttgacccacaaaggacttgttactagcgtggcacaacaagttgatggagacaatccgaatttatatatgcatagcgaggatgtgatgatctgcatattgcctttgtttcatatttattcgcttaacgcggtgttgtgctgtggactcagagcaggggtgacgatcttgattatgcagaaatttgatattgtgccatttttggaactgatacagaaatataaagttacaattggaccgtttgtgccaccaattgtgttggcaattgcgaaaagtccagtggtggataaatatgacttgtcgtcggtgaggacggttatgtctggagctgctccgttagggaaggagcttgaagatgctgttagagctaagtttcctaatgccaaacttggtcagggatatggaatgacagaggcagggccagttttagcaatgtgcctggcgtttgcaaaggaaccatacgagatcaaatcgggtgcctgtggaactgttgtgaggaatgctgaaatgaaaattgtggatcctgagaccaacgcctctcttccacgaaaccaacgcggagagatttgcattcgaggtgaccaaattatgaaaggctacctcaatgatcctgaatcaacaaggacaacaatagacgaagaaggctggttgcacacaggagatataggcttcattgacgacgatgatgagctatttattgttgatagacttaaggaaataatcaaatacaaaggcttccaggttgcccctgctgaacttgaagctctgctacttactcatcctaccatttccgatgctgcagttgttcccatgatagatgagaaagcaggagaggtgcctgtggcttttgttgtgagaacaaacggtttcaccaccactgaggaagaaatcaagcaattcgtctcgaaacaggtggtgttctacaagagaatatttcgtgtattttttgttgatgcaattccgaaatcaccatctggaaagattcttcgaaaggacttgagagcaaaaatagcatccggtgatcttcccaaataa

SEQ ID NO: 29772 - protein, 544 aa, Petroselinum crispum; identical to SEQ ID NO: 14019

SEQ ID NO: 29773 - DNA, 1689 bp, Glycine max
  CDS (1)..(1689)
atgataactctagctccttctcttgatactccaaaaactgatcaaaaccaagtttctgatccccaaactagccatgtcttcaaatcaaaattaccagatatcccaatctccaaccacctccctctccactcctactgcttccagaacctctcccaatttgcccaccgcccttgcctcatcgtcggacccgcctccaaaaccttcacctacgccgacacccacctcatttccagcaagatcgccgccggattgtccaacctcggaatcctcaagggcgacgtcgtcatgatcctcctccagaactccgccgatttcgtcttctccttcctcgccatctccatgattggcgccgtcgccaccaccgccaacccgttctacaccgccccggagatcttcaagcagttcaccgtctccaaggcgaagttgatcataacacaggcaatgtacgtggacaagctccgcaaccacgacggcgcgaagctcggcgaggacttcaaggtcgtaaccgtcgacgatccgccggagaattgcctccacttctctgtcctctcggaggcgaacgagagcgacgtgccagaggtggagatccacccggacgacgcggtggcgatgccgttctcctccggcacgacgggtttacctaaaggagtgattctcacgcacaagagtttaaccacgagtgtggcgcagcaagttgacggagagaaccctaacctctacctcaccaccgaggacgtgctcctctgcgtgcttccgctctttcacatattctcgctcaacagtgtgctattgtgcgccctcagggcggggagtgcagttttgttgatgcagaagttcgagatcgggacactgctggagctgatacagcggcaccgagtgtcggtggcgatggtggtgcccccgctggtgttggcgttggcaaagaatccgatggtggcggattttgacctgagttcaatacggttagtgctgtccggagctgctcccttggggaaggagctcgaggaggctctccggaacaggatgcctcaagctgttttgggacagggttacgggatgacagaagcagggccagtgctgtccatgtgcttgggctttgcaaagcaacctttccaaacaaaatcaggctcttgtggtaccgtagtcagaaatgcagaactcaaggttgttgaccctgaaactggtcgttctcttggctacaatcaacccggtgaaatttgcatccgagggcaacagatcatgaaaggatatctgaacgatgaggcagcgacagcatcgaccatagattcagagggttggcttcacaccggtgatgttggctacgtagatgatgatgacgaaattttcattgttgacagggtgaaggaactcatcaaatataaaggcttccaggtgccccctgcagaacttgaagggcttcttgtaagccatccctccattgcagatgcagctgttgtcccacaaaaggatgttgctgctggtgaagttcctgttgccttcgttgtgagatcaaacggctttgatctaactgaagaggctgtaaaagagtttatagctaaacaggtagtgttttacaaaagactgcacaaagtttattttgttcatgctattcccaagtctccatcaggaaagatattaaggaaagacctcagagcaaagctagaaaccgccgccactcagacgccttaa

SEQ ID NO: 29774 - protein, 562 aa, Glycine max
MITLAPSLDTPKTDQNQVSDPQTSHVFKSKLPDIPISNHLPLHSYCFQNLSQFAHRPCLIVGPASKTFTYADTHLISSKIAAGLSNLGILKGDVVMILLQNSADFVFSFLAISMIGAVATTANPFYTAPEIFKQFTVSKAKLIITQAMYVDKLRNHDGAKLGEDFKVVTVDDPPENCLHFSVLSEANESDVPEVEIHPDDAVAMPFSSGTTGLPKGVILTHKSLTTSVAQQVDGENPNLYLTTEDVLLCVLPLFHIFSLNSVLLCALRAGSAVLLMQKFEIGTLLELIQRHRVSVAMVVPPLVLALAKNPMVADFDLSSIRLVLSGAAPLGKELEEALRNRMPQAVLGQGYGMTEAGPVLSMCLGFAKQPFQTKSGSCGTVVRNAELKVVDPETGRSLGYNQPGEICIRGQQIMKGYLNDEAATASTIDSEGWLHTGDVGYVDDDDEIFIVDRVKELIKYKGFQVPPAELEGLLVSHPSIADAAVVPQKDVAAGEVPVAFVVRSNGFDLTEEAVKEFIAKQVVFYKRLHKVYFVHAIPKSPSGKILRKDLRAKLETAATQTP

SEQ ID NO: 29775 - DNA, 1629 bp, Nicotiana tabacum
  CDS (1)..(1629)
atggagaaagatacaaaacaggttgacataattttccgatcaaaactccctgatatttacatccctaaccatcttcctttacactcctactgtttcgaaaacatttccgagttcagttctcgtccttgtttaatcaatggcgccaacaaacaaatttatacgtatgctgatgttgaactcaattcaagaaaagttgctgctggtcttcacaaacaagggattcaaccaaaggatacaataatgatcctattgcctaactccccagaatttgtgtttgctttcattggtgcatcgtacctcggagctatttctacaatggccaatcctttgtttactcctgctgaggttgtgaagcaagccaaggcttctagtgctaagatcattgtcacacaagcgtgtcatgttaacaaagtgaaagattatgcatttgagaatgatgtgaagatcatatgcatcgactcggcgccggagggttgtctccacttctccgtgctaactcaggctaatgagcacgatattcctgaggttgaaattcaacctgacgatgtggtggcgttgccatactcctccgggacgacgggattacctaaaggagtgatgttgacgcacaagggacttgtgacaagcgtcgcacaacaagtcgacggtgaaaatccgaatttgtatatccatagcgaggacgtgatgctttgtgtcttgcccttgttccatatctattcactcaactccgttttgctttgtggattaagggtgggagcagcgattttgattatgcagaaatttgatattgtttctttcttggagttgatacaacgttacaaggtgacaatagggccgtttgtaccacctattgttttggccattgctaagagtcctatggttgatgattatgatctttcatcagtaagaaccgtcatgtctggggctgcaccattaggaaaggagcttgaagatactgttcgagccaaatttcctaatgctaaacttggtcagggttatggtatgacagaagctggaccagtgttggctatgtgcttggcatttgcaaaagaaccctttgaaataaaatcaggggcatgtggaacagttgtgagaaatgctgaaatgaaaattgtggatcctaaaactggtaattctcttcccagaaatcaatctggagaaatttgcattagaggagaccagatcatgaaaggctacctgaatgatccagaggccacagcaagaacaatagacaaagaagggtggttatatactggtgacattggctacattgatgatgacgacgagcttttcattgttgatcgattaaaggaactgatcaaatacaaaggatttcaagtcgcacctgctgagctcgaagctctccttctcaaccatcccaacatttctgatgctgctgttgtccccatgaaggacgagcaagcaggagaagttccagtggcttttgttgttagatccaacggatccaccattactgaagatgaagtcaaagattttatttcaaagcaggtgatattttataagaggataaagcgggtatttttcgtggatgctattcctaaatctccatctggcaaaatccttcgaaaagatttgagagctaaactggctgctgggcttccaaattaa

SEQ ID NO: 29776 - protein, 542 aa, Nicotiana tabacum
MEKDTKQVDIIFRSKLPDIYIPNHLPLHSYCFENISEFSSRPCLINGANKQIYTYADVELNSRKVAAGLHKQGIQPKDTIMILLPNSPEFVFAFIGASYLGAISTMANPLFTPAEVVKQAKASSAKIIVTQACHVNKVKDYAFENDVKIICIDSAPEGCLHFSVLTQANEHDIPEVEIQPDDVVALPYSSGTTGLPKGVMLTHKGLVTSVAQQVDGENPNLYIHSEDVMLCVLPLFHIYSLNSVLLCGLRVGAAILIMQKFDIVSFLELIQRYKVTIGPFVPPIVLAIAKSPMVDDYDLSSVRTVMSGAAPLGKELEDTVRAKFPNAKLGQGYGMTEAGPVLAMCLAFAKEPFEIKSGACGTVVRNAEMKIVDPKTGNSLPRNQSGEICIRGDQIMKGYLNDPEATARTIDKEGWLYTGDIGYIDDDDELFIVDRLKELIKYKGFQVAPAELEALLLNHPNISDAAVVPMKDEQAGEVPVAFVVRSNGSTITEDEVKDFISKQVIFYKRIKRVFFVDAIPKSPSGKILRKDLRAKLAAGLPN

SEQ ID NO: 29777 - DNA, 1686 bp, Arabidopsis thaliana
  CDS (1)..(1686)
atgatcactgcagctctacacgaacctcagattcacaaaccaaccgatacatccgtcgtctccgatgatgtgcttcctcattctcctcctacgcctcgcattttccggtcaaagcttccggacattgacatccctaaccacctccctctccacacttactgcttcgaaaaactctcatctgtttccgacaagccttgtctcatcgttggctccaccgggaaaagctacacctacggcgaaacacacctaatctgtcggagagtcgcttccgggttatacaagttaggtatcagaaaaggtgacgtcatcatgatccttctccaaaactcagccgagttcgttttctccttcatgggtgcttccatgatcggagccgtctcaaccaccgcaaaccctttctacacttctcaagagctttataaacagcttaaatcttccggagccaaactcataatcactcactctcaatacgtcgataaacttaaaaacctcggagaaaacctcacgctgatcactaccgatgaaccaacaccggagaattgtctaccattctcgacactcatcaccgacgacgaaacaaacccatttcaagaaaccgtcgatatcggcggtgacgatgcggcggcgttaccattctcatcgggaacaacagggttaccaaaaggagttgttttgacacacaagagcttaatcacaagcgttgcacaacaagtagatggagataacccaaatctttacctcaaatcaaacgacgtcatactctgcgttttaccacttttccatatctactctctcaatagcgtcctcctcaattcactccgatccggcgccacggttcttttaatgcataagtttgagatcggtgcgttattggatcttattcaaagacatagagtgacaatagcggcgcttgtaccgccgctagtgatcgctctagctaaaaacccgacggttaattcttatgatctctcctccgttagattcgttctttccggtgcagctcctttaggtaaagaacttcaagatagtcttcgtcgccgtctccctcaagccatccttggccagggatatggtatgacggaggcaggaccagtgttgtcaatgagccttgggttcgctaaagaaccgataccgacaaaatcaggttcatgtgggactgtggtccgaaacgcagagcttaaagtggttcaccttgagacacgtctctctcttggatacaaccaacctggtgagatttgtatccgcggtcaacagatcatgaaagagtacttgaacgatccagaagccacttcagcaacaatagacgaagaaggttggcttcacacaggagacattggatatgttgatgaagatgatgagattttcattgttgatcgacttaaagaagtcatcaagttcaaaggctttcaggtccctccagctgagctagagagtttgctaatcaatcaccattcaattgccgatgcagctgttgttccgcaaaatgatgaagtcgctggggaagttccggtggctttcgtggtgcgatcaaatggaaatgatatcactgaagaagatgttaaagaatatgttgccaaacaggtggtgttctataagagattgcacaaggtcttctttgttgcttccattcctaaatctccttcgggaaaaatactaagaaaggacctcaaagctaagctttgttga

SEQ ID NO: 29778 - protein, 561 aa, Arabidopsis thaliana; identical to SEQ ID NO: 13989

SEQ ID NO: 29779 - DNA, 1614 bp, Pinus taeda
  CDS (1)..(1614)
atggccaacggaatcaagaaggtcgagcatctgtacagatcgaagcttcccgatatcgagatctccgaccatctgcctcttcattcgtattgctttgagagagtagcggaattcgcagacagaccctgtctgatcgatggggcgacagacagaacttattgcttttcagaggtggaactaatttctcgcaaggtcgctgccggtctggcgaagctcgggttgcagcaggggcaggttgtcatgcttctccttccgaattgcatcgaatttgcgtttgtgttcatgggggcctctgtccggggcgccattgtgaccacggccaatcctttctacaagccgggcgagatcgccaaacaggccaaggccgcaggcgcgcgcatcatagttaccctggcagcttatgttgagaaactggccgatctgcagagccacgatgtgctcgtcatcacaatcgatgatgctcccaaggaaggttgccaacatatttccgttctgaccgaagccgacgaaacccaatgcccggccgtgaaaatccacccggacgatgtcgtggcgttgccctattcttccggaaccacggggctccccaagggcgtgatgttaacgcacaaaggcctggtgtccagcgttgcccagcaggtcgatggtgaaaatcccaatctgtatttccattccgatgacgtgatactctgtgtcttgcctcttttccacatctattctctcaattcggttctcctctgcgcgctcagagccggggctgcgaccctgattatgcagaaattcaacctcacgacctgtctggagctgattcagaaatacaaggttaccgttgccccaattgtgcctccaattgtcctggacatcacaaagagccccatcgtttcccagtacgatgtctcgtccgtccggataatcatgtccggcgctgcgcctctcgggaaggaactcgaagatgccctcagagagcgttttcccaaggccattttcgggcagggctacggcatgacagaagcaggcccggtgctggcaatgaacctagccttcgcaaagaatcctttccccgtcaaatctggctcctgcggaacagtcgtccggaacgctcaaataaagatcctcgatacagaaactggcgaatctctcccgcacaatcaagccggcgaaatctgcatccgcggacccgaaataatgaaaggatatattaacgacccggaatccacggccgctacaatcgatgaagaaggctggctccacacaggcgacgtcgaatacattgacgatgacgaagaaatcttcatagtcgacagagtaaaggagattatcaaatataagggcttccaggtggctcctgctgagctggaagctttacttgtggctcatccgtcaatcgctgacgcagcagtcgttcctcaaaagcacgaggaggcgggcgaggttccggtggccttcgtggtgaagtcgtcggaaatcagcgagcaggaaatcaaggagttcgtggcaaagcaggtgattttctacaagaaaatacacagagtttactttgtggatgcgattcctaagtcgccgtccggcaagattctgagaaaggatttgagaagcagactggcagcaaaatga

SEQ ID NO: 29780 - protein, 537 aa, Pinus taeda
MANGIKKVEHLYRSKLPDIEISDHLPLHSYCFERVAEFADRPCLIDGATDRTYCFSEVELISRKVAAGLAKLGLQQGQVVMLLLPNCIEFAFVFMGASVRGAIVTTANPFYKPGEIAKQAKAAGARIIVTLAAYVEKLADLQSHDVLVITIDDAPKEGCQHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQGYGMTEAGPVLAMNLAFAKNPFPVKSGSCGTVVRNAQIKILDTETGESLPHNQAGEICIRGPEIMKGYINDPESTAATIDEEGWLHTGDVEYIDDDEEIFIVDRVKEIIKYKGFQVAPAELEALLVAHPSIADAAVVPQKHEEAGEVPVAFVVKSSEISEQEIKEFVAKQVIFYKKIHRVYFVDAIPKSPSGKILRKDLRSRLAAK

SEQ ID NO: 29781 - DNA, 1662 bp, Vanilla planifolia; identical to SEQ ID NO: 14336
  CDS (1)..(1662)

SEQ ID NO: 29782 - protein, 553 aa, Vanilla planifolia; identical to SEQ ID NO: 14337

SEQ ID NO: 29783 - DNA, 1620 bp, Bacillus subtilis
  CDS (1)..(1620)
atgctgaaaggatttacgccttggcctgatgagttagctgagacctatcgaaagaacggctgctgggccggtgagacgtttggagatttgttaagggaccgggcagccaaatatggtgatcgcattgccattacatgcggaaacacccattggagctatcgagagcttgacacaagggctgatcgcctggctgccggatttcaaaagctcggcattcaacagatggatcgtgttgtggtgcagttgccaaatatcaaagagttttttgaagtcattttcgcgcttttccgtctgggggcgcttccagtcttcgcactgccttctcatcgaagcagtgaaattacatatttttgcgagtttgctgaagcggctgcatatatcattcccgacgcttattccggttttgactaccgttcgcttgccagacaggttcaaagcaagctgccgactttgaaaaacatcattgtcgcaggtgaggcagaggaatttttaccgctggaggatttgcatgcagaacctgtaaaactgcctgaagtcaaatcatcggatgtggcgttcctccagctttctggcgggagcaccgggctatcgaaactgattccgaggacccacgatgactacatatacagcctgaagcggagtgtggaggtctgctggctcgaccacagcacggtgtacttggccgcgctgccgatggcacacaattatccgctgagctcacccggcgttctcggcgtattatacgctggaggaagagtggtattatctccttctccaagtccagatgacgcatttcctttaattgaacgggaaaaggtcacgataaccgctcttgttccgcctcttgcgatggtatggatggatgcggcatcctcacgccgtgatgatttatccagccttcaagtgctgcaggtcggcggtgccaagtttagtgctgaagccgcgcgcagggtaaaagctgttttcggctgcacgctgcagcaggtgttcggaatggcagagggtctcgtcaattatacgagattggatgatcctgaggagatcattgtcaacacccaaggaaaaccgatgtctccatatgatgaaatgcgtgtttgggatgatcatgatcgcgacgtaaaacctggtgaaacaggccatctgctgacgcgggggccgtatacaattcgaggttactataaggcagaagagcataacgccgcttcatttactgaggacggtttttaccgtacgggtgatatcgtcaggctgacacgagacggctatattgtcgttgaaggccgggcgaaggatcaaattaaccgtggaggagaaaaggttgcggctgaagaggtagaaaatcatctgctggcgcatccggctgtccatgatgcggcaatggtctccatgcctgatcaatttcttggcgaaagatcttgtgtgttcattattccccgggatgaagccccaaaagccgcagagcttaaagcatttttgagagagcgcggactggcggcatataaaatccctgatcgagttgaatttgtcgaatccttcccgcagacaggagtaggaaaagtcagcaaaaaagcgctccgtgaagccatttccgagaagcttcttgcaggatttaaaaaataa

SEQ ID NO: 29784 - protein, 539 aa, Bacillus subtilis
MLKGFTPWPDELAETYRKNGCWAGETFGDLLRDRAAKYGDRIAITCGNTHWSYRELDTRADRLAAGFQKLGIQQMDRVVVQLPNIKEFFEVIFALFRLGALPVFALPSHRSSEITYFCEFAEAAAYIIPDAYSGFDYRSLARQVQSKLPTLKNIIVAGEAEEFLPLEDLHAEPVKLPEVKSSDVAFLQLSGGSTGLSKLIPRTHDDYIYSLKRSVEVCWLDHSTVYLAALPMAHNYPLSSPGVLGVLYAGGRVVLSPSPSPDDAFPLIEREKVTITALVPPLAMVWMDAASSRRDDLSSLQVLQVGGAKFSAEAARRVKAVFGCTLQQVFGMAEGLVNYTRLDDPEEIIVNTQGKPMSPYDEMRVWDDHDRDVKPGETGHLLTRGPYTIRGYYKAEEHNAASFTEDGFYRTGDIVRLTRDGYIVVEGRAKDQINRGGEKVAAEEVENHLLAHPAVHDAAMVSMPDQFLGERSCVFIIPRDEAPKAAELKAFLRERGLAAYKIPDRVEFVESFPQTGVGKVSKKALREAISEKLLAGFKK

SEQ ID NO: 29785 - DNA, 19 bp, Primer
atgcatcccacaggcccgc

SEQ ID NO: 29786 - DNA, 25 bp, Primer
ttattcaatctcttcacagacatcc

SEQ ID NO: 29787 - protein, 569 aa, consensus
  MISC_FEATURE (1)..(569): consensus for the disclosure of xaa see table XV
AXXLXXXXXGXXXGXXXXXXXXNXXXXXXXXXXXXXXGXXXXXXNXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGTTGXPKGXXXXHXXXXXXXXXXXXXXXXXXXXXXXXXXXXXXXXXXXXXXPXXHXXXXXXXXXXXXXXXXXXXXXXXXXXXXXXXXXXXXXXXXXXXXXVPXXXXXXXXXXXXXXXXXXXXXXXXXXXXXXXXXXXXXXXXXXXXXXXXXXXXXXXXYGXXEXXXXXXXXXXXXXXXXXXXXXXXXXXXXXXGXXXXXXXXXXXXXXXXXXXXXXXXXXXXXXGEXXXRGXXXXXXXXXXXXXXXXXXGYXXXXXXXXXXXXXXXXXGWXXTGDXXXXDXXXXXXXXXRXKXXIXXXGXXXXXXEXEXXLXXHPXXXXXXXXXXXXXXXXXXXXDXXXGEXXXAXXXXXXXXXXXXXXXXXXXXXXXXXXXXXXXXXXKXXXXXXXXXXXPXXXXGKXXXXXL

SEQ ID NO: 29788 - protein, 22 aa, consensus
  MISC_FEATURE (1)..(22): consensus for the disclosure of xaa see table XV
XXXXXXXXXGXXXXXKXXXXXX

SEQ ID NO: 29789 - protein, 40 aa, consensus
  MISC_FEATURE (1)..(40): consensus for the disclosure of xaa see table XV
XXXXXGDXXXXXXXXXXXXXXRXXXXXXXXXXXXXXXXXX

SEQ ID NO: 29790 - protein, 64 aa, consensus
  MISC_FEATURE (1)..(64): consensus for the disclosure of xaa see table XV
XXXXXXXXXXXXXXXXXXXXXXXXXXXXXXXXXXXXXXXXXXXXXXXXXXXPXXXXXKXXXXXX

SEQ ID NO: 29791 - protein, 29 aa, consensus
  MISC_FEATURE (1)..(29): consensus for the disclosure of xaa see table XV
XXXXXXXXSGTXXXXKXVXXXXXXXXXXX

SEQ ID NO: 29792 - protein, 12 aa, consensus
  MISC_FEATURE (1)..(12): consensus for the disclosure of xaa see table XV
XXXXPXXHXXXX

SEQ ID NO: 29793 - protein, 37 aa, consensus
  MISC_FEATURE (1)..(37): consensus for the disclosure of xaa see table XV
XXXXXXXXXXXXXXXXXXXXXXXXXXXXXXXYXXTEX

SEQ ID NO: 29794 - protein, 34 aa, consensus
  MISC_FEATURE (1)..(34): consensus for the disclosure of xaa see table XV
XWXXXGXXXXXXXXXXXXXXXRXKXXIXXXXXXX

SEQ ID NO: 29795 - protein, 20 aa, consensus
  MISC_FEATURE (1)..(20): consensus for the disclosure of xaa see table XV
XXXXXXXLXXXXXXXXXXXX

SEQ ID NO: 29796 - protein, 14 aa, consensus
  MISC_FEATURE (1)..(14): consensus for the disclosure of xaa see table XV
XPKXXXGKXXXXXX

SEQ ID NO: 29797 - DNA, 465 bp, Escherichia coli; identical to SEQ ID NO: 1311
  CDS (1)..(465)

SEQ ID NO: 29798 - protein, 154 aa, Escherichia coli; identical to SEQ ID NO: 1312

SEQ ID NO: 29799 - DNA, 573 bp, Salmonella enterica subsp. enterica serovar Typhi; identical to SEQ ID NO: 1313
  CDS (1)..(573)

SEQ ID NO: 29800 - protein, 190 aa, Salmonella enterica subsp. enterica serovar Typhi; identical to SEQ ID NO: 1314

SEQ ID NO: 29801 - DNA, 465 bp, Yersinia pestis; identical to SEQ ID NO: 1315
  CDS (1)..(465)

SEQ ID NO: 29802 - protein, 154 aa, Yersinia pestis; identical to SEQ ID NO: 1316

SEQ ID NO: 29803 - DNA, 465 bp, Salmonella enterica subsp. enterica serovar Typhi; identical to SEQ ID NO: 1317
  CDS (1)..(465)

SEQ ID NO: 29804 - protein, 154 aa, Salmonella enterica subsp. enterica serovar Typhi; identical to SEQ ID NO: 1318

SEQ ID NO: 29805 - DNA, 585 bp, Yersinia pestis; identical to SEQ ID NO: 1319
  CDS (1)..(585)

SEQ ID NO: 29806 - protein, 194 aa, Yersinia pestis; identical to SEQ ID NO: 1320

SEQ ID NO: 29807 - DNA, 618 bp, Pseudomonas aeruginosa; identical to SEQ ID NO: 1321
  CDS (1)..(618)

SEQ ID NO: 29808 - protein, 205 aa, Pseudomonas aeruginosa; identical to SEQ ID NO: 1322

SEQ ID NO: 29809 - DNA, 459 bp, Campylobacter jejuni; identical to SEQ ID NO: 1323
  CDS (1)..(459)

SEQ ID NO: 29810 - protein, 152 aa, Campylobacter jejuni; identical to SEQ ID NO: 1324

SEQ ID NO: 29811 - DNA, 639 bp, Xylella fastidiosa; identical to SEQ ID NO: 1325
  CDS (1)..(639)

SEQ ID NO: 29812 - protein, 212 aa, Xylella fastidiosa; identical to SEQ ID NO: 1326

SEQ ID NO: 29813 - DNA, 534 bp, Pseudomonas aeruginosa; identical to SEQ ID NO: 1327
  CDS (1)..(534)

SEQ ID NO: 29814 - protein, 177 aa, Pseudomonas aeruginosa; identical to SEQ ID NO: 1328

SEQ ID NO: 29815 - DNA, 501 bp, Vibrio cholerae; identical to SEQ ID NO: 1329
  CDS (1)..(501)

SEQ ID NO: 29816 - protein, 166 aa, Vibrio cholerae; identical to SEQ ID NO: 1330

SEQ ID NO: 29817 - DNA, 597 bp, Pseudomonas aeruginosa; identical to SEQ ID NO: 1331
  CDS (1)..(597)

SEQ ID NO: 29818 - protein, 198 aa, Pseudomonas aeruginosa; identical to SEQ ID NO: 1332

SEQ ID NO: 29819 - DNA, 567 bp, Escherichia coli; identical to SEQ ID NO: 1333
  CDS (1)..(567)

SEQ ID NO: 29820 - protein, 188 aa, Escherichia coli; identical to SEQ ID NO: 1334

SEQ ID NO: 29821 - DNA, 486 bp, Haemophilus influenzae; identical to SEQ ID NO: 1335
  CDS (1)..(486)

SEQ ID NO: 29822 - protein, 161 aa, Haemophilus influenzae; identical to SEQ ID NO: 1336

SEQ ID NO: 29823 - DNA, 552 bp, Haemophilus influenzae; identical to SEQ ID NO: 1337
  CDS (1)..(552)

SEQ ID NO: 29824 - protein, 183 aa, Haemophilus influenzae; identical to SEQ ID NO: 1338

SEQ ID NO: 29825 - DNA, 486 bp, Haemophilus influenzae; identical to SEQ ID NO: 1339
  CDS (1)..(486)

SEQ ID NO: 29826 - protein, 161 aa, Haemophilus influenzae; identical to SEQ ID NO: 1340

SEQ ID NO: 29827 - DNA, 486 bp, Haemophilus influenzae; identical to SEQ ID NO: 1341
  CDS (1)..(486)

SEQ ID NO: 29828 - protein, 161 aa, Haemophilus influenzae; identical to SEQ ID NO: 1342

SEQ ID NO: 29829 - DNA, 591 bp, Pseudomonas aeruginosa; identical to SEQ ID NO: 1343
  CDS (1)..(591): k means g or t/u

SEQ ID NO: 29830 - protein, 196 aa, Pseudomonas aeruginosa; identical to SEQ ID NO: 1344
  misc_feature (69)..(69): Xaa can be Ala or Ser
  misc_feature (112)..(112): Xaa can be Ala or Ser

SEQ ID NO: 29831 - DNA, 468 bp, Vibrio vulnificus (strain YJ016); identical to SEQ ID NO: 1345
  CDS (1)..(468)

SEQ ID NO: 29832 - protein, 155 aa, Vibrio vulnificus (strain YJ016); identical to SEQ ID NO: 1346

SEQ ID NO: 29833 - DNA, 591 bp, Photorhabdus luminescens (subsp. laumondii); identical to SEQ ID NO: 1347
  CDS (1)..(591)

SEQ ID NO: 29834 - protein, 196 aa, Photorhabdus luminescens (subsp. laumondii); identical to SEQ ID NO: 1348

SEQ ID NO: 29835 - DNA, 486 bp, Photorhabdus luminescens (subsp. laumondii); identical to SEQ ID NO: 1349
  CDS (1)..(486)

SEQ ID NO: 29836 - protein, 161 aa, Photorhabdus luminescens (subsp. laumondii); identical to SEQ ID NO: 1350

SEQ ID NO: 29837 - DNA, 516 bp, Haemophilus ducreyi; identical to SEQ ID NO: 1351
  CDS (1)..(516)

SEQ ID NO: 29838 - protein, 171 aa, Haemophilus ducreyi; identical to SEQ ID NO: 1352

SEQ ID NO: 29839 - DNA, 660 bp, Bordetella pertussis; identical to SEQ ID NO: 1353
  CDS (1)..(660)

SEQ ID NO: 29840 - protein, 219 aa, Bordetella pertussis; identical to SEQ ID NO: 1354

SEQ ID NO: 29841 - DNA, 669 bp, Bordetella parapertussis; identical to SEQ ID NO: 1355
  CDS (1)..(669)

SEQ ID NO: 29842 - protein, 222 aa, Bordetella parapertussis; identical to SEQ ID NO: 1356

SEQ ID NO: 29843 - DNA, 669 bp, Bordetella bronchiseptica (Alcaligenes bronchisepticus); identical to SEQ ID NO: 1357
  CDS (1)..(669)

SEQ ID NO: 29844 - protein, 222 aa, Bordetella bronchiseptica (Alcaligenes bronchisepticus); identical to SEQ ID NO: 1358

SEQ ID NO: 29845 - DNA, 525 bp, Nitrosomonas europaea; identical to SEQ ID NO: 1359
  CDS (1)..(525)

SEQ ID NO: 29846 - protein, 174 aa, Nitrosomonas europaea; identical to SEQ ID NO: 1360

SEQ ID NO: 29847 - DNA, 465 bp, Shigella flexneri; identical to SEQ ID NO: 1361
  CDS (1)..(465)

SEQ ID NO: 29848 - protein, 154 aa, Shigella flexneri; identical to SEQ ID NO: 1362

SEQ ID NO: 29849 - DNA, 639 bp, Xylella fastidiosa (strain Temecula1 / ATCC 700964); identical to SEQ ID NO: 1363
  CDS (1)..(639)

SEQ ID NO: 29850 - protein, 212 aa, Xylella fastidiosa (strain Temecula1 / ATCC 700964); identical to SEQ ID NO: 1364

SEQ ID NO: 29851 - DNA, 480 bp, Vibrio parahaemolyticus; identical to SEQ ID NO: 1365
  CDS (1)..(480)

SEQ ID NO: 29852 - protein, 159 aa, Vibrio parahaemolyticus; identical to SEQ ID NO: 1366

SEQ ID NO: 29853 - DNA, 681 bp, Pseudomonas syringae (pv. tomato); identical to SEQ ID NO: 1367
  CDS (1)..(681)

SEQ ID NO: 29854 - protein, 226 aa, Pseudomonas syringae (pv. tomato); identical to SEQ ID NO: 1368

SEQ ID NO: 29855 - DNA, 546 bp, Pseudomonas syringae (pv. tomato); identical to SEQ ID NO: 1369
  CDS (1)..(546)

SEQ ID NO: 29856 - protein, 181 aa, Pseudomonas syringae (pv. tomato); identical to SEQ ID NO: 1370

SEQ ID NO: 29857 - DNA, 624 bp, Pseudomonas putida (strain KT2440); identical to SEQ ID NO: 1371
  CDS (1)..(624)

SEQ ID NO: 29858 - protein, 207 aa, Pseudomonas putida (strain KT2440); identical to SEQ ID NO: 1372

SEQ ID NO: 29859 - DNA, 534 bp, Pseudomonas putida (strain KT2440); identical to SEQ ID NO: 1373
  CDS (1)..(534)

SEQ ID NO: 29860 - protein, 177 aa, Pseudomonas putida (strain KT2440); identical to SEQ ID NO: 1374

SEQ ID NO: 29861 - DNA, 645 bp, Pseudomonas putida (strain KT2440); identical to SEQ ID NO: 1375
  CDS (1)..(645)

SEQ ID NO: 29862 - protein, 214 aa, Pseudomonas putida (strain KT2440); identical to SEQ ID NO: 1376

SEQ ID NO: 29863 - DNA, 609 bp, Clostridium tetani; identical to SEQ ID NO: 1377
  CDS (1)..(609)

SEQ ID NO: 29864 - protein, 202 aa, Clostridium tetani; identical to SEQ ID NO: 1378

SEQ ID NO: 29865 - DNA, 513 bp, Bacteroides thetaiotaomicron; identical to SEQ ID NO: 1379
  CDS (1)..(513)

SEQ ID NO: 29866 - protein, 170 aa, Bacteroides thetaiotaomicron; identical to SEQ ID NO: 1380

SEQ ID NO: 29867 - DNA, 465 bp, Escherichia coli O6; identical to SEQ ID NO: 1381
  CDS (1)..(465)

SEQ ID NO: 29868 - protein, 154 aa, Escherichia coli O6; identical to SEQ ID NO: 1382

SEQ ID NO: 29869 - DNA, 429 bp, Vibrio vulnificus; identical to SEQ ID NO: 1383
  CDS (1)..(429)

SEQ ID NO: 29870 - protein, 142 aa, Vibrio vulnificus; identical to SEQ ID NO: 1384

SEQ ID NO: 29871 - DNA, 465 bp, Shewanella oneidensis; identical to SEQ ID NO: 1385
  CDS (1)..(465)

SEQ ID NO: 29872 - protein, 154 aa, Shewanella oneidensis; identical to SEQ ID NO: 1386

SEQ ID NO: 29873 - DNA, 618 bp, Chlorobium tepidum; identical to SEQ ID NO: 1387
  CDS (1)..(618)

SEQ ID NO: 29874 - protein, 205 aa, Chlorobium tepidum; identical to SEQ ID NO: 1388

SEQ ID NO: 29875 - DNA, 648 bp, Chlorobium tepidum; identical to SEQ ID NO: 1389
  CDS (1)..(648)

SEQ ID NO: 29876 - protein, 215 aa, Chlorobium tepidum; identical to SEQ ID NO: 1390

SEQ ID NO: 29877 - DNA, 576 bp, Xanthomonas campestris (pv. campestris); identical to SEQ ID NO: 1391
  CDS (1)..(576)

SEQ ID NO: 29878 - protein, 191 aa, Xanthomonas campestris (pv. campestris); identical to SEQ ID NO: 1392

SEQ ID NO: 29879 - DNA, 654 bp, Xanthomonas axonopodis (pv. citri); identical to SEQ ID NO: 1393
  CDS (1)..(654)

SEQ ID NO: 29880 - protein, 217 aa, Xanthomonas axonopodis (pv. citri); identical to SEQ ID NO: 1394

SEQ ID NO: 29881 - DNA, 465 bp, Salmonella typhimurium; identical to SEQ ID NO: 1395
  CDS (1)..(465)

SEQ ID NO: 29882 - protein, 154 aa, Salmonella typhimurium; identical to SEQ ID NO: 1396

SEQ ID NO: 29883 - DNA, 480 bp, Pasteurella multocida; identical to SEQ ID NO: 1397
  CDS (1)..(480)

SEQ ID NO: 29884 - protein, 159 aa, Pasteurella multocida; identical to SEQ ID NO: 1398

SEQ ID NO: 29885 - DNA, 480 bp, Treponema denticola ATCC 35405; identical to SEQ ID NO: 1399
  CDS (1)..(480)

SEQ ID NO: 29886 - protein, 159 aa, Treponema denticola ATCC 35405; identical to SEQ ID NO: 1400

SEQ ID NO: 29887 - DNA, 25 bp, Primer
atgcgtttctgccttattttgatca

SEQ ID NO: 29888 - DNA, 23 bp, Primer
ttagattcgtctcgcctgccaga

SEQ ID NO: 29889 - protein, 200 aa, consensus; identical to SEQ ID NO: 22546
  MISC_FEATURE (1)..(200): consensus for the disclosure of xaa see table XV

SEQ ID NO: 29890 - protein, 113 aa, consensus; identical to SEQ ID NO: 1961
  MISC_FEATURE (1)..(113): consensus for the disclosure of xaa see table XV

SEQ ID NO: 29891 - DNA, 1662 bp, Escherichia coli K12; identical to SEQ ID NO: 20332
  CDS (1)..(1662)

SEQ ID NO: 29892 - protein, 553 aa, Escherichia coli K12; identical to SEQ ID NO: 20333

SEQ ID NO: 29893 - DNA, 2040 bp, Pseudomonas aeruginosa; identical to SEQ ID NO: 20334
  CDS (1)..(2040)

SEQ ID NO: 29894 - protein, 679 aa, Pseudomonas aeruginosa; identical to SEQ ID NO: 20335

SEQ ID NO: 29895 - DNA, 1797 bp, Caulobacter crescentus; identical to SEQ ID NO: 20336
  CDS (1)..(1797)

SEQ ID NO: 29896 - protein, 598 aa, Caulobacter crescentus; identical to SEQ ID NO: 20337

SEQ ID NO: 29897 - DNA, 2148 bp, Agrobacterium tumefaciens; identical to SEQ ID NO: 20338
  CDS (1)..(2148)

SEQ ID NO: 29898 - protein, 715 aa, Agrobacterium tumefaciens; identical to SEQ ID NO: 20339

SEQ ID NO: 29899 - DNA, 1500 bp, Agrobacterium tumefaciens; identical to SEQ ID NO: 20340
  CDS (1)..(1500)

SEQ ID NO: 29900 - protein, 499 aa, Agrobacterium tumefaciens; identical to SEQ ID NO: 20341

SEQ ID NO: 29901 - DNA, 2010 bp, Agrobacterium tumefaciens; identical to SEQ ID NO: 20342
  CDS (1)..(2010)

SEQ ID NO: 29902 - protein, 669 aa, Agrobacterium tumefaciens; identical to SEQ ID NO: 20343

SEQ ID NO: 29903 - DNA, 1941 bp, Agrobacterium tumefaciens; identical to SEQ ID NO: 20344
  CDS (1)..(1941)

SEQ ID NO: 29904 - protein, 646 aa, Agrobacterium tumefaciens; identical to SEQ ID NO: 20345

SEQ ID NO: 29905 - DNA, 1956 bp, Agrobacterium tumefaciens; identical to SEQ ID NO: 20346
  CDS (1)..(1956)

SEQ ID NO: 29906 - protein, 651 aa, Agrobacterium tumefaciens; identical to SEQ ID NO: 20347

SEQ ID NO: 29907 - DNA, 1674 bp, Yersinia pestis; identical to SEQ ID NO: 20348
  CDS (1)..(1674)

SEQ ID NO: 29908 - protein, 557 aa, Yersinia pestis; identical to SEQ ID NO: 20349

SEQ ID NO: 29909 - DNA, 1569 bp, Salmonella enterica subsp. enterica serovar Typhi; identical to SEQ ID NO: 20350
  CDS (1)..(1569)

SEQ ID NO: 29910 - protein, 522 aa, Salmonella enterica subsp. enterica serovar Typhi; identical to SEQ ID NO: 20351

SEQ ID NO: 29911 - DNA, 1815 bp, Agrobacterium tumefaciens; identical to SEQ ID NO: 20352
  CDS (1)..(1815)

SEQ ID NO: 29912 - protein, 604 aa, Agrobacterium tumefaciens; identical to SEQ ID NO: 20353

SEQ ID NO: 29913 - DNA, 1950 bp, Agrobacterium tumefaciens; identical to SEQ ID NO: 20354
  CDS (1)..(1950)

SEQ ID NO: 29914 - protein, 649 aa, Agrobacterium tumefaciens; identical to SEQ ID NO: 20355

SEQ ID NO: 29915 - DNA, 1950 bp, Yersinia pestis; identical to SEQ ID NO: 20356
  CDS (1)..(1950)

SEQ ID NO: 29916 - protein, 649 aa, Yersinia pestis; identical to SEQ ID NO: 20357

SEQ ID NO: 29917 - DNA, 1644 bp, Salmonella enterica subsp. enterica serovar Typhi; identical to SEQ ID NO: 20358
  CDS (1)..(1644)

SEQ ID NO: 29918 - protein, 547 aa, Salmonella enterica subsp. enterica serovar Typhi; identical to SEQ ID NO: 20359

SEQ ID NO: 29919 - DNA, 1960 bp, Clostridium thermocellum; identical to SEQ ID NO: 20360
  CDS (189)..(1862)

SEQ ID NO: 29920 - protein, 557 aa, Clostridium thermocellum; identical to SEQ ID NO: 20361

SEQ ID NO: 29921 - DNA, 1674 bp, Enterobacter aerogenes; identical to SEQ ID NO: 20362
  CDS (1)..(1674)

SEQ ID NO: 29922 - protein, 557 aa, Enterobacter aerogenes; identical to SEQ ID NO: 20363

SEQ ID NO: 29923 - DNA, 1614 bp, Caulobacter crescentus; identical to SEQ ID NO: 20364
  CDS (1)..(1614)

SEQ ID NO: 29924 - protein, 537 aa, Caulobacter crescentus; identical to SEQ ID NO: 20365

SEQ ID NO: 29925 - DNA, 1770 bp, Caulobacter crescentus; identical to SEQ ID NO: 20366
  CDS (1)..(1770)

SEQ ID NO: 29926 - protein, 589 aa, Caulobacter crescentus; identical to SEQ ID NO: 20367

SEQ ID NO: 29927 - DNA, 1818 bp, Agrobacterium tumefaciens; identical to SEQ ID NO: 20368
  CDS (1)..(1818)

SEQ ID NO: 29928 - protein, 605 aa, Agrobacterium tumefaciens; identical to SEQ ID NO: 20369

SEQ ID NO: 29929 - DNA, 1752 bp, Agrobacterium tumefaciens; identical to SEQ ID NO: 20370
  CDS (1)..(1752)

SEQ ID NO: 29930 - protein, 583 aa, Agrobacterium tumefaciens; identical to SEQ ID NO: 20371

SEQ ID NO: 29931 - DNA, 1539 bp, Enterobacter aerogenes; identical to SEQ ID NO: 20372
  CDS (1)..(1539)

SEQ ID NO: 29932 - protein, 512 aa, Enterobacter aerogenes; identical to SEQ ID NO: 20373

SEQ ID NO: 29933 - DNA, 1668 bp, Caulobacter crescentus; identical to SEQ ID NO: 20374
  CDS (1)..(1668)

SEQ ID NO: 29934 - protein, 555 aa, Caulobacter crescentus; identical to SEQ ID NO: 20375

SEQ ID NO: 29935 - DNA, 750 bp, Caulobacter crescentus; identical to SEQ ID NO: 20376
  CDS (1)..(750)

SEQ ID NO: 29936 - protein, 249 aa, Caulobacter crescentus; identical to SEQ ID NO: 20377

SEQ ID NO: 29937 - DNA, 1794 bp, Caulobacter crescentus; identical to SEQ ID NO: 20378
  CDS (1)..(1794)

SEQ ID NO: 29938 - protein, 597 aa, Caulobacter crescentus; identical to SEQ ID NO: 20379

SEQ ID NO: 29939 - DNA, 1869 bp, Agrobacterium tumefaciens; identical to SEQ ID NO: 20380
  CDS (1)..(1869)

SEQ ID NO: 29940 - protein, 622 aa, Agrobacterium tumefaciens; identical to SEQ ID NO: 20381

SEQ ID NO: 29941 - DNA, 2307 bp, Agrobacterium tumefaciens; identical to SEQ ID NO: 20382
  CDS (1)..(2307)

SEQ ID NO: 29942 - protein, 768 aa, Agrobacterium tumefaciens; identical to SEQ ID NO: 20383

SEQ ID NO: 29943 - DNA, 1506 bp, Caulobacter crescentus; identical to SEQ ID NO: 20384
  CDS (1)..(1506)

SEQ ID NO: 29944 - protein, 501 aa, Caulobacter crescentus; identical to SEQ ID NO: 20385

SEQ ID NO: 29945 - DNA, 2352 bp, Agrobacterium tumefaciens; identical to SEQ ID NO: 20386
  CDS (1)..(2352)

SEQ ID NO: 29946 - protein, 783 aa, Agrobacterium tumefaciens; identical to SEQ ID NO: 20387

SEQ ID NO: 29947 - DNA, 2154 bp, Agrobacterium tumefaciens; identical to SEQ ID NO: 20388
  CDS (1)..(2154)

SEQ ID NO: 29948 - protein, 717 aa, Agrobacterium tumefaciens; identical to SEQ ID NO: 20389

SEQ ID NO: 29949 - DNA, 2004 bp, Caulobacter crescentus; identical to SEQ ID NO: 20390
  CDS (1)..(2004)

SEQ ID NO: 29950 - protein, 667 aa, Caulobacter crescentus; identical to SEQ ID NO: 20391

SEQ ID NO: 29951 - DNA, 1668 bp, Clostridium acetobutylicum; identical to SEQ ID NO: 20392
  CDS (1)..(1668)

SEQ ID NO: 29952 - protein, 555 aa, Clostridium acetobutylicum; identical to SEQ ID NO: 20393

SEQ ID NO: 29953 - DNA, 2358 bp, Agrobacterium tumefaciens; identical to SEQ ID NO: 20394
  CDS (1)..(2358)

SEQ ID NO: 29954 - protein, 785 aa, Agrobacterium tumefaciens; identical to SEQ ID NO: 20395

SEQ ID NO: 29955 - DNA, 2367 bp, Agrobacterium tumefaciens; identical to SEQ ID NO: 20396
  CDS (1)..(2367)

SEQ ID NO: 29956 - protein, 788 aa, Agrobacterium tumefaciens; identical to SEQ ID NO: 20397

SEQ ID NO: 29957 - DNA, 1980 bp, Vibrio cholerae; identical to SEQ ID NO: 20398
  CDS (1)..(1980)

SEQ ID NO: 29958 - protein, 659 aa, Vibrio cholerae; identical to SEQ ID NO: 20399

SEQ ID NO: 29959 - DNA, 1869 bp, Caulobacter crescentus; identical to SEQ ID NO: 20400
  CDS (1)..(1869)

SEQ ID NO: 29960 - protein, 622 aa, Caulobacter crescentus; identical to SEQ ID NO: 20401

SEQ ID NO: 29961 - DNA, 1827 bp, Caulobacter crescentus; identical to SEQ ID NO: 20402
  CDS (1)..(1827)

SEQ ID NO: 29962 - protein, 608 aa, Caulobacter crescentus; identical to SEQ ID NO: 20403

SEQ ID NO: 29963 - DNA, 2037 bp, Vibrio cholerae; identical to SEQ ID NO: 20404
  CDS (1)..(2037)

SEQ ID NO: 29964 - protein, 678 aa, Vibrio cholerae; identical to SEQ ID NO: 20405

SEQ ID NO: 29965 - DNA, 1608 bp, Pseudomonas aeruginosa; identical to SEQ ID NO: 20406
  CDS (1)..(1608)

SEQ ID NO: 29966 - protein, 535 aa, Pseudomonas aeruginosa; identical to SEQ ID NO: 20407

SEQ ID NO: 29967 - DNA, 1515 bp, Caulobacter crescentus; identical to SEQ ID NO: 20408
  CDS (1)..(1515)

SEQ ID NO: 29968 - protein, 504 aa, Caulobacter crescentus; identical to SEQ ID NO: 20409

SEQ ID NO: 29969 - DNA, 2295 bp, Rhodobacter capsulatus; identical to SEQ ID NO: 20410
  CDS (1)..(2295)

SEQ ID NO: 29970 - protein, 764 aa, Rhodobacter capsulatus; identical to SEQ ID NO: 20411

SEQ ID NO: 29971 - DNA, 1602 bp, Escherichia coli; identical to SEQ ID NO: 20412
  CDS (1)..(1602)

SEQ ID NO: 29972 - protein, 533 aa, Escherichia coli; identical to SEQ ID NO: 20413

SEQ ID NO: 29973 - DNA, 1656 bp, Escherichia coli; identical to SEQ ID NO: 20414
  CDS (1)..(1656)

SEQ ID NO: 29974 - protein, 551 aa, Escherichia coli; identical to SEQ ID NO: 20415

SEQ ID NO: 29975 - DNA, 2076 bp, Rhodobacter sphaeroides; identical to SEQ ID NO: 20416
  CDS (1)..(2076)

SEQ ID NO: 29976 - protein, 691 aa, Rhodobacter sphaeroides; identical to SEQ ID NO: 20417

SEQ ID NO: 29977 - DNA, 1917 bp, Rhodobacter capsulatus; identical to SEQ ID NO: 20418
  CDS (1)..(1917)

SEQ ID NO: 29978 - protein, 638 aa, Rhodobacter capsulatus; identical to SEQ ID NO: 20419

SEQ ID NO: 29979 - DNA, 3696 bp, Rhizobium leguminosarum; identical to SEQ ID NO: 20420
  CDS (482)..(2401)

SEQ ID NO: 29980 - protein, 639 aa, Rhizobium leguminosarum; identical to SEQ ID NO: 20421

SEQ ID NO: 29981 - DNA, 2399 bp, Rhizobium leguminosarum; identical to SEQ ID NO: 20422
  CDS (174)..(2321)

SEQ ID NO: 29982 - protein, 715 aa, Rhizobium leguminosarum; identical to SEQ ID NO: 20423

SEQ ID NO: 29983 - DNA, 2149 bp, Rhizobium leguminosarum; identical to SEQ ID NO: 20424
  CDS (202)..(2079)

SEQ ID NO: 29984 - protein, 625 aa, Rhizobium leguminosarum; identical to SEQ ID NO: 20425

SEQ ID NO: 29985 - DNA, 2362 bp, Rhizobium leguminosarum; identical to SEQ ID NO: 20426
  CDS (326)..(2200)

SEQ ID NO: 29986 - protein, 624 aa, Rhizobium leguminosarum; identical to SEQ ID NO: 20427

SEQ ID NO: 29987 - DNA, 2220 bp, Agrobacterium tumefaciens; identical to SEQ ID NO: 20428
  CDS (1)..(2220)

SEQ ID NO: 29988 - protein, 739 aa, Agrobacterium tumefaciens; identical to SEQ ID NO: 20429

SEQ ID NO: 29989 - DNA, 2379 bp, Rhodobacter sphaeroides; identical to SEQ ID NO: 20430
  CDS (1)..(2379)

SEQ ID NO: 29990 - protein, 792 aa, Rhodobacter sphaeroides; identical to SEQ ID NO: 20431

SEQ ID NO: 29991 - DNA, 1647 bp, Erwinia carotovora subsp; identical to SEQ ID NO: 20432
  CDS (1)..(1647)

SEQ ID NO: 29992 - protein, 548 aa, Erwinia carotovora subsp; identical to SEQ ID NO: 20433

SEQ ID NO: 29993 - DNA, 1671 bp, Erwinia carotovora subsp; identical to SEQ ID NO: 20434
  CDS (1)..(1671)

SEQ ID NO: 29994 - protein, 556 aa, Erwinia carotovora subsp; identical to SEQ ID NO: 20435

SEQ ID NO: 29995 - DNA, 1680 bp, Erwinia carotovora subsp; identical to SEQ ID NO: 20436
  CDS (1)..(1680)

SEQ ID NO: 29996 - protein, 559 aa, Erwinia carotovora subsp; identical to SEQ ID NO: 20437

SEQ ID NO: 29997 - DNA, 1572 bp, Erwinia carotovora subsp; identical to SEQ ID NO: 20438
  CDS (1)..(1572)

SEQ ID NO: 29998 - protein, 523 aa, Erwinia carotovora subsp; identical to SEQ ID NO: 20439

SEQ ID NO: 29999 - DNA, 1941 bp, Erwinia carotovora subsp; identical to SEQ ID NO: 20440
  CDS (1)..(1941)

SEQ ID NO: 30000 - protein, 646 aa, Erwinia carotovora subsp; identical to SEQ ID NO: 20441

SEQ ID NO: 30001 - DNA, 1536 bp, Erwinia carotovora subsp; identical to SEQ ID NO: 20442
  CDS (1)..(1536)

SEQ ID NO: 30002 - protein, 511 aa, Erwinia carotovora subsp; identical to SEQ ID NO: 20443

SEQ ID NO: 30003 - DNA, 1941 bp, Erwinia carotovora subsp; identical to SEQ ID NO: 20444
  CDS (1)..(1941)

SEQ ID NO: 30004 - protein, 646 aa, Erwinia carotovora subsp; identical to SEQ ID NO: 20445

SEQ ID NO: 30005 - DNA, 1935 bp, Erwinia carotovora subsp; identical to SEQ ID NO: 20446
  CDS (1)..(1935)

SEQ ID NO: 30006 - protein, 644 aa, Erwinia carotovora subsp; identical to SEQ ID NO: 20447

SEQ ID NO: 30007 - DNA, 1797 bp, Erwinia carotovora subsp; identical to SEQ ID NO: 20448
  CDS (1)..(1797)

SEQ ID NO: 30008 - protein, 598 aa, Erwinia carotovora subsp; identical to SEQ ID NO: 20449

SEQ ID NO: 30009 - DNA, 1836 bp, Erwinia carotovora subsp; identical to SEQ ID NO: 20450
  CDS (1)..(1836)

SEQ ID NO: 30010 - protein, 611 aa, Erwinia carotovora subsp; identical to SEQ ID NO: 20451

SEQ ID NO: 30011 - DNA, 1680 bp, Erwinia carotovora subsp; identical to SEQ ID NO: 20452
  CDS (1)..(1680)

SEQ ID NO: 30012 - protein, 559 aa, Erwinia carotovora subsp; identical to SEQ ID NO: 20453

SEQ ID NO: 30013 - DNA, 1791 bp, Erwinia carotovora subsp; identical to SEQ ID NO: 20454
  CDS (1)..(1791)

SEQ ID NO: 30014 - protein, 596 aa, Erwinia carotovora subsp; identical to SEQ ID NO: 20455

SEQ ID NO: 30015 - DNA, 1620 bp, Erwinia carotovora subsp; identical to SEQ ID NO: 20456
  CDS (1)..(1620)

SEQ ID NO: 30016 - protein, 539 aa, Erwinia carotovora subsp; identical to SEQ ID NO: 20457

SEQ ID NO: 30017 - DNA, 1662 bp, Erwinia carotovora subsp; identical to SEQ ID NO: 20458
  CDS (1)..(1662)

SEQ ID NO: 30018 - protein, 553 aa, Erwinia carotovora subsp; identical to SEQ ID NO: 20459

SEQ ID NO: 30019 - DNA, 1953 bp, Erwinia carotovora subsp; identical to SEQ ID NO: 20460
  CDS (1)..(1953)

SEQ ID NO: 30020 - protein, 650 aa, Erwinia carotovora subsp; identical to SEQ ID NO: 20461

SEQ ID NO: 30021 - DNA, 2796 bp, Photobacterium profundum; identical to SEQ ID NO: 20462
  CDS (1)..(2796)

SEQ ID NO: 30022 - protein, 931 aa, Photobacterium profundum; identical to SEQ ID NO: 20463

SEQ ID NO: 30023 - DNA, 1464 bp, Bdellovibrio bacteriovorus; identical to SEQ ID NO: 20464
  CDS (1)..(1464)

SEQ ID NO: 30024 - protein, 487 aa, Bdellovibrio bacteriovorus; identical to SEQ ID NO: 20465

SEQ ID NO: 30025 - DNA, 1539 bp, Bdellovibrio bacteriovorus; identical to SEQ ID NO: 20466
  CDS (1)..(1539)

SEQ ID NO: 30026 - protein, 512 aa, Bdellovibrio bacteriovorus; identical to SEQ ID NO: 20467

SEQ ID NO: 30027 - DNA, 1647 bp, Bdellovibrio bacteriovorus; identical to SEQ ID NO: 20468
  CDS (1)..(1647)

SEQ ID NO: 30028 - protein, 548 aa, Bdellovibrio bacteriovorus; identical to SEQ ID NO: 20469

SEQ ID NO: 30029 - DNA, 1449 bp, Bdellovibrio bacteriovorus; identical to SEQ ID NO: 20470
  CDS (1)..(1449)

SEQ ID NO: 30030 - protein, 482 aa, Bdellovibrio bacteriovorus; identical to SEQ ID NO: 20471

SEQ ID NO: 30031 - DNA, 1815 bp, Bdellovibrio bacteriovorus; identical to SEQ ID NO: 20472
  CDS (1)..(1815)

SEQ ID NO: 30032 - protein, 604 aa, Bdellovibrio bacteriovorus; identical to SEQ ID NO: 20473

SEQ ID NO: 30033 - DNA, 1599 bp, Bdellovibrio bacteriovorus; identical to SEQ ID NO: 20474
  CDS (1)..(1599)

SEQ ID NO: 30034 - protein, 532 aa, Bdellovibrio bacteriovorus; identical to SEQ ID NO: 20475

SEQ ID NO: 30035 - DNA, 1680 bp, Bdellovibrio bacteriovorus; identical to SEQ ID NO: 20476
  CDS (1)..(1680)

SEQ ID NO: 30036 - protein, 559 aa, Bdellovibrio bacteriovorus; identical to SEQ ID NO: 20477

SEQ ID NO: 30037 - DNA, 1905 bp, Bdellovibrio bacteriovorus; identical to SEQ ID NO: 20478
  CDS (1)..(1905)

SEQ ID NO: 30038 - protein, 634 aa, Bdellovibrio bacteriovorus; identical to SEQ ID NO: 20479

SEQ ID NO: 30039 - DNA, 1536 bp, Bdellovibrio bacteriovorus; identical to SEQ ID NO: 20480
  CDS (1)..(1536)

SEQ ID NO: 30040 - protein, 511 aa, Bdellovibrio bacteriovorus; identical to SEQ ID NO: 20481

SEQ ID NO: 30041 - DNA, 1650 bp, Bdellovibrio bacteriovorus; identical to SEQ ID NO: 20482
  CDS (1)..(1650)

SEQ ID NO: 30042 - protein, 549 aa, Bdellovibrio bacteriovorus; identical to SEQ ID NO: 20483

SEQ ID NO: 30043 - DNA, 1950 bp, Rhizobium sp; identical to SEQ ID NO: 20484
  CDS (1)..(1950)

SEQ ID NO: 30044 - protein, 649 aa, Rhizobium sp; identical to SEQ ID NO: 20485

SEQ ID NO: 30045 - DNA, 1959 bp, Desulfovibrio vulgaris; identical to SEQ ID NO: 20486
  CDS (1)..(1959)

SEQ ID NO: 30046 - protein, 652 aa, Desulfovibrio vulgaris; identical to SEQ ID NO: 20487

SEQ ID NO: 30047 - DNA, 1701 bp, Geobacter sulfurreducens; identical to SEQ ID NO: 20488
  CDS (1)..(1701)

SEQ ID NO: 30048 - protein, 566 aa, Geobacter sulfurreducens; identical to SEQ ID NO: 20489

SEQ ID NO: 30049 - DNA, 1485 bp, Geobacter sulfurreducens; identical to SEQ ID NO: 20490
  CDS (1)..(1485)

SEQ ID NO: 30050 - protein, 494 aa, Geobacter sulfurreducens; identical to SEQ ID NO: 20491

SEQ ID NO: 30051 - DNA, 1692 bp, Geobacter sulfurreducens; identical to SEQ ID NO: 20492
  CDS (1)..(1692)

SEQ ID NO: 30052 - protein, 563 aa, Geobacter sulfurreducens; identical to SEQ ID NO: 20493

SEQ ID NO: 30053 - DNA, 1707 bp, Geobacter sulfurreducens; identical to SEQ ID NO: 20494
  CDS (1)..(1707)

SEQ ID NO: 30054 - protein, 568 aa, Geobacter sulfurreducens; identical to SEQ ID NO: 20495

SEQ ID NO: 30055 - DNA, 2889 bp, Geobacter sulfurreducens; identical to SEQ ID NO: 20496
  CDS (1)..(2889)

SEQ ID NO: 30056 - protein, 962 aa, Geobacter sulfurreducens; identical to SEQ ID NO: 20497

SEQ ID NO: 30057 - DNA, 1590 bp, Geobacter sulfurreducens; identical to SEQ ID NO: 20498
  CDS (1)..(1590)

SEQ ID NO: 30058 - protein, 529 aa, Geobacter sulfurreducens; identical to SEQ ID NO: 20499

SEQ ID NO: 30059 - DNA, 2184 bp, Geobacter sulfurreducens; identical to SEQ ID NO: 20500
  CDS (1)..(2184)

SEQ ID NO: 30060 - protein, 727 aa, Geobacter sulfurreducens; identical to SEQ ID NO: 20501

SEQ ID NO: 30061 - DNA, 1701 bp, Yersinia pestis; identical to SEQ ID NO: 20502
  CDS (1)..(1701)

SEQ ID NO: 30062 - protein, 566 aa, Yersinia pestis; identical to SEQ ID NO: 20503

SEQ ID NO: 30063 - DNA, 1641 bp, Shigella flexneri; identical to SEQ ID NO: 20504
  CDS (1)..(1641)

SEQ ID NO: 30064 - protein, 546 aa, Shigella flexneri; identical to SEQ ID NO: 20505

SEQ ID NO: 30065 - DNA, 1995 bp, Wolinella succinogenes; identical to SEQ ID NO: 20506
  CDS (1)..(1995)

SEQ ID NO: 30066 - protein, 664 aa, Wolinella succinogenes; identical to SEQ ID NO: 20507

SEQ ID NO: 30067 - DNA, 1635 bp, Photorhabdus luminescens; identical to SEQ ID NO: 20508
  CDS (1)..(1635)

SEQ ID NO: 30068 - protein, 544 aa, Photorhabdus luminescens; identical to SEQ ID NO: 20509

SEQ ID NO: 30069 - DNA, 1695 bp, Photorhabdus luminescens; identical to SEQ ID NO: 20510
  CDS (1)..(1695)

SEQ ID NO: 30070 - protein, 564 aa, Photorhabdus luminescens; identical to SEQ ID NO: 20511

SEQ ID NO: 30071 - DNA, 2955 bp, Chromobacterium violaceum; identical to SEQ ID NO: 20512
  CDS (1)..(2955)

SEQ ID NO: 30072 - protein, 984 aa, Chromobacterium violaceum; identical to SEQ ID NO: 20513

SEQ ID NO: 30073 - DNA, 1620 bp, Chromobacterium violaceum; identical to SEQ ID NO: 20514
  CDS (1)..(1620)

SEQ ID NO: 30074 - protein, 539 aa, Chromobacterium violaceum; identical to SEQ ID NO: 20515

SEQ ID NO: 30075 - DNA, 1542 bp, Bordetella pertussis; identical to SEQ ID NO: 20516
  CDS (1)..(1542)

SEQ ID NO: 30076 - protein, 513 aa, Bordetella pertussis; identical to SEQ ID NO: 20517

SEQ ID NO: 30077 - DNA, 1620 bp, Bordetella pertussis; identical to SEQ ID NO: 20518
  CDS (1)..(1620)

SEQ ID NO: 30078 - protein, 539 aa, Bordetella pertussis; identical to SEQ ID NO: 20519

SEQ ID NO: 30079 - DNA, 1821 bp, Bordetella pertussis; identical to SEQ ID NO: 20520
  CDS (1)..(1821)

SEQ ID NO: 30080 - protein, 606 aa, Bordetella pertussis; identical to SEQ ID NO: 20521

SEQ ID NO: 30081 - DNA, 1707 bp, Bordetella pertussis; identical to SEQ ID NO: 20522
  CDS (1)..(1707)

SEQ ID NO: 30082 - protein, 568 aa, Bordetella pertussis; identical to SEQ ID NO: 20523

SEQ ID NO: 30083 - DNA, 1638 bp, Bordetella parapertussis; identical to SEQ ID NO: 20524
  CDS (1)..(1638)

SEQ ID NO: 30084 - protein, 545 aa, Bordetella parapertussis; identical to SEQ ID NO: 20525

SEQ ID NO: 30085 - DNA, 1668 bp, Bordetella parapertussis; identical to SEQ ID NO: 20526
  CDS (1)..(1668)

SEQ ID NO: 30086 - protein, 555 aa, Bordetella parapertussis; identical to SEQ ID NO: 20527

SEQ ID NO: 30087 - DNA, 1497 bp, Bordetella parapertussis; identical to SEQ ID NO: 20528
  CDS (1)..(1497)

SEQ ID NO: 30088 - protein, 498 aa, Bordetella parapertussis; identical to SEQ ID NO: 20529

SEQ ID NO: 30089 - DNA, 1659 bp, Bordetella bronchiseptica; identical to SEQ ID NO: 20530
  CDS (1)..(1659)

SEQ ID NO: 30090 - protein, 552 aa, Bordetella bronchiseptica; identical to SEQ ID NO: 20531

SEQ ID NO: 30091 - DNA, 1740 bp, Bordetella bronchiseptica; identical to SEQ ID NO: 20532
  CDS (1)..(1740)

SEQ ID NO: 30092 - protein, 579 aa, Bordetella bronchiseptica; identical to SEQ ID NO: 20533

SEQ ID NO: 30093 - DNA, 1599 bp, Bordetella bronchiseptica; identical to SEQ ID NO: 20534
  CDS (1)..(1599)

SEQ ID NO: 30094 - protein, 532 aa, Bordetella bronchiseptica; identical to SEQ ID NO: 20535

SEQ ID NO: 30095 - DNA, 1611 bp, Bordetella bronchiseptica; identical to SEQ ID NO: 20536
  CDS (1)..(1611)

SEQ ID NO: 30096 - protein, 536 aa, Bordetella bronchiseptica; identical to SEQ ID NO: 20537

SEQ ID NO: 30097 - DNA, 1842 bp, Treponema hyodysenteriae; identical to SEQ ID NO: 20538
  CDS (1)..(1842)

SEQ ID NO: 30098 - protein, 613 aa, Treponema hyodysenteriae; identical to SEQ ID NO: 20539

SEQ ID NO: 30099 - DNA, 1557 bp, Erwinia sp; identical to SEQ ID NO: 20540
  CDS (1)..(1557)

SEQ ID NO: 30100 - protein, 518 aa, Erwinia sp; identical to SEQ ID NO: 20541

SEQ ID NO: 30101 - DNA, 2259 bp, Nitrosomonas europaea; identical to SEQ ID NO: 20542
  CDS (1)..(2259)

SEQ ID NO: 30102 - protein, 752 aa, Nitrosomonas europaea; identical to SEQ ID NO: 20543

SEQ ID NO: 30103 - DNA, 2331 bp, Nitrosomonas europaea; identical to SEQ ID NO: 20544
  CDS (1)..(2331)

SEQ ID NO: 30104 - protein, 776 aa, Nitrosomonas europaea; identical to SEQ ID NO: 20545

SEQ ID NO: 30105 - DNA, 1863 bp, Erwinia chrysanthemi; identical to SEQ ID NO: 20546
  CDS (1)..(1863)

SEQ ID NO: 30106 - protein, 620 aa, Erwinia chrysanthemi; identical to SEQ ID NO: 20547

SEQ ID NO: 30107 - DNA, 1533 bp, Janthinobacterium sp; identical to SEQ ID NO: 20548
  CDS (1)..(1533)

SEQ ID NO: 30108 - protein, 510 aa, Janthinobacterium sp; identical to SEQ ID NO: 20549

SEQ ID NO: 30109 - DNA, 1656 bp, Pseudomonas syringae; identical to SEQ ID NO: 20550
  CDS (1)..(1656)

SEQ ID NO: 30110 - protein, 551 aa, Pseudomonas syringae; identical to SEQ ID NO: 20551

SEQ ID NO: 30111 - DNA, 1815 bp, Yersinia pestis; identical to SEQ ID NO: 20552
  CDS (1)..(1815)

SEQ ID NO: 30112 - protein, 604 aa, Yersinia pestis; identical to SEQ ID NO: 20553

SEQ ID NO: 30113 - DNA, 1611 bp, Yersinia pestis; identical to SEQ ID NO: 20554
  CDS (1)..(1611)

SEQ ID NO: 30114 - protein, 536 aa, Yersinia pestis; identical to SEQ ID NO: 20555

SEQ ID NO: 30115 - DNA, 1638 bp, Yersinia pestis; identical to SEQ ID NO: 20556
  CDS (1)..(1638)

SEQ ID NO: 30116 - protein, 545 aa, Yersinia pestis; identical to SEQ ID NO: 20557

SEQ ID NO: 30117 - DNA, 2424 bp, Vibrio vulnificus; identical to SEQ ID NO: 20558
  CDS (1)..(2424)

SEQ ID NO: 30118 - protein, 807 aa, Vibrio vulnificus; identical to SEQ ID NO: 20559

SEQ ID NO: 30119 - DNA, 1941 bp, Shewanella oneidensis; identical to SEQ ID NO: 20560
  CDS (1)..(1941)

SEQ ID NO: 30120 - protein, 646 aa, Shewanella oneidensis; identical to SEQ ID NO: 20561

SEQ ID NO: 30121 - DNA, 1965 bp, Shewanella oneidensis; identical to SEQ ID NO: 20562
  CDS (1)..(1965)

SEQ ID NO: 30122 - protein, 654 aa, Shewanella oneidensis; identical to SEQ ID NO: 20563

SEQ ID NO: 30123 - DNA, 2931 bp, Leptospira interrogans; identical to SEQ ID NO: 20564
  CDS (1)..(2931)

SEQ ID NO: 30124 - protein, 976 aa, Leptospira interrogans; identical to SEQ ID NO: 20565

SEQ ID NO: 30125 - DNA, 1521 bp, Escherichia coli O6; identical to SEQ ID NO: 20566
  CDS (1)..(1521)

SEQ ID NO: 30126 - protein, 506 aa, Escherichia coli O6; identical to SEQ ID NO: 20567

SEQ ID NO: 30127 - DNA, 2010 bp, Rhizobium etli; identical to SEQ ID NO: 20568
  CDS (1)..(2010)

SEQ ID NO: 30128 - protein, 669 aa, Rhizobium etli; identical to SEQ ID NO: 20569

SEQ ID NO: 30129 - DNA, 2535 bp, Rhizobium etli; identical to SEQ ID NO: 20570
  CDS (1)..(2535)

SEQ ID NO: 30130 - protein, 844 aa, Rhizobium etli; identical to SEQ ID NO: 20571

SEQ ID NO: 30131 - DNA, 2262 bp, Rhizobium etli; identical to SEQ ID NO: 20572
  CDS (1)..(2262)

SEQ ID NO: 30132 - protein, 753 aa, Rhizobium etli; identical to SEQ ID NO: 20573

SEQ ID NO: 30133 - DNA, 786 bp, Azotobacter vinelandii; identical to SEQ ID NO: 20574
  CDS (1)..(786)

SEQ ID NO: 30134 - protein, 261 aa, Azotobacter vinelandii; identical to SEQ ID NO: 20575

SEQ ID NO: 30135 - DNA, 1953 bp, Xanthomonas campestris; identical to SEQ ID NO: 20576
  CDS (1)..(1953)

SEQ ID NO: 30136 - protein, 650 aa, Xanthomonas campestris; identical to SEQ ID NO: 20577

SEQ ID NO: 30137 - DNA, 1869 bp, Xanthomonas campestris; identical to SEQ ID NO: 20578
  CDS (1)..(1869)

SEQ ID NO: 30138 - protein, 622 aa, Xanthomonas campestris; identical to SEQ ID NO: 20579

SEQ ID NO: 30139 - DNA, 1659 bp, Xanthomonas campestris; identical to SEQ ID NO: 20580
  CDS (1)..(1659)

SEQ ID NO: 30140 - protein, 552 aa, Xanthomonas campestris; identical to SEQ ID NO: 20581

SEQ ID NO: 30141 - DNA, 2040 bp, Xanthomonas campestris; identical to SEQ ID NO: 20582
  CDS (1)..(2040)

SEQ ID NO: 30142 - protein, 679 aa, Xanthomonas campestris; identical to SEQ ID NO: 20583

SEQ ID NO: 30143 - DNA, 1638 bp, Xanthomonas campestris; identical to SEQ ID NO: 20584
  CDS (1)..(1638)

SEQ ID NO: 30144 - protein, 545 aa, Xanthomonas campestris; identical to SEQ ID NO: 20585

SEQ ID NO: 30145 - DNA, 2058 bp, Xanthomonas campestris; identical to SEQ ID NO: 20586
  CDS (1)..(2058)

SEQ ID NO: 30146 - protein, 685 aa, Xanthomonas campestris; identical to SEQ ID NO: 20587

SEQ ID NO: 30147 - DNA, 2259 bp, Xanthomonas campestris; identical to SEQ ID NO: 20588
  CDS (1)..(2259)

SEQ ID NO: 30148 - protein, 752 aa, Xanthomonas campestris; identical to SEQ ID NO: 20589

SEQ ID NO: 30149 - DNA, 2019 bp, Xanthomonas campestris; identical to SEQ ID NO: 20590
  CDS (1)..(2019)

SEQ ID NO: 30150 - protein, 672 aa, Xanthomonas campestris; identical to SEQ ID NO: 20591

SEQ ID NO: 30151 - DNA, 2100 bp, Xanthomonas campestris; identical to SEQ ID NO: 20592
  CDS (1)..(2100)

SEQ ID NO: 30152 - protein, 699 aa, Xanthomonas campestris; identical to SEQ ID NO: 20593

SEQ ID NO: 30153 - DNA, 1356 bp, Xanthomonas campestris; identical to SEQ ID NO: 20594
  CDS (1)..(1356)

SEQ ID NO: 30154 - protein, 451 aa, Xanthomonas campestris; identical to SEQ ID NO: 20595

SEQ ID NO: 30155 - DNA, 2373 bp, Xanthomonas campestris; identical to SEQ ID NO: 20596
  CDS (1)..(2373)

SEQ ID NO: 30156 - protein, 790 aa, Xanthomonas campestris; identical to SEQ ID NO: 20597

SEQ ID NO: 30157 - DNA, 1974 bp, Xanthomonas campestris; identical to SEQ ID NO: 20598
  CDS (1)..(1974)

SEQ ID NO: 30158 - protein, 657 aa, Xanthomonas campestris; identical to SEQ ID NO: 20599

SEQ ID NO: 30159 - DNA, 2133 bp, Xanthomonas axonopodis; identical to SEQ ID NO: 20600
  CDS (1)..(2133)

SEQ ID NO: 30160 - protein, 710 aa, Xanthomonas axonopodis; identical to SEQ ID NO: 20601

SEQ ID NO: 30161 - DNA, 1911 bp, Xanthomonas axonopodis; identical to SEQ ID NO: 20602
  CDS (1)..(1911)

SEQ ID NO: 30162 - protein, 636 aa, Xanthomonas axonopodis; identical to SEQ ID NO: 20603

SEQ ID NO: 30163 - DNA, 1992 bp, Xanthomonas axonopodis; identical to SEQ ID NO: 20604
  CDS (1)..(1992)

SEQ ID NO: 30164 - protein, 663 aa, Xanthomonas axonopodis; identical to SEQ ID NO: 20605

SEQ ID NO: 30165 - DNA, 2001 bp, Xanthomonas axonopodis; identical to SEQ ID NO: 20606
  CDS (1)..(2001)

SEQ ID NO: 30166 - protein, 666 aa, Xanthomonas axonopodis; identical to SEQ ID NO: 20607

SEQ ID NO: 30167 - DNA, 2112 bp, Xanthomonas axonopodis; identical to SEQ ID NO: 20608
  CDS (1)..(2112)

SEQ ID NO: 30168 - protein, 703 aa, Xanthomonas axonopodis; identical to SEQ ID NO: 20609

SEQ ID NO: 30169 - DNA, 1989 bp, Xanthomonas axonopodis; identical to SEQ ID NO: 20610
  CDS (1)..(1989)

SEQ ID NO: 30170 - protein, 662 aa, Xanthomonas axonopodis; identical to SEQ ID NO: 20611

SEQ ID NO: 30171 - DNA, 2061 bp, Xanthomonas axonopodis; identical to SEQ ID NO: 20612
  CDS (1)..(2061)

SEQ ID NO: 30172 - protein, 686 aa, Xanthomonas axonopodis; identical to SEQ ID NO: 20613

SEQ ID NO: 30173 - DNA, 2304 bp, Xanthomonas axonopodis; identical to SEQ ID NO: 20614
  CDS (1)..(2304)

SEQ ID NO: 30174 - protein, 767 aa, Xanthomonas axonopodis; identical to SEQ ID NO: 20615

SEQ ID NO: 30175 - DNA, 2085 bp, Xanthomonas axonopodis; identical to SEQ ID NO: 20616
  CDS (1)..(2085)

SEQ ID NO: 30176 - protein, 694 aa, Xanthomonas axonopodis; identical to SEQ ID NO: 20617

SEQ ID NO: 30177 - DNA, 2079 bp, Xanthomonas axonopodis; identical to SEQ ID NO: 20618
  CDS (1)..(2079)

SEQ ID NO: 30178 - protein, 692 aa, Xanthomonas axonopodis; identical to SEQ ID NO: 20619

SEQ ID NO: 30179 - DNA, 2070 bp, Xanthomonas axonopodis; identical to SEQ ID NO: 20620
  CDS (1)..(2070)

SEQ ID NO: 30180 - protein, 689 aa, Xanthomonas axonopodis; identical to SEQ ID NO: 20621

SEQ ID NO: 30181 - DNA, 2064 bp, Xanthomonas axonopodis; identical to SEQ ID NO: 20622
  CDS (1)..(2064)

SEQ ID NO: 30182 - protein, 687 aa, Xanthomonas axonopodis; identical to SEQ ID NO: 20623

SEQ ID NO: 30183 - DNA, 1965 bp, Xanthomonas axonopodis; identical to SEQ ID NO: 20624
  CDS (1)..(1965)

SEQ ID NO: 30184 - protein, 654 aa, Xanthomonas axonopodis; identical to SEQ ID NO: 20625

SEQ ID NO: 30185 - DNA, 2088 bp, Xanthomonas axonopodis; identical to SEQ ID NO: 20626
  CDS (1)..(2088)

SEQ ID NO: 30186 - protein, 695 aa, Xanthomonas axonopodis; identical to SEQ ID NO: 20627

SEQ ID NO: 30187 - DNA, 2043 bp, Xanthomonas axonopodis; identical to SEQ ID NO: 20628
  CDS (1)..(2043)

SEQ ID NO: 30188 - protein, 680 aa, Xanthomonas axonopodis; identical to SEQ ID NO: 20629

SEQ ID NO: 30189 - DNA, 2013 bp, Xanthomonas axonopodis; identical to SEQ ID NO: 20630
  CDS (1)..(2013)

SEQ ID NO: 30190 - protein, 670 aa, Xanthomonas axonopodis; identical to SEQ ID NO: 20631

SEQ ID NO: 30191 - DNA, 1560 bp, Rhodovulum sulfidophilum; identical to SEQ ID NO: 20632
  CDS (1)..(1560)

SEQ ID NO: 30192 - protein, 519 aa, Rhodovulum sulfidophilum; identical to SEQ ID NO: 20633

SEQ ID NO: 30193 - DNA, 1422 bp, Burkholderia cepacia; identical to SEQ ID NO: 20634
  CDS (1)..(1422)

SEQ ID NO: 30194 - protein, 473 aa, Burkholderia cepacia; identical to SEQ ID NO: 20635

SEQ ID NO: 30195 - DNA, 1632 bp, Ralstonia solanacearum; identical to SEQ ID NO: 20636
  CDS (1)..(1632)

SEQ ID NO: 30196 - protein, 543 aa, Ralstonia solanacearum; identical to SEQ ID NO: 20637

SEQ ID NO: 30197 - DNA, 1545 bp, Ralstonia solanacearum; identical to SEQ ID NO: 20638
  CDS (1)..(1545)

SEQ ID NO: 30198 - protein, 514 aa, Ralstonia solanacearum; identical to SEQ ID NO: 20639

SEQ ID NO: 30199 - DNA, 1575 bp, Ralstonia solanacearum; identical to SEQ ID NO: 20640
  CDS (1)..(1575)

SEQ ID NO: 30200 - protein, 524 aa, Ralstonia solanacearum; identical to SEQ ID NO: 20641

SEQ ID NO: 30201 - DNA, 1542 bp, Ralstonia solanacearum; identical to SEQ ID NO: 20642
  CDS (1)..(1542)

SEQ ID NO: 30202 - protein, 513 aa, Ralstonia solanacearum; identical to SEQ ID NO: 20643

SEQ ID NO: 30203 - DNA, 1575 bp, Ralstonia solanacearum; identical to SEQ ID NO: 20644
  CDS (1)..(1575)

SEQ ID NO: 30204 - protein, 524 aa, Ralstonia solanacearum; identical to SEQ ID NO: 20645

SEQ ID NO: 30205 - DNA, 1557 bp, Ralstonia solanacearum; identical to SEQ ID NO: 20646
  CDS (1)..(1557)

SEQ ID NO: 30206 - protein, 518 aa, Ralstonia solanacearum; identical to SEQ ID NO: 20647

SEQ ID NO: 30207 - DNA, 1803 bp, Ralstonia solanacearum; identical to SEQ ID NO: 20648
  CDS (1)..(1803)

SEQ ID NO: 30208 - protein, 600 aa, Ralstonia solanacearum; identical to SEQ ID NO: 20649

SEQ ID NO: 30209 - DNA, 1548 bp, Ralstonia solanacearum; identical to SEQ ID NO: 20650
  CDS (1)..(1548)

SEQ ID NO: 30210 - protein, 515 aa, Ralstonia solanacearum; identical to SEQ ID NO: 20651

SEQ ID NO: 30211 - DNA, 1590 bp, Ralstonia solanacearum; identical to SEQ ID NO: 20652
  CDS (1)..(1590)

SEQ ID NO: 30212 - protein, 529 aa, Ralstonia solanacearum; identical to SEQ ID NO: 20653

SEQ ID NO: 30213 - DNA, 1548 bp, Ralstonia solanacearum; identical to SEQ ID NO: 20654
  CDS (1)..(1548)

SEQ ID NO: 30214 - protein, 515 aa, Ralstonia solanacearum; identical to SEQ ID NO: 20655

SEQ ID NO: 30215 - DNA, 1941 bp, Ralstonia solanacearum; identical to SEQ ID NO: 20656
  CDS (1)..(1941)

SEQ ID NO: 30216 - protein, 646 aa, Ralstonia solanacearum; identical to SEQ ID NO: 20657

SEQ ID NO: 30217 - DNA, 1986 bp, Ralstonia solanacearum; identical to SEQ ID NO: 20658
  CDS (1)..(1986)

SEQ ID NO: 30218 - protein, 661 aa, Ralstonia solanacearum; identical to SEQ ID NO: 20659

SEQ ID NO: 30219 - DNA, 1548 bp, Ralstonia solanacearum; identical to SEQ ID NO: 20660
  CDS (1)..(1548)

SEQ ID NO: 30220 - protein, 515 aa, Ralstonia solanacearum; identical to SEQ ID NO: 20661

SEQ ID NO: 30221 - DNA, 990 bp, Ralstonia solanacearum; identical to SEQ ID NO: 20662
  CDS (1)..(990)

SEQ ID NO: 30222 - protein, 329 aa, Ralstonia solanacearum; identical to SEQ ID NO: 20663

SEQ ID NO: 30223 - DNA, 1608 bp, Ralstonia solanacearum; identical to SEQ ID NO: 20664
  CDS (1)..(1608)

SEQ ID NO: 30224 - protein, 535 aa, Ralstonia solanacearum; identical to SEQ ID NO: 20665

SEQ ID NO: 30225 - DNA, 1542 bp, Ralstonia solanacearum; identical to SEQ ID NO: 20666
  CDS (1)..(1542)

SEQ ID NO: 30226 - protein, 513 aa, Ralstonia solanacearum; identical to SEQ ID NO: 20667

SEQ ID NO: 30227 - DNA, 1545 bp, Ralstonia solanacearum; identical to SEQ ID NO: 20668
  CDS (1)..(1545)

SEQ ID NO: 30228 - protein, 514 aa, Ralstonia solanacearum; identical to SEQ ID NO: 20669

SEQ ID NO: 30229 - DNA, 1803 bp, Ralstonia solanacearum; identical to SEQ ID NO: 20670
  CDS (1)..(1803)

SEQ ID NO: 30230 - protein, 600 aa, Ralstonia solanacearum; identical to SEQ ID NO: 20671

SEQ ID NO: 30231 - DNA, 1890 bp, Ralstonia solanacearum; identical to SEQ ID NO: 20672
  CDS (1)..(1890)

SEQ ID NO: 30232 - protein, 629 aa, Ralstonia solanacearum; identical to SEQ ID NO: 20673

SEQ ID NO: 30233 - DNA, 1854 bp, Ralstonia solanacearum; identical to SEQ ID NO: 20674
  CDS (1)..(1854)

SEQ ID NO: 30234 - protein, 617 aa, Ralstonia solanacearum; identical to SEQ ID NO: 20675

SEQ ID NO: 30235 - DNA, 1662 bp, Salmonella typhimurium; identical to SEQ ID NO: 20676
  CDS (1)..(1662)

SEQ ID NO: 30236 - protein, 553 aa, Salmonella typhimurium; identical to SEQ ID NO: 20677

SEQ ID NO: 30237 - DNA, 1521 bp, Salmonella typhimurium; identical to SEQ ID NO: 20678
  CDS (1)..(1521)

SEQ ID NO: 30238 - protein, 506 aa, Salmonella typhimurium; identical to SEQ ID NO: 20679

SEQ ID NO: 30239 - DNA, 1644 bp, Salmonella typhimurium; identical to SEQ ID NO: 20680
  CDS (1)..(1644)

SEQ ID NO: 30240 - protein, 547 aa, Salmonella typhimurium; identical to SEQ ID NO: 20681

SEQ ID NO: 30241 - DNA, 1155 bp, Salmonella typhimurium; identical to SEQ ID NO: 20682
  CDS (1)..(1155)

SEQ ID NO: 30242 - protein, 384 aa, Salmonella typhimurium; identical to SEQ ID NO: 20683

SEQ ID NO: 30243 - DNA, 1626 bp, Salmonella typhimurium; identical to SEQ ID NO: 20684
  CDS (1)..(1626)

SEQ ID NO: 30244 - protein, 541 aa, Salmonella typhimurium; identical to SEQ ID NO: 20685

SEQ ID NO: 30245 - DNA, 1782 bp, Rhizobium meliloti; identical to SEQ ID NO: 20686
  CDS (1)..(1782)

SEQ ID NO: 30246 - protein, 593 aa, Rhizobium meliloti; identical to SEQ ID NO: 20687

SEQ ID NO: 30247 - DNA, 2070 bp, Rhizobium meliloti; identical to SEQ ID NO: 20688
  CDS (1)..(2070)

SEQ ID NO: 30248 - protein, 689 aa, Rhizobium meliloti; identical to SEQ ID NO: 20689

SEQ ID NO: 30249 - DNA, 2526 bp, Rhizobium meliloti; identical to SEQ ID NO: 20690
  CDS (1)..(2526)

SEQ ID NO: 30250 - protein, 841 aa, Rhizobium meliloti; identical to SEQ ID NO: 20691

SEQ ID NO: 30251 - DNA, 1998 bp, Rhizobium meliloti; identical to SEQ ID NO: 20692
  CDS (1)..(1998)

SEQ ID NO: 30252 - protein, 665 aa, Rhizobium meliloti; identical to SEQ ID NO: 20693

SEQ ID NO: 30253 - DNA, 2367 bp, Rhizobium meliloti; identical to SEQ ID NO: 20694
  CDS (1)..(2367)

SEQ ID NO: 30254 - protein, 788 aa, Rhizobium meliloti; identical to SEQ ID NO: 20695

SEQ ID NO: 30255 - DNA, 1665 bp, Rahnella aquatilis; identical to SEQ ID NO: 20696
  CDS (1)..(1665)

SEQ ID NO: 30256 - protein, 554 aa, Rahnella aquatilis; identical to SEQ ID NO: 20697

SEQ ID NO: 30257 - DNA, 1587 bp, Agrobacterium tumefaciens; identical to SEQ ID NO: 20698
  CDS (1)..(1587)

SEQ ID NO: 30258 - protein, 528 aa, Agrobacterium tumefaciens; identical to SEQ ID NO: 20699

SEQ ID NO: 30259 - DNA, 1857 bp, Agrobacterium rhizogenes; identical to SEQ ID NO: 20700
  CDS (1)..(1857)

SEQ ID NO: 30260 - protein, 618 aa, Agrobacterium rhizogenes; identical to SEQ ID NO: 20701

SEQ ID NO: 30261 - DNA, 1815 bp, Rhizobium meliloti; identical to SEQ ID NO: 20702
  CDS (1)..(1815)

SEQ ID NO: 30262 - protein, 604 aa, Rhizobium meliloti; identical to SEQ ID NO: 20703

SEQ ID NO: 30263 - DNA, 2124 bp, Rhizobium meliloti; identical to SEQ ID NO: 20704
  CDS (1)..(2124)

SEQ ID NO: 30264 - protein, 707 aa, Rhizobium meliloti; identical to SEQ ID NO: 20705

SEQ ID NO: 30265 - DNA, 1524 bp, Erwinia amylovora; identical to SEQ ID NO: 20706
  CDS (1)..(1524)

SEQ ID NO: 30266 - protein, 507 aa, Erwinia amylovora; identical to SEQ ID NO: 20707

SEQ ID NO: 30267 - DNA, 2172 bp, Agrobacterium rhizogenes; identical to SEQ ID NO: 20708
  CDS (1)..(2172)

SEQ ID NO: 30268 - protein, 723 aa, Agrobacterium rhizogenes; identical to SEQ ID NO: 20709

SEQ ID NO: 30269 - DNA, 2277 bp, Agrobacterium rhizogenes; identical to SEQ ID NO: 20710
  CDS (1)..(2277)

SEQ ID NO: 30270 - protein, 758 aa, Agrobacterium rhizogenes; identical to SEQ ID NO: 20711

SEQ ID NO: 30271 - DNA, 1725 bp, Agrobacterium tumefaciens; identical to SEQ ID NO: 20712
  CDS (1)..(1725)

SEQ ID NO: 30272 - protein, 574 aa, Agrobacterium tumefaciens; identical to SEQ ID NO: 20713

SEQ ID NO: 30273 - DNA, 2410 bp, Rhizobium leguminosarum; identical to SEQ ID NO: 20714
  CDS (37)..(1998)

SEQ ID NO: 30274 - protein, 653 aa, Rhizobium leguminosarum; identical to SEQ ID NO: 20715

SEQ ID NO: 30275 - DNA, 3600 bp, Desulfovibrio gigas; identical to SEQ ID NO: 20716
  CDS (302)..(2251)

SEQ ID NO: 30276 - protein, 649 aa, Desulfovibrio gigas; identical to SEQ ID NO: 20717

SEQ ID NO: 30277 - DNA, 1662 bp, Salmonella typhimurium; identical to SEQ ID NO: 20718
  CDS (1)..(1662)

SEQ ID NO: 30278 - protein, 553 aa, Salmonella typhimurium; identical to SEQ ID NO: 20719

SEQ ID NO: 30279 - DNA, 24 bp, Primer
atgattaaccgtatccgcgtagtc

SEQ ID NO: 30280 - DNA, 27 bp, Primer
ttaaaatgtttcccagtttggatcttg

SEQ ID NO: 30281 - protein, 350 aa, consensus
  MISC_FEATURE (1)..(350): consensus for the disclosure of xaa see table XV
GXXXLXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXLXXXXXXQAXXXXXTXXXXXXXXXXVXXXXXXAXXAXXXXXXXXXXAXXXXXXXXXXXXXXXXXXXXXXXXXXXMXXIXXXSXXIXXIXXVIXXIAFQTNXLALNAXVEAARAGEXGXGFAVVAXEVRXLAXRSXXAAXEIXXLIXXXXXXXXXXXXXXXXSXXXXXXGXXXXXXXGXXXXXXXXXXXXXXXXXXXIXXXXXEQXXGXXXXXXXXXXXDXXTQXNAXXXEXXXXXXXXXXXXXXXLXXXXXXF

SEQ ID NO: 30282 - protein, 71 aa, consensus; identical to SEQ ID NO: 22551
  MISC_FEATURE (1)..(71): consensus for the disclosure of xaa see table XV

SEQ ID NO: 30283 - DNA, 366 bp, Escherichia coli (strain K-12)
  CDS (1)..(366)
atgaaccatgcaccgcatttatatttcgcctggcaacaactcgtcgaaaaaagccagctcatgttacgcctggcaacggaagaacaatgggacgaactcatcgccagcgaaatggcgtatgttaatgcggtgcaggagattgcacatttgactgaagaggttgacccgtccaccacgatgcaggagcagctccgcccgatgctgcgcctgattctcgacaacgaaagcaaggtaaagcagttattacagattcggatggatgaactggcgaaactggtcggtcagtcatcggtgcaaaaatcggtgttgagtgcctatggcgatcagggcggctttgtgctggctccgcaggataacctcttttga

SEQ ID NO: 30284 - protein, 121 aa, Escherichia coli (strain K-12)
MNHAPHLYFAWQQLVEKSQLMLRLATEEQWDELIASEMAYVNAVQEIAHLTEEVDPSTTMQEQLRPMLRLILDNESKVKQLLQIRMDELAKLVGQSSVQKSVLSAYGDQGGFVLAPQDNLF

SEQ ID NO: 30285 - DNA, 363 bp, Yersinia pestis CO92
  CDS (1)..(363)
atggaacgtcaccagcatcttttgtccgaatatcaacaaatcctaactctcagtgagcaaatgcttatgttggctactgtggaaaactggaatgcgctggttgatctggaaatgacttatctcaaagccgttgaaaatacagctaatatcactatttcctcttgtacatcaccagtattgcaagaattactgcgccaaaaattgagatccatattggagaatgagatagaaattaagcggttactgcaacgtcgtttagataaattaagtgaattggtggggcaatctacccgccaacaggcagttaatcgtacttatggtcagttccccgatcaggcactgctgctgggtgaaacacaataa

SEQ ID NO: 30286 - protein, 120 aa, Yersinia pestis CO92
MERHQHLLSEYQQILTLSEQMLMLATVENWNALVDLEMTYLKAVENTANITISSCTSPVLQELLRQKLRSILENEIEIKRLLQRRLDKLSELVGQSTRQQAVNRTYGQFPDQALLLGETQ

SEQ ID NO: 30287 - DNA, 366 bp, Shigella flexneri 2a str. 301
  CDS (1)..(366)
atgaacaatgcaccgcatttgtatttcgcctggcaacaactcgtcgaaaaaagccagctcatgttacgcctggcaacggaagaacaatgggacgaactcatcgctagcgaaatggcgtatgtgaatgcggtgcaggagatcgcacacctgactgaagaggttgccccgtccactacgatgcaggagcagctccgcccgatgctgcacctgattctcgacaacgaaagcaaggtaaagcagttattacagattcggatggatgaactggcgaaactggtcggtcagtcatcggtgcaaaaatcggtgttaagtgcctatggcgatcagggcggctttgtgctggctccgcaggataacctcttttga

SEQ ID NO: 30288 - protein, 121 aa, Shigella flexneri 2a str. 301
MNNAPHLYFAWQQLVEKSQLMLRLATEEQWDELIASEMAYVNAVQEIAHLTEEVAPSTTMQEQLRPMLHLILDNESKVKQLLQIRMDELAKLVGQSSVQKSVLSAYGDQGGFVLAPQDNLF

SEQ ID NO: 30289 - DNA, 378 bp, Photorhabdus luminescens subsp. laumondii TTO1
  CDS (1)..(378)
atggataataaaatggatcttttgtcagcttaccaacggatcctaagtttaagtgagcaaatgcttaatttagctaaaaatgaaaaatgggatgaacttgttgatatggaaatcacctacctcaaagcagtagaagtgatcagccattcttcaatatcatcgacgacttctctttcgttacagcaaaaaatgaccaacattttgcaaataattttagataatgaaaatgagattaaaaaactactacagaaaagacttgatgaattaagtaaactcatcaaacaagcaagccaacagcaattattaaatgatagctacggccaattccctgttgaaccctatcataatacccttatgaactctacggagcaaaagtaa

SEQ ID NO: 30290 - protein, 125 aa, Photorhabdus luminescens subsp. laumondii TTO1
MDNKMDLLSAYQRILSLSEQMLNLAKNEKWDELVDMEITYLKAVEVISHSSISSTTSLSLQQKMTNILQIILDNENEIKKLLQKRLDELSKLIKQASQQQLLNDSYGQFPVEPYHNTLMNSTEQK

SEQ ID NO: 30291 - DNA, 381 bp, Erwinia carotovora subsp. atroseptica SCRI1043
  CDS (1)..(381)
atggtctccccccatcggcttctaaaagattaccaacaacttttgtctctgagtcaaaaaattcttcatttggccatcagcggccaatgggatacgttggttgagcaagagattgtttatgttcagtccgttgaaggcttagttaacacgccaattcctgacgaaattgacagcgtgatgcgactgcatctgcgacaaattttgcaggaagtgatggataatgaagcgaaagtgaaacaacttttgcagaagcggatggatgagttaagttcgttaatggggcaatcactgaagcaaaagtcaattaatgcaacttatagcgaatttgcagggcagcgacggttacttgacgaccccttgcctgacgaaacgcgctcataa

SEQ ID NO: 30292 - protein, 126 aa, Erwinia carotovora subsp. atroseptica SCRI1043
MVSPHRLLKDYQQLLSLSQKILHLAISGQWDTLVEQEIVYVQSVEGLVNTPIPDEIDSVMRLHLRQILQEVMDNEAKVKQLLQKRMDELSSLMGQSLKQKSINATYSEFAGQRRLLDDPLPDETRS

SEQ ID NO: 30293 - DNA, 363 bp, Yersinia pseudotuberculosis IP 32953
  CDS (1)..(363)
atggaacgtcaccagcatcttttgtccgaatatcaacaaatcctaactctcagtgagcaaatgcttatgttggctactgtggaaaactgggatgcgctggttgatctggaaatggcttatctcaaagccgttgaaaatacagctaatatcactatttcctcttgttcatcgccagtattgcaagaattactgcgccaaaaattgagatccatattggagaatgagatagaaattaagcggttactgcaacgtcgtttagataaattaagtgaattggtggggcaatctacccgccaacaggcggttaatcgtacttatggtcagttccccgatcaggcactgctgctgggtgaaacacaataa

SEQ ID NO: 30294 - protein, 120 aa, Yersinia pseudotuberculosis IP 32953
MERHQHLLSEYQQILTLSEQMLMLATVENWDALVDLEMAYLKAVENTANITISSCSSPVLQELLRQKLRSILENEIEIKRLLQRRLDKLSELVGQSTRQQAVNRTYGQFPDQALLLGETQ

SEQ ID NO: 30295 - DNA, 363 bp, Erwinia chrysanthemi
  CDS (1)..(363)
atggaaaacctctctccattactaattgagtatcaggggttactcaaactcatccgaaatatcaaggccatggcgcttaacggattatgggatgatgttgttgaacaggagatagtttatatccagtcaatagagagaatcagccagattaacgttccagccaatattcccagcacggtgcaattacagttccggcagcttcttcaggacatactggatacggaatcacaggtgaaagagctgctgcagaacagaatgcaggagctggcggtactcatccagcaatcacaaaatcaaaaatcgattaacaacacttatgccgagttttccgacgatattctcccgggaaaaccgcagccctga

SEQ ID NO: 30296 - protein, 120 aa, Erwinia chrysanthemi
MENLSPLLIEYQGLLKLIRNIKAMALNGLWDDVVEQEIVYIQSIERISQINVPANIPSTVQLQFRQLLQDILDTESQVKELLQNRMQELAVLIQQSQNQKSINNTYAEFSDDILPGKPQP

SEQ ID NO: 30297 - DNA, 369 bp, Salmonella typhimurium
  CDS (1)..(369)
atgacctcaaccgtggagtttatcaaccgttggcagcgtattgcgctgctcagtcaatcgctgcttgaacttgcgcagcgaggtgaatgggatctcttactgcaacaagaggtctcctatctgcaaagtattgaaacggtgatggaaaagcaaactccaccgggcattacgcgaagtattcaggatatggtcgccggatacatcaaacaaacgctggacaatgagcagctcctgaaagggctgctgcaacagcgactggatgaactgagtagtttgatcggacaatccacccgccaaaaatcactcaacaacgcgtatggccgtctttccggtatgttactcgtgccagatgcgcctggcgcctcataa

SEQ ID NO: 30298 - protein, 122 aa, Salmonella typhimurium
MTSTVEFINRWQRIALLSQSLLELAQRGEWDLLLQQEVSYLQSIETVMEKQTPPGITRSIQDMVAGYIKQTLDNEQLLKGLLQQRLDELSSLIGQSTRQKSLNNAYGRLSGMLLVPDAPGAS

SEQ ID NO: 30299 - DNA, 25 bp, Primer
atgaaccatgcaccgcatttatatt

SEQ ID NO: 30300 - DNA, 25 bp, Primer
ttaaaagaggttatcctgcggagcc

SEQ ID NO: 30301 - protein, 106 aa, consensus
  MISC_FEATURE (1)..(106): consensus for the disclosure of xaa see table XV
MXXXXXXXXXXQXXXXXXXXXXXXAXXXXWXXXXXXEXXYXXXXXXXXXXXXXXXXXXXXXXXXXXXXXXXXXXEXXXKXLLQXRXXXLXXLXXQXXXQXXXXXXY

SEQ ID NO: 30302 - protein, 106 aa, consensus
  MISC_FEATURE (1)..(106): consensus for the disclosure of xaa see table XV
MXXXXXLXXXXQXXXXXSXXXLXLAXXXXWDXLXXXEXXYXXXXXXXXXXXXXXXXXXXXQXXXXXXLXXXLXNEXXXKXLLQXRXDXLXXLXXQSXXQXXXXXXY

SEQ ID NO: 30303 - protein, 44 aa, consensus
  MISC_FEATURE (1)..(44): consensus for the disclosure of xaa see table XV
MXXXXXXXXXXQXXXXXXXXXXXXAXXXXWXXXXXXEXXYXXXX

SEQ ID NO: 30304 - protein, 48 aa, consensus
  MISC_FEATURE (1)..(48): consensus for the disclosure of xaa see table XV
XXXXXXXXXXXXXXXEXXXKXLLQXRXXXLXXLXXQXXXQXXXXXXYX

SEQ ID NO: 30305 - DNA, 591 bp, Escherichia coli K12
  CDS (1)..(591)
atgaacgtggtgatccttgataccggctgcgccaacctgaactcggtgaagtctgccattgcgcgtcacggttatgaacccaaagtcagccgtgacccggacgtcgtgttgctggccgataaactgtttttacccggcgttggcactgcgcaagcggcgatggatcaggtacgtgagcgcgagctgtttgatctcatcaaagcctgtacccaaccggtgctgggcatctgcttagggatgcaactgctggggcggcgcagcgaagagagcaacggcgtcgacttgctgggcatcatcgacgaagacgtgccgaaaatgaccgactttggtctgccactgccacatatgggctggaaccgcgtttacccgcaggcaggcaaccgcctgtttcaggggattgaagacggcgcgtacttttactttgttcacagctacgcaatgccggtcaatccgtggaccatcgcccagtgtaattacggcgaaccgttcaccgcggcggtacaaaaagataacttctacggcgtgcagttccacccggagcgttctggtgccgctggtgctaagttgctgaaaaacttcctggagatgtga

SEQ ID NO: 30306 - protein, 196 aa, Escherichia coli K12
MNVVILDTGCANLNSVKSAIARHGYEPKVSRDPDVVLLADKLFLPGVGTAQAAMDQVRERELFDLIKACTQPVLGICLGMQLLGRRSEESNGVDLLGIIDEDVPKMTDFGLPLPHMGWNRVYPQAGNRLFQGIEDGAYFYFVHSYAMPVNPWTIAQCNYGEPFTAAVQKDNFYGVQFHPERSGAAGAKLLKNFLEM

SEQ ID NO: 30307 - DNA, 591 bp, Idiomarina loihiensis L2TR
  CDS (1)..(591)
atgaatgtggtgattgtcgataccgagtgtgccaacctgacatctgtccgctttgcggttgaacgtttgggctactcagtgcttattaccgatgatgcagaacaaatacgcgccgctgaccgtgtcattttgcctggcgtaggtaccgctgccgcagctatgcgtaacttacagcgcaagcaactcgtggagccgctacgggagttaacccagccggtgctgggtatttgcctgggcatgcagttactgacctcacactcagaagaaggtgacgttgactgcctgaatttaattccggcaaaaaccaaacgcctgcgcgattctggtctgcctttgccgcatatgggctggaataccctgcagccgaccgcagataacccgttagtcgacacgagcgacagctactgctatttcgtgcacagttttgctgtagcagttgatgagtacactatagccagcagcgagtatggtgagcgttttgcctcaatgatacgtcacaacaactattttggtgcgcagtttcaccctgagcgttcaggtaagactggcgaagctctgctgaaacgttttctggagttaacattatgctga

SEQ ID NO: 30308 - protein, 196 aa, Idiomarina loihiensis L2TR
MNVVIVDTECANLTSVRFAVERLGYSVLITDDAEQIRAADRVILPGVGTAAAAMRNLQRKQLVEPLRELTQPVLGICLGMQLLTSHSEEGDVDCLNLIPAKTKRLRDSGLPLPHMGWNTLQPTADNPLVDTSDSYCYFVHSFAVAVDEYTIASSEYGERFASMIRHNNYFGAQFHPERSGKTGEALLKRFLELTLC

SEQ ID NO: 30309 - DNA, 639 bp, Silicibacter pomeroyi DSS-3
  CDS (1)..(639)
atgctcaccgccatcatcgattacgaatcgggcaacctgcactcggccgaaaaggcgtttcagcgcatggcgcgcgagaccggcgcgggcgaggtggtggtgacctcggatgccgatctggtggcccgggccgaccggctggtgctgccgggtgacggcgcctttcccgcctgcgccgccgagttgcgtgggcacaagggcctatatgacgcgatggtcgaggcggtggagcagaagggtcgcccttttctgggcatctgcgtcggcatgcaactcatggccaccaccggtcacgagtatgaagagacccccggtctgggctgggtcgcaggcgacgtggttcggatcacgcctgagaacgcggcgctgaaagtgccgcatatgggctggaacgatctggtgatcgaggcggcgcatccgatctttgacgggatcgccgggggcgatcacgtctatttcgtgcattcctatcacttccgggtgacaaaccccactgagcggctggcccatgtggactatggcgggccggtcactgcggtggtcgggcgcgacaccatggttggactgcagttccaccccgagaaaagccaggccatcggcctgcgcatgatcggcaatttcctgacctggaccccctaa

SEQ ID NO: 30310 - protein, 212 aa, Silicibacter pomeroyi DSS-3
MLTAIIDYESGNLHSAEKAFQRMARETGAGEVVVTSDADLVARADRLVLPGDGAFPACAAELRGHKGLYDAMVEAVEQKGRPFLGICVGMQLMATTGHEYEETPGLGWVAGDVVRITPENAALKVPHMGWNDLVIEAAHPIFDGIAGGDHVYFVHSYHFRVTNPTERLAHVDYGGPVTAVVGRDTMVGLQFHPEKSQAIGLRMIGNFLTWTP

SEQ ID NO: 30311 - DNA, 597 bp, Methanocaldococcus jannaschii DSM 2661
  CDS (1)..(597)
atgaaaatgattggaataattgattacaacgcagggaatttgagaagtattcaaaaggcagttgaactctatgataaggtaataataacaaacaacagtgaggagttattggcttgtgataagataattctaccaggtgtaggaaattttggtagtgcaatggaaaatttagctccattaaaagagacaatatacaaaattgttgatgatagagttccattcttaggaatatgtttaggaatgcagattttatttgaagagagcgaagagaaaagaggaatcaaaggtttagggataataaaaggcaatgtaatcaagtttaaggatgttgaaaaacttccacatatgggctggaatagtgtaaaaatagttaaagattgcccactgtttgaaggaataaaaaacaatagttacttttactttgttcattcatatcatgtaaatccagatgaagattgtatagttggaaaaactgaatatggaagagagtttccaagcgttataaacaaagataatgtctttgccacccaattccacccagaaaaaagtggaaaaattggtttaaagattatagaaaattttgttgagttgttataa

SEQ ID NO: 30312 - protein, 198 aa, Methanocaldococcus jannaschii DSM 2661
MKMIGIIDYNAGNLRSIQKAVELYDKVIITNNSEELLACDKIILPGVGNFGSAMENLAPLKETIYKIVDDRVPFLGICLGMQILFEESEEKRGIKGLGIIKGNVIKFKDVEKLPHMGWNSVKIVKDCPLFEGIKNNSYFYFVHSYHVNPDEDCIVGKTEYGREFPSVINKDNVFATQFHPEKSGKIGLKIIENFVELL

SEQ ID NO: 30313 - DNA, 855 bp, Halobacterium sp. NRC-1
  CDS (1)..(855)
atggttccggctgcgcccgcggttttgaggaagttgcgtcggtccattggtgtacgggttacagttcgattattgaatcaaaaaggatttttcattctatttgcggagacggaccacagcgggcgtttgcgcgtgcgttgcggcgggccaccggtggagacgaaaaaggcctttggcgtcggtggcgaacggacggccatggatacgacgggcaccgggcagcgtggggcgtcgatcgtggtcgtggactacggcctggggaacctgcggagtgtcacgcgggggttggagcgcgcgagcgccgacgtttcgatcgtcggggacccgggcgcgttggacgacgccgatggcatcgtgttgccgggggtcggcgcgttcggcgacggcatggagaacgccgggccgttccgggacgcactcaccgacgcggccgacgaggggcggcccctgttcggcatctgtctggggatgcagatgctgttgtcttcgagcgaggaggccgaccacgagggccaaggcgacgccagggggctggacctcattccggggaggaacgtccggttcaccggcacggtgaaagtcccgcatatgggctggaacgagctcgctgtcactcgcgaccacccgctcgtggggggcgtcgacggcgagtacgcctacttcgtgcactcctactacgccgcaccggacgaccccggtcacgtcgtcgcggagaccgactacggcgagcggttccccgcggtcgtcgccaacgacgccggcaacgtcttcgggacgcagttccaccccgagaagtccggggcaaccgggctgcgcatcctccggaacttcgtcgactactgcgccgaccagtag

SEQ ID NO: 30314 - protein, 284 aa, Halobacterium sp. NRC-1
MVPAAPAVLRKLRRSIGVRVTVRLLNQKGFFILFAETDHSGRLRVRCGGPPVETKKAFGVGGERTAMDTTGTGQRGASIVVVDYGLGNLRSVTRGLERASADVSIVGDPGALDDADGIVLPGVGAFGDGMENAGPFRDALTDAADEGRPLFGICLGMQMLLSSSEEADHEGQGDARGLDLIPGRNVRFTGTVKVPHMGWNELAVTRDHPLVGGVDGEYAYFVHSYYAAPDDPGHVVAETDYGERFPAVVANDAGNVFGTQFHPEKSGATGLRILRNFVDYCADQ

SEQ ID NO: 30315 - DNA, 666 bp, Agrobacterium tumefaciens str. C58
  CDS (1)..(666)
atggaaggcgctgacatgcgtgtcgcgattatcgactacggttcgggcaatttgcgttcggccaccaaagctttcgagcgtgccgcccgcgaggctggcatcgacgcaaccatcgatctgaccgacaagccggatcacgtcgcttcggcggaccgcatcgtcctgccgggcgtcggtgcctatgcggattgcagtgcgggtctgaatgccatgcccggtatgcacgaggcgctcatcgaagccgtcgagaaaaaagcccatcctttcctcggcatctgcgtcggcatgcagctgatgtcctcgcgcggactggaaaagaccgtcagcaccgggctcggctggatcgaaggtgacgtcgtggaaatgacgccgtccgatcccactcttaaaatcccgcagatcggctggaatacgctggaaatccgccacgcgcacccgctgttcgacggcataaagaccggtgcggatgggctgcacgcctatttcgtgcattcctatcatctggcggccaagcactcgactgacgtcatcgccaccaccaattatggtggcgcgatgacggctttcgtcggccgcgacaacatggcgggcgcgcagttccacccggaaaaaagccagacgctcggccttgccctgatttccaatttcctgcgctggaagccctga

SEQ ID NO: 30316 - protein, 221 aa, Agrobacterium tumefaciens str. C58
MEGADMRVAIIDYGSGNLRSATKAFERAAREAGIDATIDLTDKPDHVASADRIVLPGVGAYADCSAGLNAMPGMHEALIEAVEKKAHPFLGICVGMQLMSSRGLEKTVSTGLGWIEGDVVEMTPSDPTLKIPQIGWNTLEIRHAHPLFDGIKTGADGLHAYFVHSYHLAAKHSTDVIATTNYGGAMTAFVGRDNMAGAQFHPEKSQTLGLALISNFLRWKP

SEQ ID NO: 30317 - DNA, 594 bp, Sulfolobus tokodaii str. 7
  CDS (1)..(594)
gtgatgaaagctactctaataaactatggtgtaggaaacctgttcagcattaaggctggtctagaaagggttgggtttaatgttaagatttctttcttaccagagggagatgaagatgtcatagtattgcctggtgtaggtgcgttttctgcagtctcttcctatctaaattctatgaaggataaatttaatgaactgagagagagaggagtaaagtttttgggtgtatgtttaggtatgcaagtaatgtttgatgaaggaactgaggggggtttgagtaaaggtttaggatggtttaaaggtaaagttgataaaattcattctaacgtaaaacttcctcatattggttgggacaagttatttgttaataaagattcttgtaatttgactgaaggcttagatggtaaatatgtgtattatgtccatagttatgtagcgtatacaaatgattacgttgcttatagtgagtatggaattaaatacccagctatagtatgtaatgattttgctgtaggaactcagtttcatcctgaaaagagcagtgtaactggtaagatattccttagaaacttttattcgtgggttaaaagatga

SEQ ID NO: 30318 - protein, 197 aa, Sulfolobus tokodaii str. 7
MMKATLINYGVGNLFSIKAGLERVGFNVKISFLPEGDEDVIVLPGVGAFSAVSSYLNSMKDKFNELRERGVKFLGVCLGMQVMFDEGTEGGLSKGLGWFKGKVDKIHSNVKLPHIGWDKLFVNKDSCNLTEGLDGKYVYYVHSYVAYTNDYVAYSEYGIKYPAIVCNDFAVGTQFHPEKSSVTGKIFLRNFYSWVKR

SEQ ID NO: 30319 - DNA, 594 bp, Salmonella typhimurium LT2
  CDS (1)..(594)
gtgatgaacgtcgtcatccttgacaccggctgcgccaatttaagctcggtaaaatccgccgtggcgcgccacggttacaccccggtggtcagccgcgaagcggaaatcgtattacgcgctgacaaactctttctgcccggcgtcggcacggcgcaggccgctatggatcaactgcgcgaacgtgaactgatcgacttaattaaagcgtgtactcagccggtactgggtatctgcttagggatgcaactgctgggtcgtcgcagcgaagagacgcgcggcgtggatctgctgaacattatcgaacaagacgtgccgaaaatgaccgactttggtctgccgctgccgcacatgggctggaatcgcgtgtatccgcaggcgggcaaccggctgtttcagggcattgaagatggcgcctatttttactttgttcacagctacgcgatgccggtcaacccgtggactatcgcccagtgcaattacggcgagccgtttaccgcggcggtacagaaagataatttcttcggcgtacagttccacccggaacgttcgggcgcggcgggcgcacagttgctgaaaaacttcctggagatgtaa

SEQ ID NO: 30320 - protein, 197 aa, Salmonella typhimurium LT2
MMNVVILDTGCANLSSVKSAVARHGYTPVVSREAEIVLRADKLFLPGVGTAQAAMDQLRERELIDLIKACTQPVLGICLGMQLLGRRSEETRGVDLLNIIEQDVPKMTDFGLPLPHMGWNRVYPQAGNRLFQGIEDGAYFYFVHSYAMPVNPWTIAQCNYGEPFTAAVQKDNFFGVQFHPERSGAAGAQLLKNFLEM

SEQ ID NO: 30321 - DNA, 735 bp, Brucella melitensis 16M
  CDS (1)..(735)
atggggccagcaagtgtcccgccctgctccttccacctttggcgcgactataggatttgtcggccatcgcggagaaaactgaaaatgcgtgttgctattattgactatggttccggcaatcttcgctcggccaccaaggctttcgagcgcgccgcccatgaaagcggcatatcggcggaaatcgacctgacttgcgatgcgcagcgggttgccagcgcagaccgcatcgtcctgcccggtgttggcgcctatgcggattgccgccgtgggctcgatgccgtacccggcatggtcgaggcgctgaacgataccgtattgaagaaagcgcgtccgttccttggcatctgcgtgggtatgcagcttatgtcggaacgcggactggaaaaaaccgtcacgaacggccttggctggattgcgggcgatgtgcgtgaaatggtgccgtccgatgcatcgctgaaaattccgcagatcggctggaatcggattcacgtgaaacattcgcatccgatcttcgacggaatccccaccggcgacgacggcctgcatgcctattttgtccactcctatatgctggatgcgaaaaatgcatccgatgttctggctgtgaccgattatggcggcgacgttaccgccgccgtcgggcgcgacaacatggtgggcacccagttccatcccgaaaagagccagttgctcggcctttcgttcattgccaatttcctgaaatggaagccttga

SEQ ID NO: 30322 - protein, 244 aa, Brucella melitensis 16M
MGPASVPPCSFHLWRDYRICRPSRRKLKMRVAIIDYGSGNLRSATKAFERAAHESGISAEIDLTCDAQRVASADRIVLPGVGAYADCRRGLDAVPGMVEALNDTVLKKARPFLGICVGMQLMSERGLEKTVTNGLGWIAGDVREMVPSDASLKIPQIGWNRIHVKHSHPIFDGIPTGDDGLHAYFVHSYMLDAKNASDVLAVTDYGGDVTAAVGRDNMVGTQFHPEKSQLLGLSFIANFLKWKP

SEQ ID NO: 30323 - DNA, 624 bp, Methanosarcina mazei Go1
  CDS (1)..(624)
ttgtttgttagagctatgaaaagaatcgtgattatcgattacgggcttggaaatctcagaagtgttcaaaaagggcttgaacacgccggagcaagtcccgcaatctccgggaatcctgaagagatcctggcagcagacggtattattctcccaggagtcggtgcttttatagatgcaatgaagtgtctggtccctctcaaaaagaccatagccgaatttgcagaatcgggaaagccaatgcttggaatatgcctggggcagcaggttttgatgagctcttccgaagaaggcaggctgacagacgggcttgacctcattcagggcagggtgcttcgattcccgaagtctgaactgaaagttcctcaaatgggctggaataacataagggtcaaacaggaccaccctctgtttaaaggcattcccgacggttctttcgtgtatttcgtgcactcatattatgtggatactgctgcagagaacacccttgcatcatgcgaatatgggcttgaatatgcggcttcagttgtaaactcaaaaggaaatgttatgggcacccagttccaccctgaaaaaagcggagccaccgggttaaagattttgagaaacttcgttgaaatgtgctga

SEQ ID NO: 30324 - protein, 207 aa, Methanosarcina mazei Go1
MFVRAMKRIVIIDYGLGNLRSVQKGLEHAGASPAISGNPEEILAADGIILPGVGAFIDAMKCLVPLKKTIAEFAESGKPMLGICLGQQVLMSSSEEGRLTDGLDLIQGRVLRFPKSELKVPQMGWNNIRVKQDHPLFKGIPDGSFVYFVHSYYVDTAAENTLASCEYGLEYAASVVNSKGNVMGTQFHPEKSGATGLKILRNFVEMC

SEQ ID NO: 30325 - DNA, 1650 bp, Eremothecium gossypii
  CDS (1)..(1650)
atggtacaggtcgtgcacatcgtggacgtcgaaagcggcaacctgcaatcgatcacaaacgcaattgagcatctaggctatgaggtgaagctgatacgaagtggcgctgatcctgagctggacaaggcggagacgctaattctaccgggcgtcgggaattttggccatttcactcgcaacatgcgcgcccgtgggtttgtggacgctatctcctcatacatcgcatctgggaggcccctgatgggcatctgcgttgggctacaagtgctatttagaagctccgaagaagaccctggcgcagaaggactggcgctggtcgacatgtcgctgtcgcggttccgcgatgagtcaaagccggttccggagataggttggaacaccctgcaactggacggagaccaattcttcggtcttgacccctgcggaaggtactacttcgtgcactcgtatgctgcgatgttggcaaatggtgcgggccggttgcgagagcagggctggcgcgtcgcgacagccaggtacggcgatgagcgatttgtagcggcgctggcacgtggaaacctgtttgcaacgcaattccacccagaaaagtcggggaagctcgggttgcaactactggccaacttcctgaagcagcaacacccttctattgaccgcggctcgcaggatatagagctgctcaccaatgattactctaattatgggttgaccagacggattatcgcatgtttagatgtgcgcgccaacgatgagggagatctcgtggtgacgaaaggcgaccaatatgatgtcagagacaagcaagaaagtggtgcgatcagaaacctaggcaagccggtcgagctggcgcagctttattacgagcaaggtgcagacgagattacattcctgaatataacgagcttcaaggattgtccattaagggatgcaccaatgctggaggtgctgcggctagctgctaagacgacttttgttccgttgactgtgggcggcggaatccgggatatagttgatccggacgggacaagaatctctgctctggacgttgctggcctttacttccgatccggtgcagataaagtttccatcgggacagacgctgtctatgccgcggagcggtactacgaggccgggacacgtggggatggctcgtctcccatagaaaccatttcgaaggcctacgggtcccaggcggtggtaatttctgttgatcctaagcgagtttatgttgattccccggatgatactcccaataagaccatcgagtccaagtatcctaattctaaaggtcaaagatggtgctggtaccaatgtactttgaaaggagggcgagaatgcagtaagattggcgtctgggaattagtaagggcatgcgaagccctaggtgccggcgagattctcttaaattgcatcgacagagatggtacaaatgttggatacgatctcgagttgcttaaactggttaagtatgccgtaaaaattcccgtcgttgcctcgagcggcgcagggaagcctgagcatttccaagaagcatttctcgagactggagtagatgcctgtttgggagcgggtatattccataggggagaatacaccgttcgagaagtcaaggaccatctcagcaggaacggattgaaagtgaggctgatttga

SEQ ID NO: 30326 - protein, 549 aa, Eremothecium gossypii
MVQVVHIVDVESGNLQSITNAIEHLGYEVKLIRSGADPELDKAETLILPGVGNFGHFTRNMRARGFVDAISSYIASGRPLMGICVGLQVLFRSSEEDPGAEGLALVDMSLSRFRDESKPVPEIGWNTLQLDGDQFFGLDPCGRYYFVHSYAAMLANGAGRLREQGWRVATARYGDERFVAALARGNLFATQFHPEKSGKLGLQLLANFLKQQHPSIDRGSQDIELLTNDYSNYGLTRRIIACLDVRANDEGDLVVTKGDQYDVRDKQESGAIRNLGKPVELAQLYYEQGADEITFLNITSFKDCPLRDAPMLEVLRLAAKTTFVPLTVGGGIRDIVDPDGTRISALDVAGLYFRSGADKVSIGTDAVYAAERYYEAGTRGDGSSPIETISKAYGSQAVVISVDPKRVYVDSPDDTPNKTIESKYPNSKGQRWCWYQCTLKGGRECSKIGVWELVRACEALGAGEILLNCIDRDGTNVGYDLELLKLVKYAVKIPVVASSGAGKPEHFQEAFLETGVDACLGAGIFHRGEYTVREVKDHLSRNGLKVRLI

SEQ ID NO: 30327 - DNA, 1662 bp, Neurospora crassa
  CDS (1)..(1662)
atgccgaccgttcacctcctggattacgtcgccggcaacgtgcgcagcttggtcaatgccattgagagggttggctacagcgtcgagtgggtccggtcgccggaggaggttgccaatgctgataaactcatcctccctggcgtaggccacttcggccactgcctctcccagctcgcctccgccggctacatggcccccatccgcgcccacatcgagtccggtaagcccttcatgggcatctgcgtcggcctccaggctctcttcgaaggctcgtccgaagaccccaactgccccggtctgggtgtcctccccggcaagctcgaccgcttcgacgacacctccaagtccgtcccccacattggctggaacgacgcctcgtgcccgaccaacccgaacctctttggtctcaaccccgactccaaatactactatgtccactcgtacaagatgccctacaccaagggccagctcgagtcgcaagggtgggcggtggctaccggtgtctatggcggcgagacctttattggcgccattgccaagggcaacgtgatggccacccagttccaccctgagaagtcgggtgtcgccggtctgcgcgtcatccgggccttcctcgatggctctggcgccgctgctctggcttcccaccctccccaggaggtccccaacgccggcgacgatgccctcgtcagcaaggagggcctcacccgtcgtgtcattgcctgcttggatgtgcgcaccaacgaccagggcgacttggtggtcaccaagggtgaccaatatgatgtccgcgaaaagtctgacgaccgcaacgtccgcaacctcggcaagcccgtcgagatggcgcgcaagtactacgaacaaggcgccgacgaagtgaccttcctcaacatcacctccttccgcgactgccccgttgccgacctgcccatgctcgagatccttcgcctgacctccaagaccgtcttcgttcccctgaccgtcggcggcggcatccgcgacaccgtcgacacggacggcaccaaggtctccgccctcgaaatcgccaccatgtacttccagtcaggcgccgacaaggtgtccattggctccgacgccgtcatcgctgccgaggagtactatgcctccggcaagacgctctttggcaacacggccattgagcagatcagcaaagcctacggaaaccaggctgtcgtcgtctcggtcgatcccaagcgcgtctacgtccccaagcccgatgccacgagacaccacaccgtcaagacgtcgtaccccggccccaagggcgaggaatactgctggtacgcctgcacgatcaagggcgggcgcgagacgagggatctggatgtggttgaactcacgcaggccgtggaagccatgggctgcggcgagattctgttgaactgcattgacaaggacggcaccaacagcgggtttgatctggagttgatcaggcaggtcaaggcggccgtgaggataccggttattgccagctcgggggcgggcaacccgggtcactttgaggaggtgtttagggagacgacgacggacgccgcgctgggagcaggcatgttccaccgtggggagtatacagtacagcaggtcaaggaggagctgaaggcgagggggttggtggtcagacagtttgagggagatctctga

SEQ ID NO: 30328 - protein, 553 aa, Neurospora crassa
MPTVHLLDYVAGNVRSLVNAIERVGYSVEWVRSPEEVANADKLILPGVGHFGHCLSQLASAGYMAPIRAHIESGKPFMGICVGLQALFEGSSEDPNCPGLGVLPGKLDRFDDTSKSVPHIGWNDASCPTNPNLFGLNPDSKYYYVHSYKMPYTKGQLESQGWAVATGVYGGETFIGAIAKGNVMATQFHPEKSGVAGLRVIRAFLDGSGAAALASHPPQEVPNAGDDALVSKEGLTRRVIACLDVRTNDQGDLVVTKGDQYDVREKSDDRNVRNLGKPVEMARKYYEQGADEVTFLNITSFRDCPVADLPMLEILRLTSKTVFVPLTVGGGIRDTVDTDGTKVSALEIATMYFQSGADKVSIGSDAVIAAEEYYASGKTLFGNTAIEQISKAYGNQAVVVSVDPKRVYVPKPDATRHHTVKTSYPGPKGEEYCWYACTIKGGRETRDLDVVELTQAVEAMGCGEILLNCIDKDGTNSGFDLELIRQVKAAVRIPVIASSGAGNPGHFEEVFRETTTDAALGAGMFHRGEYTVQQVKEELKARGLVVRQFEGDL

SEQ ID NO: 30329 - DNA, 1668 bp, Magnaporthe grisea 70-15
  CDS (1)..(1668)
atgcccaaagtatacctgctggactatgttgccggcaatgttcgtagcctggtcaacgctatcgaaaaggtcggctttgaagtggaatgggtcaaaactccagaagaggttgccaaggcagataaattgatcctgccaggcgtaggccactttggccactgcctctctcaactttccaaggctggcttcctaccagccatccagaagcacattgccgatggcaagtcctttatgggcatctgtgtcggcatgcaagccattttctctggctcgtcagaagacccggcatgtcccggtctcggcctgatcaaggggtcactggaccgcttcaacgacagcacaaaggccgtacctcacatcggctggaacgatgctaccattactacgaccacacagccaaacagcaacaatgagccatcaacgctccttgaccttcgtccctcctccaagtattactacgtccactcgtataaatacccttatgtccctggcgagcttgaagcgcaggggtggacggtagcaacaggagtttatggcgaggagacgttcgtcggtgcagtcgctcgcggcaacgtcctggttacgcagttccaccccgagaagagtggcgtcgccggcctgcgagtcctccgatccttcctggacccctccggcgctgcctcactaggatcggccgccgtcgcaccacggaaccccgtacccgcaggactgacccgccgcgtgattgcatgcctggacgtacgcaccaacgatgcgggtgacctcgtagtgaccaagggcgaccagtacgacgtccgcgagaagtcatccgaccgtggcgtccgaaacctcggcaagccggtcgacctggccaagaagtactacgaacagggcgccgacgaggtcacgttcctcaacattacctccttccgcgactgccccctagccgacctgcccatgctcgaggtcctccgcctcacgtccgagacggtgtttgtgccgctgacagtcggcggcggcatccgcgacacggtcgacgttgacgggaccaaggtgtctgccctcgacgtcgcgagcatgtacttccgcagcggcgccgacaaggtcagcatcgggtccgacgccgtgaccgccgccgaggagtactacgccgccggcaagaccttgtccggctccaccgccatcgagcagatcagccgcgcgtacggcaaccaggccgtcgtggtgtccgtcgacccgaagcgcgtctacgtggcctcgcccgaagcgacacgtcacgccaccatccaaaccgcgttcccgggccccaacggcgaagcttactgctggtacgcgtgcacggccaagggtgggcgggagacgcgcgatgtcgacgtggtggagctgacacaggccgtagaggccatgggtgccggcgagatcctgctcaactgcatcgacaaggacggcaccaacagcggtttcgacctggagctgatcgcgcaggtcaaggccgccgtcaagatccccgtcatcgccagcagcggagccggcaacccgggacactttgaggaggtgtttgaaaagaccacgactgacgccgcgctcggggctggtatctttcaccgcggagagtacaccgttacgcaggtcaaggatcacctggcgaccaagggattgctggtgagacagttcgagggggagttgtga

SEQ ID NO: 30330 - protein, 555 aa, Magnaporthe grisea 70-15
MPKVYLLDYVAGNVRSLVNAIEKVGFEVEWVKTPEEVAKADKLILPGVGHFGHCLSQLSKAGFLPAIQKHIADGKSFMGICVGMQAIFSGSSEDPACPGLGLIKGSLDRFNDSTKAVPHIGWNDATITTTTQPNSNNEPSTLLDLRPSSKYYYVHSYKYPYVPGELEAQGWTVATGVYGEETFVGAVARGNVLVTQFHPEKSGVAGLRVLRSFLDPSGAASLGSAAVAPRNPVPAGLTRRVIACLDVRTNDAGDLVVTKGDQYDVREKSSDRGVRNLGKPVDLAKKYYEQGADEVTFLNITSFRDCPLADLPMLEVLRLTSETVFVPLTVGGGIRDTVDVDGTKVSALDVASMYFRSGADKVSIGSDAVTAAEEYYAAGKTLSGSTAIEQISRAYGNQAVVVSVDPKRVYVASPEATRHATIQTAFPGPNGEAYCWYACTAKGGRETRDVDVVELTQAVEAMGAGEILLNCIDKDGTNSGFDLELIAQVKAAVKIPVIASSGAGNPGHFEEVFEKTTTDAALGAGIFHRGEYTVTQVKDHLATKGLLVRQFEGEL

SEQ ID NO: 30331 - DNA, 1650 bp, Gibberella zeae PH-1
  CDS (1)..(1650)
atgcccactgttcacctattagattatgttgccggcaacatcaggagtctggtgaatgccattgagaagtgtggctacgaggtcgaatgggtccgatctcctgaggaagttcccaatgcagagaaacttatcctccccggtgtcggccactttggccattgtctttcccagctttctcaagccggctatctagaacctatcaagaaacacattgctgatgggaagccctttttcggtgtttgcgttggcctacaagctcttttccagggttctgtcgaggatcctgacatccccggtctcggagtcgtgccagctactttggatcgatttgacgactcaagtaaatcggtacctcacatcggttggaacaatgccttcacggctgggaaggccatgtacgaccttcagccggactcaaagtattattatgttcattcgtacaagtgcccctacaagccaggagagcttgagtcgcagggatgggctgttgcgactggcacatacggcgccgagactttcgtaggtgccatcgccaagggcaatatctacgcaacccaattccacccagagaagtccggcgccgccggtctaaggacactccgtgcctttctcacgggtgaaggactgaaaaccctcggcaatgtagtcgatgaagctgtcgccaatgctcccatcaagttcgaggacagcctgacacgacgagtcattgcatgcttggatgtgcgaacaaacgaccagggcgatttggttgttaccaagggtgaccagtacgatgtccgcgagaagggtgacgatcgcaacgtgcgtaacctgggcaagcctgttgagatggctaagcgatactacgaatctggggcggacgaggtcacgttccttaacatcacttctttccgggactgcccagtcgccgatctccccatgcttgagatcgttcgtcaaacgtctcgcactgtttttgtgcccctaaccattggtggtggtatccgtgataccgtagacactgatggcacaaaggtttcagcgctcgagattgccaccatgtacttcaagtctggtgctgacaaggtctcgatcgggtctgatgctgttcttgctgccgaagagtactactctctcggtcgtaagctatttggtaacactgccatcgaacagatttcacgggcctatggcaaccaggccgtcgttgtgagcgttgaccccaagcgcgtctacgttcccaagccagatgctacccgacacaacatcgtcaagacacagttccccggtcccaagggtgaggagtactgttggtacgcctgcacgatcaagggcggtcgtgaaactcgggatatggatgtagtcgagcttacacaggctgtcgaggcgatgggaaccggagagattctcctcaactgcattgacaaagacggtactaacagtgggttcgactttgagctcatcaaccaagtcaagggagctgtcaagatccccgtcattgcctcaagtggtgctggcaacccgtctcactttgaagatgtattccaaaagaccccgacagatgccgctttgggtgctggaatgttccaccgcggcgagtacacagtcaagcaagtgaaggattacctacaagaaaagggtctcaaggtgagacagttcgaagagggcttttag

SEQ ID NO: 30332 - protein, 549 aa, Gibberella zeae PH-1
MPTVHLLDYVAGNIRSLVNAIEKCGYEVEWVRSPEEVPNAEKLILPGVGHFGHCLSQLSQAGYLEPIKKHIADGKPFFGVCVGLQALFQGSVEDPDIPGLGVVPATLDRFDDSSKSVPHIGWNNAFTAGKAMYDLQPDSKYYYVHSYKCPYKPGELESQGWAVATGTYGAETFVGAIAKGNIYATQFHPEKSGAAGLRTLRAFLTGEGLKTLGNVVDEAVANAPIKFEDSLTRRVIACLDVRTNDQGDLVVTKGDQYDVREKGDDRNVRNLGKPVEMAKRYYESGADEVTFLNITSFRDCPVADLPMLEIVRQTSRTVFVPLTIGGGIRDTVDTDGTKVSALEIATMYFKSGADKVSIGSDAVLAAEEYYSLGRKLFGNTAIEQISRAYGNQAVVVSVDPKRVYVPKPDATRHNIVKTQFPGPKGEEYCWYACTIKGGRETRDMDVVELTQAVEAMGTGEILLNCIDKDGTNSGFDFELINQVKGAVKIPVIASSGAGNPSHFEDVFQKTPTDAALGAGMFHRGEYTVKQVKDYLQEKGLKVRQFEEGF

SEQ ID NO: 30333 - DNA, 1848 bp, Ustilago maydis 521
  CDS (1)..(1848)
atgctctacctgctcgattacggagccggcaatgtgcgcagtctcgccaactcgatcagccagctcggcttcgagttcaaatgggtggagtcgcctcaggatctcgccaaggcggacaagcttctgttccccggtgtgggcgcttttggacctgcaatggagtcgattcgcgaaaaaggatatgcggagccgttgaaagcatacattgcttccggaaagccgtacatgggcatttgcatcggcctgcagacactgtttgaggggtcggacgaagcaccgggcgttgctggtctcggcatcgtccctggaatcgtctcgagcttctcggcgtatgaagaggagcgcaagctcaacaaatcggtcccgcagatgggctggaattccgcacaagtcgtcaagacgcgcaatgacaatggtgatcaggatgcgctcaagtatggcttcccggatcgtgcatcgggcgaaacaagtcactactactttgtacactcgtatcgcgcagcataccagccggacaaacatgcagactgggtgttgacgacaacgcagtatggatccgaggtgtttctgtcgtcgatccagaaggggaatgtgtttgccacccagttccacccggaaaagagcggccgtgctggcctcgaagtgcttcgcgcttggctcagccagcccggcactatggaaatcagcaaagaacggctgctgcttgacgcgcaacaagtggctgttcccgcaccccaagatggcctcacaaaacgcatcgttgcatgcctcgatgtgcgcagcaacgacgatggcgatcttgtcgttaccaaaggcgaatcatacgacgtacgcgaaacgctcgagcacacgccaaccgacgagtcagaagctggttcgtccacagccaccaggcgcaaggtgcgcaacctcggcaaacctgtcgacctcgcactgcgatactacctggaaggtgcagatgaaatcacgtttctcaacatcacctcgttccgttcgtgcgcattgcaggatcaaccgatgctcagcctgctcgaagctgcagctgccaagatctttgttccactcaccatcggcggaggcatcaaggacagtgtcgatccggatggaacgccgagaccggccaaagaggtggctgatgcctacttccgtgctggtgctgacaaagtctcgattggttccgaagcggtgtacgctgtacaagagctgtacgcacgtgcggcgcagaacggatacgagaacgagagcaatccgctccgatttagcgaggcgtgtttgacaggaaacacgggcatcgagaccatcagtaaggcgtacggtgcgcaagcagtggtggtgtcgatcgacccacgtcgtgtctacgtcactgaaggagagcacgtggatccaaaacacgttgcatgtctcgtacagggggtcgctggttccgaagatcatggcaaacgatggtggtatcgatgcaccgttaagggtggacgagaagatcgtgatcttgacgtcatccaactggcacgtggtgtacagcgtctaggtgccggcgaaatcctgctcaactcgatcgaccgcgatggatccaacaagggcttcgatcgccagctcgtcgagctcgtacgtggcagtgtcagcatcccggtgatcgcgtcgtctggcgccggcaccgcccagcactttgtcgacatctttaccgctcaagccgacaaccaaagtaccgtagaagctgccttggccgccggcatcttccaccgcaaacaatgctcgatcgacgacgtcaagtcatcgctgttgcaaaacggtttcaaggtgagaagagaacacgtagccgccggagctggcgccatctcgaaacagtaa

SEQ ID NO: 30334 - protein, 615 aa, Ustilago maydis 521
MLYLLDYGAGNVRSLANSISQLGFEFKWVESPQDLAKADKLLFPGVGAFGPAMESIREKGYAEPLKAYIASGKPYMGICIGLQTLFEGSDEAPGVAGLGIVPGIVSSFSAYEEERKLNKSVPQMGWNSAQVVKTRNDNGDQDALKYGFPDRASGETSHYYFVHSYRAAYQPDKHADWVLTTTQYGSEVFLSSIQKGNVFATQFHPEKSGRAGLEVLRAWLSQPGTMEISKERLLLDAQQVAVPAPQDGLTKRIVACLDVRSNDDGDLVVTKGESYDVRETLEHTPTDESEAGSSTATRRKVRNLGKPVDLALRYYLEGADEITFLNITSFRSCALQDQPMLSLLEAAAAKIFVPLTIGGGIKDSVDPDGTPRPAKEVADAYFRAGADKVSIGSEAVYAVQELYARAAQNGYENESNPLRFSEACLTGNTGIETISKAYGAQAVVVSIDPRRVYVTEGEHVDPKHVACLVQGVAGSEDHGKRWWYRCTVKGGREDRDLDVIQLARGVQRLGAGEILLNSIDRDGSNKGFDRQLVELVRGSVSIPVIASSGAGTAQHFVDIFTAQADNQSTVEAALAAGIFHRKQCSIDDVKSSLLQNGFKVRREHVAAGAGAISKQ

SEQ ID NO: 30335 - DNA, 1662 bp, Aspergillus nidulans FGSC A4
  CDS (1)..(1662)
atgcccactgttcatctgcttgattatgtcgctggaaatgtgcgttccttggtgaatgccatcaacaaggttggatatgaagttgagtgggtgagatcgcccagcgatttgaaagatgtcgagaagctcatacttccaggagtcggccacttcggccattgcctttctcagctttcaagcggtggctatttgcagccgataagagagcatattgcttccgggaaaccgtttatgggaatatgtgttggtttacaatcccttttcgagagttccgaggaggatcccaacattcctggtttgggtacaatcccagcgcggttgcgcaaatttgacgcaaaaacgaagagcgtacctcatatcggttggaactcggcaacagatacccgcattgactcgactggaggccagaccttctatggattgagcccaagcagcaagtactactacgtacactcatacgccgcgccatatgagccgggaattcttgagaaagatggttggttggtcgccacggcgagttatggggaggagaaattcatcggcgcgatagcacgagataacatctttgcgacacaattccatcccgagaagagcggccaagcaggcctacgcacccttcgcgctttcttggacggagctcagctccattctgtcacattagaagactcgattttgacaggagagaaaaacggtcttacccgtaggatcatcgcctgtcttgatgttcgtacgaatgatgtcggcgatctcgttgtgactaagggcgatcaatatgatgttcgcgagaaggatggtgcggatgctggagggcaagtgaggaacctgggaaagccggttgatatggctaagaaatattacgaacagggggcagatgaggtgacgtttttaaacatcacctctttcagaaactgtccgttagccgacctccctatgctcgagattctccgaagaacgtcggagaccgtcttcgtacctttgactattggtggcggcattagggacactgtggatacagacggtactcacatcccagctctagacgtggcatcgatgtacttcaaatctggggctgacaaagtcagcattggttcggatgccgttgttgctgcggaagattattacgcagctggcaaagttctgtctggcaaaactgccattgaaactatttctaaggcgtatggaaaccaggctgtcgttgtaagcgttgacccgaagcgcgtttatgtcagccaaccagaagacacgaaacaccgtacgatagaaacgaaatttcctaacgccgccgggcaaaatttctgttggtaccagtgtactataaagggtggcagagagaccagagacttagatgtctgccagctggtgcaagccgtcgaggcaatgggtgctggggagattctgctgaattgcattgataaagacgggagcaacagtggtttcgatcttgaactgatcaaccacgtcaaagctgcagtaaaaatacccgtgattgcctctagcggagctggtatgccgaagcattttgaggaagtttttgatcaaacgacgacagatgctgctctgggtgctgggatgttccatcgtggtgagtatactgttggtgaagtcaagcaataccttgaggatagaggtttccttgttcgacgattcgagcctgatgtctga

SEQ ID NO: 30336 - protein, 553 aa, Aspergillus nidulans FGSC A4
MPTVHLLDYVAGNVRSLVNAINKVGYEVEWVRSPSDLKDVEKLILPGVGHFGHCLSQLSSGGYLQPIREHIASGKPFMGICVGLQSLFESSEEDPNIPGLGTIPARLRKFDAKTKSVPHIGWNSATDTRIDSTGGQTFYGLSPSSKYYYVHSYAAPYEPGILEKDGWLVATASYGEEKFIGAIARDNIFATQFHPEKSGQAGLRTLRAFLDGAQLHSVTLEDSILTGEKNGLTRRIIACLDVRTNDVGDLVVTKGDQYDVREKDGADAGGQVRNLGKPVDMAKKYYEQGADEVTFLNITSFRNCPLADLPMLEILRRTSETVFVPLTIGGGIRDTVDTDGTHIPALDVASMYFKSGADKVSIGSDAVVAAEDYYAAGKVLSGKTAIETISKAYGNQAVVVSVDPKRVYVSQPEDTKHRTIETKFPNAAGQNFCWYQCTIKGGRETRDLDVCQLVQAVEAMGAGEILLNCIDKDGSNSGFDLELINHVKAAVKIPVIASSGAGMPKHFEEVFDQTTTDAALGAGMFHRGEYTVGEVKQYLEDRGFLVRRFEPDV

SEQ ID NO: 30337 - DNA, 1659 bp, Candida glabrata CBS138
  CDS (1)..(1659)
atgtctacggtacatgttattgatgttgagagtggtaacttgcagtctctgaccaatgcaattgaatatctagggtttagagtccaattgatcaaggactcccaagatcctgaactgctgaaagcagaaaagttgatactgccaggtgttggtaactatgggcatgtgtatgagaatatattatccagagggtttgagaagcccatcagggaatacatagcttctggcaaaccgatcatgggtatttgtgttggtctacaagttttgtttaatagctctaccgaaagtccctccagcggcgggtttggctatgtgaaccatagactatctcgcttcaatgatgatgaaaagccagttcctgaaattggctggaacagcgtcatcccagaaaaggacttgttctttggcttagatccttacaagagatattatttcgttcactcatatgctggtatactagatgcagcaacagaatcaagcttgaaagctgacggctggaggattgcgaaggctaaatatggttctgaggaatttattgctgcagtttacaaggacaatatatttgctactcagttccaccctgagaaatcaggtttggcaggtttgcatataattgaaaactttctaaaacaggcacatccagggttaccagcttactcagaggatgaaaagtccttgcttggcaatgattactcaaactatggattaacgagaagaattatagcgtgtttggacgtacgtactaatgatcaaggagatctcgttgttacaaagggagaccaatatgatgtcagagagaaaagtggtgacaacgacgtaagaaatcttggtaagccagttcaattggctcaaaaatattatgaacaaggtgccgatgaagtgacatttttaaatattacatcattcagagacagtccggtgaaagataccccaatgcttgaagtgttgagacagactgcgaaaaaggtttttgtcccattaaccgttggtggtggtatcaaggatatcgtcgatccggatggaacccatgttagcgctcttgaagtagcaagtctgtacttcagatcaggtgctgataaagtctctatcgggaccgattctgtttatgctgcagagaaatactatgcgaatgaaggaaaaggggatggtacatcgccaattgaaactatctcaaaagcttacggtgctcaagcagttgtaatttctgttgatcccaagagagtttatgttaacgatccaagtgaaactaaaaacaaaacaataaaaacaaaattccctaatgagaagggacaagatgtatgctggtaccaatgcacaattaaaggtggtagagagagtagagatattggtgtttgggaactagctagagcgtgtgaagcattgggtgctggtgaaattcttctaaattgtattgataaagatggttctaactcaggctatgatcttgaactcatcaaccatgctaaggaagctgtgaaaattcccgttattgcgtcttcgggtgcgggaaaccctgcacattttgaagaaggtttcaagcaatctgctgcagatgcttgtctgggtgcaggtatgttccacagagaagaatacactgtaaatgatgtaaaggaatacttattgaaaaaagggttgaaagttagagtagataaaaactaa

SEQ ID NO: 30338 - protein, 552 aa, Candida glabrata CBS138
MSTVHVIDVESGNLQSLTNAIEYLGFRVQLIKDSQDPELLKAEKLILPGVGNYGHVYENILSRGFEKPIREYIASGKPIMGICVGLQVLFNSSTESPSSGGFGYVNHRLSRFNDDEKPVPEIGWNSVIPEKDLFFGLDPYKRYYFVHSYAGILDAATESSLKADGWRIAKAKYGSEEFIAAVYKDNIFATQFHPEKSGLAGLHIIENFLKQAHPGLPAYSEDEKSLLGNDYSNYGLTRRIIACLDVRTNDQGDLVVTKGDQYDVREKSGDNDVRNLGKPVQLAQKYYEQGADEVTFLNITSFRDSPVKDTPMLEVLRQTAKKVFVPLTVGGGIKDIVDPDGTHVSALEVASLYFRSGADKVSIGTDSVYAAEKYYANEGKGDGTSPIETISKAYGAQAVVISVDPKRVYVNDPSETKNKTIKTKFPNEKGQDVCWYQCTIKGGRESRDIGVWELARACEALGAGEILLNCIDKDGSNSGYDLELINHAKEAVKIPVIASSGAGNPAHFEEGFKQSAADACLGAGMFHREEYTVNDVKEYLLKKGLKVRVDKN

SEQ ID NO: 30339 - DNA, 1659 bp, Kluyveromyces lactis NRRL Y-1140
  CDS (1)..(1659)
atgacagtcgtgcatattattgatgtggaatctggtaatttgcaatccttgcagaatgctatcaatcatttaggttacgagacaagattaatcaagtctgcttcagatccagagttacaaactgctgaaagaatcatcctgccaggtgtcggtaattttggccattttgtcgataacttaacttctcgtgggtttgagcaacctatcaaagattatattgcatccggaaggccgttgatgggtatttgtgttggcttgcaagcgcttttcgatggatcttctgaatctccttcaagcagagggttaggtttaatcccaggtactttgtccaaatttgatatcagtgaaggtaaaagtgttcccgaaattggatggaataccattattccacaggacgatctttcatttggtttagatccttataaaaggtactacttcgttcattcttttgctatgatcgtcgatgatgtacaacttgatgacttgcatagtaagggatggaaagttgctttgacaagatacggtaacgaaagatttgttgccgccattcacaaggataatgtgttttctacacaattccatccggagaaatctggtaaggccggtctagaaattatagataactttttgaaaggtattcacccagttacagagtacacagatgaacaaaaatctcttttagggaatgactatacaaactttggtttgacaagaagaataattgcttgtctcgatgtccgtacgaatgatcaaggtgatctagtggtaaccaaaggggaccaatacgatgtccgtgaaaaaacagaaggaggcaacgttagaaacttgggaaaacctgtagagctcgcacaacgttactatgaacaaggtgctgatgaagttactttcttaaatatcaccagtttcagaaactgtccattaaaggatactccaatgttggatgtgctaagacttgctgccaagactgtgtttgtaccactgacagtcggaggtggtatcaaagatgtcgtggatgttgacggcacaaaagtaccggctttagatgtggccggcatgtatttcagatctggtgctgataaggtttctattggtacagatgcagtgtttgctgcagaaaagtactatgctaacggagaaaagggtgatggaaaatctccaattgaaacgatttctaaagcttatggtgcacaagcggtggttatttctgtggaccctaaaagagtttatgttaacaataggaacgaaacccctaataaatgtttccaaactttatcgcctaatcctgaggggcaaaattggtgctggtatcaatgtacaatcaagggtggtagagaatccagagacctaggagcctgggaattggctcatgcatgtgaagcccttggtgctggtgagattctcctaaactgtattgataaagacggctcaaactcaggatacgatttggaattaatcgatcatattaaaagtgccgtttcaattcctgttattgcctcatcaggtgcagggaatccaggtcactttgaacaaggatttacaaagacaaaggctgatgcttgtttaggtgcaggtatgttccatagaggagaatacactgttaaccaggtcaaggattacctgatctctaaaggtttaaaagtcagaattgataacgagtaa

SEQ ID NO: 30340 - protein, 552 aa, Kluyveromyces lactis NRRL Y-1140
MTVVHIIDVESGNLQSLQNAINHLGYETRLIKSASDPELQTAERIILPGVGNFGHFVDNLTSRGFEQPIKDYIASGRPLMGICVGLQALFDGSSESPSSRGLGLIPGTLSKFDISEGKSVPEIGWNTIIPQDDLSFGLDPYKRYYFVHSFAMIVDDVQLDDLHSKGWKVALTRYGNERFVAAIHKDNVFSTQFHPEKSGKAGLEIIDNFLKGIHPVTEYTDEQKSLLGNDYTNFGLTRRIIACLDVRTNDQGDLVVTKGDQYDVREKTEGGNVRNLGKPVELAQRYYEQGADEVTFLNITSFRNCPLKDTPMLDVLRLAAKTVFVPLTVGGGIKDVVDVDGTKVPALDVAGMYFRSGADKVSIGTDAVFAAEKYYANGEKGDGKSPIETISKAYGAQAVVISVDPKRVYVNNRNETPNKCFQTLSPNPEGQNWCWYQCTIKGGRESRDLGAWELAHACEALGAGEILLNCIDKDGSNSGYDLELIDHIKSAVSIPVIASSGAGNPGHFEQGFTKTKADACLGAGMFHRGEYTVNQVKDYLISKGLKVRIDNE

SEQ ID NO: 30341 - DNA, 1773 bp, Debaryomyces hansenii CBS767
  CDS (1)..(1773)
atgaagacagtatacgttatagatgttgagagcggtaatttgcaatccttattcaatgccataaaacgcatagggggttatgatgttaagtttattcatgatgcaaaagaattcgccgactacaatgatagtattgaaaaattaatattcccaggtgtgggtaactatgctcattttatcaagcaattacacgatagagagttagtggatccaattactaagtatatcgagagtggtagggctcttatgggtatttgtgttggattacaagcatttttcgaaagtagtgaagagagtgataattcggaatatcagggtttgggatatttgaaatttggcttatccaaattcaataagtcagatccagtctttactcaaagaaaacaattgaaagcggttccgcatatcggctggaatagtgttaatacaatcaaggctaataataccactctttcgaagacaacgtctttttttggaatcaatacagttaataaatactattttgttcattcatacgcggctatactaaaagatgaacaacaagaaaaggtgatcagcgaagccatttcaaatggctgggatattgcttttgcaagatacggatcagaaatcttcttagcagcggtatcgtataagaacttcttcgccacgcagttccacccagaaaaatctggcgttgctggtttgaaagttatcaaaagcttcttggaaggctcaaggtttagtgaggtcactacatctgatgctcagccggttgataatattgaaaatactttgagtggattaaccagaagaattattgcctgccttgatgttagaagtaatgatgacggagatttggttgtcacgaaaggtgatcaatataatgttcgtgaatcgtccggagattctgatgaaagtaaggtaagaaacttaggaaaacctgttgaattagcaacgagatattacaatcaaggggctgatgaggttacgtttttaaatataacttcattccgtaattcacctttgaaggatttgcccatgttgaaagtcttgagtacagcagcagaaacaatctttgtacctttaacagtaggtggtggaattaaagatttagttgacccaatctctggtgaaaaagtgccagctgccaaggtagccagtttgtattttagatctggtgctgataaagtgagtattggctctgatgctgtcacaatagccgagaattattatgcgaacaacaaacataagacgggaactacttcgattgaaaccatttctgctacctttggtagccaggctgtggttatatctgttgacccaaagcgtaaatacgttctgtccccatctgaaaccacaatggaaaccattcatattcaggatcctctgaagtatggtccagcaggcgagaaatattgctattatcaagtgacttctcaaggtggaagagtaactcacgaattaggtgcgcttgagttatgtcttgcgtgtgaagatttaggtgctggtgaaattttattgaattcaattgatcatgatggttctaataaaggttttaatttggaattattaagacaagttaaagaaaaagcttcaatccctgttatagctagttctggtgctggaaagcctgaacatttccaagaagtttttgacatggattgtggaattgacgctgctttaggagctggtttatttcacagaggtgaatatgaagtcaacgatgttaagagatatttacaaaaagaatgctctatggatgtcaggttagatgacactgtggaattatag

SEQ ID NO: 30342 - protein, 590 aa, Debaryomyces hansenii CBS767
MKTVYVIDVESGNLQSLFNAIKRIGGYDVKFIHDAKEFADYNDSIEKLIFPGVGNYAHFIKQLHDRELVDPITKYIESGRALMGICVGLQAFFESSEESDNSEYQGLGYLKFGLSKFNKSDPVFTQRKQLKAVPHIGWNSVNTIKANNTTLSKTTSFFGINTVNKYYFVHSYAAILKDEQQEKVISEAISNGWDIAFARYGSEIFLAAVSYKNFFATQFHPEKSGVAGLKVIKSFLEGSRFSEVTTSDAQPVDNIENTLSGLTRRIIACLDVRSNDDGDLVVTKGDQYNVRESSGDSDESKVRNLGKPVELATRYYNQGADEVTFLNITSFRNSPLKDLPMLKVLSTAAETIFVPLTVGGGIKDLVDPISGEKVPAAKVASLYFRSGADKVSIGSDAVTIAENYYANNKHKTGTTSIETISATFGSQAVVISVDPKRKYVLSPSETTMETIHIQDPLKYGPAGEKYCYYQVTSQGGRVTHELGALELCLACEDLGAGEILLNSIDHDGSNKGFNLELLRQVKEKASIPVIASSGAGKPEHFQEVFDMDCGIDAALGAGLFHRGEYEVNDVKRYLQKECSMDVRLDDTVEL

SEQ ID NO: 30343 - DNA, 1662 bp, Yarrowia lipolytica CLIB99
  CDS (1)..(1662)
atgccaattatccacgtgatcaacgtcgagtctggcaacctgcggtctctggaaaacgccctcaacgtgctgggatacacggtggagtgggtctctagcccagaccagatcactgactccattgagaagctcattttccccggagttggcaactttggccactttgtgaaggagattgacgcccgaggattcattggccccctcaagaagtacattgagagcaaacggccgttgtttggcatctgtgtgggtctccaggctttttttgagggatccgaggagtccaagactgttgcaggactgggtcttgtgcccggtgttctgagcaagtttgacgataaggacaagagcgtgccccagattggctggaactcggtggatagccgagatttcgccgagcacaagtctctgtacggcatggtgccttcttccaagtactactttgtgcattcgtacgcttgtattctggatgaggccgtcaagaacaagatcgaggctgcaggctgggatattgccacgtcacaatatggtaaccagacatttgtggctgctatttccaaggacaatgttgttgctacccaattccaccccgagaagtctggagcagccggtctgcgtgtgattgacgctttcctcaagggtaagaagtacgtggaggaccctgtaattgctccccagacatcgttcggtctcacaaagcgagtcatcgcctgtctggacgttcgaaccaacgaccagggtgatcttgttgttaccaagggagaccagtatgacgtgcgagagaagactggagagggccacgtacgaaacctcggaaagccagtttccatggccgaaaagtactacaaggacggagccgatgaggtcactttccttaacattacttcgttccgagactgccctgttcaggatcttcccatgctggaggttcttcgacagacttccaagactgtttttgtgcccctgactgtcggaggtggtatccgagacgtaactgactcttctggaaacgtcaccaccgctctacaggttgctacccagtactttatgtctggtgccgacaaggtgagtattggtagtgatgcggtctttgctgccgaggagtactacaagagcggcaagaagctatctggtaagacccccatggagactatttccgccgcatacggagtccaggccgttgttgtttctgtcgaccccaagcgagtctacgttgatgctcccctgaccgacagagtttgcattgagaccaaatacccctctgccgacggaaagaagtactgctggtaccagtgcaccgtcaagggcggacgagaggcccgagatcttggcgttttcgagctcgtccaggcgtgcgaggctctgggagctggagagattctgctcaactgcattgataaggacggaaccaactccggtttcgatcttgagctcatcgaccacgtcaagtctgccgtcaagatccccgtcattgcttcctccggcgctggaaaccccggtcacttcgaggaggtcttccgagagacctctgctgacgcggctcttggagctggtatgttccaccgaggagagtactccgtcaaggatgtcaaggacttcctggagaacaagggcgaggttgtgcgagcctttgagccaattgagctggttcacgttgagtaa

SEQ ID NO: 30344 - protein, 553 aa, Yarrowia lipolytica CLIB99
MPIIHVINVESGNLRSLENALNVLGYTVEWVSSPDQITDSIEKLIFPGVGNFGHFVKEIDARGFIGPLKKYIESKRPLFGICVGLQAFFEGSEESKTVAGLGLVPGVLSKFDDKDKSVPQIGWNSVDSRDFAEHKSLYGMVPSSKYYFVHSYACILDEAVKNKIEAAGWDIATSQYGNQTFVAAISKDNVVATQFHPEKSGAAGLRVIDAFLKGKKYVEDPVIAPQTSFGLTKRVIACLDVRTNDQGDLVVTKGDQYDVREKTGEGHVRNLGKPVSMAEKYYKDGADEVTFLNITSFRDCPVQDLPMLEVLRQTSKTVFVPLTVGGGIRDVTDSSGNVTTALQVATQYFMSGADKVSIGSDAVFAAEEYYKSGKKLSGKTPMETISAAYGVQAVVVSVDPKRVYVDAPLTDRVCIETKYPSADGKKYCWYQCTVKGGREARDLGVFELVQACEALGAGEILLNCIDKDGTNSGFDLELIDHVKSAVKIPVIASSGAGNPGHFEEVFRETSADAALGAGMFHRGEYSVKDVKDFLENKGEVVRAFEPIELVHVE

SEQ ID NO: 30345 - DNA, 627 bp, Listeria monocytogenes str. 4b F2365
  CDS (1)..(627)
atgattgttattattgactacgatacaggaaatacgaaaagcatcagtaaagcccttgattttatcgggttacaaaacaaaatttctagtgataaaacagaaatcgctcaagctgatggtgttattttgcccggagttggtgcttatccagaagccatgcaagaactcactcgacgcggattagataaaacattaaaagaaattgctaccgctggcaaaccaattcttggcgtttgtcttggtatgcaactattactcgaatcaagtaacgaacatagctatactaaagggctcggcctcattcccggtcatgtcgaaatgctaccagacgaatccgaatttgccgttccgcacatgggctggaatcaattacaaatcaaacgcaccaccccgcttacacaaaacatcgctggagaatatgtctattacgttcattcctactatgccaactgtccagaagcttacattatcgcaacaagtggttattctattgatatccctggcatgataaataacggcaatatttacggagcacagttccatcctgaaaaaagcggccaaatcggtcttgaaattttaaaaggttttaaggaggtcattcgttcatgcaaatcttcccagcaatag

SEQ ID NO: 30346 - protein, 208 aa, Listeria monocytogenes str. 4b F2365
MIVIIDYDTGNTKSISKALDFIGLQNKISSDKTEIAQADGVILPGVGAYPEAMQELTRRGLDKTLKEIATAGKPILGVCLGMQLLLESSNEHSYTKGLGLIPGHVEMLPDESEFAVPHMGWNQLQIKRTTPLTQNIAGEYVYYVHSYYANCPEAYIIATSGYSIDIPGMINNGNIYGAQFHPEKSGQIGLEILKGFKEVIRSCKSSQQ

SEQ ID NO: 30347 - DNA, 561 bp, Picrophilus torridus DSM 9790
  CDS (1)..(561)
atgatagcaataatcgactacggctccgggaatcttgcaagcgttgaaaaagcactgcatggtgttgtgacgtctgatccatataaaatagatatggcggacaagattgtgtttcccggcgcaggttcattttcagcagctgtctctggcataaaaaacataagagacattataatagaaaagataaggaatggaacgccttaccttggcatatgccttggccttgagattcttttttctgaaagtgaggaggggcctggcaccggcctgtcattttttaatgaaaggctaaaaaggtttaaaaaaggcattcacatgggatggaacactgttgagttcaatgataatattatattttctggaataaaaaaaggtgaatatttttactttgtgcatcgttactatgcaccattaggttcctatacatgcggcaaaacgttttttaatggctattttacctcatttataaacataaataatatatatgccgtgcagttccatcctgaaaaatctggcgagccgggattaaaactcttaaggaattttggtgagcttgcatga

SEQ ID NO: 30348 - protein, 186 aa, Picrophilus torridus DSM 9790
MIAIIDYGSGNLASVEKALHGVVTSDPYKIDMADKIVFPGAGSFSAAVSGIKNIRDIIIEKIRNGTPYLGICLGLEILFSESEEGPGTGLSFFNERLKRFKKGIHMGWNTVEFNDNIIFSGIKKGEYFYFVHRYYAPLGSYTCGKTFFNGYFTSFININNIYAVQFHPEKSGEPGLKLLRNFGELA

SEQ ID NO: 30349 - DNA, 630 bp, Bacillus thuringiensis serovar konkukian str. 97-27
  CDS (1)..(630)
ttgattgccattatagattatggaatgggaaatattcgtagtgtagaacaagcattaaaatacattggagcagcgtacatcgtaacgagtgataaagaggagatttttagaagtgatggagtgattttaccaggagtaggtgcatttccaaaagctatggatatattggaagaaaaagatttagttcgtgtgttacaagaaattgggtgttcaaggaaaccacttctaggcatttgcttaggaatgcagcttttatttgaaaaaagtgaggaactccaagattgtaacggattaagtttattgccaggtgttattcgaaagttaaaagttccttataaaattcctcatatgggatggaatgagttaaagaaagaaggagaaatagcgctttggaatggagtagaggacagttctttcgtatattatgtccactcttattacgcagattgtccaaatgaaattgtgtatggaataagtgattatggagtgaaagtacctggttttgtagcaaaaggaaatatatatggtgcgcagtttcatcctgaaaaaagtggtgacattggcatgcaaatgttgaaaaattttaaaggagtggtagaaacatggaaatcttcccagctatcgatttaa

SEQ ID NO: 30350 - protein, 209 aa, Bacillus thuringiensis serovar konkukian str. 97-27
MIAIIDYGMGNIRSVEQALKYIGAAYIVTSDKEEIFRSDGVILPGVGAFPKAMDILEEKDLVRVLQEIGCSRKPLLGICLGMQLLFEKSEELQDCNGLSLLPGVIRKLKVPYKIPHMGWNELKKEGEIALWNGVEDSSFVYYVHSYYADCPNEIVYGISDYGVKVPGFVAKGNIYGAQFHPEKSGDIGMQMLKNFKGVVETWKSSQLSI

SEQ ID NO: 30351 - DNA, 618 bp, Acinetobacter sp. ADP1
  CDS (1)..(618)
atgacccgcattgcccttcttgattatggtatgggaaatttacactctgctgctaaagcacttgagcatgtcggggcaaccgtagatgtcaccaatgatccaaagctgattgctaaagctgataaaatcgtatttccaggtgtgggtgcaatgcgcgactgtatgcagggcatgcacgaagcaggcattgatgaagtggtacgtcaggctgtatttaacaagcctgtattggccatctgtgttggcatgcaggcactgcttgaaagctctgaagaaaatggcggtgttcctgcattaggtatttttgaaggtgcagttaaacattttcctgaccttggtcacttaaaagttccacatatgggttggaatcaggtatatcagaacgatcctgctcacccgatgtggaacaatatcgatcaagacagccgcttttactttgtacatagttattatgtagaacccaaacagtctgatctgattgcagcaacctgcgattacggtctgcaattttgcaccgcaattcataaagacaatttgtttgccacccagtttcatccagagaaaagtcacactgctggcttacaactgttaaaaaactttgtggaatggaatatttga

SEQ ID NO: 30352 - protein, 205 aa, Acinetobacter sp. ADP1
MTRIALLDYGMGNLHSAAKALEHVGATVDVTNDPKLIAKADKIVFPGVGAMRDCMQGMHEAGIDEVVRQAVFNKPVLAICVGMQALLESSEENGGVPALGIFEGAVKHFPDLGHLKVPHMGWNQVYQNDPAHPMWNNIDQDSRFYFVHSYYVEPKQSDLIAATCDYGLQFCTAIHKDNLFATQFHPEKSHTAGLQLLKNFVEWNI

SEQ ID NO: 30353 - DNA, 591 bp, Erwinia carotovora subsp. atroseptica SCRI1043
  CDS (1)..(591)
atgaaggtcgtcattcttgataccggctgcgccaacctctcttcggtgacctacgccgtgcagcggttggggtatacgccggttgttagccgcgaggccgagattgtcctgcaagcagacaagctatttctgccgggtgttggtaccgcgcaggccgcgatgaatcaactggaagagcgcgatctaatcgcgctgatcaaagcctgtacccaaccggttctcggcatttgcctcggcatgcagttgctggggacacacagcgacgaaagtggtggcatccccacgctggggattgtcgatacgccagtaaaaaaaatgatagaccacggcttgccactgccgcacatgggctggaatcaggtgattccgaaggccgggcatcgtttgttccgcgatattgatgatggcgcctatttctatttcgttcacagctatgccatgccagtctgcgaaaacacgattgcacaagccaactacggcgaagccttcactgccgcgctggaaaaagataacttctttggcgtgcagttccaccccgagcgttctggtgctgcgggcgcgcaactgctgaaaaactttctggagatgtag

SEQ ID NO: 30354 - protein, 196 aa, Erwinia carotovora subsp. atroseptica SCRI1043
MKVVILDTGCANLSSVTYAVQRLGYTPVVSREAEIVLQADKLFLPGVGTAQAAMNQLEERDLIALIKACTQPVLGICLGMQLLGTHSDESGGIPTLGIVDTPVKKMIDHGLPLPHMGWNQVIPKAGHRLFRDIDDGAYFYFVHSYAMPVCENTIAQANYGEAFTAALEKDNFFGVQFHPERSGAAGAQLLKNFLEM

SEQ ID NO: 30355 - DNA, 654 bp, Propionibacterium acnes KPA171202
  CDS (1)..(654)
atgccggtcgtgtccccagcactaaaggcgctctcaatgtctgatccggtgcgggtcggcattatcgaccatggatcaggaaaccttcactccgctagacgtgcgttgcgtcaggtaggtgccgaggtgatcgtttccaacgacccgagtgccctactcgataccgacgctctcgtcctccccggagtgggagcgttagcggtgtgtatgacagggttgcgggctatgggcggggcccgtcttgtccgtcaatgggttgacgagggacgacctctgctgggtatctgcgtgggccaccagatgcttttcgagcgaggacgtgaacgcgacgttgacgtcaagtgccttggtgttcttcctggcgtcgttgaggagctgccagcagagcgactgccccatatggggtggaacacagtgacaccggccaccgactcagccttattccagggcgtgcaagagaggttctacttcgtccattcctatggtgtggtcgttaccggacctcacgaccacttcaccactgcgacccatcagggagccacctttgtcgcagccgcagagtatggcccggtaacgtccacgcagttccatcctgaaaagtcggggatagcaggtctcgctttgctcacacgctggctgaatcagctgagttga

SEQ ID NO: 30356 - protein, 217 aa, Propionibacterium acnes KPA171202
MPVVSPALKALSMSDPVRVGIIDHGSGNLHSARRALRQVGAEVIVSNDPSALLDTDALVLPGVGALAVCMTGLRAMGGARLVRQWVDEGRPLLGICVGHQMLFERGRERDVDVKCLGVLPGVVEELPAERLPHMGWNTVTPATDSALFQGVQERFYFVHSYGVVVTGPHDHFTTATHQGATFVAAAEYGPVTSTQFHPEKSGIAGLALLTRWLNQLS

SEQ ID NO: 30357 - DNA, 630 bp, Leifsonia xyli subsp. xyli str. CTCB07
  CDS (1)..(630)
gtgagccgtcccgtcgtcgtcttcgagtacggctcgggcaacgtccactcggcggtcaaggcgctggaagcggccggggcggatgtcgaactcacccgcgaccggcggcgcgcgcaggaggccgatggtctggttgtgccgggtgtcggcgcattcgccgcggtggtcgatcggcttcgggccgcccacggcgacgagatcatcgagcggcggctggcgggcgggcgtccggtgctcgggatctgtgtcgggatgcaggtgatgttcgagcgcggaacggagcacggacaggagaccgcagggctaggcgagtggccgggcgctgtcgagcccctgtgcgccggggtcgtgccccacgtgggctggaacgcagtggaggccccggcggactcggtgctgttcgacggtgtctgggacgagcgattctacttcgtccactcctacgccgcgcagcactggacgctggaggcgaccggtccgttcccgaagccgcgcgtcagctgggccgagcacggttcgcggttcgtcgccgcggtggagaacggtccgctgagcgcgacgcagttccacccagagaagtcgggcagcgccggtctccggctgctggccaactggatcgggtcgctgtag

SEQ ID NO: 30358 - protein, 209 aa, Leifsonia xyli subsp. xyli str. CTCB07
MSRPVVVFEYGSGNVHSAVKALEAAGADVELTRDRRRAQEADGLVVPGVGAFAAVVDRLRAAHGDEIIERRLAGGRPVLGICVGMQVMFERGTEHGQETAGLGEWPGAVEPLCAGVVPHVGWNAVEAPADSVLFDGVWDERFYFVHSYAAQHWTLEATGPFPKPRVSWAEHGSRFVAAVENGPLSATQFHPEKSGSAGLRLLANWIGSL

SEQ ID NO: 30359 - DNA, 1593 bp, Desulfotalea psychrophila LSv54
  CDS (1)..(1593)
atgaaagtaacgctattggattatggggctggcaatgttcgtagtatacgtaatgctattcgggcgttaggatgtgaaattgtagaggtacagcatcccgaagatattttaacggcagataaactgatctttccgggggtcggaagctttggctctgtgatgcacaccctgcgtgaccgtggctatatagaacctctcaagcgaagaatagaggaagacaagccctttcttggcatctgtgttgccctgcaggccctgtttgaaggcagtgaagagacccccggcgtggcggggcttggcatcctgccggggcagatcaaaaaatttgtgcgctcggccctatcggtgccgcagattggctggaatggcattcatctcctcaaagaatctccctcctttgctggctatgaggaagaaaagctctattttgttcactcctaccatgcaccccttgatactgtgcctgaggattgggccttaacagcaacagattacggtactcgctttatctcggcggtggaaaagggaaatgttaccgcatttcagttccacccggaaaagagcggacaagccggtttgaaccttctccagaatttcctctcctcccagaagaggccctcgcagactccaatcgtaccgattgagatagagaagaagacagagcatgcaaagcgtgttattgcctgccttgatgtacgctccaatgataacggtgatcttgttgtgaccaagggcgatcagtatgatgttcgtcaggagggtgaggtgcgaaatctgggcaaaccggtggatcttgcccgtcgctactatcaggagggggccgacgaggtaactttcctcaatataacaggctttagagattttcccatggaggaccagcccatgattgaggtgctgcagaaggcctctgaaaatgtatttgtaccccttaccattggtggtggcatccgtgactttaccgatagcaatggtaagtattactctgcccttgacgttgccgctcagtatttcagatccggggccgataaaatatctattggctccgatgccgtagccattgttgaggaatatctggccaccggcaagaagagcggcaagagctccatcgaacagatctctgccgtctatggtgtgcaggcagttgttatctctgtagatccgcgcagagtctacgtacaaagcccggacgagactactcatacctgtgttaaaacagggagtttaggacctaatggcgaagagtactgttggtatcagtgtacgattaagggcggtcgggagggaagtaagctcgatgctgtccagttggtgcagggctgtgaggccctgggggcgggagagattctgctcaactgtattgataaggatggtaccaacgatggttttgagcttgaactgatctctctggtcaagaaggctgtctccattccggttattgcctccagtggtgctggctctgcccgggattttgtcgaggtcttccgagaaacagatgccgatgcggctctggcagcgggaatctttcacagagaagaggttccaatctctgaggtaaagacaacccttatgcaggcaggaatctcctgtcgctga

SEQ ID NO: 30360 - protein, 530 aa, Desulfotalea psychrophila LSv54
MKVTLLDYGAGNVRSIRNAIRALGCEIVEVQHPEDILTADKLIFPGVGSFGSVMHTLRDRGYIEPLKRRIEEDKPFLGICVALQALFEGSEETPGVAGLGILPGQIKKFVRSALSVPQIGWNGIHLLKESPSFAGYEEEKLYFVHSYHAPLDTVPEDWALTATDYGTRFISAVEKGNVTAFQFHPEKSGQAGLNLLQNFLSSQKRPSQTPIVPIEIEKKTEHAKRVIACLDVRSNDNGDLVVTKGDQYDVRQEGEVRNLGKPVDLARRYYQEGADEVTFLNITGFRDFPMEDQPMIEVLQKASENVFVPLTIGGGIRDFTDSNGKYYSALDVAAQYFRSGADKISIGSDAVAIVEEYLATGKKSGKSSIEQISAVYGVQAVVISVDPRRVYVQSPDETTHTCVKTGSLGPNGEEYCWYQCTIKGGREGSKLDAVQLVQGCEALGAGEILLNCIDKDGTNDGFELELISLVKKAVSIPVIASSGAGSARDFVEVFRETDADAALAAGIFHREEVPISEVKTTLMQAGISCR

SEQ ID NO: 30361 - DNA, 639 bp, Symbiobacterium thermophilum IAM 14863
  CDS (1)..(639)
atggcccggatcgtcatcgtggactacgggatgggcaacctcgccagcgtccggaacgccctgcgggcggtgggcttcgaggcggcggtgagcgacgacccggcggcggtggcgggggcggacggcctggtgctgcccggcgtgggcgcgttcggcaccggcatgcagaacctggcccgccgcggcctcgatcaggccgtgcggcaggcggccgcagccggccggccggtcctgggcatctgcctggggatgcagctcctcctcgcggagggcgacgagggcggcccgcgcccggggctgggcctcctggaggggcgggttgcgcgccttcccgacgggctgccccttccccagatcggctggaacctggtggagccgcagcgggaccacccgctcttcgccgggctgccgacccccttctgggcctatttcgaccacgcttacgcggtggagggcgaaccgccgtccacggcgctggccctgaccgactacggccgcacctacccctcggtggtgggccgcggcaacctgctgggtatccagttccatcccgagaagtcctcccgggcgggactccggatgctggccaactgggggagaatggtatgcgacttgatctctacccggccatcgacctga

SEQ ID NO: 30362 - protein, 212 aa, Symbiobacterium thermophilum IAM 14863
MARIVIVDYGMGNLASVRNALRAVGFEAAVSDDPAAVAGADGLVLPGVGAFGTGMQNLARRGLDQAVRQAAAAGRPVLGICLGMQLLLAEGDEGGPRPGLGLLEGRVARLPDGLPLPQIGWNLVEPQRDHPLFAGLPTPFWAYFDHAYAVEGEPPSTALALTDYGRTYPSVVGRGNLLGIQFHPEKSSRAGLRMLANWGRMVCDLISTRPST

SEQ ID NO: 30363 - DNA, 630 bp, Bacillus cereus ZK
  CDS (1)..(630)
ttgattgccattatagattatggaatgggaaatattcgtagtgtagaacaagcattaaaatacattggagcagcgtacatcgtaacgagtgataaagaagagatttttagaagtgatggagtgattttaccaggagtaggtgcatttccaaaagcgatggatatattggaagaaaaagatttagttcgtgtgttacaagaaattgggcgttcaagaaaaccacttctaggcatttgcttaggaatgcagcttttatttgaaaaaagtgaggaactccaagattgtaacggattaagtttattgccaggtgttattcgaaagttaaaagttccttataaaattcctcatatgggatggaatgagttaaagaaagaaggagaaatagcgctttggaatggagtagaggacggttctttcgtatattatgtccactcttattacgcagattgtccaaatgaaattgtgtatggaataagtgattatggagtgaaagtacctggttttgtagcaaaaggaaatatatatggtgcacagtttcatcctgaaaaaagtggtgacattggcatgcaaatattgaaaaattttaaaggagtggtagaaacatggaaatcttcccagctatcgatttaa

SEQ ID NO: 30364 - protein, 209 aa, Bacillus cereus ZK
MIAIIDYGMGNIRSVEQALKYIGAAYIVTSDKEEIFRSDGVILPGVGAFPKAMDILEEKDLVRVLQEIGRSRKPLLGICLGMQLLFEKSEELQDCNGLSLLPGVIRKLKVPYKIPHMGWNELKKEGEIALWNGVEDGSFVYYVHSYYADCPNEIVYGISDYGVKVPGFVAKGNIYGAQFHPEKSGDIGMQILKNFKGVVETWKSSQLSI

SEQ ID NO: 30365 - DNA, 585 bp, Mannheimia succiniciproducens MBEL55E
  CDS (1)..(585)
atgatcatcatcgacacaggctgtgcaaacctgtcatctgtaaaatttgcattcgatcgcttaaatattaaagcggaaattagccgtgatattgcaaccattaaatcggcggataaattgttgttgcccggtgtgggcacggcaatggcggcgatgaaaatcttgcaagatcgcaatttaatcgaaaccatccaaaacgccacccaacctatgctcggtatctgtttaggtatgcagctgatgacggagtattccagcgaaggcaatgtgccgaccctaagcctgatgagcgggcatacggatttaatcccgaacacgggtttaccgctgccgcatatgggctggaacaaagtgcgctacgagcaagatcacccgctgtttgccggtatcgagcaagacagccatttctattttgtacatagctatgcggtgttgccgaatgaacataccatcgccaccagcgattacggtgtgccttttagtgcggcgttaggctgtaaaaatttctacggcgtgcagttccatccggaacgttccggcaaaaacggcgcgcagttgttgaaaaactttgtggagaatctgtaa

SEQ ID NO: 30366 - protein, 194 aa, Mannheimia succiniciproducens MBEL55E
MIIIDTGCANLSSVKFAFDRLNIKAEISRDIATIKSADKLLLPGVGTAMAAMKILQDRNLIETIQNATQPMLGICLGMQLMTEYSSEGNVPTLSLMSGHTDLIPNTGLPLPHMGWNKVRYEQDHPLFAGIEQDSHFYFVHSYAVLPNEHTIATSDYGVPFSAALGCKNFYGVQFHPERSGKNGAQLLKNFVENL

SEQ ID NO: 30367 - DNA, 639 bp, Bacillus licheniformis DSM 13
  CDS (1)..(639)
atgatcggtgtcatagattacggaatgggaaacctgtacagcgtttctaaagcgcttgaacggattgatgccccttattttgtgtccgagcatccggatgaactgaagagagcggacagctatatccttccgggagtcggcgcttttcgggatgcaatggagattttaaccgagaacggcctgaaaacatttattcaagctgccgcaaacgaaggaaaacctcttctcggcatatgcctcggcatgcagcttttgtttgaagaaagcgaagaacacggggcgtcagaagggctcggcctgttgaaaggaaaagtcgttaaactgaaagactgtgatcaagcgggaaatcgcttaaaagtgcctcacatgggctggaatcttctcaaagtccaccgcgactcgccgcttttgccaaaagcgaaagaaggattcgcgtatttcgttcattcgtattatgtcagcggaatcgaagaggaagctttgcttgcaagcgccgaatacggtgtgtgtgtacccgctgtcgtcggtcttggcaatgtatacggggcccagttccatccggaaaagagcagtacggtcggcatgttgatcttagagcggttcaagcagtttacacaagaacagaaggtgaaaaaatga

SEQ ID NO: 30368 - protein, 212 aa, Bacillus licheniformis DSM 13
MIGVIDYGMGNLYSVSKALERIDAPYFVSEHPDELKRADSYILPGVGAFRDAMEILTENGLKTFIQAAANEGKPLLGICLGMQLLFEESEEHGASEGLGLLKGKVVKLKDCDQAGNRLKVPHMGWNLLKVHRDSPLLPKAKEGFAYFVHSYYVSGIEEEALLASAEYGVCVPAVVGLGNVYGAQFHPEKSSTVGMLILERFKQFTQEQKVKK

SEQ ID NO: 30369 - DNA, 600 bp, Legionella pneumophila subsp. pneumophila str. Philadelphia 1
  CDS (1)..(600)
atgattgctgtgattgatgtcagtgggaataatttaacttctctgacaaatgccttgattcgattgggagggcattttgcactgacccatgatgctgaagaaatacaaaaagcaagccatgtcattttgccaggggttggaacagcacgttctggtatgacagctttgcagcaaaatgggctaatagacgttttaagaaccttaacccaaccacttcttggcatctgtcttggaatgcaattattgcttgaatacagcgaagaagacgacataccctgcctgggtttgattcctggagttgcagagttattaaaagctgaaagaaatcatcctgttcctcatatgggatggaacaatcttcattggcaaaaaacatcatcattacaacaaggattaaataatagtgattatgtttattttgttcatagctatgctctaaaagcagataattatgcattagctcgatgtcagtatcatgaagagttcactgcagttgtaaaaaaaggtaatttttatggtatgcaatttcatccagaaaaatcagccaatgttggcatggtattactaaataactttttatctttggagtctacatgttag

SEQ ID NO: 30370 - protein, 199 aa, Legionella pneumophila subsp. pneumophila str. Philadelphia 1
MIAVIDVSGNNLTSLTNALIRLGGHFALTHDAEEIQKASHVILPGVGTARSGMTALQQNGLIDVLRTLTQPLLGICLGMQLLLEYSEEDDIPCLGLIPGVAELLKAERNHPVPHMGWNNLHWQKTSSLQQGLNNSDYVYFVHSYALKADNYALARCQYHEEFTAVVKKGNFYGMQFHPEKSANVGMVLLNNFLSLESTC

SEQ ID NO: 30371 - DNA, 591 bp, Bacteroides fragilis YCH46
  CDS (1)..(591)
atgaaagtagcagttatcaaatataatgcaggcaacatccgttctgtggactatgccttgaagcgcttaggggtggaagcagtgattacatctgataaagaggtgctgaaagctgccgataaagtgatctttccaggggtgggagaggccgagactaccatgcttcatctcaaggagagtggcatggatcgtttcattaaagaactccgtcagccggtgctgggcatttgcctgggcatgcaactgatgtgccgcttctccgaagaggggaatgtcgattgtctgggtattttcgataccgatgtgaaacgttttgctcctcgaaagcacgaggaaaaagttccccacatgggatggaataccatcagctgcctgaagagtgacctgttcaaaggattcacccgtgatgaatttgtctatttcgtacatagttattatgtgcccgtcagcgaatttaccgctgccgaaaccgattacatccggcctttcagtgccgctttgcataaagataatttctatgccacccagtttcatcccgaaaaaagcggtgaggcgggcgaaagaattataaagaatttcctggagctttag

SEQ ID NO: 30372 - protein, 196 aa, Bacteroides fragilis YCH46
MKVAVIKYNAGNIRSVDYALKRLGVEAVITSDKEVLKAADKVIFPGVGEAETTMLHLKESGMDRFIKELRQPVLGICLGMQLMCRFSEEGNVDCLGIFDTDVKRFAPRKHEEKVPHMGWNTISCLKSDLFKGFTRDEFVYFVHSYYVPVSEFTAAETDYIRPFSAALHKDNFYATQFHPEKSGEAGERIIKNFLEL

SEQ ID NO: 30373 - DNA, 642 bp, Burkholderia mallei ATCC 23344
  CDS (1)..(642)
atgaaaacttcgattgcaattgtggattacggaatgggcaacctgcgctcggtcgcgcaggcgctcatgaaggcggagccggcggccgacgtgaagatcgtcgaccggcccgaggcgattcgcgcggccgaccgcgtggtgctgccgggccagggcgcgatgcccgactgcatgcggtgcctcggcgaatccggcttgcaggaggcggtggtcgaggcgtcgcgcacgaagccgctgctcggcgtatgcgtcggcgagcagatgctgttcgactggagcgcggaaggcgacacgaaggggctcggcctgctgccgggcaaggtggtgcgcttcgcgctcgagggccggctgcaggacgacggctcgcgcttcaaggtgccgcagatgggctggaaccgggtgcgccagacccaggcgcatccgttgtgggacggcgtgccggatgacgcctatttctacttcgtgcacagttattacgtggtgccggacaacccggcgcacacggcgggcgagaccctgtacggcgacgttttcacgtccgcggtcgcgcgcgacaatctcttcgcgacccaatttcaccccgaaaagagcgccgaagtggggttgcggctgtaccggaattttgtccactggaacccctga

SEQ ID NO: 30374 - protein, 213 aa, Burkholderia mallei ATCC 23344
MKTSIAIVDYGMGNLRSVAQALMKAEPAADVKIVDRPEAIRAADRVVLPGQGAMPDCMRCLGESGLQEAVVEASRTKPLLGVCVGEQMLFDWSAEGDTKGLGLLPGKVVRFALEGRLQDDGSRFKVPQMGWNRVRQTQAHPLWDGVPDDAYFYFVHSYYVVPDNPAHTAGETLYGDVFTSAVARDNLFATQFHPEKSAEVGLRLYRNFVHWNP

SEQ ID NO: 30375 - DNA, 654 bp, Methylococcus capsulatus str. Bath
  CDS (1)..(654)
atgtcttcggtggcggtcatcgattacggcatggggaatctccattccatcgccaaggcgctccagcatgcagacgcaaacgccgctgtcacggtcacgtccgatccggacgtgatcctcgcgagtgatcgcgtggtgttccccggggtgggagccatgcgtgactgcatggcgcacctcgccgagcggcgattggagcaggttgtccgccgcgccgccgctgagaagccgttcctcggcatctgtctcggcatgcaggcgttgcttgaagagagcgaggagaacggcggcacccgctgcctcggcctcattacggggcgggtgctgcggttcccggaagggctcaccggtgctgccggcgaaccgctcaagatcccgcacatgggctggaaccgtgttcatttcagcgacccatcccatccgctttgggccggtatcccggcggagagctggttctatttcgtgcatagctattacgcggcgcccgccgatccggccgacgtcgccgcgaccagcgactatcccaccccgtttgcggcggccgtggcgcggggcaaggttttcgcggtgcagttccatcccgaaaagagccaggccgccggtttgcgtctgctggccaattttctccggtgggaaccttggtcatcccgttga

SEQ ID NO: 30376 - protein, 217 aa, Methylococcus capsulatus str. Bath
MSSVAVIDYGMGNLHSIAKALQHADANAAVTVTSDPDVILASDRVVFPGVGAMRDCMAHLAERRLEQVVRRAAAEKPFLGICLGMQALLEESEENGGTRCLGLITGRVLRFPEGLTGAAGEPLKIPHMGWNRVHFSDPSHPLWAGIPAESWFYFVHSYYAAPADPADVAATSDYPTPFAAAVARGKVFAVQFHPEKSQAAGLRLLANFLRWEPWSSR

SEQ ID NO: 30377 - DNA, 636 bp, Nocardia farcinica IFM 10152
  CDS (1)..(636)
gtgacgaggaaatccgtcgccctgctggactacggatcgggcaacctgcactccgccgaacgcgccctggtgcgcgcgggcgccgacgtgcgggtcaccgccgaccccgacgccgcgctggccgtcgacggcctcgtggtgcccggcgtcggcgcgttcgcggcgtgcatggcggggctgcgcgcggtgcgcggggagaagatcatcggccagcggctcgccggcggccggccggtgctcggcatctgcgtcggcatgcagatcctgttcgagcgcggggtggaattcggcgtggagaccgagggctgcgcggagtggccgggcgtggtcgagcgcctcgacgcgccggtgctgccgcacatgggatggaacaccgtcagcgcgcccgcggacagcgtgctcttcgccgggatggacgccgacacccgcttctacttcgtgcactcctacgccgcgcagcggtgggagctgccgccgaacgagcacttcgccgcacccaagctgacctgggccgagcacggcgtgcggttcctggccgccgtggagaacgggccgctgtcggccacccagttccatccggagaagtccggcgacgcgggcgcgcagctgctgcgcaactgggtcgactcgctctga

SEQ ID NO: 30378 - protein, 211 aa, Nocardia farcinica IFM 10152
MTRKSVALLDYGSGNLHSAERALVRAGADVRVTADPDAALAVDGLVVPGVGAFAACMAGLRAVRGEKIIGQRLAGGRPVLGICVGMQILFERGVEFGVETEGCAEWPGVVERLDAPVLPHMGWNTVSAPADSVLFAGMDADTRFYFVHSYAAQRWELPPNEHFAAPKLTWAEHGVRFLAAVENGPLSATQFHPEKSGDAGAQLLRNWVDSL

SEQ ID NO: 30379 - DNA, 642 bp, Legionella pneumophila str. Lens
  CDS (1)..(642)
atgagttcagtttcaattttagattatggggtaggcaatttattaagtgtagctcgagcttttcaatattttgatgcgtctgtcaatttagtgagcacacccgaggaaattatgagtgccgatcggttggttttgccaggagtaggcgcttttgaagatgggatgaaaggattaactacattaaattttatagaacccataaagcaatttgcacggagtggaaaaccttttctgggaatatgtcttggcatgcagatgatgctttccaaaagtactgaatttggacaacatgaaggtctgggtctaattgctggcgaggttgttagcgtcccttcacatggagttgatggtcaattgcataaaatacctcatataggctggaatgaactggtttccacctcggaaggcgaggattggtgtcatactatcctgaaaaatataccattaaattcttcagtatattttgttcattcttttatggccatgcctagtaatcctaaaaagcgtctggctgatactttatatgatggtcaggctattagcgcagtaataaaagatgaaaatatgtacggatgccaatttcatcctgaaaaaagcggggaagtaggattaagcattattcaacagtttttgcagatttag

SEQ ID NO: 30380 - protein, 213 aa, Legionella pneumophila str. Lens
MSSVSILDYGVGNLLSVARAFQYFDASVNLVSTPEEIMSADRLVLPGVGAFEDGMKGLTTLNFIEPIKQFARSGKPFLGICLGMQMMLSKSTEFGQHEGLGLIAGEVVSVPSHGVDGQLHKIPHIGWNELVSTSEGEDWCHTILKNIPLNSSVYFVHSFMAMPSNPKKRLADTLYDGQAISAVIKDENMYGCQFHPEKSGEVGLSIIQQFLQI

SEQ ID NO: 30381 - DNA, 618 bp, Leuconostoc mesenteroides subsp. mesenteroides ATCC 8293
  CDS (1)..(618)
atggcgattattatcgtagactatggcgcgggtaatattagaaatgtcatgaaagcaattgaatatacaggattaaatgccaaagtttctcaagatcctgccgagattgctgccgctgatggtctggtagtgccaggagttggcgcttttgcctcagcaatggataaacttcgagaacgtaatttggttgaaccaataaaacagttttcaaatagcggtaaaccattgttgggtgtttgcttagggatgcagttactttttgactcatcaactgaatttggtgaaacgagaggtcttgggctaattcccgggcaagtggttgaattacctaaacaagagaattataaagtaccgcaaatgggctggaatcagaacaaagtgagccaaatcaaccaaatcactcgaacaatgaatgataaatatacttactttgtacatagctattatgcggtaacggattcaaaatatattgcggcaactgttaattatggaaaagttgatgtaccaagtgttgtggttaacaaaaatgtgattggtgcccaatttcatccagaaaaatctggacaagatggattagagatttggcaaaactttaaggaaatggtagaaaacgtatga

SEQ ID NO: 30382 - protein, 205 aa, Leuconostoc mesenteroides subsp. mesenteroides ATCC 8293
MAIIIVDYGAGNIRNVMKAIEYTGLNAKVSQDPAEIAAADGLVVPGVGAFASAMDKLRERNLVEPIKQFSNSGKPLLGVCLGMQLLFDSSTEFGETRGLGLIPGQVVELPKQENYKVPQMGWNQNKVSQINQITRTMNDKYTYFVHSYYAVTDSKYIAATVNYGKVDVPSVVVNKNVIGAQFHPEKSGQDGLEIWQNFKEMVENV

SEQ ID NO: 30383 - DNA, 639 bp, Azotobacter vinelandii
  CDS (1)..(639)
atgcagacggtagccgtgatcgactatggcatgggcaacctgcactcggtggccaaggcgctggagcacgtcggcgccggcagggtgctgatcaccagcgacgcccaagtgatccgcgaggccgaccgggtggtgtttcccggtgtcggcgcgatccgcgactgcatggccgagatccgtcgcctgggcttcgacgccctggtccgcgaggtgagcgccgaccggccgttcctcggcatctgcgtcggcatgcaggcgttgctggagcacagcgaggagaacggcggggtcgactgcatcggcctgttccccggccgggtgcgcttcttcggcaaggacctggtcgagggcggcgagcacctcaaggtgccgcacatgggctggaacgaggtcgcgcagagcgtcgaccatccgctctggcacaacatcccggaccgtggccgcttctatttcgtgcacagctactacatcgaggccggcaatccgcgccaggtggtcggtcgcggccactacggggtcgacttcgccgccgcgctggccgagggctcgcgcttcgccgtgcagttccacccggaaaagagccacacccacggcctgcaactgctgcagaacttcgccgcctgggacgggcgctggtag

SEQ ID NO: 30384 - protein, 212 aa, Azotobacter vinelandii
MQTVAVIDYGMGNLHSVAKALEHVGAGRVLITSDAQVIREADRVVFPGVGAIRDCMAEIRRLGFDALVREVSADRPFLGICVGMQALLEHSEENGGVDCIGLFPGRVRFFGKDLVEGGEHLKVPHMGWNEVAQSVDHPLWHNIPDRGRFYFVHSYYIEAGNPRQVVGRGHYGVDFAAALAEGSRFAVQFHPEKSHTHGLQLLQNFAAWDGRW

SEQ ID NO: 30385 - DNA, 636 bp, Desulfitobacterium hafniense DCB-2
  CDS (1)..(636)
atgataggaatcatcgattatggtcgcggaaatttgcgcagtgtggaaaaagccctctggaaattaggatatccggctaaggttctggaatctcccgctgaactgatggctgtgaagggcatcattttgccgggagtgggagcattcgccgatgctatggcagctcttgaagaaaagggatggattcagcccttaatccactacgcccattcaggaaagcctttcttagggatttgcctcggcatgcaggtgctctttgaagtcggggaggagcatggtgagcataagggattgggactgctccccgggagagtggtcaggttcccggccggccgcaagattcctcatatgggctggaatacccttcatcaggaaaagccttgccggcttcttgaggggattcccgatgaagcttatttttattttgttcactcctattatgtggccagtgaggagcaggagattcttgctggaatgagcgactatggagtgccttttccggctttggtgggaagggataatgtttggggagcacaattccaccctgagaagtccagtccttggggtcttaagctattggagaactttggaaagtgggtgaatgaggatgcgactgtttccagccatcgatcttaa

SEQ ID NO: 30386 - protein, 211 aa, Desulfitobacterium hafniense DCB-2
MIGIIDYGRGNLRSVEKALWKLGYPAKVLESPAELMAVKGIILPGVGAFADAMAALEEKGWIQPLIHYAHSGKPFLGICLGMQVLFEVGEEHGEHKGLGLLPGRVVRFPAGRKIPHMGWNTLHQEKPCRLLEGIPDEAYFYFVHSYYVASEEQEILAGMSDYGVPFPALVGRDNVWGAQFHPEKSSPWGLKLLENFGKWVNEDATVSSHRS

SEQ ID NO: 30387 - DNA, 636 bp, Nostoc punctiforme PCC 73102
  CDS (1)..(636)
atgccagtaattgcggtcgtagactacgagatgggaaatttgcactcagtctgtaaagggttggaaaaagctggggcaactcctaatgttacttattctccaaaggaattagagcaggcagatgcaatagttctgccaggagtgggagcatttgatccagcagtacaacacctgcgagcgcgtggtttggaacaacctattaaagatgcgatcgcatctggtaaaccttttttgggaatttgtttaggattgcaaattctctttgaatcaagtgcagaaggtacccaaccaggactaggaattatcaaaggaaaagtgcgccgatttcgtccagaacctgacatcactattcctcacatgggttggaatcagctggaaatgactcaggcaaaaagtattttgtgggagcatttgccgtccgatccttgggtatattttgtccattcttactatgttgacccaatagacccgctaatccgtgcagcaaccatcacccacggtactcaaaccgtcacagctgcgatcgctcacgaaaatctgatggcagttcaatttcaccccgaaaaatcatctaatattggattgcaaatcttgtctaattttgttgctcaagtccgtgaaaaaattcctgcctaa

SEQ ID NO: 30388 - protein, 211 aa, Nostoc punctiforme PCC 73102
MPVIAVVDYEMGNLHSVCKGLEKAGATPNVTYSPKELEQADAIVLPGVGAFDPAVQHLRARGLEQPIKDAIASGKPFLGICLGLQILFESSAEGTQPGLGIIKGKVRRFRPEPDITIPHMGWNQLEMTQAKSILWEHLPSDPWVYFVHSYYVDPIDPLIRAATITHGTQTVTAAIAHENLMAVQFHPEKSSNIGLQILSNFVAQVREKIPA

SEQ ID NO: 30389 - DNA, 639 bp, Pseudomonas syringae pv. syringae B728a
  CDS (1)..(639)
atgcagacagttgcggtcatcgattacggcatgggcaacctgcactctgtcgccaaggcgctggagcatgtgggcgcaggccgtgtgctgattaccagtgacgccaaggtgattcgcgaagccgatcgcatcgtctttccgggtgtgggcgcgattcgcgactgcatggccgagattcgccgtctgggctttgattcgctggttcaggaagtgagccaggaccgtccgtttctgggtatctgcgtcggcatgcaggcgttgctcgacagcagcgaagagaacggcggcgtggactgcatcggcatgtttcccggccaggtaaagttcttcggcaaggacctgcatgaagagggcgagcacctgaaagtgccgcacatgggctggaaccaggtcgctcaggcggtggatcacccgctgtggcatgacattccggatcaggcgcgtttctacttcgtgcacagtttctatatcgatgccgccaatcagcgtcaggtggtcgggcgtggccactacggcctcgacttcgccgctgcgctggccgacggttcgcgcttcgccgtgcaattccaccctgaaaagagccatacccacggcctgcagttgctgcagaacttcgccgcctgggatggtcgctggtaa

SEQ ID NO: 30390 - protein, 212 aa, Pseudomonas syringae pv. syringae B728a
MQTVAVIDYGMGNLHSVAKALEHVGAGRVLITSDAKVIREADRIVFPGVGAIRDCMAEIRRLGFDSLVQEVSQDRPFLGICVGMQALLDSSEENGGVDCIGMFPGQVKFFGKDLHEEGEHLKVPHMGWNQVAQAVDHPLWHDIPDQARFYFVHSFYIDAANQRQVVGRGHYGLDFAAALADGSRFAVQFHPEKSHTHGLQLLQNFAAWDGRW

SEQ ID NO: 30391 - DNA, 642 bp, Desulfovibrio desulfuricans G20
  CDS (1)..(642)
atgcttgcgatcctgaaatacaaggccggcaaccagacaagcgtgcgccgtgccctgaaccacatcgggatccccaacgtgatcacggcggaccccgccgagatcgccgcctcggaaggcatcatctttcccggcgtgggggccgccggacaggccatggacgaactgacggccgccggacttgacgctgtgctcaaagagcaggtggaagcaggcaaaccgctgctgggcatctgtgtaggctgccagataatgctggactacagtcaggaaaacgatacccgtacgctgggcatcattcccggagaatgccatctgttcaatcccgcgctggaagacgaaaccggcgcgcccatccgcgtaccgcacatgggctggaacagagtgatacccagaaagccgtgcgcacttttcaaaggcatttccgatgatgccgaattttattttgtgcacagctactttcccaacccgcagccggactatgtcattgccaccacgacgtacggcaaggaattctgttctgttcacggcgggccggggctgtgggccgtccagttccatccggaaaaaagcggcagacccggactgaagctgctcagcaacttccacgcatactgcaaggaggccgccaatgctcagtaa

SEQ ID NO: 30392 - protein, 213 aa, Desulfovibrio desulfuricans G20
MLAILKYKAGNQTSVRRALNHIGIPNVITADPAEIAASEGIIFPGVGAAGQAMDELTAAGLDAVLKEQVEAGKPLLGICVGCQIMLDYSQENDTRTLGIIPGECHLFNPALEDETGAPIRVPHMGWNRVIPRKPCALFKGISDDAEFYFVHSYFPNPQPDYVIATTTYGKEFCSVHGGPGLWAVQFHPEKSGRPGLKLLSNFHAYCKEAANAQ

SEQ ID NO: 30393 - DNA, 591 bp, Actinobacillus pleuropneumoniae serovar 1 str. 4074
  CDS (1)..(591)
atgaatttagtcatcatcaacacaggttgtgcaaacctgtcatctgtaaaatttgcattcgatcgcttgggtattcaggcggagattagttgtgatttagacaaaatcaaatcagcggataaattgctgttgcccggagtggggacggctgcggcggcgatgaagattttgcaagatcgcgatttgattgacacgatccgcaacgccactcagccaatgcttggtatttgtttgggtatgcagttaatgactgaattttctgccgaaggcgatgtggacacactcaagctaatgagtggcaaaaccgagttaatccccaatacaggtttgccgttgccacatatgggctggaacaaggttcagtatcaagccgaccacccgttatttcacggcattgagcaaaacagccatttctattttgtacatagctatgcggtgttgccgaatgaaaacaccattgctaccgctgattatggcgtgcctttctcggctgcgattgcgagcaaaaacttctacggcgtacagttccaccccgagcgttcgggcaaaaatggcgcacagttgttgcgaaattttgtggagaatatttaa

SEQ ID NO: 30394 - protein, 196 aa, Actinobacillus pleuropneumoniae serovar 1 str. 4074
MNLVIINTGCANLSSVKFAFDRLGIQAEISCDLDKIKSADKLLLPGVGTAAAAMKILQDRDLIDTIRNATQPMLGICLGMQLMTEFSAEGDVDTLKLMSGKTELIPNTGLPLPHMGWNKVQYQADHPLFHGIEQNSHFYFVHSYAVLPNENTIATADYGVPFSAAIASKNFYGVQFHPERSGKNGAQLLRNFVENI

SEQ ID NO: 30395 - DNA, 645 bp, Psychrobacter sp. 273-4
  CDS (1)..(645)
atgagtcgagccacaaaaatcgcactattagattatggtatgggtaatttacactctgccagcaaagcattgtctgcggtaggggcggaagtctctatcaccaatgaccctaaagtcgtcgctgctgcggataagattttcttccctggtgtcggcgccatgcgtgattgtatcgctggcatgcatgaggcaggtattgatgatgtcatacgtcaggcgatatttaataagcccgtcatggctatctgtgttggcatgcaggcgttatttgagcagtctgctgaaaatggtggcacgccttgtctgagtatcttagatggcacagtaccggcttttaacccagaatggaaagatgaaaaaggggtgcagataaaagtaccgcacatgggctggaataccattagcggcatgaattttgagcatccattgtggaatggtatcgaagataaggcgcatttttattttgtgcacagttattactgtgagccagcagacagctcgcaagtggctgctatttgcgattatggtcagccgttttgtgccagtatcttgcaagataacttatttgctacccaattccatcctgaaaaaagccatactgcaggcttgcagttattaaagaattttgtggattgggatatttaa

SEQ ID NO: 30396 - protein, 214 aa, Psychrobacter sp. 273-4
MSRATKIALLDYGMGNLHSASKALSAVGAEVSITNDPKVVAAADKIFFPGVGAMRDCIAGMHEAGIDDVIRQAIFNKPVMAICVGMQALFEQSAENGGTPCLSILDGTVPAFNPEWKDEKGVQIKVPHMGWNTISGMNFEHPLWNGIEDKAHFYFVHSYYCEPADSSQVAAICDYGQPFCASILQDNLFATQFHPEKSHTAGLQLLKNFVDWDI

SEQ ID NO: 30397 - DNA, 609 bp, Methanococcoides burtonii DSM 6242
  CDS (1)..(609)
atgaaaaaaatagtgataattgattatgggcttggtaatcttcgcagtgttcagaaaggactggagcatgcaggtgcagaagtcctcatctcaaaggaccctgcagacattggaaatgccgatggtatcattcttccaggtgtgggtgcattttccgatgcaatgaagaacatcgtgccttttttggatcccataactgattatgtggcatcaggcaagccacttctcggtatatgtctgggaatgcaaatgcttatgaccaggtctgaagaaggtggtcttacagaaggacttgaccttgttccaggaaatgttgtgaggtttccaagatctgagttgaaggtccctcaaatgggctggaactctttaaagatcgaacatgaccatcccttctatgagggtgtgtctgatggggcttttgtatattttgtacattcctattatgttgataccgattcatcccacatgcttgcatcatgtgattacggcatagactttgctgcatcggtagtaaattcggcaggcaatgttataggcactcagttccatcctgaaaaaagtggcgatattggtttgaaaatgctcacaaactttgtagacatgtgctga

SEQ ID NO: 30398 - protein, 202 aa, Methanococcoides burtonii DSM 6242
MKKIVIIDYGLGNLRSVQKGLEHAGAEVLISKDPADIGNADGIILPGVGAFSDAMKNIVPFLDPITDYVASGKPLLGICLGMQMLMTRSEEGGLTEGLDLVPGNVVRFPRSELKVPQMGWNSLKIEHDHPFYEGVSDGAFVYFVHSYYVDTDSSHMLASCDYGIDFAASVVNSAGNVIGTQFHPEKSGDIGLKMLTNFVDMC

SEQ ID NO: 30399 - DNA, 648 bp, Dechloromonas aromatica RCB
  CDS (1)..(648)
atgacgctggctggccaaaccattgccgtcatcgactatggcatgggcaatctgcgctctgtctcgaaggccctcgagcacgtggctggcggcaagcaagttattgtcaccgccgatcccgctgtcgtcgccgccgcggaacgtgttgtttttcccggtcagggcgcgatgccggactgcatgcgcgagctggatgcgcgtggcttgcgcaccgccgtgctggctgcggccaaggacaagcctttcctcggtatctgcgtcggcgagcaaatgctgttcgagcatagcgacgaaggcaatgtgccggcactcggtgtcttcgccggcaacgtcaagcgcttccccgatgagaaaatgcacctgcccacaggcgagcgcttgaaggtgccgcacatgggctggaacgaggtgcgccagaaaccacatgcgctgtggagtggcatcgcggacggctcgcgcttctatttcgtgcacagctattttgtcgagccggccgatctggcgctggtgacgggcatttgcgaatatggcgtgccctttacctgtgcagtggggcgggataatatcttcgcggttcaattccatcctgagaaaagcgctcgcgacggtttgcaacttctgaaaaacttcgttgagtggcaaccctga

SEQ ID NO: 30400 - protein, 215 aa, Dechloromonas aromatica RCB
MTLAGQTIAVIDYGMGNLRSVSKALEHVAGGKQVIVTADPAVVAAAERVVFPGQGAMPDCMRELDARGLRTAVLAAAKDKPFLGICVGEQMLFEHSDEGNVPALGVFAGNVKRFPDEKMHLPTGERLKVPHMGWNEVRQKPHALWSGIADGSRFYFVHSYFVEPADLALVTGICEYGVPFTCAVGRDNIFAVQFHPEKSARDGLQLLKNFVEWQP

SEQ ID NO: 30401 - DNA, 636 bp, Anabaena variabilis ATCC 29413
  CDS (1)..(636)
atgccagttgttgctgttatagattatgagatgggaaatttgcattcggtttgcaaaggattagaaaaagcgggggcgactcctataattactcattctcatcaggaattaactaaggccgatgcagtcatattgccgggagtgggagcatttgacccagcagtgcagagtttgcgatcgcgtgatttagaacaaccaattaaagatacaatcgcttcaggcaaacccttcttaggtatctgtttagggctgcaaattctgtttgaatcgagtgcggaaggtactcaaccaggactaggaattatcaaaggaaaagtgcggcggtttatttctgaaccaggaattaccattccccacatgggttggaatcagttggaattaacccaaccaaaaagcattttgtgggagcatttgccaccccaaccttgggtatattttgtacattcctactatgttgacccagttgagcctcaagttcgtgctgcaactgttactcacggtacgcaaaccgttacggcagctattgcccatgaaaacctgatggcagtacaatttcatcccgaaaaatcgtcaaatattgggctgcaaatcctgtctaattttgtctcccaagtacgggaaaaaattgctgcataa

SEQ ID NO: 30402 - protein, 211 aa, Anabaena variabilis ATCC 29413
MPVVAVIDYEMGNLHSVCKGLEKAGATPIITHSHQELTKADAVILPGVGAFDPAVQSLRSRDLEQPIKDTIASGKPFLGICLGLQILFESSAEGTQPGLGIIKGKVRRFISEPGITIPHMGWNQLELTQPKSILWEHLPPQPWVYFVHSYYVDPVEPQVRAATVTHGTQTVTAAIAHENLMAVQFHPEKSSNIGLQILSNFVSQVREKIAA

SEQ ID NO: 30403 - DNA, 654 bp, Synechococcus elongatus PCC 7942
  CDS (1)..(654)
atggcctccacccctcaaattgccgtggttgactatgacatgggcaacctgcactccgcctgcaagggcctagaagctgctggggccaatccgatcgtgacggctgatccggccacaattctggcggcggatggtgtcttactgccaggggttggcgcttttgatccagccatggaccacctgcgcgatcgccagttgattgaaccgctgcaccaggctgcaaccagtggcaagccttttttgggaatctgtttgggtctgcaactgttgtttgaagccagtgaagaaggacagtcggccggactagggatcttgcccggtcgggttcaacgctttcgcagtgagcctgggctagtcattcctcatatgggctggaatcaactccaactgcagcagcccgattgccccctgtggcaaaatcttggcgctgatccttggttctacttcgtccatacctactacgtagtcccgagtgaaccgaccctgacagccgcgacagttcagcatggttcacaaccagtcaccgccgcgatcgcccgcgatcgcctctgggctgtgcaattccaccccgaaaaatcagcgaaggctggcttgcaactgctggctaattttgtcacccaagttgcagcggctcagcttcaaacagtggcatga

SEQ ID NO: 30404 - protein, 217 aa, Synechococcus elongatus PCC 7942
MASTPQIAVVDYDMGNLHSACKGLEAAGANPIVTADPATILAADGVLLPGVGAFDPAMDHLRDRQLIEPLHQAATSGKPFLGICLGLQLLFEASEEGQSAGLGILPGRVQRFRSEPGLVIPHMGWNQLQLQQPDCPLWQNLGADPWFYFVHTYYVVPSEPTLTAATVQHGSQPVTAAIARDRLWAVQFHPEKSAKAGLQLLANFVTQVAAAQLQTVA

SEQ ID NO: 30405 - DNA, 615 bp, Methylobacillus flagellatus KT
  CDS (1)..(615)
atgggcaatttacgctccgtgtccaaggcgctggagcatgtcgcccccaaccagactgtgattgtgaccagtgacccggcacagattgccgccgcccgtcgcgtggtgttccctggtcaaggtgccatgccagattgcatgcgcgagctggatgcgcgcggcttgcggaatgccgttattgccgctgccgccgaaaagccattcttggggatctgcattggcttgcagttgctgttcgagcatagcgaagaaggaaatgctgccggtttgggggtactcaaaggcaaggtaaagcgctttgcggcggcagagatgcacgatgagcacggagccaaactcaaggtgccgcatatgggttggaatcaggtctaccagagcctggagcatccgctatggcatggtattgccgacggtgaacgtttctattacgtgcatagttattacgttttaccggaagatgctggactggctgcgggctatagtgagtatcccaagcggttcaccagttccattgcccgcggtaacctgtttgctgtccagttccatccggagaagagccatgatgccgggctcaagcttctttccaacttcgtccggtgggacggggtgttttaa

SEQ ID NO: 30406 - protein, 204 aa, Methylobacillus flagellatus KT
MGNLRSVSKALEHVAPNQTVIVTSDPAQIAAARRVVFPGQGAMPDCMRELDARGLRNAVIAAAAEKPFLGICIGLQLLFEHSEEGNAAGLGVLKGKVKRFAAAEMHDEHGAKLKVPHMGWNQVYQSLEHPLWHGIADGERFYYVHSYYVLPEDAGLAAGYSEYPKRFTSSIARGNLFAVQFHPEKSHDAGLKLLSNFVRWDGVF

SEQ ID NO: 30407 - DNA, 636 bp, Crocosphaera watsonii WH 8501
  CDS (1)..(636)
atgggctttctggctgttattgactatgacatgggtaatctgcactccgcttgtaaggggctagaaaaagcaggaattcagccaaaaataaccaattctccccaagatattgcagaagctgaggccattgttctgcccggagtgggttcgttcgatccggcggtgcaaaatttacgatcgcgtaatttagaggaacctatcaaaaaggcgatcgctgaaggtaagccattcttaggtatttgtttgggtttacagattctttttgatggttcagaagaagggaaagaaccagggttaggcattatcaaagggatggtacgtcgtttcaaatccgagcctaatttaaccataccccacatgggttggaatcagttacaattggctcaagcaaatttatctttatggcaagggttaacccccgatccctatgtctattttgtgcattcctattatgtcgatcccgttgatgctgagattaatgctgctgttgtgactcatgggagccaaacagttacagcagcgatcgcccgtgataatctgatggcggtacaatttcacccggaaaaatcatcggataatggattacagattctttccaattttgcagcaacgctccagaaaaacttgatcaattga

SEQ ID NO: 30408 - protein, 211 aa, Crocosphaera watsonii WH 8501
MGFLAVIDYDMGNLHSACKGLEKAGIQPKITNSPQDIAEAEAIVLPGVGSFDPAVQNLRSRNLEEPIKKAIAEGKPFLGICLGLQILFDGSEEGKEPGLGIIKGMVRRFKSEPNLTIPHMGWNQLQLAQANLSLWQGLTPDPYVYFVHSYYVDPVDAEINAAVVTHGSQTVTAAIARDNLMAVQFHPEKSSDNGLQILSNFAATLQKNLIN

SEQ ID NO: 30409 - DNA, 588 bp, Exiguobacterium sp. 255-15
  CDS (1)..(588)
atgatcgcgatcgtagattatggtgtcggcaatatcgcaaacatcgaacgggcgttaaaagagctcggagaagccgtcatcgtcacaagtgatctggaattacttggacaggcggaagcgctcgttttaccgggggtcggtgcctatgcgccggcaatggcccggttagaagagacgggattgattgagttcttacaggaacaagcgacgaaaaaaccattcctcgggatttgtctcgggatgcaactgttgtttgaatcaagcgatgaagacggacagacagaagggctcggtattttaccgggaacagtcgaaaagttgccaagtgacgtccgcttgccgcatatgggctggcatcaattgaagaatcacggcgaagcggtttatttcgttcactcgtacggtgcggtctgtgatccggactggatcgtcgactcggtcgaatacggacgactcgtcccggccatcgtccaaaaggacttggtgacagggatgcagttccacccggagaagagtggcgaagtcggactgaaattacttaaggaatggagagagacgacatgcaactctacccagcaatcgatttaa

SEQ ID NO: 30410 - protein, 195 aa, Exiguobacterium sp. 255-15
MIAIVDYGVGNIANIERALKELGEAVIVTSDLELLGQAEALVLPGVGAYAPAMARLEETGLIEFLQEQATKKPFLGICLGMQLLFESSDEDGQTEGLGILPGTVEKLPSDVRLPHMGWHQLKNHGEAVYFVHSYGAVCDPDWIVDSVEYGRLVPAIVQKDLVTGMQFHPEKSGEVGLKLLKEWRETTCNSTQQSI

SEQ ID NO: 30411 - DNA, 651 bp, Mesorhizobium sp. BNC1
  CDS (1)..(651)
atgcgcgttgccatcatcgactacggctccggcaatctgcgctccgcgaccaaggcgttcgagcgcgcggcgcgcgaatcgggaatcgcggctgagatagatcttaccaatgacgctgagcgggtccgcaaggccgatcgcatcgttctgcccggggtgggggcatatgcggattgccgggcggggctcgatgcagtgccgggcatggtggaagcaatcgaagaagttgccattggacgggcacgccccttctttgggatttgcgtcggcatgcagcttatgtcggaacgcgggctggagaagaccacgacgaatggcttcggctggatcgcgggagacgtgaaggagatcacccccagcgatccgtcactgaaaatcccgcaaatcgggtggaacacgattcacgtgaaacatcgccacccgctctttgagggtattccgacggggcgcgaggggctgcacgcctatttcgtccattcctatcatattgatgcgacgcgaagggaggatgtcctggccgtaaccgactatgggggcgagatcaccgcggcggtggcccgtggcaacctcgccggaacgcagttccatccggaaaagagccagatgctcggccttggccttatcgcgaatttcctgagatggcggccatga

SEQ ID NO: 30412 - protein, 216 aa, Mesorhizobium sp. BNC1
MRVAIIDYGSGNLRSATKAFERAARESGIAAEIDLTNDAERVRKADRIVLPGVGAYADCRAGLDAVPGMVEAIEEVAIGRARPFFGICVGMQLMSERGLEKTTTNGFGWIAGDVKEITPSDPSLKIPQIGWNTIHVKHRHPLFEGIPTGREGLHAYFVHSYHIDATRREDVLAVTDYGGEITAAVARGNLAGTQFHPEKSQMLGLGLIANFLRWRP

SEQ ID NO: 30413 - DNA, 618 bp, Rubrobacter xylanophilus DSM 9941
  CDS (1)..(618)
ttgagggtcgcggtggtggactacggcgcgggcaacaccctctcggtcacccgcgccctgcagagggccggggcggaggtggagctcaccccggacccggcgcgggtgctcgccgccggggccgtggtgctgccgggggtgggggccttcggggactgcgtgcggaagctcgccgagcgggggctggacgaggcctgccgggagcacgtggggcgcggcggccccctcttgggggtgtgcgtggggctgcaggtgctcttcgagggttcggaggagtcgccgggggcggaggggctcggcctcctgcccgggagggtggtgcggttctccggggaggggttgcgggtgccgcacatgggctggaacaccctccgggtgctcagggggcacccggtcctggaggggctcgacggcgaggccttctacttcgtccactcctaccaccccgagcccgccgagcccgcggacctcttggcgacctcctcctacggcggggagttctgcgccgcggccgggcgggggaacctggtggccgtgcagttccacccggagaagagcagccgggcggggctccgcctctacgagaacttcctgaggtgggcgcgtggggcctcgtga

SEQ ID NO: 30414 - protein, 205 aa, Rubrobacter xylanophilus DSM 9941
MRVAVVDYGAGNTLSVTRALQRAGAEVELTPDPARVLAAGAVVLPGVGAFGDCVRKLAERGLDEACREHVGRGGPLLGVCVGLQVLFEGSEESPGAEGLGLLPGRVVRFSGEGLRVPHMGWNTLRVLRGHPVLEGLDGEAFYFVHSYHPEPAEPADLLATSSYGGEFCAAAGRGNLVAVQFHPEKSSRAGLRLYENFLRWARGAS

SEQ ID NO: 30415 - DNA, 639 bp, Rhodobacter sphaeroides 2.4.1
  CDS (1)..(639)
atgctgacggtcctcgtcgattacgacagcggcaatctccactcggccgaaaaggcgttccagcgcatggcgaccgagaccggggccgggcaggtcctcgtgtcggacaggcccgaggatgtggcgcgcgccgaccggatcgtgctgccgggcgacggcgccttcccggcctgccgccgcgcgctcggcagctacggcggcctgtccgaggcgatcgaggaggcggtgacgcggcgcgcacggcccttcctcggcatctgcatcggcatgcagatgatggccacgcgcggtctcgaacatgaggagacgccgggcttcggctggatcgcgggcgaggtggtgcggatcgcgccctccgacccgcatctgaaggtgccgcacatggggtggaacgacctgacggtcgaccatccccacccggtgctgacggggatcgagacgggcgatcacgcctatttcgtccattcctaccatttccaggtggcccacgatgccgagcggctggcccatgccgactatggcgcggacatcacggccatcgtggggcgcgacacgatggtgggcacgcagttccacccggagaagagccagaagaccggcctgcggctgatcgccaacttcctgacctggaagccctga

SEQ ID NO: 30416 - protein, 212 aa, Rhodobacter sphaeroides 2.4.1
MLTVLVDYDSGNLHSAEKAFQRMATETGAGQVLVSDRPEDVARADRIVLPGDGAFPACRRALGSYGGLSEAIEEAVTRRARPFLGICIGMQMMATRGLEHEETPGFGWIAGEVVRIAPSDPHLKVPHMGWNDLTVDHPHPVLTGIETGDHAYFVHSYHFQVAHDAERLAHADYGADITAIVGRDTMVGTQFHPEKSQKTGLRLIANFLTWKP

SEQ ID NO: 30417 - DNA, 651 bp, Magnetospirillum magnetotacticum MS-1
  CDS (1)..(651)
atgagcggcatcgtcgccatcatcgattacggctcgggcaatctgcgctcggcggccaaggccttcgagcgggtggtggccgaggccagcctcaatctcgaggtggccgtcaccaatgatcccaaggtggtggaaagcgccgatcgcatcgttctgcccggcgtcggcgccttcgccgattgccgcgccggtcttctggccctgccgggcatggccgagacgctgaccgagcgggtgctggctcagggcacgccgttcttcggcatctgtgtcggcatgcagctgatggccagtatcgggcgcgagcatggcctgcatgccggattgggctggatcgcgggcgaggtggtgccgctgggcgttgaatcccagggcctcaaagtgccgcatatgggctggaaccagttggttcccgacggattgtcccatccgctgctggcggggctggaatccgagtcccatgcctatttcgtccattcctacaagttcgagaccgccaatccggcccatcgcctcgcccatgtggactatggcggagcggtgaccgccgtggtcgggcgcgacaatatggtcggcacccaattccatcccgagaagtcccagatcacggggctcaaggtgatttccaacttcctgacgtggaagccataa

SEQ ID NO: 30418 - protein, 216 aa, Magnetospirillum magnetotacticum MS-1
MSGIVAIIDYGSGNLRSAAKAFERVVAEASLNLEVAVTNDPKVVESADRIVLPGVGAFADCRAGLLALPGMAETLTERVLAQGTPFFGICVGMQLMASIGREHGLHAGLGWIAGEVVPLGVESQGLKVPHMGWNQLVPDGLSHPLLAGLESESHAYFVHSYKFETANPAHRLAHVDYGGAVTAVVGRDNMVGTQFHPEKSQITGLKVISNFLTWKP

SEQ ID NO: 30419 - DNA, 609 bp, Burkholderia cepacia R18194
  CDS (1)..(609)
atgggcaacctgcgctcggtcgcgcaggcgctcaagaaggccgaaccggccgccgacgtggcgatcgtcgacacgccggccgcgatccgcgcggccgaccgtgtcgtgctgcccggccagggcgcgatgcccgactgcatgcgcagcctcggcgaatcgggcctgcaggaggccgtgatcgaggcgtcgcgcacgaagccgctgctcggcgtgtgcgtcggcgagcagatgctgttcgactggagcgcggaaggcgacacgaagggcctcggcctgttgcccggcaaggtcgtgcgtttcgagctcgacggccgcctgcaggacgacggttcgcgcttcaaggtgccgcagatgggctggaaccgcgtgcgccagtcgcagccgcacccgctgtgggacggcgtgcccgacgacgcgtatttctactttgtgcacagctattacgtgacgccggacaacccggctcatacggtgggcgaaacggcttacggcgcgccgtttacgtccgcggtcgcgcgggataacctcttcgcgacccaattccaccccgagaaaagcgcggaggtcgggttgcgtctgtatcgcaacttcgtacactggaagccgtga

SEQ ID NO: 30420 - protein, 202 aa, Burkholderia cepacia R18194
MGNLRSVAQALKKAEPAADVAIVDTPAAIRAADRVVLPGQGAMPDCMRSLGESGLQEAVIEASRTKPLLGVCVGEQMLFDWSAEGDTKGLGLLPGKVVRFELDGRLQDDGSRFKVPQMGWNRVRQSQPHPLWDGVPDDAYFYFVHSYYVTPDNPAHTVGETAYGAPFTSAVARDNLFATQFHPEKSAEVGLRLYRNFVHWKP

SEQ ID NO: 30421 - DNA, 609 bp, Burkholderia cepacia R1808
  CDS (1)..(609)
atgggcaacctgcgctcggtggcgcaggcgctcaagaaggccgaaccggccgccgacgtggcgatcgtcgacacgccggccgcgattcgcgcggccgaccgcgtcgtgctgcccggccagggcgcgatgcccgactgcatgcgctgcctcggcgaatcgggactgcaggaggcggtgctcgaggcgtcgcgcacgaagccgctgctcggcgtgtgcgtgggcgagcagatgctgttcgactggagcgcggaaggcgacacgaagggcctcggcctgttgccgggcaaggttctgcgcttcgagctcgaaggccggctgcaggacgacggctcgcgcttcaaggtgccgcagatgggctggaaccgcgtgcatcagtcgcgctcgcacccgctgtgggaaggcgtgcccgacgacgcgtatttctacttcgtgcacagctactacgtgagcccggagaacccgcagcacacggtgggcgagacggcctacggcgcgccgtttacgtccgcagtcgcgcgcgacaacatcttcgcgacccaattccatccggagaagagcgcggaggtcggcttgcgtctgtatcgcaacttcgtgcactggcagccgtga

SEQ ID NO: 30422 - protein, 202 aa, Burkholderia cepacia R1808
MGNLRSVAQALKKAEPAADVAIVDTPAAIRAADRVVLPGQGAMPDCMRCLGESGLQEAVLEASRTKPLLGVCVGEQMLFDWSAEGDTKGLGLLPGKVLRFELEGRLQDDGSRFKVPQMGWNRVHQSRSHPLWEGVPDDAYFYFVHSYYVSPENPQHTVGETAYGAPFTSAVARDNIFATQFHPEKSAEVGLRLYRNFVHWQP

SEQ ID NO: 30423 - DNA, 627 bp, Listeria monocytogenes str. 1/2a F6854
  CDS (1)..(627)
atgattgtaattattgactatgatacaggaaatacgaaaagtatcagcaaagcacttgatttcatcgggctacaaaataaaatttctagtgatacaacagaaatcgctcaagctgatggcgttattttaccaggagttggcgcttatcctgaagctatgaaagaactcactcggcgcgggctaaataaaacattaaaagaaatcgctgccggtggcaaaccaattcttggtgtttgtcttggtatgcaacttttactcgaatcaagtaacgaacatagctttactaatggtctcggtctcattcccggtcatgtcgaaaaattaccagaagatcccgaatttgccgttccacatatgggctggaatcaactacaaatcaaacgtgccaccccgcttacaaaacaacttgatggagaatacgtttattacgttcactcctattacgccaattgcccagaagaatacattatcgcaacaagtggctattctattgaagttcctggcatgataaataaaggcaatatttacggcgcccagttccatcctgaaaaaagcggccaaatcggtcttgaaattttaaaaggatttaaggaggtcacttattcatgcaaatcttcccagcaatag

SEQ ID NO: 30424 - protein, 208 aa, Listeria monocytogenes str. 1/2a F6854
MIVIIDYDTGNTKSISKALDFIGLQNKISSDTTEIAQADGVILPGVGAYPEAMKELTRRGLNKTLKEIAAGGKPILGVCLGMQLLLESSNEHSFTNGLGLIPGHVEKLPEDPEFAVPHMGWNQLQIKRATPLTKQLDGEYVYYVHSYYANCPEEYIIATSGYSIEVPGMINKGNIYGAQFHPEKSGQIGLEILKGFKEVTYSCKSSQQ

SEQ ID NO: 30425 - DNA, 630 bp, Bacillus cereus G9241
  CDS (1)..(630)
ttgattgccatcatagattatggaatgggaaatattcgtagtgtagaacaagcattaaagcatattggagcagcgtacattgtaacgggtgataaagaagagatttttagaagtgatggagtgattttaccaggagtaggtgcatttccaaaagcgatggatgtattggaagaaaaagatttagtacgtgtgttaaaaaaaatcgggcgttccagaaaaccacttctaggtatttgcctaggaatgcagcttttatttgaaaaaagtgaggaactacaagactgtaacgggttaagtttattgccaggcgttattcgaaagttaaaggttccttataaaattcctcatatgggatggaatgagttaaagaaagaaggagaaatagcgctttggaatggagtagaggacggttctttcgtatattatgtccactcttattacgcagattgtccaaatgaaattgtatatggaataagtgaatatggagtaaaagtacctggttttgtagcaaaaggaaatatatatggtgcacagtttcatcctgaaaaaagtggtgacataggaatgcaaatgttgaaaaattttaaaggagtggtagaatcatggaaatcttcccagctatcgatttaa

SEQ ID NO: 30426 - protein, 209 aa, Bacillus cereus G9241
MIAIIDYGMGNIRSVEQALKHIGAAYIVTGDKEEIFRSDGVILPGVGAFPKAMDVLEEKDLVRVLKKIGRSRKPLLGICLGMQLLFEKSEELQDCNGLSLLPGVIRKLKVPYKIPHMGWNELKKEGEIALWNGVEDGSFVYYVHSYYADCPNEIVYGISEYGVKVPGFVAKGNIYGAQFHPEKSGDIGMQMLKNFKGVVESWKSSQLSI

SEQ ID NO: 30427 - DNA, 657 bp, Rubrivivax gelatinosus PM1
  CDS (1)..(657)
atgagccgtcgcgtggcggtcatcgactacggcatgggcaacctgcgctcggtgtcgcaggccgtgctgcacgcggccgccgggaccggcttcgaggtggttgtgacggccgagcccgaggtggtgcgcgctgccgaacgcgtggtgctgcccggccagggcgcgatgcgcgactgcatgcgcgagctgcgagaggcgcacgggggcgccctgcgggccgccgtgctcgaggccgccgccgacaagccgctgatgggcgtgtgcgtcggcatgcagatgctgctcgaccacagcgaggaacaggacacgcccggcctgggcctgatcccgggccgggtgcggcgcttccagctcgaaggccgactccagcccgacggcagccgctacaaggtgccgcagatgggctggaaccaggtgctgcaggcccgtccgcacccggtgtgggccggcgtgcccgatgccagctggttctatttcgtgcacagcttctatgcgcagccggccgatccggcgcacagcgttggtgaaaccgactatggcgcgcgctttaccagtgcggtggcacgcgataatatttttgccacccagttccaccccgagaagagcgctgcacacggcctggccctgtaccgcaacttcctcggctggtgcccctga

SEQ ID NO: 30428 - protein, 218 aa, Rubrivivax gelatinosus PM1
MSRRVAVIDYGMGNLRSVSQAVLHAAAGTGFEVVVTAEPEVVRAAERVVLPGQGAMRDCMRELREAHGGALRAAVLEAAADKPLMGVCVGMQMLLDHSEEQDTPGLGLIPGRVRRFQLEGRLQPDGSRYKVPQMGWNQVLQARPHPVWAGVPDASWFYFVHSFYAQPADPAHSVGETDYGARFTSAVARDNIFATQFHPEKSAAHGLALYRNFLGWCP

SEQ ID NO: 30429 - DNA, 726 bp, Rhodospirillum rubrum
  CDS (1)..(726)
ttgggtcttttccgcttttttgacaggctccgggcccgggttggcgccctgcccggcgccctcatcggggtccaggctgtgatgcgtgtcgcgcttatcgattatggctcgggcaatctccgttcggcggcgaaagccctcgaacgggccgctcgcgacggtggagtcgccgccgaaatcgtcgttacccgcgatgtcgagggggtcctgggggccgatcgcgtggtgctgcccggcgtcggcgccttcgccaattgccggcgcggcttgcagggcatcgatggcatggtcgaggccctggccgaggtggcgctggtccgcgcccgccccttccttggcatctgcgtcggcatgcagctgctggccgacgagggcgtggaatatggccgtcaccccggtctgggatggatcggcggcaccgtggaagcgatcagcccggccgaccccgccctcaagatcccccacatgggatggaacagcctggattttcaggccgatagtcatgccttgctcgccggcatcgagccggggacccatgtctatttcgtccatagctaccacttccgccccgccgacccggcgacgcgcttggccagcgttgaatacggcgggccgctgaccgcgatgatcggccgggaaaatctggtcggaacccagttccatcccgagaaaagccaggccgccgggctgcgcctgatcgccaatttcctgcgctgggccccgtga

SEQ ID NO: 30430 - protein, 241 aa, Rhodospirillum rubrum
MGLFRFFDRLRARVGALPGALIGVQAVMRVALIDYGSGNLRSAAKALERAARDGGVAAEIVVTRDVEGVLGADRVVLPGVGAFANCRRGLQGIDGMVEALAEVALVRARPFLGICVGMQLLADEGVEYGRHPGLGWIGGTVEAISPADPALKIPHMGWNSLDFQADSHALLAGIEPGTHVYFVHSYHFRPADPATRLASVEYGGPLTAMIGRENLVGTQFHPEKSQAAGLRLIANFLRWAP

SEQ ID NO: 30431 - DNA, 636 bp, Magnetococcus sp. MC-1
  CDS (1)..(636)
atgattaccgttgttgattatggatcgggcaacctgcgttcggtctccaaagcgctggaaaaagtggggggcaatgtggtggtaagcgcccatcccgaagatgtcacccaagcggatcgcttggtgctgcctggggtaggtgcctttgccgactgccgccgcaacctggatcgcgcccaactgaccgaaccggtattggcccacattcgtgcgggcaagccctttttgggcatctgtgttgggatgcagatgttgtttgatgaaagccatgagtttggcgtgcatgagggttttggtttaattcccggcaaggtcgaggcgttttctaaaaaaatgcaggaccctgccgatcttaaacgccatctcaaggtaccccacatgggctggaccccggtgcatcaaacggtcgaacaccccatgtggcagggcattgaggatatggcccatttttattttgtacactcgtttcacggcgtggtggaccaccaagcacaccaactggggcaaaccacctacggcattcctttcacctcggcggtggggcatgacaacatttttgccacccagtttcaccctgaaaagagccaaaacaatggcctcaggttgctggaaaattttgttaactggcagctataa

SEQ ID NO: 30432 - protein, 211 aa, Magnetococcus sp. MC-1
MITVVDYGSGNLRSVSKALEKVGGNVVVSAHPEDVTQADRLVLPGVGAFADCRRNLDRAQLTEPVLAHIRAGKPFLGICVGMQMLFDESHEFGVHEGFGLIPGKVEAFSKKMQDPADLKRHLKVPHMGWTPVHQTVEHPMWQGIEDMAHFYFVHSFHGVVDHQAHQLGQTTYGIPFTSAVGHDNIFATQFHPEKSQNNGLRLLENFVNWQL

SEQ ID NO: 30433 - DNA, 639 bp, Magnetococcus sp. MC-1
  CDS (1)..(639)
atgaatgtcgtcgtagactatggctgtggcaatttggcatccattgtgaacatggctaaaaaggcgggatatggtgcggtgatctcgtcagatcctgcccagatagccaaggcgacgcgtctgattttgcctggggtaggggcctatgaccaaggcatggcgcagttgcaacagcgggggctgcgtgaggtgctggatgagcaggtgctcaaacggaaggtgccgctgctggggatctgtctgggggcgcagttaatcgcccgtgggagtgaagagggggtgctacccggtttgggatggatcgccgccgatgtggtacgctttgatgccagccgcatggggcaacatgcacgcatcccccatattggctggtgtgattttattccagaagggaacgccccattggtggcacagatggaggcgcagagtcgtttttattttgtacacagctaccatctacagtgcgaggatgcaaacgatgtcatgggtcgagcggtgcatggctattcctttgtcgcagcggtagcccgggacaatatttttggggtgcagtttcatccggagaagagccaccgttttggtttgcacctgctgacccgattttttgagttgccggcggcggtgcccagtcatgcatga

SEQ ID NO: 30434 - protein, 212 aa, Magnetococcus sp. MC-1
MNVVVDYGCGNLASIVNMAKKAGYGAVISSDPAQIAKATRLILPGVGAYDQGMAQLQQRGLREVLDEQVLKRKVPLLGICLGAQLIARGSEEGVLPGLGWIAADVVRFDASRMGQHARIPHIGWCDFIPEGNAPLVAQMEAQSRFYFVHSYHLQCEDANDVMGRAVHGYSFVAAVARDNIFGVQFHPEKSHRFGLHLLTRFFELPAAVPSHA

SEQ ID NO: 30435 - DNA, 636 bp, Thermobifida fusca
  CDS (1)..(636)
atgcagccacgcgttgtcatcctcgactacggatcgggaaacctccgttccgcgcagcgggccgtggcgcgcgtcggcgcccacgccacgatcagcagtgacccgcacaccgcgttggaagccgacgggctcgtcgtccccggagtgggggcgtttgcagcgtgcatgcgcggactgcgtgcgctccgcggcgaccgcgtcatcggcaaacgcctcgccggaggccggcccgtcctcggtatctgcgtgggcatgcagatcctgttcgaacggggagtcgaaaacgacgtcgtcaccgaaggctgcgcggaatggcccggcaccgtggaacggctcgacgctcccgtcatcccccacatgggttggaataccgtggacgcgcccgcggaatccgccatgttcgccggaatcgacaaagacacgcgcttctacttcgtccactcctacggcgtgcgcacctgggagatgcagaccacaagcccgcacctgaaaccgccgctggttacctggtccacccacggcaccccgttcgtggcggccgtggagaacggtccgctgtgggccacccagttccacccggagaaatccggggacgcgggcgcccaactgctcgccaactgggtggcgacactgtag

SEQ ID NO: 30436 - protein, 211 aa, Thermobifida fusca
MQPRVVILDYGSGNLRSAQRAVARVGAHATISSDPHTALEADGLVVPGVGAFAACMRGLRALRGDRVIGKRLAGGRPVLGICVGMQILFERGVENDVVTEGCAEWPGTVERLDAPVIPHMGWNTVDAPAESAMFAGIDKDTRFYFVHSYGVRTWEMQTTSPHLKPPLVTWSTHGTPFVAAVENGPLWATQFHPEKSGDAGAQLLANWVATL

SEQ ID NO: 30437 - DNA, 609 bp, Methanosarcina barkeri str. fusaro
  CDS (1)..(609)
atgaaaagaattgtgattctcgattacgggcttggaaacctccgcagtgttcaaaaagggcttgaacacgtcggatcaagtcccgcaatctcaggggatcctgaggaaattcttgccgcagacggtttaattctcccgggggtcggcgcttttgtggacgcgatgaagtgccttgaccccatcaaagggactatagaagaatacgcaaggtcaggcaagccgatgctcgggatctgtcttggacaacaggttctcatgagttcttcggaggaaggaaagcttactgacgggcttgaccttatttccggaaaggtgctgcgctttccaaaatccgaactaaaggtgcctcatattggctggaacaatatcaaaatcaagcaggaccaccctctgtttgaagggattcctgacaactctttcgtatacttcgtccactctttctatgtggacacagcatctgaaaacacccttgcgtcctgcaattatgggctggacttttcagcttctgtcgtaaattctaaaggcaatgttatgggtacccagttccaccctgaaaaaagtggagctatcgggttgaagattctgaaaaactttgtagacatgtgctga

SEQ ID NO: 30438 - protein, 202 aa, Methanosarcina barkeri str. fusaro
MKRIVILDYGLGNLRSVQKGLEHVGSSPAISGDPEEILAADGLILPGVGAFVDAMKCLDPIKGTIEEYARSGKPMLGICLGQQVLMSSSEEGKLTDGLDLISGKVLRFPKSELKVPHIGWNNIKIKQDHPLFEGIPDNSFVYFVHSFYVDTASENTLASCNYGLDFSASVVNSKGNVMGTQFHPEKSGAIGLKILKNFVDMC

SEQ ID NO: 30439 - DNA, 633 bp, Geobacter metallireducens GS-15
  CDS (1)..(633)
atggcaacaatcgcaatcatcgactacggcatgggtaatctccgctccgtccagaaggggttcgaaaaggtggggttcgaggcggtggtgaccgccgacccgaaggtggtcctggaggcggagaaggtggtcctccccggcgtgggggcgttccgggactgtatgcgcaacctggagcagggtgggttcgtggagccgattctcacggtgatccaggatggacgccccttcctcggcatctgcgtcgggatgcagctcctcttcaccgatagcgtggagttcggcctttaccaggggctgaacgtcattcccggccacgtcctccgcttccccgaggggatgcgcgaaagaggcgaggatctcaaggtcccccacatggggtggaaccagctttccatcaaacgtcgcccttcggctttctccgatgttgaggatggagcgaacgtttatttcgttcactcgttctacgcaaagcccgatgaagagggtgtcgttgccgctacgagcagttacggtattgatttctgcgccgccgtctggaaggacaacatcgtcgccacccagttccaccccgagaagtcccaggcggtgggtttaagtattttaaaaaatttcgcgctttcaaaagcataa

SEQ ID NO: 30440 - protein, 210 aa, Geobacter metallireducens GS-15
MATIAIIDYGMGNLRSVQKGFEKVGFEAVVTADPKVVLEAEKVVLPGVGAFRDCMRNLEQGGFVEPILTVIQDGRPFLGICVGMQLLFTDSVEFGLYQGLNVIPGHVLRFPEGMRERGEDLKVPHMGWNQLSIKRRPSAFSDVEDGANVYFVHSFYAKPDEEGVVAATSSYGIDFCAAVWKDNIVATQFHPEKSQAVGLSILKNFALSKA

SEQ ID NO: 30441 - DNA, 630 bp, Novosphingobium aromaticivorans DSM 12444
  CDS (1)..(630)
atggctgagacgctcgcgctcgtcgactatggcgcgggcaacctgcgctcggttgcaaatgcgctcaaggcggcgggggccgagggcgtcgtggtgaccgccgatcctgcggtcgttcgggccgcagatcgcgtcgttctgcccggcgtaggtgccttcaaggcctgcataggtgctctcaggggcgtttcgggtcttgtcgaggcgatggaggagcgggtgctcgtgggcggtgctccgttcctcggcatttgcgtgggaatgcagctccttgccgaccgcggcgtggaacacggcgtcaccgagggcctcggctggatcggcggagaagtccgcgtgatcgagccggccgatccgtcgatcaaggtgccccacatgggctggaacgacgtcgcgccgatgccccacgaaggcggcgcggaactgatcgagcccggcgaggcctatttcctgcactcgtaccacttcgtcaccgacgccggcgcgcacatcgcggcgatgagcgaccacggtggcgggatcgtcgcggcggtcgcgcgcgacaatatcctgggcgtgcagttccacccggaaaagagccagtcctacggcctttctttgctcgcccgcttcctcgaatggaagccctga

SEQ ID NO: 30442 - protein, 209 aa, Novosphingobium aromaticivorans DSM 12444
MAETLALVDYGAGNLRSVANALKAAGAEGVVVTADPAVVRAADRVVLPGVGAFKACIGALRGVSGLVEAMEERVLVGGAPFLGICVGMQLLADRGVEHGVTEGLGWIGGEVRVIEPADPSIKVPHMGWNDVAPMPHEGGAELIEPGEAYFLHSYHFVTDAGAHIAAMSDHGGGIVAAVARDNILGVQFHPEKSQSYGLSLLARFLEWKP

SEQ ID NO: 30443 - DNA, 570 bp, Ferroplasma acidarmanus
  CDS (1)..(570)
atgatagcaattatcgatattaatacaggaaacctttccaatataaatagaatagtcaggggaaaagtaaccagcgatccatatgaaatagaaaaatctgtaaaaataatttttccgggggtggggtctttccagtatgtgtcacaaattattgagcctattaaggatctgctggtagagaaaataaagtccgggattccatatcttggaatatgcctcgggctggaaatcctcttcgaaaacagcgaagaaggccccggcaacggattaggagtattcaatggaactgtaaagaagtttaatggtgtaaaaactccccatatgggatggaatacagtaaatgtaaaatccccttcaaagattatggaaggcatagggaatgactcattcttttattttatgcattcatattatgcccctgaaaatcaatatacagttatggagacagaatacggaaataaatttgcttcaggaatcgaaatgggaaatatctatggggtgcagttccatcctgaaaaatccggaaacgatggcatacgggtattgaaaaattttggaggtttgaaatga

SEQ ID NO: 30444 - protein, 189 aa, Ferroplasma acidarmanus
MIAIIDINTGNLSNINRIVRGKVTSDPYEIEKSVKIIFPGVGSFQYVSQIIEPIKDLLVEKIKSGIPYLGICLGLEILFENSEEGPGNGLGVFNGTVKKFNGVKTPHMGWNTVNVKSPSKIMEGIGNDSFFYFMHSYYAPENQYTVMETEYGNKFASGIEMGNIYGVQFHPEKSGNDGIRVLKNFGGLK

SEQ ID NO: 30445 - DNA, 582 bp, Cytophaga hutchinsonii
  CDS (1)..(582)
atgaaactagcaatagtaaaatacaatgcgggtaatattcaatccgtcatatatgcgttaaatcgtttaggcattgagcctgtattgacagatgatgtagatgaattgagatctgcagataaagtattgtttccgggtcagggtgaagcatctaatgcgatgaattacctgcgcagcaaaggactggatcaggtgattaaagatctgaaacaaccggtgtttggtatttgcatcggtcagcagctattgtgcgaacattcagaagaaaacaatacagattgtttgggaattattcctgctaaagtaaagaagtttcctcctttggataaagtaccccagatcggctggaacacggttacagaattgaaaagccctttgtttaaagggatagcagaagagagctacgtgtattttgtacatagctattatgtagagtcaaatgcgtatcagatagcaacaacaaattacattctcccgtatgcgtgtgccctgcagaaagataatttctacgcggtacagtttcacccggaaaaaagcagcgacgtgggagaacaaatattgaaaaatttcatagagttgtaa

SEQ ID NO: 30446 - protein, 193 aa, Cytophaga hutchinsonii
MKLAIVKYNAGNIQSVIYALNRLGIEPVLTDDVDELRSADKVLFPGQGEASNAMNYLRSKGLDQVIKDLKQPVFGICIGQQLLCEHSEENNTDCLGIIPAKVKKFPPLDKVPQIGWNTVTELKSPLFKGIAEESYVYFVHSYYVESNAYQIATTNYILPYACALQKDNFYAVQFHPEKSSDVGEQILKNFIEL

SEQ ID NO: 30447 - DNA, 615 bp, Clostridium thermocellum ATCC 27405
  CDS (1)..(615)
ttgatagcggtaatagattatggagtaggtaatttaaaaagcgtggaaaaagcatttcaatttattggttatgatgcaaggacaacttctgataaagaacttattttaaatgcggattctgtggttcttccgggagtgggagcctttgcggatgccatggacagtctttcaaaaagcggaatgattgaagtaatacaaaaggttattgacagcggaaaaccgtttttgggcatttgccttggcatgcagcttttgtttgagtacagtgaagaaggtggacagaataagaagggacttgggatcttaaaaggtgcaatcaaacagcttccctttggcatgaatcttaaggtgcctcatatgggatggaatagtctggagcttaaaaacaagtctttgttgtttgacgggcttccccaaaaaccgtatgtttattttgttcactcttattacctcgacactgatgatgaagacattgtcattgcaaaaaccaactatggtatcaacttctctgttgcggtgcaaaagcaaaatgtttttgctacccagttccatcctgagaaaagcggtgaagttggacttaaaatattaaaaaattttgcgggaatcatattctaa

SEQ ID NO: 30448 - protein, 204 aa, Clostridium thermocellum ATCC 27405
MIAVIDYGVGNLKSVEKAFQFIGYDARTTSDKELILNADSVVLPGVGAFADAMDSLSKSGMIEVIQKVIDSGKPFLGICLGMQLLFEYSEEGGQNKKGLGILKGAIKQLPFGMNLKVPHMGWNSLELKNKSLLFDGLPQKPYVYFVHSYYLDTDDEDIVIAKTNYGINFSVAVQKQNVFATQFHPEKSGEVGLKILKNFAGIIF

SEQ ID NO: 30449 - DNA, 678 bp, Microbulbifer degradans 2-40
  CDS (1)..(678)
atgacccaacagcgcattgcagtcatcgattacggtatgggcaacttgcattcggttgccagtgctcttagccacgttgcgcccaccgaagacgtagtggttaccgccgaccccgacattattgccagtgcagatcgcgttatattcccaggtgttggcgccatccgcgattgcatggcggaaatactgcggttagacatcaacaccgttgtggataccgccatacaagccggtaaacccgtattggcaatatgtgtaggtatgcaggcgttaatgaatcgcagcgaagaaaacggcggcgtagattgcttaggtcgtattcccgggcaggttaaatttttctctgctagcccagaatttaaactggccagtgatgaaagcagcccttctggcgagcgcctaaaagtgccgcatatgggttggaaccaagtgcagcaaaccgtcgatcaccccatgtgggacaaaatcgacaacaacagccgcttctactttgtacacagctattatgtagaggtagaaaactccgatgtaattgccggtcgcgcccattacggcttggaatttaccgcatcgctgtttaaagataatttgttcgctgtgcagttccacccagaaaaaagtcaccacagcggcttgcagttgttatctaattttgtgcgttggaacggcgcctcgtag

SEQ ID NO: 30450 - protein, 225 aa, Microbulbifer degradans 2-40
MTQQRIAVIDYGMGNLHSVASALSHVAPTEDVVVTADPDIIASADRVIFPGVGAIRDCMAEILRLDINTVVDTAIQAGKPVLAICVGMQALMNRSEENGGVDCLGRIPGQVKFFSASPEFKLASDESSPSGERLKVPHMGWNQVQQTVDHPMWDKIDNNSRFYFVHSYYVEVENSDVIAGRAHYGLEFTASLFKDNLFAVQFHPEKSHHSGLQLLSNFVRWNGAS

SEQ ID NO: 30451 - DNA, 645 bp, Trichodesmium erythraeum IMS101
  CDS (1)..(645)
atgtcaactattgcagttatagattacgatatgggtaacttgcactccgtttgtaaaggcttagaaaaagcaggagcaactccaaaaattacagattcttcaatagaaatagacaaggctgatgcagtgattttaccaggggtagggtctttcgatccagcagtacaacatttaagaacacgcaacttagaaatacctattaaacaagttattgcttctggaaaaccatttttaggtatatgtttaggtttacaaatattatttgaaagtagcgaagaaggtcaagaaccaggcttaggaatatttgctggaaaagtatgtcggtttaaatctgaacctggcctgacaattccacaaatgggttggaataaattacaatttactcaaccagaacatcttttgtggagtgaaataggttctcaaccctgggtatattttgttcattcttattatgttgatcctacagactctcaagttacagcagcaactgtcacccatggtcatcaaactgttactgcagcagtaggaaaagataatttaatagcagtacaatttcacccagaaaaatcttctactgccggattaaaaattttgtcaaattttgttagtaaagttatccctaaaaatttggctttagctagttaa

SEQ ID NO: 30452 - protein, 214 aa, Trichodesmium erythraeum IMS101
MSTIAVIDYDMGNLHSVCKGLEKAGATPKITDSSIEIDKADAVILPGVGSFDPAVQHLRTRNLEIPIKQVIASGKPFLGICLGLQILFESSEEGQEPGLGIFAGKVCRFKSEPGLTIPQMGWNKLQFTQPEHLLWSEIGSQPWVYFVHSYYVDPTDSQVTAATVTHGHQTVTAAVGKDNLIAVQFHPEKSSTAGLKILSNFVSKVIPKNLALAS

SEQ ID NO: 30453 - DNA, 633 bp, Moorella thermoacetica ATCC 39073
  CDS (1)..(633)
atgcggccgattgctatcatcgactatggtatgggcaaccttttaagcgtccagaaggccctggaccgccttggttacccggtcgaggtaaccgacgacccaggagagatcaccgctgctcccggtgtcattctgcccggggtgggggcctttgccgacgctatggccaacctgcagcagaaggggctggtggcagccatccgcgaggttgcggagcggggcgtgcccttgctgggcatctgcctggggctacaactccttttctccaccagcgaggagggggggcaggtagccggcctggatctcctgccgggagaggtcaagaggttaccggccggcataaaagttccccatatgggctggaaccaggtccgtttcccgcggccgggggccctcttccggggaatccccgggggtacagacttttactttgtccattcgtattatattgtaccccgggaggaagaagtggtaaccggcaccaccgaatacggcctggagtttgccgtcagcatccagaggggcaacctcttcggggtccagtttcacccggagaagagcagccgccggggcctggaagttttaaagaatttcggggagttggtgcgccatgctggtaatgccggccattga

SEQ ID NO: 30454 - protein, 210 aa, Moorella thermoacetica ATCC 39073
MRPIAIIDYGMGNLLSVQKALDRLGYPVEVTDDPGEITAAPGVILPGVGAFADAMANLQQKGLVAAIREVAERGVPLLGICLGLQLLFSTSEEGGQVAGLDLLPGEVKRLPAGIKVPHMGWNQVRFPRPGALFRGIPGGTDFYFVHSYYIVPREEEVVTGTTEYGLEFAVSIQRGNLFGVQFHPEKSSRRGLEVLKNFGELVRHAGNAGH

SEQ ID NO: 30455 - DNA, 687 bp, Thiobacillus denitrificans ATCC 25259
  CDS (1)..(687)
atgagcgtcgatatcgccgtcgtcgactacggcatgggcaacctgcgctcggtgtccaaggcgatcgagcacgtcgcgccgtccgccacggtggtcgtcacctccagtccggacgtgatcgccgaagccggtcgggtcgtgttcccgggccagggcgcggcccgcgactgtatgcgcgagatcgacgcgcgcgggctgcgcgaggcgatcgccacggccgcgcgcagcaagcccttcctcggcatctgcatgggcatgcaggtgctcttcgagcacagcgaggaaggcgatacggcctgcctcgggattcttcctggcaacgtgcagcgctttccgcacgaggctatgcacgacgatcgcggcaacaagctcaaggtcccgcacatgggctggaacaacgtccaccagggcgcgccgcatccgctgtggtccggaatcgaggacggcgaacgcttttacttcgttcacagctatttcgtgcagccgacgacgcccgacttgatcgcgggcttctcgcattacccctttccgttcacctgcgccgtcgcgtccggaaacatcttcgccgtccagttccacccggaaaaaagccagaacgccgggctcacgctgctcggaaacttcgtgacctggaatccgggcgagcacgcctcggcctgcgatctctccggcgcaagctgcgcctga

SEQ ID NO: 30456 - protein, 228 aa, Thiobacillus denitrificans ATCC 25259
MSVDIAVVDYGMGNLRSVSKAIEHVAPSATVVVTSSPDVIAEAGRVVFPGQGAARDCMREIDARGLREAIATAARSKPFLGICMGMQVLFEHSEEGDTACLGILPGNVQRFPHEAMHDDRGNKLKVPHMGWNNVHQGAPHPLWSGIEDGERFYFVHSYFVQPTTPDLIAGFSHYPFPFTCAVASGNIFAVQFHPEKSQNAGLTLLGNFVTWNPGEHASACDLSGASCA

SEQ ID NO: 30457 - DNA, 639 bp, Silicibacter sp. TM1040
  CDS (1)..(639)
atgctgaccgccatcatcgactatgagtccggcaatctgcactccgccgagaaggcctttcagcgcatggcgacagaggtcggcgcgggggatgtggttgtcacatccgacgccgatgtggtggcccgcgctgatcggttggtgctgcccggcgacggtgcctttcccgcctgcgccgcagagctgcgcggccacaagggcatctatgacgccatggtcgaggctgtggaggtcaagggccgtcccttcctcgggatctgcgttggcatgcagttgatggccaccaccggtcacgaatatgaggacacgccggggcttggctgggtcgacggggatgtggtgaaaatcaccccggcagaggcacatctgaaggtgccgcatatgggctggaacgatctggtgatcaatcacccgcacccggtgtttgacggcatctcgaccggggatcactgctatttcgtgcacagctaccatttccgcgtcgccaacccgaacgaacggctggcacatgtggattatgcgggcgatgtcacggcagtgatcgggcgcgacaccatgcttggcatgcagtttcaccccgaaaagagccagcatgtcgggctcaagatgatcggcaatttcctcacctggaaaccctga

SEQ ID NO: 30458 - protein, 212 aa, Silicibacter sp. TM1040
MLTAIIDYESGNLHSAEKAFQRMATEVGAGDVVVTSDADVVARADRLVLPGDGAFPACAAELRGHKGIYDAMVEAVEVKGRPFLGICVGMQLMATTGHEYEDTPGLGWVDGDVVKITPAEAHLKVPHMGWNDLVINHPHPVFDGISTGDHCYFVHSYHFRVANPNERLAHVDYAGDVTAVIGRDTMLGMQFHPEKSQHVGLKMIGNFLTWKP

SEQ ID NO: 30459 - DNA, 639 bp, Pseudomonas aeruginosa UCBPP-PA14
  CDS (1)..(639)
atgcagacggtagccgtgatcgactacggcatgggcaacctgcactcggtggccaaggccctcgagcacgtcggtgccggccgggtgctggtgagcagcgacgcggcagtgatccgcgaggccgaccgggtggtgttccccggggtcggcgcgatccgcgactgcatggccgagatccgccgcctgggcttcgacgccctggtccgcgaggtcagccaggaccgcccgttcctcggcatctgcgtcggcatgcaggcattgctggagcgcagcgaggagaacgacggggtcgactgcatcggtctgttccccggccaggtgcgcttcttcggcaaggacctgcacgaagccggcgagcacctgaaggtgccgcacatgggctggaaccaggtgagccaggcggtggagcacccgctgtggcacgagattcccgaccaggcgcgcttctacttcgtgcacagctactacatcgaggccggcaatccgcgccaggtggtggggcacgggcactacggcgtcgatttcgccgccgcgctggccgaaggctcgcgtttcgccgtgcagttccacccggaaaagagccatacccacggcctgcaactgctgcagaacttcgtggcctgggacgggcgctggtag

SEQ ID NO: 30460 - protein, 212 aa, Pseudomonas aeruginosa UCBPP-PA14
MQTVAVIDYGMGNLHSVAKALEHVGAGRVLVSSDAAVIREADRVVFPGVGAIRDCMAEIRRLGFDALVREVSQDRPFLGICVGMQALLERSEENDGVDCIGLFPGQVRFFGKDLHEAGEHLKVPHMGWNQVSQAVEHPLWHEIPDQARFYFVHSYYIEAGNPRQVVGHGHYGVDFAAALAEGSRFAVQFHPEKSHTHGLQLLQNFVAWDGRW

SEQ ID NO: 30461 - DNA, 654 bp, Ralstonia eutropha JMP134
  CDS (1)..(654)
atgactaccatagcaattgtggattacggcgtgggcaacctgcgctcggtggcgcaggccctgcgggccgcggcaccggaggcggatgtgcgcgtggtggatgccccggaaggcattcggagcgcggatcgcgtggtgctgccggggcagggcgccatgcctgactgcatgtcggcgctgggcgcttcggggctgcaggaggcggtgatcgaggcggcagccagcaagccgatgttcggtgtgtgcgttggcgaacagatgctgttcgagtccagcagcgaagccaggcccggcaccgacaagacgccttgcctggggctgatgccgggtgaagtcatccgcttcgaactggacgggatgacccagccggacggctcgcgctacaaggtgccgcagatgggctggaaccgcgtcaaacagtccaggccccatccgctgtgggatggcatcccggacgaaagctggttttacttcgtgcacagctacttcgtgcgcgcgcaggatccggcccatattgccggcgaaacggagtatggggtcgtgtttaccagtgcggtagcacgcgataatatttttgccacgcagttccaccccgaaaaaagcgcagccatggggttgcagctttaccggaacttcgtgcactggaatccctga

SEQ ID NO: 30462 - protein, 217 aa, Ralstonia eutropha JMP134
MTTIAIVDYGVGNLRSVAQALRAAAPEADVRVVDAPEGIRSADRVVLPGQGAMPDCMSALGASGLQEAVIEAAASKPMFGVCVGEQMLFESSSEARPGTDKTPCLGLMPGEVIRFELDGMTQPDGSRYKVPQMGWNRVKQSRPHPLWDGIPDESWFYFVHSYFVRAQDPAHIAGETEYGVVFTSAVARDNIFATQFHPEKSAAMGLQLYRNFVHWNP

SEQ ID NO: 30463 - DNA, 654 bp, Polaromonas sp. JS666
  CDS (1)..(654)
atggcggtcgtcgactacggctcgggcaacctgcgttcggtgtcacaagctgttcagcatgtgtctcagggcagcggctatgaggtgttggtcacctcgcgcgcgcaggacgtgctggacgccgagcgtgtggtgctgcccggccagggggccatgcctgactgcatgcgggcgctgtctgaatccggcctgaaggatgcggtattgcatgccgccgcgaacaaacccctgttcggcgtgtgtgtgggcatgcagatgctgctggaccgcagtcacgagggggtcgccggcatcgcaacgcccggcctgggcctgattcccggcgaggtcgtcaagttcgacctggccgggcagatccagcccgatggcagccgctacaaggtgccgcaaatgggctggaaccaggtgtggcggcctgcctcgatccagcacccgatctgggctggcgtgccggacggtgcctatttttacttcgtgcacagcttttatgcccgtccgtcggatgcgcgccacatcgccggagaggcggactatggcgggcgctttacggcggcaattgcacgcgataatatttttgccacccagttccaccccgagaaaagcgccgaccacggactggccctgtaccgcaatttcctgcactggaagccctga

SEQ ID NO: 30464 - protein, 217 aa, Polaromonas sp. JS666
MAVVDYGSGNLRSVSQAVQHVSQGSGYEVLVTSRAQDVLDAERVVLPGQGAMPDCMRALSESGLKDAVLHAAANKPLFGVCVGMQMLLDRSHEGVAGIATPGLGLIPGEVVKFDLAGQIQPDGSRYKVPQMGWNQVWRPASIQHPIWAGVPDGAYFYFVHSFYARPSDARHIAGEADYGGRFTAAIARDNIFATQFHPEKSADHGLALYRNFLHWKP

SEQ ID NO: 30465 - DNA, 699 bp, Haloarcula marismortui ATCC 43049
  CDS (1)..(699)
atgagtgtcagacagacgactgcggacgtggtcgtcgtcgattacggactggggaacctccggagcgtcacgcgcgggctcgaacgcgccggcgcgaacgtttcgctctcggaggaccccgcagagttcgacgcggctgacggcatcgtcctgcccggcgtcggagccttctccgaagggatggacaacgctgggccgttccgcgaggcgctggtcgaacaggccgaggccgggaagcccctgttcggaatctgtctcgggatgcagatgctcctgacgacgagtgaggaggccgaccacgaaggacagggcgacgccgaggggctggacctcattccggggaagaacgtccggttcagccgcgaccagaccgtgccacacatgggctggaacgaacttgacgtgacgcgggaccatcccctcgtcgagggcgtcgacagcgtggggtcgaagaccccacgggcagacggaaccggtggttccgtcgacggcgaacacgcctacttcgtccactcctactacgccgttcctgacgacgagagcgcgacggtggcgacgacggactacgggacagacttcgcatcgattgttgccaacgacgccggcaacgtcttcgggacgcagttccacccggagaagtcgggcgaaaccgggcttcgcatcctccggaactacgtcgactactgtctcgaccactga

SEQ ID NO: 30466 - protein, 232 aa, Haloarcula marismortui ATCC 43049
MSVRQTTADVVVVDYGLGNLRSVTRGLERAGANVSLSEDPAEFDAADGIVLPGVGAFSEGMDNAGPFREALVEQAEAGKPLFGICLGMQMLLTTSEEADHEGQGDAEGLDLIPGKNVRFSRDQTVPHMGWNELDVTRDHPLVEGVDSVGSKTPRADGTGGSVDGEHAYFVHSYYAVPDDESATVATTDYGTDFASIVANDAGNVFGTQFHPEKSGETGLRILRNYVDYCLDH

SEQ ID NO: 30467 - DNA, 621 bp, uncultured archaeon GZfos18F2
  CDS (1)..(621)
atgatctccatcattgattacaaggccggaaatctcgcgagtgtggtctgtgccgtgcgttaccttggatttgaatgccgggtcacacgctcaataaacgatatcctgtccgcagagcgcgttatcttccccggagtcgggtcggcgcggcaggccatggaagaccttgaagagaccggcattgacgaggccataaggcaatattgcgcatcagggcgcccgtttttgggtatctgtctcggcacccagatcattctcgaaaagagcgaggagcttgacaccacatgcctcggcctgatccgaggtgaggtgattcgattcccagaaccgctcctttccgataccggcgagcgcctcaaggtcccccacatgggatggaatcgggtcgagttccctgaaagacaccctgctctgaaagggatagaccctcaaagtgaattctattttgttcactcttactaccctgtgcctgtgtcagagaaggccatagtcggaaccacaacacacgggatcgcattcgcaagcatcctggaacaggacaacatcattgcaacccagtttcacccggaaaaaagcggccgccccggtctggagtttttgaaaaatttttgcaggacataa

SEQ ID NO: 30468 - protein, 206 aa, uncultured archaeon GZfos18F2
MISIIDYKAGNLASVVCAVRYLGFECRVTRSINDILSAERVIFPGVGSARQAMEDLEETGIDEAIRQYCASGRPFLGICLGTQIILEKSEELDTTCLGLIRGEVIRFPEPLLSDTGERLKVPHMGWNRVEFPERHPALKGIDPQSEFYFVHSYYPVPVSEKAIVGTTTHGIAFASILEQDNIIATQFHPEKSGRPGLEFLKNFCRT

SEQ ID NO: 30469 - DNA, 693 bp, uncultured archaeon GZfos14B8
  CDS (1)..(693)
atgattaaactttttttacactttttctttttagaaaaaagaaaaaaatatttctttggtaaagctttctttttaaaagaaaggtttatgatcgcaataatagactatgggatggggaatctgttcagcatatacaacgggatgaaaaaggtgtatgataatccgatgctgattactgcggataatattccaagtataagaaccgcagaaggcgttattgttcccggcgtgggtgcatttgatgactgcatacgaaacctagaacctttttctgaggtgttaatcgagggtgtagaatccggcgtgccggtactctggatctgcattgggatgcagattttatttgaagcgagcgaagagggcaaggaaaaagggttggggttgataccaggaaaagtagttcgtttacctgcagatgtgagagttccacacatgggttggaacaatttacatctgcaaaggcattcaaatctgctgaatgggattacggatgcagattatttctatttcgtgcattcttattattgcgtgccgagagatgaggacgctgttatggcatcagcagaatacggcgcgcagttagccgcggtggtgaataaggacaatgtatatggcgtgcagtttcacccagagaagtcatcgaagaaggggttgcagattttacgtaattttgtgcatatatgcaagcgttaa

SEQ ID NO: 30470 - protein, 230 aa, uncultured archaeon GZfos14B8
MIKLFLHFFFLEKRKKYFFGKAFFLKERFMIAIIDYGMGNLFSIYNGMKKVYDNPMLITADNIPSIRTAEGVIVPGVGAFDDCIRNLEPFSEVLIEGVESGVPVLWICIGMQILFEASEEGKEKGLGLIPGKVVRLPADVRVPHMGWNNLHLQRHSNLLNGITDADYFYFVHSYYCVPRDEDAVMASAEYGAQLAAVVNKDNVYGVQFHPEKSSKKGLQILRNFVHICKR

SEQ ID NO: 30471 - DNA, 609 bp, uncultured bacterium 440
  CDS (1)..(609)
atgataggcataattgattacggcttaagtaatattggttcaatttccaatgcggtaaacaaacttaatcatagttaccaaataatcagtaattcaaaaaatttaaataaaattgataagattattttacctggtgttggaaattttaaaaaagctatagcaaatttaaaaaaacaaaatttatttgattctttaaaggactttattacggataaaaaaaagccttttttgggaatctgtcttggaatgcaaattttatacaatcatagttcggaagatggtggagaaaatggacttggtgtaataaatggaaaagttaagcaattaatgcctagcaaaaaatttaaagttccaaatgtgggatggagagaaattgagattcttaaaaaaggtgttttaataaatcaatttattgataaaccaattttttactttgtacataaatatgcttgttattctgaagaaaaaatcaatacagttgctcaactaaattatataaatcaatttgattgtattatagaaaaagaaaatatttttggtacacaatttcatccagaaaagagtcaaaaaaatggattacaactattaaataattttttaaaaatttaa

SEQ ID NO: 30472 - protein, 202 aa, uncultured bacterium 440
MIGIIDYGLSNIGSISNAVNKLNHSYQIISNSKNLNKIDKIILPGVGNFKKAIANLKKQNLFDSLKDFITDKKKPFLGICLGMQILYNHSSEDGGENGLGVINGKVKQLMPSKKFKVPNVGWREIEILKKGVLINQFIDKPIFYFVHKYACYSEEKINTVAQLNYINQFDCIIEKENIFGTQFHPEKSQKNGLQLLNNFLKI

SEQ ID NO: 30473 - DNA, 612 bp, Rhizobium leguminosarum bv
  CDS (1)..(612)
gtgatcactgtggtagactatggcgtcgggaatatcggcgcaattaccaatatggcggagtatctggggatcgatgctcggccaagcggtgatcccaaggagatcgaaagtgccgcgaagctcgttcttccaggggtcggtgcgtttgacaaagcaatggccacgttgagaaacagaaaattagtcgatccactgaatcacgcggtgcgcgaacggagggttcctgttctcggcatatgtctcggtatgcagctgttggcgcgatccagcgaggaaggctcggaaactggactaggctggataaatgcggatgtgaagcgcatcaggctgccggcaacatcatcccttaaggttcctcatatcggttggcttgagataaagccgcgccgagaaagcgctctgttcgacaggtccaaccggcgggagcgcttctatttcgaccacagctattttgtcgattgcgatgatccgaatgacgttaccgccgtcatcgactacggcgaggagctatgttgcgcagtgagttcgaacaatgtcagcggcgtgcaatttcatcctgaaaaaagccaccgcttcgggatgcgggttcttgaagcattcggaaagctttga

SEQ ID NO: 30474 - protein, 203 aa, Rhizobium leguminosarum bv
MITVVDYGVGNIGAITNMAEYLGIDARPSGDPKEIESAAKLVLPGVGAFDKAMATLRNRKLVDPLNHAVRERRVPVLGICLGMQLLARSSEEGSETGLGWINADVKRIRLPATSSLKVPHIGWLEIKPRRESALFDRSNRRERFYFDHSYFVDCDDPNDVTAVIDYGEELCCAVSSNNVSGVQFHPEKSHRFGMRVLEAFGKL

SEQ ID NO: 30475 - DNA, 1779 bp, Arabidopsis thaliana
  CDS (1)..(1779)
atggaggctacggcggcgccattctcttcaattgtctcttccagacaaaacttctcttcatcttcttcgattcgcgcttcttctccggcttctttattcctctcccagaagagtattggcaatgttaatcgcaaattcaaatctcccagaagcctctccgtccgcgcatcttctacctcagattctgttgtgactttgcttgactacggagctggaaatgttcggagcatccgcaatgctcttcgtcatctcggcttcagcatcaaagacgttcaaacgccgggagacattctgaatgctgatcgactcatatttccaggcgttggtgcttttgcacccgccatggatgtacttaacagaactgggatggctgaagctttgtgcaaatatattgagaatgaccgtccatttctaggcatatgtcttggtctacaactacttttcgattctagtgaagagaatggaccagtcaaaggtcttggtgtgataccgggaatagttggacgctttgatgcttcagctggtataagagtaccccacattggctggaatgctttgcaagttgggaaggattctgaaattttggatgatgttggaaaccgtcatgtctattttgttcattcgtacagggccattccatcagatgaaaataaggactggatttcgtctacctgtaattatggtgaatcatttatatcttccataagaaggggaaatgtgcatgcagttcaattccatcctgaaaagagcggggaggtggggctttctgttttaagaaggttcttgcatccaaaattacctgcaacacagaagccaatggaaggaaaggcctcaaaacttgcaaagagggtgattgcttgtcttgatgtgaggacgaatgataaaggagatctcgtagttactaaaggggatcagtatgatgtgagagagcaatctaatgaaaacgaggttcgaaaccttggcaaacctgttgatttggctgggcagtattacaaagatggtgcagatgagattagctttttaaacataactggattccgcgattttcctctaggggatttgccgatgattcaggtgttgaggcagacatcaaagaatgtctttgtaccactaactgttggaggtggtattagagactttacagatgctagtggcaggtactattctagcttggaagttgctgctgagtatttcagatccggtgctgataagatctccataggaagtgacgctgtttctgctgcagaggagttcataaaatcaggggtgaagacaggaaagagtagtttagaacagatatccagagtttatggaaatcaggcagtggttgtaagtattgatcctcgtagagtttatgtgaaccatccggatgatgtgccatacaaagtcatcagagtaactaatccaggcccaaatggagaagaatatgcccggtatcagtgcacggtcagtggaggacgagaaggtcgacctattggagcatttgagcttgcgaaagcggttgaagaattaggtgccggtgaaatactattgaactgcatagactgtgatggtcaagggaaaggattcgacatagacttagtaaagctcatctcagattcagtaggcataccggtgatcgcaagcagtggagcaggtactcccgaccacttttccgaggtgtttgagaagacaaacgcatctgccgcgcttgctgccggcattttccaccggaaagaggtaccaatccaatctgtgaaagagcacttacaagaggagcgcatagaagtcaggatctga

SEQ ID NO: 30476 - protein, 592 aa, Arabidopsis thaliana
MEATAAPFSSIVSSRQNFSSSSSIRASSPASLFLSQKSIGNVNRKFKSPRSLSVRASSTSDSVVTLLDYGAGNVRSIRNALRHLGFSIKDVQTPGDILNADRLIFPGVGAFAPAMDVLNRTGMAEALCKYIENDRPFLGICLGLQLLFDSSEENGPVKGLGVIPGIVGRFDASAGIRVPHIGWNALQVGKDSEILDDVGNRHVYFVHSYRAIPSDENKDWISSTCNYGESFISSIRRGNVHAVQFHPEKSGEVGLSVLRRFLHPKLPATQKPMEGKASKLAKRVIACLDVRTNDKGDLVVTKGDQYDVREQSNENEVRNLGKPVDLAGQYYKDGADEISFLNITGFRDFPLGDLPMIQVLRQTSKNVFVPLTVGGGIRDFTDASGRYYSSLEVAAEYFRSGADKISIGSDAVSAAEEFIKSGVKTGKSSLEQISRVYGNQAVVVSIDPRRVYVNHPDDVPYKVIRVTNPGPNGEEYARYQCTVSGGREGRPIGAFELAKAVEELGAGEILLNCIDCDGQGKGFDIDLVKLISDSVGIPVIASSGAGTPDHFSEVFEKTNASAALAAGIFHRKEVPIQSVKEHLQEERIEVRI

SEQ ID NO: 30477 - DNA, 615 bp, Pseudomonas aeruginosa
  CDS (1)..(615)
atgatcactattattgactatgggatcggtaatatacaggcatttgtcaatgtctacaaacgtctgcatatacctgcgcaggtggctcgtgtaaattctgatctgaagaacgtagaaaaactagtccttcccggggtgggttcattcgatcatgccatgctgcgatttactgagtctggaatgcgtgaagctgttgagtttttggtgaaagataaaggtatacccgttcttggtatttgtgtgggtatgcagatgctggctgacagaagtgatgagggtaagttaccaggcttgggttggattcctggccacgttcgttcttttcgctccgtaactgggctgcaaaatattgcaatgccacatatggggtggaatgacgtagtatcggttggtaacaatcctctgtttaatggcttggaacagggggcgcgcttctattttttgcattctttttactttgaaagcttgtatctcgaacatgtcgctgcgggaactttctacgggcatgacttcaatagtgcagtctcaagggacaatattttcggtgtccagtttcatcccgagaaaagccaccactttggggtcaagctcctaaagaatttcgcggaactctga

SEQ ID NO: 30478 - protein, 204 aa, Pseudomonas aeruginosa
MITIIDYGIGNIQAFVNVYKRLHIPAQVARVNSDLKNVEKLVLPGVGSFDHAMLRFTESGMREAVEFLVKDKGIPVLGICVGMQMLADRSDEGKLPGLGWIPGHVRSFRSVTGLQNIAMPHMGWNDVVSVGNNPLFNGLEQGARFYFLHSFYFESLYLEHVAAGTFYGHDFNSAVSRDNIFGVQFHPEKSHHFGVKLLKNFAEL

SEQ ID NO: 30479 - DNA, 1884 bp, Candida albicans
  CDS (1)..(1884)
atgacgaaaacaatccatatcatcgatgtagaaagtggtaatttacaatcactttcaaatgcaatcaaacgtatcgattctaattatatcattaaattcattcataatgaacaagatttcattgataatgattctcaaattgaaaaattgattttccctggtgttggtaattttggacattttgttaaacaattaaatgaacggaaattaattaatcatttaaaatcatatattaaacaagatcgtccattaatggggatttgtgttggtttacaatcgatttttcatgaatcggaagaaagtccaaatattaaaggattaggattattattagataatgatgataatgatgatgatgatgagaagaagttaaaattatataaatttgataatgatgatgaaaaatttaaaatcaggggcattaaaaaatctgttcctcatattggttggaataatattcatgatataattattaatggcaaacaaacaacgactaaatctttatatggattgaataagattgataaatattattttgttcattcttatgctgcaattattaaaaataataatgatgaaataattgaaaataaattcattaaggatttatcttcaaaaggttgggatttggcaattagtcaatatggatcagaaaaatttatatctgctatatcaaaaaataatttatttgctactcaatttcatccagaaaaatccggaattgttggtttaaaaattattaaaaattttttaaatggtgaaaagaacccaaccccaaccccaaccccaaccccaactccaaacaacctagcccaaggggtagattcttcttctactttggatgttgaaaccaccttaacggggttgactagaagaattattgcatgtcttgatgttagaactaatgatgatggtgatttagtggtcactaaaggtgatcaatataatgttcgagaacaattatcatcatcatcaactaacgaatctgccgaggaggattcttcacaggttcgtaatttaggtaaaccagttgaattagcaacaaaatattataatcaaggagctgatgaaattacatttttaaatatcacatctttccgtaattctcctttaaaagatttacccatgttacaagtattgaaaaaagctgctgaaactatatttgttccattgactgttggtggaggtattaaagatttatatgatccagaaactgggaaaactgttcctgctgttgatgtggctcatttatatttccaatcaggtgctgataaaattagtattggatctgatgccgttaccattgccgaaaattattatgccaataatggggaaattaccggtctttcatcaattgaaaccatttcttccaaatttggtaatcaagcagttgttatatcagttgatcctaaaagaaaatatatcaaagatccaacaactgaaactactactatgcaaacaataaaaatcactgatccttcacaatatggtccaaatggtgaacaatattgttattatcaagtaacttctcaaggtggaaggaaaattcatgaattaggtgcattagaattatgtttagcttgtgaaaaattgggagctggagaaattttattaaattcaatcgatcatgatggttccaataaaggatttaatttacaattattacaacaaattaaatctcaagtttcaatccccgtgattgctagtagtggtgctggtaatcctcaacatttccaacaagtatttgaaatggattgtggaattgatgctgctttaggtgctggtttgtttcatcgtggtgaatataccgttaatcaagtaaagaaatatttacaacaagaagcaaaaatggatgttagattagatgaagatttggagttgtaa

SEQ ID NO: 30480 - protein, 627 aa, Candida albicans
MTKTIHIIDVESGNLQSLSNAIKRIDSNYIIKFIHNEQDFIDNDSQIEKLIFPGVGNFGHFVKQLNERKLINHLKSYIKQDRPLMGICVGLQSIFHESEESPNIKGLGLLLDNDDNDDDDEKKLKLYKFDNDDEKFKIRGIKKSVPHIGWNNIHDIIINGKQTTTKSLYGLNKIDKYYFVHSYAAIIKNNNDEIIENKFIKDLSSKGWDLAISQYGSEKFISAISKNNLFATQFHPEKSGIVGLKIIKNFLNGEKNPTPTPTPTPTPNNLAQGVDSSSTLDVETTLTGLTRRIIACLDVRTNDDGDLVVTKGDQYNVREQLSSSSTNESAEEDSSQVRNLGKPVELATKYYNQGADEITFLNITSFRNSPLKDLPMLQVLKKAAETIFVPLTVGGGIKDLYDPETGKTVPAVDVAHLYFQSGADKISIGSDAVTIAENYYANNGEITGLSSIETISSKFGNQAVVISVDPKRKYIKDPTTETTTMQTIKITDPSQYGPNGEQYCYYQVTSQGGRKIHELGALELCLACEKLGAGEILLNSIDHDGSNKGFNLQLLQQIKSQVSIPVIASSGAGNPQHFQQVFEMDCGIDAALGAGLFHRGEYTVNQVKKYLQQEAKMDVRLDEDLEL

SEQ ID NO: 30481 - DNA, 606 bp, Campylobacter jejuni
  CDS (1)..(606)
atgatagcgctcattgattacaaggcgggaaatttaaactctgttgctaaggcttttgaaaaaataggagctataaatttcatagctaaaaatccaaaagatttgcaaaaagcagataaattgcttttacctggagtgggatcttttaaagaagcgatgaaaaatttaaaagaacttggttttatagaagctttaaaagagcaagttttagtacaaaaaaaacctattttaggcatttgtttaggaatgcagctttttttagaaaggggctatgaaggtggagtttgcgaaggacttggttttatagaaggtgaagtagtcaaatttgaagaggatttaaatttaaaaatcccacatatgggttggaatgagcttgaaattttaaaacaagttcctttgtatcaaggcatagataataagagtgatttttattttgtgcattctttttatgtgaaatgcaaagatgagtttgtaagcgctaaagcacaatacggacataaatttgttgcatctttacaaaaagatcatatttttgctacacaatttcaccctgaaaaaagtcaaaatttaggtttaaaacttttagaaaattttgcaaggctttaa

SEQ ID NO: 30482 - protein, 201 aa, Campylobacter jejuni
MIALIDYKAGNLNSVAKAFEKIGAINFIAKNPKDLQKADKLLLPGVGSFKEAMKNLKELGFIEALKEQVLVQKKPILGICLGMQLFLERGYEGGVCEGLGFIEGEVVKFEEDLNLKIPHMGWNELEILKQVPLYQGIDNKSDFYFVHSFYVKCKDEFVSAKAQYGHKFVASLQKDHIFATQFHPEKSQNLGLKLLENFARL

SEQ ID NO: 30483 - DNA, 633 bp, Leptospira interrogans
  CDS (1)..(633)
atgatcgccattcttgattatggaatgggaaatattcattcttgtttaaaagccgtatctctttatactaaggattttgtttttacaaaagatcattcaacgattgaaaattcaaaagctctaatattaccaggtgacggacattttgataaagcgatggagaacttgaattcaactggacttcggaaaacgattgataaacacgtaacttccggaaaacctcttttcggaatttgtatcggctttcaaattctttttgaatcttcagaagagattgctcaaggttcaaaaaaagagcagatcgaaggtttaggatatatcaaaggtaaaatcaaaaaatttcacggaaaggattttaaagttccgcatattggttggaatcgccttcaaattcgtagaaaagataaaagtgttcttttaaaaggaattggagatcaatcttttttttacttcattcattcttatagacctactgatgctgaaggaaatgcgatcaccggactttgtgattactaccaggaaaaatttccagccgttgtagagaaaaataatattttcggaacgcagttccatcctgaaaaatcacatacccacggacttaaacttttggagaattttattcgttttatatga

SEQ ID NO: 30484 - protein, 210 aa, Leptospira interrogans
MIAILDYGMGNIHSCLKAVSLYTKDFVFTKDHSTIENSKALILPGDGHFDKAMENLNSTGLRKTIDKHVTSGKPLFGICIGFQILFESSEEIAQGSKKEQIEGLGYIKGKIKKFHGKDFKVPHIGWNRLQIRRKDKSVLLKGIGDQSFFYFIHSYRPTDAEGNAITGLCDYYQEKFPAVVEKNNIFGTQFHPEKSHTHGLKLLENFIRFI

SEQ ID NO: 30485 - DNA, 651 bp, Prochlorococcus marinus
  CDS (1)..(651)
atgaccgcttgcgtacttattgttgatgcaggcctagggaatataggttccgttgttgcagcatacgatcgtcttggtgtacgcaattttcgtattcgcaaacctccttcagatattgcttgctacacccatttgattctccctggtgtaggttcattctctgctggaatggactcacttaacagtttaggttggtcagattggttgaaagatgtttggcttccaacaggacgtcccttacttggcatctgccttggtatgcaacttcttgcctctagaggttttgaaggctctgattcaggtaattcaatccccggactcgatcttatctcaggtaaaatcgtacttatgtcccctagtcaaaatttggcgcttccccacgttggctggaattcggtgtattggtcaaacacaataaccccactttcagtagacataaattctggctgtgatttttattttgttcatagttacacattccgttgtgatgatgattcaaactgccttgctacctctaattatggttcacaattttccgctgttgtttcagacattagtcgtaatgtatggggtatgcagtttcatccagaaaaaagtcaaaagttgggtaagtgtctccttcaaaatttcattgctcttaatccatgctga

SEQ ID NO: 30486 - protein, 216 aa, Prochlorococcus marinus
MTACVLIVDAGLGNIGSVVAAYDRLGVRNFRIRKPPSDIACYTHLILPGVGSFSAGMDSLNSLGWSDWLKDVWLPTGRPLLGICLGMQLLASRGFEGSDSGNSIPGLDLISGKIVLMSPSQNLALPHVGWNSVYWSNTITPLSVDINSGCDFYFVHSYTFRCDDDSNCLATSNYGSQFSAVVSDISRNVWGMQFHPEKSQKLGKCLLQNFIALNPC

SEQ ID NO: 30487 - DNA, 633 bp, Synechococcus sp
  CDS (1)..(633)
atgtcaaaaattgcaattgttgattatggaatgtgtaatctttggtccattaagtctgccattcaattcataggttatgattcgattttgacttctgatcccaaagatattttaaactcgtctgctataatattacctggtgttggttcatttaagactggaatggataatcttttatctttaggtctatcacaagcaattattgatgcttgtatgtttaggtcaattccaatcttaggaatatgcttaggttttcaattattgtgctgtagcagtgaagagccttcgtatacgaaagggctttcactattaccaatccagattgttccactgtgccgacatattgatgcttcatttgttcttccacatgtaggttttacttcagtttatacatcaaagaatgatcctctcttcaagaatattgctaacaaatcagatttttattttgttcattcatatggggcgtttaatgttccccatgactttactacctactcatattgtaattatgatgcaaaaatcatctcttcagccaatgttaatcacataatgggtgttcagtttcatcccgaaaagagtcagaccaatggccttattctattagataacttcttgtctttttccaatgtctaa

SEQ ID NO: 30488 - protein, 210 aa, Synechococcus sp
MSKIAIVDYGMCNLWSIKSAIQFIGYDSILTSDPKDILNSSAIILPGVGSFKTGMDNLLSLGLSQAIIDACMFRSIPILGICLGFQLLCCSSEEPSYTKGLSLLPIQIVPLCRHIDASFVLPHVGFTSVYTSKNDPLFKNIANKSDFYFVHSYGAFNVPHDFTTYSYCNYDAKIISSANVNHIMGVQFHPEKSQTNGLILLDNFLSFSNV

SEQ ID NO: 30489 - DNA, 588 bp, Campylobacter jejuni
  CDS (1)..(588)
atgaaaatcatcatcatcgatacagcctgtgcgaatttagcatctttgaaattttgtctagatagattaggttttaatgcaactatcagtagggatttaaaagagcttgaaagtgcggataagctttttttacctggagtgggtaccgcaaaagaagcaatgaaaaatttagaacaatttaatcttattgattttattcaaaataccaaaaaacctttgcttggtatttgtttaggtatgcaaattttaggaaatttttctgaagaattaaatcaagaaaccttaaaactcatagattttacaactcaaaaatttaaagctaaagaaggctttacttttccacatatgggatggaatgaagtttatagctctcatgctttgtttaaaggcttagaaggggcttatttttattttgtgcatagttattgtgtaggacttgggaaatacactatagcagattgtgagtattcgcaaaaatttagcgcaagcgtaatgaaagataatttttacggagtgcaatttcaccctgaaagaagtagcgaggctggggaaattttaatttcaaattttattaaggatataggatga

SEQ ID NO: 30490 - protein, 195 aa, Campylobacter jejuni
MKIIIIDTACANLASLKFCLDRLGFNATISRDLKELESADKLFLPGVGTAKEAMKNLEQFNLIDFIQNTKKPLLGICLGMQILGNFSEELNQETLKLIDFTTQKFKAKEGFTFPHMGWNEVYSSHALFKGLEGAYFYFVHSYCVGLGKYTIADCEYSQKFSASVMKDNFYGVQFHPERSSEAGEILISNFIKDIG

SEQ ID NO: 30491 - DNA, 615 bp, Leptospira interrogans
  CDS (1)..(615)
gtgattggaatcttagactacggagtcggaaatttaaaagcgtttgcgaatgtactgaaagatttgaattttcgtaaccaaattgttaaaaccgaacaggagctcaagagttgcacaaaaatcattatgccgggagtaggttcttttgatagcgtaatggataagttgagcgagtcaggtatcagggatgtactttccgatctggtaatgagtaaaaaaattccggtacttggagtatgtgtgggaatgcaaattttagcctcttcaagcgaagagggaaccaaatccggactgggttggattcaaggaaaagttaaaaagtttaattttgatcaatcaaattctttactcacagttcctcaaattggttggaatgaagtgacctctattcgtgataataaacttttattgaatttggagaaaaatccgcgcttttattttttacattcttattatatggaatgtgaagaagacaatgatgtaatcgcttttgccgattatggagggaattttacttgtgcagtaaatcgagataatatatttgggactcagtttcatcctgaaaaaagtcatcataatggcgtagcgttgttacgcaattttgccagtttataa

SEQ ID NO: 30492 - protein, 204 aa, Leptospira interrogans
MIGILDYGVGNLKAFANVLKDLNFRNQIVKTEQELKSCTKIIMPGVGSFDSVMDKLSESGIRDVLSDLVMSKKIPVLGVCVGMQILASSSEEGTKSGLGWIQGKVKKFNFDQSNSLLTVPQIGWNEVTSIRDNKLLLNLEKNPRFYFLHSYYMECEEDNDVIAFADYGGNFTCAVNRDNIFGTQFHPEKSHHNGVALLRNFASL

SEQ ID NO: 30493 - DNA, 609 bp, Pseudomonas aeruginosa
  CDS (1)..(609)
gtgatcgttgttattgattacggtgtaggtaacattgcttcagtcttgaacatgctgaagcgagttggtgccaaagccaaggcatccgatagccgagaggatatcgagcaggcggagaaactgattttgcctggtgtcggtgcttttgacgccggaatgcaaacactacgcaagagtgggctggtggatgtactgacagagcaggtcatgatcaaacgaaagccggtcatgggggtgtgtctcgggagtcagatgctggggctgcgatctgaggagggagcggaaccggggcttggatggatcgatatggatagcgtccgtttcgaaaggcgtgacgaccgaaaggttccacatatgggctggaatcaagtgtcaccgcaattggagcatcctatacttagcggtataaacgagcaaagccgattctattttgttcatagttattatatggttccgaaagacccagacgatatcctgttgagttgtaattatgggcaaaaattcactgcggcggtggctcgggataatgttttcggatttcagtttcatcctgagaagagtcataaattcggtatgcagttattcaaaaacttcgtggagcttgtctga

SEQ ID NO: 30494 - protein, 202 aa, Pseudomonas aeruginosa
MIVVIDYGVGNIASVLNMLKRVGAKAKASDSREDIEQAEKLILPGVGAFDAGMQTLRKSGLVDVLTEQVMIKRKPVMGVCLGSQMLGLRSEEGAEPGLGWIDMDSVRFERRDDRKVPHMGWNQVSPQLEHPILSGINEQSRFYFVHSYYMVPKDPDDILLSCNYGQKFTAAVARDNVFGFQFHPEKSHKFGMQLFKNFVELV

SEQ ID NO: 30495 - DNA, 639 bp, Synechococcus sp
  CDS (1)..(639)
ttggggcttcatctcggtctgattgattacggcatgggcaatctccactcggtggagaaggccttcaaccgcctgggtcatcaacccagtcgcgtcgtcaaccccagcgatctcgatggttgcgatgctttggttctgcctggcgtcggatccttcgatccagccatcgacaatcttcaatccaccggtctgatccccgatctgaaacgctggaatgaggccgaccggcccttgctcggcatttgtcttggactccaattgctgttcgagtccagtgccgagggccgtcttgagggtctcggactgatcaaaggccacgtggaacgtttgcccatcggggctggagcccggattccgcacatgggatgggcacctctggacctgaggcgagccaacccaatgctcgcggctgcggaccctttggcttgggtttacttcgttcacagttatgccgctgtgccggagcgacccgaaacactggctgcagcagcatcctttgggagctcctccgtcaccgcaatggtgtggcagcgccgattgggcgcttgccagttccacccggaaaaatcatcagacagcggtagcgcgatgctgaagcgttggctggattggctccaacgtggagccccgatcggttga

SEQ ID NO: 30496 - protein, 212 aa, Synechococcus sp
MGLHLGLIDYGMGNLHSVEKAFNRLGHQPSRVVNPSDLDGCDALVLPGVGSFDPAIDNLQSTGLIPDLKRWNEADRPLLGICLGLQLLFESSAEGRLEGLGLIKGHVERLPIGAGARIPHMGWAPLDLRRANPMLAAADPLAWVYFVHSYAAVPERPETLAAAASFGSSSVTAMVWQRRLGACQFHPEKSSDSGSAMLKRWLDWLQRGAPIG

SEQ ID NO: 30497 - DNA, 621 bp, Vibrio vulnificus
  CDS (1)..(621)
atgattactatcgttgattatggtcttggtaatatcaaggcatttgctaacttatacaagaaactgaatattgagttagtgtttgctagtgatgtaaatgaccttgctaacgcaaccaagattattttacctggtgtaggagcatttgatcatgctatgcaaatgcttaatgactcaggtatgcgcgagacattagatgaactagtgttagaaaaaaaggtacctgtaattggcatatgtgttggtatgcaaatgatggctgactccagcgaagaggggcaattaaaaggactcggatggatacctggtacagttaaaaagtttaaaagagagtctcaagctctagaaagtcaatatccgctaccgcatatgggatggaattcacttgaaatagcaagaacatctgagttgttgttaggcttggacgagcaaaaacttttttattttttgcattcttattattacgagccaaacgataaagaacatgtggtcgccactgcaaattatggctttgagtacgcttgcattgtgaacaaagataacgtttatggtatccaatgccaccctgaaaaaagtcaccataacggtgttgctttgttaaagagttttgcgagtttatag

SEQ ID NO: 30498 - protein, 206 aa, Vibrio vulnificus
MITIVDYGLGNIKAFANLYKKLNIELVFASDVNDLANATKIILPGVGAFDHAMQMLNDSGMRETLDELVLEKKVPVIGICVGMQMMADSSEEGQLKGLGWIPGTVKKFKRESQALESQYPLPHMGWNSLEIARTSELLLGLDEQKLFYFLHSYYYEPNDKEHVVATANYGFEYACIVNKDNVYGIQCHPEKSHHNGVALLKSFASL

SEQ ID NO: 30499 - DNA, 636 bp, Anabaena sp
  CDS (1)..(636)
atgccagttgttgctgttatagattatgagatgggaaatttgcattctgtttgcaaaggattagaaaaagcgggggcgactcctataattactcattgtcatcaggaattaaccaaggctgatgcagtcatattgccgggagtgggagcatttgacccagcagtacagagcttgcgatcgcgtgatttagaacaaccaattaaagatacaatcgcttctggtaaacccttcttaggtatctgtttagggctgcaaattctttttgaatcgagtgcggaaggtaatcaaccaggactaggaattatcaagggaaaagtgcggcggtttgtttgggaaccaggaattacaattcctcacatgggttggaatcagttggaattaacccaaccaaaaagcattttgtgggagcatttgccaccccaaccttgggtatattttgtgcattcctactatgttgacccatttgaacctcaagttcgtgctgcaactgttactcacggtacgcaaaccgtcacggcagccattgcccatgaaaacctgatggcagtacaatttcacccagaaaaatcgtcaaatattgggctgcaaatcctgtctaattttgtctctcaagtacgggaaaaaatagcagcataa

SEQ ID NO: 30500 - protein, 211 aa, Anabaena sp
MPVVAVIDYEMGNLHSVCKGLEKAGATPIITHCHQELTKADAVILPGVGAFDPAVQSLRSRDLEQPIKDTIASGKPFLGICLGLQILFESSAEGNQPGLGIIKGKVRRFVWEPGITIPHMGWNQLELTQPKSILWEHLPPQPWVYFVHSYYVDPFEPQVRAATVTHGTQTVTAAIAHENLMAVQFHPEKSSNIGLQILSNFVSQVREKIAA

SEQ ID NO: 30501 - DNA, 624 bp, Aquifex aeolicus
  CDS (1)..(624)
atgaggactgttgtaatagactatggaatgggcaacttaaggagtgtcagtaaagctcttgaggcggtaggatttcccgaagtagtagtctcaaacgattacagagtggcttccgaggcggatgtccttgttcttccgggtgtcggtgccttcggagacgctatgaaaaatctggaggaactaaacttagtcagcgtaataaggagacatatagaaaaaggaaagccctttcttggaatatgcctcggtcttcaactcctctttgaaaaaagctatgaacacggtgagcataggggtctcgggattttaaagggtgaggttatactgctccctttgggggtgaaaataccccacataggatggaaccagctgtggtttaagaaggaaagtgagatactggaaggtctgaaagagggagatttcgtttacttcgtccactcttacagagtagttccggaagacgagagcgtagttctcacaaaaaccgattacggagaatacttcgtctcttcaatagaactggataacgtagtggctttccagttccaccccgaaaagagtcaaaagaagggcttaaaactccttgaaaattttaaaaggaaggcggaaaagcttaccacctga

SEQ ID NO: 30502 - protein, 207 aa, Aquifex aeolicus
MRTVVIDYGMGNLRSVSKALEAVGFPEVVVSNDYRVASEADVLVLPGVGAFGDAMKNLEELNLVSVIRRHIEKGKPFLGICLGLQLLFEKSYEHGEHRGLGILKGEVILLPLGVKIPHIGWNQLWFKKESEILEGLKEGDFVYFVHSYRVVPEDESVVLTKTDYGEYFVSSIELDNVVAFQFHPEKSQKKGLKLLENFKRKAEKLTT

SEQ ID NO: 30503 - DNA, 594 bp, Archaeoglobus fulgidus
  CDS (1)..(594)
atgattgcaatagtcaactatggtgtgggcaacttaaagagcatttcaaaggcgctggagactgtgggggcgaaagtgtctgttaccagcgacccggaaaaaataaagtgtgcatcgggagttgtttttccgggcgttggtgcgtttaagtcagcaatcgaaaagttaaatctaatcagggacgttatcgactctcttgaagtcccaatactcggtatttgtcttggaatgcagcttttcgccacagaaagcacggaaggtggtgtttacagggggttggattacattccggggagagttgtaaggttccctcccagcgttggaaaggtgccgcacatgggctggaacactttaaagataacgagagaagcagaaattctggacggtgttgagagcggcgagttcgtctacttcgtgcactcctactacatgcaaaccgacgatgagtttgtaatctccaaaactgactacggaattgactttccgtcaggagttgagagggaaaattacatcggctttcagttccatcccgagaagagcggaaaggtagggctgagaattctggagaacttcgtgaacatcgttaagaggtag

SEQ ID NO: 30504 - protein, 197 aa, Archaeoglobus fulgidus
MIAIVNYGVGNLKSISKALETVGAKVSVTSDPEKIKCASGVVFPGVGAFKSAIEKLNLIRDVIDSLEVPILGICLGMQLFATESTEGGVYRGLDYIPGRVVRFPPSVGKVPHMGWNTLKITREAEILDGVESGEFVYFVHSYYMQTDDEFVISKTDYGIDFPSGVERENYIGFQFHPEKSGKVGLRILENFVNIVKR

SEQ ID NO: 30505 - DNA, 579 bp, Azospirillum brasilense
  CDS (1)..(579)
atggaaaccgttgcgctgatcgattacggctccggcaacctgcgttcgcccgccaaggctctggagcgcgcggcggcggggtgccatgcctccttccaagtcttggtgacctccgacgccgacgccgtgcgcaaggccgaccgcgtcgtcctgccggccgtcggcgccttcgccgactgcaagcgcggcctgtcggaggttcccggcatgcagctgatggcggagggcgggcgcgagtacggcgtgaccgaggggctgggctggatcaagggcgaggtggtgaagctggagcccgccgacccgacgctgaagatcccgcacatgggctggaacgagctggacatccgccgggagcacccggtgctggccggcctgcgcgagcgggcgcacgcctacttcgtccactcctaccgcttcgccgtggagcggccggaggacgtgatcgccagcgccgattacggcgggcctttcgcagcggtggtcggacgcgacaatctggtcggcacccagttccacccggaaaagagccaggagaccggcctcgccctggtcgccaacttcctgacctggcgggtctga

SEQ ID NO: 30506 - protein, 192 aa, Azospirillum brasilense
METVALIDYGSGNLRSPAKALERAAAGCHASFQVLVTSDADAVRKADRVVLPAVGAFADCKRGLSEVPGMQLMAEGGREYGVTEGLGWIKGEVVKLEPADPTLKIPHMGWNELDIRREHPVLAGLRERAHAYFVHSYRFAVERPEDVIASADYGGPFAAVVGRDNLVGTQFHPEKSQETGLALVANFLTWRV

SEQ ID NO: 30507 - DNA, 630 bp, Bacillus cereus
  CDS (1)..(630)
ttgattgccattatagattatggaatgggaaatattcgtagtgtagaacaagcattaaagcatattggagcagcgtacattgtaacgagtgataaagaagagatttttagaagtgatggagtgattttaccaggagtaggtgcatttccaaaagcgatggatgtattggaagaaaaagatttagtgcgtgtgttacaagaaatcgggcgttcaagaaaaccacttctaggtatttgcctaggaatgcagcttttatttgaaaaaagtgaggaactacaagactgtaacgggctaagtttattgccaggcgttattcgaaagctaaaggttccttataaaattcctcatatgggatggaatgagttaaagaaagaaggagaaatagcgctttggaatggagtagaggacggttctttcgtatattatgtccactcttattacgcagattgtccaaatgaaattgtgtatggaataagtgattatggagtgaaagtacctggttttgtagcaaaagaaaatatatatggcgcacagtttcatcctgaaaaaagtggtgatataggcatgcaaatgttgaaaaattttaaaggagtggtagaatcatggaaatcttcccagctatcgatttaa

SEQ ID NO: 30508 - protein, 209 aa, Bacillus cereus
MIAIIDYGMGNIRSVEQALKHIGAAYIVTSDKEEIFRSDGVILPGVGAFPKAMDVLEEKDLVRVLQEIGRSRKPLLGICLGMQLLFEKSEELQDCNGLSLLPGVIRKLKVPYKIPHMGWNELKKEGEIALWNGVEDGSFVYYVHSYYADCPNEIVYGISDYGVKVPGFVAKENIYGAQFHPEKSGDIGMQMLKNFKGVVESWKSSQLSI

SEQ ID NO: 30509 - DNA, 630 bp, Bacillus cereus
  CDS (1)..(630)
ttgattgccattatagattatggaatggggaatattcgcagtgtagagcaagcattaaaatatattggcgcagagtacattgtaacgagtgataaaaaagagatattgagaagcgatggcgtgattttaccgggagtaggtgcatttccgaaagcgatggacgtattagaagaaagagatttagtgtgtgtactaaaagaggtttgtgatataggaaaaccactcctcggtatatgtttgggcatgcagcttttatttgaacgaagtgaggaactaaaagattgtagcgggttaggtttactaccaggggaaattcgtaagttaaaagtttcgtataaaattcctcatatgggatggaatgaattaaggaaggaaagagaatttccgctttggaatggattagtggatggttctttcgtgtattatgttcactcatattacgcggattgtccagatgaaattgtatgcggagtaagtgattatggaatgcaagtaccagggtttgtcgcgaaaggaaatgtatttggtgcacagtttcatccagaaaaaagtggcgaaattggcatgcaaatattaaaaaattttcaaggggtggtagaagcatggaaatcttcccagctatcgatttaa

SEQ ID NO: 30510 - protein, 209 aa, Bacillus cereus
MIAIIDYGMGNIRSVEQALKYIGAEYIVTSDKKEILRSDGVILPGVGAFPKAMDVLEERDLVCVLKEVCDIGKPLLGICLGMQLLFERSEELKDCSGLGLLPGEIRKLKVSYKIPHMGWNELRKEREFPLWNGLVDGSFVYYVHSYYADCPDEIVCGVSDYGMQVPGFVAKGNVFGAQFHPEKSGEIGMQILKNFQGVVEAWKSSQLSI

SEQ ID NO: 30511 - DNA, 639 bp, Bacillus subtilis
  CDS (1)..(639)
atgatcggcgtgatagattacggaatggggaatttatacagtgtctcaaaggcgcttgaacgtgtcggcgtgccgtattttgtttctgaaaagccggaggagctgaaagaagctgatgctttcattttgccgggagtcggttcatttggagacgcgatggacaatttgggctacacgaagcttgatcaattgattcacgatatggtctcagagggaaggctgcttctcgggatctgcctcggcatgcagcttttatttgaagaaagcgaagaaaacggcaccgcttcaggactcgggctgttaaaaggaaaagcagtcaggctgaaagcagaagatgaaaaaggaaacaagctgaaggttccgcatatgggctggaatcgtctttcttttcataatgaatctccgctgctgactaaaacagaacaaggctacgcttacttcgttcattcctattacattgacgggatggaggagaacgcgcttctggcaagcgccgattatggtgtacgagtgcctgctgtagtcggaaaaagaaacgtcttcggcgcccaatttcatccggaaaaaagcagcacggtcggaatgtctattttaacccaatttacgaaaatggcagcagaacagaaggtgaaaaaatga

SEQ ID NO: 30512 - protein, 212 aa, Bacillus subtilis
MIGVIDYGMGNLYSVSKALERVGVPYFVSEKPEELKEADAFILPGVGSFGDAMDNLGYTKLDQLIHDMVSEGRLLLGICLGMQLLFEESEENGTASGLGLLKGKAVRLKAEDEKGNKLKVPHMGWNRLSFHNESPLLTKTEQGYAYFVHSYYIDGMEENALLASADYGVRVPAVVGKRNVFGAQFHPEKSSTVGMSILTQFTKMAAEQKVKK

SEQ ID NO: 30513 - DNA, 591 bp, Bacteroides thetaiotaomicron
  CDS (1)..(591)
atgaaagtagcagttgtaaaatacaatgccgggaatatccgttctgtggactatgctctgaagcggttgggagtagaagcagtgattactgccgataaagaaatacttcaatctgccgataaagtgattttccccggagtaggagaggcgggaactaccatgaatcacctgaaagcaacagggctcgacgagctgatcaagaatctgcgtcagcctgtgttcggaatttgcctcggtatgcagctgatgtgccgacattctgaagaaggtgaggtggactgcctgaatatctttgatgtagacgtgaaacgttttgttccgcagaagcatgaagataaagtgccgcatatgggctggaatacgattggtaagacaaacagcaaactgttcgaaggattcaccgaagaagagtttgtctactttgtacacagtttctatgtgccggtttgtgactttactgctgctgaaaccgattatatccatccgttcagcgcggcattgcataaagataacttttatgccacccagttccatccggagaaaagcgggaagacaggtgaaagggttctgaggaactttctggatctctaa

SEQ ID NO: 30514 - protein, 196 aa, Bacteroides thetaiotaomicron
MKVAVVKYNAGNIRSVDYALKRLGVEAVITADKEILQSADKVIFPGVGEAGTTMNHLKATGLDELIKNLRQPVFGICLGMQLMCRHSEEGEVDCLNIFDVDVKRFVPQKHEDKVPHMGWNTIGKTNSKLFEGFTEEEFVYFVHSFYVPVCDFTAAETDYIHPFSAALHKDNFYATQFHPEKSGKTGERVLRNFLDL

SEQ ID NO: 30515 - DNA, 615 bp, Bdellovibrio bacteriovorus
  CDS (1)..(615)
atgatcaaaattgtcgattatggtcttggtaatattcaggcctttgccaatttgtataaaagactccatattccggttgtcgttgccagaaccgctgatgagcttgctggcgccacaaagattattcttccgggggttggggcttttgatcatgcaatggcaagattaaatgaatcaggaatgcgtgaaatactggaaagcttggttcaaaaagacaaagtaccggtgttaggaatttgcgtcggaatgcaaatgcttgctaactccagcgacgagggtgtcttgccgggtttaggttgggtcccaggtcgtgttagagaatttcggaatattccaggtttagaggggatcgcccaacctcatatgggttggaacgatgttaagcctgttgttagctcgggtctttttaagggactggagactgatgctcgtttctattttcttcattcgttcttttttgaatgccaaaatccggattactctctagctagcgcaaactatggtttggaattcagctgtgcagtggctaatcgcaacgtctatggtgttcaatttcaccctgaaaaaagtcacgacttcggaatgacgctgttgaagaacttttcggagatttag

SEQ ID NO: 30516 - protein, 204 aa, Bdellovibrio bacteriovorus
MIKIVDYGLGNIQAFANLYKRLHIPVVVARTADELAGATKIILPGVGAFDHAMARLNESGMREILESLVQKDKVPVLGICVGMQMLANSSDEGVLPGLGWVPGRVREFRNIPGLEGIAQPHMGWNDVKPVVSSGLFKGLETDARFYFLHSFFFECQNPDYSLASANYGLEFSCAVANRNVYGVQFHPEKSHDFGMTLLKNFSEI

SEQ ID NO: 30517 - DNA, 648 bp, Bifidobacterium longum
  CDS (1)..(648)
atgaccacagcggttgttttcgattacggtttcggcaatgtacgttccatggtgcgtgcgctcgccaatcttggcgtcgacaccaccctcacctccgactaccggcagtcgttggaggccgacggcctagtcgtgccgggcgtgggtgcgttcgccgcatgtatggaaggactgaagaaggtcgacggcgaccgtgtgatctatgatcgcatccgcgctggccgcccggtgctcggcgtgtgcgtgggcgagcagatcatgttcgaacacggtctggagcacggtgcccatgccgcaggcatcggactgatcggcggttcggtgaacctgctggacgccgacgtggtgcctcacatgggatgggacacgatcgagaccgcccccgattcggtgctgctcaacggcgtggagaacgaacggttctacttcgtgcactcctacgccgcgatggaagtgaagccggcggatacgtcccgcttcgacatcgatctgagcgattcgcccgaacgcgtgagctggtgctcgtacggccgatcgcgctttgtggccgcctacgaacacggcccgctgtccgccacgcaattccacccggaaaagtccggggacgctggctcccagctcctcaagaactggatcgccacgctgtaa

SEQ ID NO: 30518 - protein, 215 aa, Bifidobacterium longum
MTTAVVFDYGFGNVRSMVRALANLGVDTTLTSDYRQSLEADGLVVPGVGAFAACMEGLKKVDGDRVIYDRIRAGRPVLGVCVGEQIMFEHGLEHGAHAAGIGLIGGSVNLLDADVVPHMGWDTIETAPDSVLLNGVENERFYFVHSYAAMEVKPADTSRFDIDLSDSPERVSWCSYGRSRFVAAYEHGPLSATQFHPEKSGDAGSQLLKNWIATL

SEQ ID NO: 30519 - DNA, 678 bp, Bordetella pertussis
  CDS (1)..(678)
gtgagcaccattgccattgtcgattacggaatgggcaacttccattccgtcgcccgcgcgctgcaacatgccgcgcccgacgccgacatccggatctgtaaccgccccgagcagatcgacgcggccgaccgcgtcgtcttccccggccagggcgccatgcccgactgcatgcgcacgctgaacgaatccggcctgcgcgccgcggtcgagcgcgccgccgccagcaagccgctgatgggcgtgtgcgtgggcgagcagatgctgttcgagcgcagcgaggaaggcggtacgccgtgcctgggcatcttcccgggcgaggtgcgccgcttcgccggcccgcagttcgccgacccggtcgccgccgaccaggccgccgcggcgccccccgctgccgcgcgggaacgcctgaaagtcccgcacatgggctggaaccaagtgcggcaaacgcgctcccatgcattgtgggagggcatcccggacggcacgcatttctatttcgtgcacagttattatgcggctccatccgatccggccctgaccaccggcgtcaccgattacggggtcgcctttacctgcgccgtggcggccgctaacattttcgcggtgcagttccaccccgagaagagcgccgagcacggtttgcgcctgtaccgcaattttgtagactggcaaccgtaa

SEQ ID NO: 30520 - protein, 225 aa, Bordetella pertussis
MSTIAIVDYGMGNFHSVARALQHAAPDADIRICNRPEQIDAADRVVFPGQGAMPDCMRTLNESGLRAAVERAAASKPLMGVCVGEQMLFERSEEGGTPCLGIFPGEVRRFAGPQFADPVAADQAAAAPPAAARERLKVPHMGWNQVRQTRSHALWEGIPDGTHFYFVHSYYAAPSDPALTTGVTDYGVAFTCAVAAANIFAVQFHPEKSAEHGLRLYRNFVDWQP

SEQ ID NO: 30521 - DNA, 651 bp, Bradyrhizobium japonicum
  CDS (1)..(651)
atgagcatcgccatcatcgattacggttccggtaatctgcattccgccgcgaaagccttcgagcgcgccgcgcgcagcctggaggacccgcaaaaggtcttcgtcaccagcgatccggatcaggcttacggcgccgatcgcctggtgctgccgggcgtcggcgccttcgccgattgccggcgcggcctcgacgccgtcaacggcatggtcgaggcgatcaccgaagcggtgcgggtcaaggcgcggccgatgttcggcatctgcgtcggcatgcagctgttcgccacccgcggcaaggagcatgtcatcacgcagggcctgaactggatcggcggcgacgtcgagaagatcacgccgcgcgacgaaagcctgaagatcccgcacatgggctggaacacgctcgacgtgctgcgcgagcacccggtgctgaacaagctgccgctcggccccaagggccagcacgcctatttcgtgcactcctaccacctcaacgccgccaatgaggcggacgtgctcgcgcgcgccgactatggcgggcctgtcaccgcgatcgtcgcgaaggacaccgccatcggcacgcaattccaccccgagaagagccagcgttttggcctcgctctgatctcgaactttttgcgatggaagccgtga

SEQ ID NO: 30522 - protein, 216 aa, Bradyrhizobium japonicum
MSIAIIDYGSGNLHSAAKAFERAARSLEDPQKVFVTSDPDQAYGADRLVLPGVGAFADCRRGLDAVNGMVEAITEAVRVKARPMFGICVGMQLFATRGKEHVITQGLNWIGGDVEKITPRDESLKIPHMGWNTLDVLREHPVLNKLPLGPKGQHAYFVHSYHLNAANEADVLARADYGGPVTAIVAKDTAIGTQFHPEKSQRFGLALISNFLRWKP

SEQ ID NO: 30523 - DNA, 594 bp, Buchnera aphidicola
  CDS (1)..(594)
gtggatattgcaatattaaatactggttgtgctaatttaacttcaattcaagttgcaattaaaaaattaggttatgattccatagtaacttctgatccttctatagtattaaaatctaaaaaaatttttttaccaggtgtaggaacagctttagctgctatggaacaattacataaaaaaaatttgattaatactttaaaaaaattgacgcaacctattctaggcatttgtcttggaatgcaaattttttctcaatttagcgaagaatgtaaaggagtaaaaactattggaatttttgataattgttttacgcatcttttaaaaagcagtaatttaccattaccgcatatgggttggaatcatattgtttttaataatttgcatccattatttaaaaacattgataaaaaagaaagattttattttgttcatagttatattatacccctgaataaatatactttagcaaaaactaaatatggtgtatcttttagttctgtaatgcaaaaaaataattttttcggagttcaatttcatcccgaaaaatctggtgatgcaggagctcaattgttaaaaaattttttagagatataa

SEQ ID NO: 30524 - protein, 197 aa, Buchnera aphidicola
MDIAILNTGCANLTSIQVAIKKLGYDSIVTSDPSIVLKSKKIFLPGVGTALAAMEQLHKKNLINTLKKLTQPILGICLGMQIFSQFSEECKGVKTIGIFDNCFTHLLKSSNLPLPHMGWNHIVFNNLHPLFKNIDKKERFYFVHSYIIPLNKYTLAKTKYGVSFSSVMQKNNFFGVQFHPEKSGDAGAQLLKNFLEI

SEQ ID NO: 30525 - DNA, 591 bp, Buchnera aphidicola
  CDS (1)..(591)
atgagcattgtaattataaataccggttgtgctaatttatcatctttaaaatatgctattcaaagattaggctacaatgttattattactagtaatcataaaaatatattaaatgctaaaaaagtattcttgcctggtgttggcactgcattttcagctatgaagatgttaaatcaatttaaattaaaagatgttctttataaatatcaacagccagtgttaggaatttgtttaggaatgcaattactgtgttcgtttagtagtgaaaataatggtattaaaatgttagatataattcatgctcctgttaacattttaaaatctaataagtttcccttaccccataatggttggaataatgtcagtgtttgtgatgaaaatccattgtttattggtattaaaaacaattctaaattttattttttgcatagttatgcattgtatgaaaatgattatatgatagctaaaacattttataatgtttattttagcgcagcagtacgtaaagaaaatttttttggtgttcaatttcatccagaaaaatctggtttagtaggcttacaattattaaaaaattttttggagatataa

SEQ ID NO: 30526 - protein, 196 aa, Buchnera aphidicola
MSIVIINTGCANLSSLKYAIQRLGYNVIITSNHKNILNAKKVFLPGVGTAFSAMKMLNQFKLKDVLYKYQQPVLGICLGMQLLCSFSSENNGIKMLDIIHAPVNILKSNKFPLPHNGWNNVSVCDENPLFIGIKNNSKFYFLHSYALYENDYMIAKTFYNVYFSAAVRKENFFGVQFHPEKSGLVGLQLLKNFLEI

SEQ ID NO: 30527 - DNA, 591 bp, Candidatus Blochmannia floridanus
  CDS (1)..(591)
atgaaaataattattattaataccaattgttctaatttatcatctgtaaaaattatgttaaataaattaggatgtaacacaataattactgatgatcctgatctcatcattcaatcagataaaatacttttacctggagtaggaactgctaatactgctatgaaacaattgaaaaaaaaaaatctcattcaattaataaaaaaatgtacccaacccaccctaggtatttgcttaggtatgcaattatttggatcatttagcaatgaaaacactcatacaaatactttaaatattattaatgttccagtaaaacatatgtattctcctaccctccctattcctcatatgggatggaataatattactattttaaaaaaacatgatttattaaatggcataaacaacaaccattatttctattttgcacatagctactgcatggaattaaactataccaccattgcttatactaattatggacaaccatttagctcagtaatagtatataaaaatttttttggagtacaattccacccagaaaaatcaagtttttctggagaacaattaattaaaaatttcctggagatataa

SEQ ID NO: 30528 - protein, 196 aa, Candidatus Blochmannia floridanus
MKIIIINTNCSNLSSVKIMLNKLGCNTIITDDPDLIIQSDKILLPGVGTANTAMKQLKKKNLIQLIKKCTQPTLGICLGMQLFGSFSNENTHTNTLNIINVPVKHMYSPTLPIPHMGWNNITILKKHDLLNGINNNHYFYFAHSYCMELNYTTIAYTNYGQPFSSVIVYKNFFGVQFHPEKSSFSGEQLIKNFLEI

SEQ ID NO: 30529 - DNA, 642 bp, Caulobacter crescentus
  CDS (1)..(642)
atgcagaccgtcgccctgatcgattacgggtcgggcaacctgcgttcggccgagaaggccctgcgtgaggcggcccgacgccgcgcgctggacgccgacatcgttgtcaccgccgaccctgaccttgtcgccaaggccgatcgcgtcttcctgcccggcgtcggggccttcgcctcgtgccgcgccgggcttgacgccaccggcgtctatgaggcgatgaaccaggccgtacacggacgcggcgtgccgttcatgggcatctgcgtcggccaccagctcctggccaccgaagggctggagttcggcgtcacccccggcctgaactggattcagggccaggtgaagaagctcgagcccaacgatccgacgctgaccatcccgcacatgggctggaacgcgatcagcctcgtgcgtcctcatgccctgttcgcgggcatcgacgacggcgcccacatgtatttcgccaactcgttcgccctgaccccttcccatgtggaagatgtcgtcgcgaccgccgaccacggcggaccgttcacggccgctgtggccaaggacaatgtcgcgggcgtacagttccaccctgaaaaatcacaagcatcagggctcgccctgctcgccaacttcctggaatggcgcccatga

SEQ ID NO: 30530 - protein, 213 aa, Caulobacter crescentus
MQTVALIDYGSGNLRSAEKALREAARRRALDADIVVTADPDLVAKADRVFLPGVGAFASCRAGLDATGVYEAMNQAVHGRGVPFMGICVGHQLLATEGLEFGVTPGLNWIQGQVKKLEPNDPTLTIPHMGWNAISLVRPHALFAGIDDGAHMYFANSFALTPSHVEDVVATADHGGPFTAAVAKDNVAGVQFHPEKSQASGLALLANFLEWRP

SEQ ID NO: 30531 - DNA, 606 bp, Chlorobium tepidum
  CDS (1)..(606)
atggtatttattgccgactatggcgccggaaacctcaggtcggtgcacaaggctttcgattatctcggtatcgaggcagtcgtcagcgacaaggcatccgagatgagccgttacgataaagtgcttattcccggtgtcggcgcgtttggcccggcgatggaagcgctgaaccgccagggattcgacgaggcgatccgggagcatatcgacaaaggccgcagtgtgctcggtatctgccttggcatgcagctctttctttcagaaagcgaggagatgggagcgtataagggccttgacatcgtgcctggcaaggtgctccgttttaccagcagtaccgacaagattccgcagattggctggaactctgttgattattgcaaggactcggtccttttccgcaatgttccagatcagtcgtatttctacttcgtgcactcttactattgtgctcccgacgagccggaaagcgtggccgcgaccacctttttcgccgggaaaaaattttgttcggccattgagaaaaatggtattttcgcggtacagtttcaccctgaaaaaagctccgaagcaggtttgcaggtgctgaaaaattttgcagaattttaa

SEQ ID NO: 30532 - protein, 201 aa, Chlorobium tepidum
MVFIADYGAGNLRSVHKAFDYLGIEAVVSDKASEMSRYDKVLIPGVGAFGPAMEALNRQGFDEAIREHIDKGRSVLGICLGMQLFLSESEEMGAYKGLDIVPGKVLRFTSSTDKIPQIGWNSVDYCKDSVLFRNVPDQSYFYFVHSYYCAPDEPESVAATTFFAGKKFCSAIEKNGIFAVQFHPEKSSEAGLQVLKNFAEF

SEQ ID NO: 30533 - DNA, 639 bp, Chromobacterium violaceum
  CDS (1)..(639)
atgaaagtcgcagtcatcgactacggcatgggcaatctgcactcggtgctgaagtccctgcaggccgtcaacgaaaacggcgccgatattttcctcacccgcgacccggaagcggtggtgaaggccgacaaggtggtctttcccggccagggcgcgatgcccgactgcatgcgcgaattgaaccgccacggcttggccgaggcggtccgtgaaaccacgcaaagcaagccgttttttggaatctgcgtcggcgcgcagctattgttcgaacatagcgaagaaggagacaccgccggcctgggcctgttcccgggcaaggtggtccgcttcgccgacgaccaggtcgccggcggcgagcgtctgaaagtgccgcatatgggttggaaccaggtttaccagactcggtcccaccccttgttcgccggcatcgccgacggcgagcgcttctatttcgttcacagctaccattttgcgccggccgacgcggcgctgacgctggcggaaagcgattatccgcagcggtttgcctgtatcgtcgggcgtggcaatatattcgccacgcagtttcacaccgaaaagagccaccgggccggacttcagatgatgaagaacttcctggcctgggacggcaatgtttaa

SEQ ID NO: 30534 - protein, 212 aa, Chromobacterium violaceum
MKVAVIDYGMGNLHSVLKSLQAVNENGADIFLTRDPEAVVKADKVVFPGQGAMPDCMRELNRHGLAEAVRETTQSKPFFGICVGAQLLFEHSEEGDTAGLGLFPGKVVRFADDQVAGGERLKVPHMGWNQVYQTRSHPLFAGIADGERFYFVHSYHFAPADAALTLAESDYPQRFACIVGRGNIFATQFHTEKSHRAGLQMMKNFLAWDGNV

SEQ ID NO: 30535 - DNA, 612 bp, Clostridium acetobutylicum
  CDS (1)..(612)
atgaataaaaaaatagctataatagattatgatatgggaaatctccttagtgttaagaaagctttcgattatattggggcaaattcgtttataacctctgattcaaaggaaatagaaaaaagtgatgctataatacttccaggcgtgggagcttttcctgatgctatgagtagtttaaaagaaaatgggatagataaaacaattataaatgaagctaaaaatggaaaaccttttgcgggaatatgccttggaatgcagcttctatttgatgagagtgaagaggttacaaacacaaaagggcttggacttataggcggaaaaataagaaaaatgaaaacagagtttaaaattccacatatgggatggaatagtttaaatatacctagagagtgcaatatattaaagggagtttcaaaaggaagctatgtgtactttgttcattcttactatgcagaattggcggataaaaataatctaaatgcatattgtgattatgggactaagttgccagcggttgtaagctataaaaatatatttggaattcagtttcatccagaaaaaagcggagagataggacttacaatacttaaaaacttttgggagttgatataa

SEQ ID NO: 30536 - protein, 203 aa, Clostridium acetobutylicum
MNKKIAIIDYDMGNLLSVKKAFDYIGANSFITSDSKEIEKSDAIILPGVGAFPDAMSSLKENGIDKTIINEAKNGKPFAGICLGMQLLFDESEEVTNTKGLGLIGGKIRKMKTEFKIPHMGWNSLNIPRECNILKGVSKGSYVYFVHSYYAELADKNNLNAYCDYGTKLPAVVSYKNIFGIQFHPEKSGEIGLTILKNFWELI

SEQ ID NO: 30537 - DNA, 633 bp, Corynebacterium diphtheriae
  CDS (1)..(633)
atgaagaaagtggcacttctcgattacggttctgggaatctacgttcagcgcaacgagcgttggaacgagttggcgcagaagtagaggtaacaaacgatccggatgtagtactggctgcggacggtctcctcgtaccaggagtgggtgcttttgatgcatgcatgaaggggctaaaagcggtccaaggtgaccgaatgattggtcagcgcttggcagggggacgccctgtgatgggcatttgtgtaggtatgcagatcatgtttgattctggcaacgaacacggcatctctgcagctggatgtgggcagtggccaggaaacgtcgaaaagcttgaggctcgtgttctaccgcatatgggttggaacacggtggaagcagcgcaagactcacaactttttgctggactcgacgctgatacgcgtttttattttgtgcactcttacggtgtgcgttggtgggagttcgaaggcgacggtttaacacgtgcaccattagtaacgtgggctcagcatgaatctgaccgatttgttgccgctgtggaaaacggtgcgttgatggctacccagttccacccagagaaatctggggatgcaggtgcacaactcctgcggaattggattgatctgctgtaa

SEQ ID NO: 30538 - protein, 210 aa, Corynebacterium diphtheriae
MKKVALLDYGSGNLRSAQRALERVGAEVEVTNDPDVVLAADGLLVPGVGAFDACMKGLKAVQGDRMIGQRLAGGRPVMGICVGMQIMFDSGNEHGISAAGCGQWPGNVEKLEARVLPHMGWNTVEAAQDSQLFAGLDADTRFYFVHSYGVRWWEFEGDGLTRAPLVTWAQHESDRFVAAVENGALMATQFHPEKSGDAGAQLLRNWIDLL

SEQ ID NO: 30539 - DNA, 636 bp, Corynebacterium efficiens
  CDS (1)..(636)
atgaccaaaaccgtcgctctactcgactatggatcaggcaacctccgctccgcccagcgtgcgctcgagcacgtcggtgcggaggtcatcgtgaccagtgaccccgatatctgcaccaacgccgatgggctcctcgtccccggtgtcggggccttcgatgcctgcatgaaggggctgcggggggtcttcggccatcgcatcatcggcacccgcctggcgggtgggcgtccggtcatgggtatctgcgtgggcatgcagatcctcttcgacgagggcatcgaacacggtatccagacacggggttgcggtgagtggtccggccgggtggaacgcctgcaggcccgtatcctcccgcacatggggtggaacaccgtggagaaacaacccggtagtgagatgttcgccgggttgagtgaggatgaacggtactacttcgtccacacctacggtgtccgtgactggaccctggtcaccgatgacctgaccaccccgccgctggtcacctgggccgtgcacgaaaatgaccggttcgtcgccgccgtggaaaacggtgcgctgtgggccacccagttccacccggagaaatccggggacgcgggcgcgcagctgctgcgcaactggatcaaccacatctaa

SEQ ID NO: 30540 - protein, 211 aa, Corynebacterium efficiens
MTKTVALLDYGSGNLRSAQRALEHVGAEVIVTSDPDICTNADGLLVPGVGAFDACMKGLRGVFGHRIIGTRLAGGRPVMGICVGMQILFDEGIEHGIQTRGCGEWSGRVERLQARILPHMGWNTVEKQPGSEMFAGLSEDERYYFVHTYGVRDWTLVTDDLTTPPLVTWAVHENDRFVAAVENGALWATQFHPEKSGDAGAQLLRNWINHI

SEQ ID NO: 30541 - DNA, 636 bp, Corynebacterium glutamicum
  CDS (1)..(636)
atgaccaaaactgtcgcccttctcgactacggatctggaaaccttcgttctgctcaacgcgcactagagcgtgccggtgcagaagttatcgtgagctccgatccagaagtttgcaccaacgctgatggcctcctagttcctggagtgggcgcatttgatgcctgcatgaagggtttgaaaaacgtcttcggacatcgcattatcggacagcgtcttgctggtggacgtccagtgatgggtatttgtgtgggcatgcagatcctgttcgatgaaggcgatgagcacggcattaagtcagctggttgcggcgagtggcctggcaaagtggaacgcctccaagcggagatcctgcctcacatggggtggaacacacttgaaatgcctaccaactcaccaatgtttgagggaatttcacctgatgagcgtttctacttcgtgcactcctatggtgtgcgcaagtggacgttggaaaccgacgatctgaccacgcctccagaggttgtgtgggcgaagcacgaaaatgatcgttttgtggcagctgtggaaaacggcacgctgtgggctactcaattccacccagaaaaatcaggtgacgcaggcgcacagctactgcgaaactggatcaactacatctaa

SEQ ID NO: 30542 - protein, 211 aa, Corynebacterium glutamicum
MTKTVALLDYGSGNLRSAQRALERAGAEVIVSSDPEVCTNADGLLVPGVGAFDACMKGLKNVFGHRIIGQRLAGGRPVMGICVGMQILFDEGDEHGIKSAGCGEWPGKVERLQAEILPHMGWNTLEMPTNSPMFEGISPDERFYFVHSYGVRKWTLETDDLTTPPEVVWAKHENDRFVAAVENGTLWATQFHPEKSGDAGAQLLRNWINYI

SEQ ID NO: 30543 - DNA, 645 bp, Cyanidium caldarium
  CDS (1)..(645)
atgaaaaatatcggaataattaattgtggtatgggaaatttgcactcagtctcaaatgcaatttcaaacatagggtttaacccagtcatcattaatgcctcaaaagacttagtatcttttgcttgttctgcgttagtcttgccaggagttggctcctttgatttagccattgatagactagaaaaaaaaaatttgattgagccagtgaagctttggatacaagaggataggccttttgttggaatttgtttagggctgcaattattatttgaaggtagcgatgaaggatcgaagcctggtctaaagatttttaatgggtatgtttcacagttcaaacatagcttagttaaaaaagtcccacatatgggatggaacaagttatatttcaatcgttttaatactattgacaatttggtccctcattattttcattatgacttgcagccttgggcttattttgttcattcttattatattgagcctaaggattgttatacgtttaatacaacttcattaacattttatggaaaacagaaaattgtatcttctattagctataacaatattcttgcaactcaatttcatcccgagaagtctggcctatttggtctttttatcttaaaacgatttttatcttcttattga

SEQ ID NO: 30544 - protein, 214 aa, Cyanidium caldarium
MKNIGIINCGMGNLHSVSNAISNIGFNPVIINASKDLVSFACSALVLPGVGSFDLAIDRLEKKNLIEPVKLWIQEDRPFVGICLGLQLLFEGSDEGSKPGLKIFNGYVSQFKHSLVKKVPHMGWNKLYFNRFNTIDNLVPHYFHYDLQPWAYFVHSYYIEPKDCYTFNTTSLTFYGKQKIVSSISYNNILATQFHPEKSGLFGLFILKRFLSSY

SEQ ID NO: 30545 - DNA, 648 bp, Cyanophora paradoxa
  CDS (1)..(648)
atgattaattcaaaaaataatagtccgattgaaattagtattattgattatcaaatggggaatctctattcggtatgtaaaggaattgagagatccggtggcattccaaaaataattaattctgctgaagaaattaaaaaagcaactgcactaattcttcctggtgttggatcttttgatccagcaatgaaacaattaaaaaaacaagatttaattaatcctattaaagatgcaatctcagaaaaaaagccctttttaggaatttgcttaggcttacatttattgtttgaagaaagtgaggaaggtatagaatcaggattaggtattttatcaggttcagtaaaaagaataaagaatgaacccgaaattacaattcctcacatggggtggaatcaattacaattaacaaatcctaaatgttatttatgggatggattaacaaaatatccttgggtttactttgttcattcttattttgcccaaccaaaaaatccaaacgttattgctgcagcagtaactcatggaactcaacaagtaacagcagcaattcaatatgaaaatatttctgctgttcaatttcatccagaaaaatctgcttctattgggttacatatgttaaataattttgttcaacaaagttgtaattag

SEQ ID NO: 30546 - protein, 215 aa, Cyanophora paradoxa
MINSKNNSPIEISIIDYQMGNLYSVCKGIERSGGIPKIINSAEEIKKATALILPGVGSFDPAMKQLKKQDLINPIKDAISEKKPFLGICLGLHLLFEESEEGIESGLGILSGSVKRIKNEPEITIPHMGWNQLQLTNPKCYLWDGLTKYPWVYFVHSYFAQPKNPNVIAAAVTHGTQQVTAAIQYENISAVQFHPEKSASIGLHMLNNFVQQSCN

SEQ ID NO: 30547 - DNA, 648 bp, Deinococcus radiodurans
  CDS (1)..(648)
atgagcaccacccccgtccgtgcagctcccgaagtccttctcctcgattacggcgcgggcaatgtccgcagcgccgcccgcgctctggaacgcgccggaatgacggtgcgcgtgaccgacaatgccgccgacgtgccgcacgcccccgcgctggtggtgcccggtcagggccacttccggcaggtgatggaagccttcgagcacggcggctttcacggcccggtactggacgccgcccgcgccggggtgcctttgctgggcatctgtgtggggatgcagttgctctttgacggctcggaggaagcgcccggcgtgcccggcctgggcctgattgccgggcaagttcgcaagtttgcccccgcccccgagcgcaaggtgccgcagatgggctggaacgcgcttgaggcgcggggcgactcgccgctgctgcgcgggctggggccggatgcctacgcctacttcgtccactcgtactacgtgccggtggacgtgccggtcaccgacggcgccgtgaccgactacggcgtgccgttctggtcggcgctgagccggggcaacctgcacgccgcgcagtttcaccccgaaaaaagcggggcggtggggctggcgctgctggcgaatttccgccgcgaactcgccccggcctga

SEQ ID NO: 30548 - protein, 215 aa, Deinococcus radiodurans
MSTTPVRAAPEVLLLDYGAGNVRSAARALERAGMTVRVTDNAADVPHAPALVVPGQGHFRQVMEAFEHGGFHGPVLDAARAGVPLLGICVGMQLLFDGSEEAPGVPGLGLIAGQVRKFAPAPERKVPQMGWNALEARGDSPLLRGLGPDAYAYFVHSYYVPVDVPVTDGAVTDYGVPFWSALSRGNLHAAQFHPEKSGAVGLALLANFRRELAPA

SEQ ID NO: 30549 - DNA, 642 bp, Desulfovibrio vulgaris
  CDS (1)..(642)
atgctcgcgattctcgactacaaggcgggcaaccagaccagtgtccgccgggcactggaccatctgggcatcccttgcgtcatcaccgccgaccccgaggtcattcagggtgcggcgggtgtcatcttccccggcgtgggggcggcagggcaggccatgaacgaactggtcaccaccggtctcgacgaggtgctgcgccgtcaggttcaggcgggcaggcccctgctgggcatatgtgtcggctgccagatcatgctcgactacagtcaggagaacgacaccaaggcgctcggcatcatccccggcgaatgcaggctgttcaacccggcatggacggacgaggatggcgcgcccatccgcgtgccgcacatgggctggaaccacatcgtccagcgcaggccgtgcgaactgctgaagggcatcgaaccggaggcggagttctacttcgtgcatagctactacccggcaccgcccgaagagtacgtcatcgccacctgcacctatggtgccgagttctgtgccatccatggcgggccgggcctttgggccgtgcagttccaccccgagaagagcggacgccccggtctgcggctgctcgccaacttccacagatactgcacggaggccgccgatgctcagtaa

SEQ ID NO: 30550 - protein, 213 aa, Desulfovibrio vulgaris
MLAILDYKAGNQTSVRRALDHLGIPCVITADPEVIQGAAGVIFPGVGAAGQAMNELVTTGLDEVLRRQVQAGRPLLGICVGCQIMLDYSQENDTKALGIIPGECRLFNPAWTDEDGAPIRVPHMGWNHIVQRRPCELLKGIEPEAEFYFVHSYYPAPPEEYVIATCTYGAEFCAIHGGPGLWAVQFHPEKSGRPGLRLLANFHRYCTEAADAQ

SEQ ID NO: 30551 - DNA, 1662 bp, Emericella nidulans
  CDS (1)..(1662)
atgcccactgttcatctgcttgattatgtcgctggaaatgtgcgttccttggtgaatgccatcaacaaggttggatatgaagttgagtgggtgagatcgcccagcgatttgaaagatgtcgagaagctcatacttccaggagtcggccacttcggccattgcctttctcagctttcaagcggtggctatttgcagccgataagagagcatattgcttccgggaaaccgtttatgggaatatgtgttggtttacaatcccttttcgagagttccgaggaggatcccaacattcctggtttgggtacaatcccagcgcggttgcgcaaatttgacgcaaaaacgaagagcgtacctcatatcggttggaactcggcaacagatacccgcattgactcgactggaggccagaccttctatggattgagcccaagcagcaagtactactacgtacactcatacgccgcgccatatgagccgggaattcttgagaaagatggttggttggtcgcacggcgagtttatggggaggagaaattcatcggcgcgatagcacgagataacatctttgcgacacaattccatcccgagaagagcggccaaggcaggcctacgcacccttcgcgctttcttggacggagctcagctccattctgtcacattagagactcgattttgacaggagagaaaaacggtcttacccgtaggatcatcgcctgtcttgatgttcgtacgaatgatgtcggcgatctcgttgtgactaagggcgatcaatatgatgttcgcgagaaggatggtgcggatgctggagggcaagtgaggaacctgggaaagccggttgatatggctaagaaatattacgaacagggggcagatgaggtgacgtttttaaacatcacctctttcagaaactgtccgttagccgacctccctatgctcgagattctccgaagaacgtcggagaccgtcttcgtacctttgactattggtggcggcattagggacactgtggatacagacggtactcacatcccagctctagacgtggcatcgatgtacttcaaatctggggctgacaaagtcagcattggttcggatgccgttgttgctgcggaagattattacgcagctggcaaagttctgtctggcaaaactgccattgaaactatttctaaggcgtatggaaaccaggctgtcgttgtaagcgttgacccgaagcgcgtttatgtcagccaaccagaagacacgaaacaccgtacgatagaaacgaaatttcctaacgccgccgggcaaaatttctgttggtaccagtgtactataaagggtggcagagagaccagagacttagatgtctgccagctggtgcaagccgtcgaggcaatgggtgctggggagattctgctgaattgcattgataaagacgggagcaacagtggttcgatcttgactgatcaaccaccgtcaaagcgtgcagtaaaaatacccgtgattgcctctagcggagctggtatgccgaagcattttgaggaagtttttgatcaaacgacgacagatgctgctctgggtgctgggatgttccatcgtggtgagtatactgttggtgaagtcaagcaataccttgaggatagaggtttccttgttcgacgattcgagcctgatgtctga

SEQ ID NO: 30552 - protein, 553 aa, Emericella nidulans
MPTVHLLDYVAGNVRSLVNAINKVGYEVEWVRSPSDLKDVEKLILPGVGHFGHCLSQLSSGGYLQPIREHIASGKPFMGICVGLQSLFESSEEDPNIPGLGTIPARLRKFDAKTKSVPHIGWNSATDTRIDSTGGQTFYGLSPSSKYYYVHSYAAPYEPGILEKDGWLVARRVYGEEKFIGAIARDNIFATQFHPEKSGQGRPTHPSRFLGRSSAPFCHIRDSILTGEKNGLTRRIIACLDVRTNDVGDLVVTKGDQYDVREKDGADAGGQVRNLGKPVDMAKKYYEQGADEVTFLNITSFRNCPLADLPMLEILRRTSETVFVPLTIGGGIRDTVDTDGTHIPALDVASMYFKSGADKVSIGSDAVVAAEDYYAAGKVLSGKTAIETISKAYGNQAVVVSVDPKRVYVSQPEDTKHRTIETKFPNAAGQNFCWYQCTIKGGRETRDLDVCQLVQAVEAMGAGEILLNCIDKDGSNSGSILTDQPPSKRAVKIPVIASSGAGMPKHFEEVFDQTTTDAALGAGMFHRGEYTVGEVKQYLEDRGFLVRRFEPDV

SEQ ID NO: 30553 - DNA, 630 bp, Geobacter sulfurreducens
  CDS (1)..(630)
atgaccaagattgcaattatcgactacggcatggggaatctccggtcggtccagaaggggttcgagaaggtgggcttcgaggcggttgtgactgccgaccccaaggtggtgctggaggcggaaaagatcgtccttcccggcgtgggagcctttcgcgactgcatgcgcaacctggagcagggggggttcgtggagccgatcctcagggtgatccgggaggggcgcccctttctcggcatctgcgtcgggatgcagctcctcttgaccgacagcgtggagttcggcctctaccaggggctgaacgtcattcctggccacgtcctccgttttcccgaggggatgcgcgaaggaggcgaggaactcaaagtcccccacatggggtggaaccagctctccatcaaacgccgcccaccggcctttgccgaggtggaggacggggccaacgtctatttcgtccattcatactatgaaatgcccgacgacgagagtgtcatcgccgccacctgcacctacggcgtcgagttctgcgccgccatctggaaggacaacatcgtcgccacccagttccatcccgagaagtcacaggcggtggggctgtccatactcaagaacttcggagagatgaagtga

SEQ ID NO: 30554 - protein, 209 aa, Geobacter sulfurreducens
MTKIAIIDYGMGNLRSVQKGFEKVGFEAVVTADPKVVLEAEKIVLPGVGAFRDCMRNLEQGGFVEPILRVIREGRPFLGICVGMQLLLTDSVEFGLYQGLNVIPGHVLRFPEGMREGGEELKVPHMGWNQLSIKRRPPAFAEVEDGANVYFVHSYYEMPDDESVIAATCTYGVEFCAAIWKDNIVATQFHPEKSQAVGLSILKNFGEMK

SEQ ID NO: 30555 - DNA, 681 bp, Gloeobacter violaceus
  CDS (1)..(681)
atggcgcgcaccccaaacattgccctggtggattacggcgtcggcaacctgcactcggcccgcaagggcctggaggcgatgggagcgcgggtgacactcagcggccagcccctgacgctgagcgccgccgacggcgtcgtgctgccgggggtgggctccttcgacacggcgattacccggctcaacgaccgggggctgggagatgcgattatccaactggtgcgcgcaggacagccgatgctgggcatctgtctggggctgcaggtgctctttgactcctctgaagaaggacgactgccgggcctggggctgctgcccggtcgggtgcgccgcttccggagcgaacccggcctcaccattccccatgtgggctggaaccaactgcactttgacaatgtcgattgcccgctgtggcgggatctggcggcgggcggttgggtttactttgtgcattcttattacgtcgatcctgcccgcgccgaggaccgcgccgcttccgccgtgcatggcagccagcacttcaccgccgccgtgtgccgggacaacctgatggcggtgcaatttcacccggaaaagtcagcggacacgggactgcgcatcctcaaaaactttgttgagcgggccgcttcgcgcagcgccgccgaagtagcggcccgctgcgctactcgccctccagcttga

SEQ ID NO: 30556 - protein, 226 aa, Gloeobacter violaceus
MARTPNIALVDYGVGNLHSARKGLEAMGARVTLSGQPLTLSAADGVVLPGVGSFDTAITRLNDRGLGDAIIQLVRAGQPMLGICLGLQVLFDSSEEGRLPGLGLLPGRVRRFRSEPGLTIPHVGWNQLHFDNVDCPLWRDLAAGGWVYFVHSYYVDPARAEDRAASAVHGSQHFTAAVCRDNLMAVQFHPEKSADTGLRILKNFVERAASRSAAEVAARCATRPPA

SEQ ID NO: 30557 - DNA, 600 bp, Haemophilus influenzae
  CDS (1)..(600)
atgataaacatcacgattatagacacaggttgtgccaacctttcttctgtaaaattcgcctttgaccgattaggttacaataccgagatcacttttgatctcaataaaatcaaatctgccgataagctgattttacctggcgtaggcactgcaaatgcagcaatgtataatttacaagaacgtcaattgatcgagaccattcaaaatctaacacaaccagtgctaggaatttgtttgggtatgcagttaatgaccgaattttccgaagagggtaatgtgccgaccttaaacctaataagcggaaaaactaatcgaattcccgatacgggtttaccgttacctcaaatgggatggaatcgcgtgcaatttgtaaaaaactgtccgttatttgatggtattgtgcaaaatagtcacttctattttgtgcatagttatgcagttagcccgaatgaacattcggtggcaataagcaattatggtgtgaatttttctgctgcgatagcgaaagagaatttttacggtgtacaatttcatcctgaacgttcgggtaaaaatggtgcgttgttgctaaaaaattttgtggaaaaagtaccgttttaa

SEQ ID NO: 30558 - protein, 199 aa, Haemophilus influenzae
MINITIIDTGCANLSSVKFAFDRLGYNTEITFDLNKIKSADKLILPGVGTANAAMYNLQERQLIETIQNLTQPVLGICLGMQLMTEFSEEGNVPTLNLISGKTNRIPDTGLPLPQMGWNRVQFVKNCPLFDGIVQNSHFYFVHSYAVSPNEHSVAISNYGVNFSAAIAKENFYGVQFHPERSGKNGALLLKNFVEKVPF

SEQ ID NO: 30559 - DNA, 609 bp, Lactococcus lactis
  CDS (1)..(609)
atgaaaaaaattgttatcatcgactacaatattggaaatcttcaaagtgtacaggccgcatttttacgattgggacaagaaacagtgatttcaagagatttagaggaaattcgtaaagcagatgcacttattcttccaggagttggggcttttcctacagcaatgaataatctaaaaaagtttaatttgattgaacttatacaagaacgagctgctgctggaataccaatattgggaatttgtttaggaatgcaagtgctttttgaaaaaggatacgagatagaagaaagacaaggtcttggacttttaaagggagaggtgattccaatcaaaactaatgagaaaattccgcatatgggatggaatcaattaaacctggctaaagccagtccaacaactcattatttgtctgataatgatgaggtctattttgtccattcttatcaggcgacttgtcctgatgatgaactcattgcctacaccacttatggcgaagtaaaaattccggcaattgttggaaaaaataatgtgataggctgtcaatttcaccctgaaaagagtggagaaattggcagaaaggtactaaaagcattcttggaggaaatttaa

SEQ ID NO: 30560 - protein, 202 aa, Lactococcus lactis
MKKIVIIDYNIGNLQSVQAAFLRLGQETVISRDLEEIRKADALILPGVGAFPTAMNNLKKFNLIELIQERAAAGIPILGICLGMQVLFEKGYEIEERQGLGLLKGEVIPIKTNEKIPHMGWNQLNLAKASPTTHYLSDNDEVYFVHSYQATCPDDELIAYTTYGEVKIPAIVGKNNVIGCQFHPEKSGEIGRKVLKAFLEEI

SEQ ID NO: 30561 - DNA, 642 bp, Legionella pneumophila
  CDS (1)..(642)
atgagttcagtttcaattgtagattatggggtaggcaatttattaagtgtggctcgagcttttcaatattttgatgcttctgtcaatttagtgagcacacccgaggaaattatgagtgccgatcggttggttttgccaggagtaggcgcttttgaagatgggatgaaaggattaactacattaaattttatagaacccataaagcaatttgcgcggagtggaaaaccttttctgggaatatgtcttggcatgcagatgatgctctcaagaagtactgaattcggacaacatgaaggcctggatctaatagctggcgaggttgttagcgttccttcacatggagttgatggtcaattgcataaaatacctcatataggctggaatgaactggtttccacctcagaaggcgaggattggtgtcatactatcctgaaaaatataccattaaattcttcagtatattttgttcattcttttatggccatgcctagtaatcctaaaaagcgtctggctgatactttatatgatggtcaggctattagcgcagtaataaaagatgaaaatatgtacggatgccaatttcatcctgaaaaaagcggggaagtaggtttaagcatcattcaacagtttttgcagatttag

SEQ ID NO: 30562 - protein, 213 aa, Legionella pneumophila
MSSVSIVDYGVGNLLSVARAFQYFDASVNLVSTPEEIMSADRLVLPGVGAFEDGMKGLTTLNFIEPIKQFARSGKPFLGICLGMQMMLSRSTEFGQHEGLDLIAGEVVSVPSHGVDGQLHKIPHIGWNELVSTSEGEDWCHTILKNIPLNSSVYFVHSFMAMPSNPKKRLADTLYDGQAISAVIKDENMYGCQFHPEKSGEVGLSIIQQFLQI

SEQ ID NO: 30563 - DNA, 615 bp, Leptospira borgpetersenii
  CDS (1)..(615)
gtgattggaattttagactacggagtcggaaatttaaaggcctttgcgaacgtacttaaaggtctgaattttcatcatcaaatcgttaaaaccgaacaggaactaaaaggttgtgaaaaaatcatcatgccgggtgtgggttcgttcgatagcgtgatgaataagttgatcgaatcgggcattcgggacgtgctttccgatttaataatcaacaaaaaaattcctatactaggcgtttgtgtgggaatgcaaattttagcttcctctagtgaagaaggtagtaaatcgggacttggttggattcgaggaagagtgaaaaagtttaactttgatcgatccgatttctcacttactattcctcaaataggttggaacgaagttaactctacgaaagaaaatacgttattaaaaaatttggagaagaatcctcgtttctatttcttacattcatattatatagaatgtgaggataagaaagatgtgattgcgatcgcgaactatggaggggattttacgtgtgcagtaaatcgcgaaaatatctacggaactcagtttcatcccgaaaaaagtcatcacaatggagtcgccttaattcgtaattttgcaagtttataa

SEQ ID NO: 30564 - protein, 204 aa, Leptospira borgpetersenii
MIGILDYGVGNLKAFANVLKGLNFHHQIVKTEQELKGCEKIIMPGVGSFDSVMNKLIESGIRDVLSDLIINKKIPILGVCVGMQILASSSEEGSKSGLGWIRGRVKKFNFDRSDFSLTIPQIGWNEVNSTKENTLLKNLEKNPRFYFLHSYYIECEDKKDVIAIANYGGDFTCAVNRENIYGTQFHPEKSHHNGVALIRNFASL

SEQ ID NO: 30565 - DNA, 627 bp, Listeria monocytogenes
  CDS (1)..(627)
atgattgtaattattgactatgatacaggaaacacgaagagcatcagcaaagcacttgattttatcggactacaaaacaaaatttctagtgatgcaacagaaatctcacaggctgacggcgttattttaccaggagttggcgcttatcctgaagctatgaaagaactcactcggcgcgggctaaataaaacattaaaagaaatcgctgccggtggcaaaccaattcttggtgtttgtcttggtatgcaacttttactcgaatcaagtaacgaacatagctttactaatggtctcggtctcattcccggtcatgtcgaaaaattaccagaagatcccgaatttgccgttccacatatgggctggaatcaactacaaatcaaacgtgccaccccgcttacaaaacaacttgatggagaatacgtttattacgttcactcctattacgccaattgcccagaagaatacattatcgcaacaagtggctattctattgaagttcctggcatgataaataaaggcaatatttacggcgcccagttccatcctgaaaaaagcggccaaatcggtcttgaaattttaaaaggatttaaggaggtcacttattcatgcaaatcttcccagcaatag

SEQ ID NO: 30566 - protein, 208 aa, Listeria monocytogenes
MIVIIDYDTGNTKSISKALDFIGLQNKISSDATEISQADGVILPGVGAYPEAMKELTRRGLNKTLKEIAAGGKPILGVCLGMQLLLESSNEHSFTNGLGLIPGHVEKLPEDPEFAVPHMGWNQLQIKRATPLTKQLDGEYVYYVHSYYANCPEEYIIATSGYSIEVPGMINKGNIYGAQFHPEKSGQIGLEILKGFKEVTYSCKSSQQ

SEQ ID NO: 30567 - DNA, 609 bp, Methanosarcina acetivorans
  CDS (1)..(609)
atgaaaagaatcgtaattatcgattacgggcttggaaatctaagaagtgttcaaaaaggacttgaacatgttggggcaaatcccgcaatctcagggaaccctgaggagatcctgacagccgatggtatcattcttcccggggttggtgcttttatagatgcaatgaaatgtctgattcccctcaaaggggttatcgcggaatttgcagagtccggaaagccaatgctcgggatctgtctcgggcagcaggttctgatgagctcttccgaagaaggcaggctgaccggcgggcttgacctcattcagggcagagtgctccgctttccgaagtccgagctgaaagtgccccacatgggctggaacaatatcaggatcaagcaggatcatcctctgtttaaaggcatttctgacggttctttcgtatacttcgtacactcctattatgtggacacaactgcggaaaacactctcgcgtcatgtgaatacgggctggatttttcagcttctgtcgtaaactcaaaaggaaatgttatgggtacccagttccaccccgagaaaagtggaaccacagggcttaagattctgaaaaacttcgttgaaatgtgttaa

SEQ ID NO: 30568 - protein, 202 aa, Methanosarcina acetivorans
MKRIVIIDYGLGNLRSVQKGLEHVGANPAISGNPEEILTADGIILPGVGAFIDAMKCLIPLKGVIAEFAESGKPMLGICLGQQVLMSSSEEGRLTGGLDLIQGRVLRFPKSELKVPHMGWNNIRIKQDHPLFKGISDGSFVYFVHSYYVDTTAENTLASCEYGLDFSASVVNSKGNVMGTQFHPEKSGTTGLKILKNFVEMC

SEQ ID NO: 30569 - DNA, 597 bp, Methanobacterium thermoautotrophicum
  CDS (1)..(597)
ttgatagccatcatagactatggaagcggaaacctcaggagcatagccaatgcattcaggaagataggggcagatgcccttgtgacatcagatccacagatccttgaagccgccgacgcactcgtactcccgggtgtcggtgcatttggaagtgcgatggccaaactcgagggtctgagggaaaccctgctggggaacatcatggatgggaaacccttcctggggatatgcctggggctacaggtgctcctttcagagagccaggaatctcctggtgtccatggtcttgaccttataccgggaagggtcataagaataccaccaggcaataaggtcccccatatgggctggaaccagctgataattgtggaagattcacagctccttgagggtgctgaggatgagtacttctacttcgtccactcctactatgctgaaccctccaacgacgtggtcgttgcaaggacagattatggggttgaaatgacagcggccatcgaatccgataacatccatgcaacccagttccaccctgaaaagagcggggaagccggactggatgttctaaggaactttgtcgaaataatcagggcatga

SEQ ID NO: 30570 - protein, 198 aa, Methanobacterium thermoautotrophicum
MIAIIDYGSGNLRSIANAFRKIGADALVTSDPQILEAADALVLPGVGAFGSAMAKLEGLRETLLGNIMDGKPFLGICLGLQVLLSESQESPGVHGLDLIPGRVIRIPPGNKVPHMGWNQLIIVEDSQLLEGAEDEYFYFVHSYYAEPSNDVVVARTDYGVEMTAAIESDNIHATQFHPEKSGEAGLDVLRNFVEIIRA

SEQ ID NO: 30571 - DNA, 621 bp, Mycobacterium leprae
  CDS (1)..(621)
gtgagaagtaaatcggttgtagttctggattacggttcgggtaatttgtggtcggtgcagcgcgcgctgcagcgggttggtgccgcggtcgaagttacggctgactcagctgcaggcgccgccgctgacgggttgctggtgcccggtgtcggcgcgttcgaggcgtgcatggcaggtctgcggaaaatcgcgggtgaacggaccatcgccgagcggatcgtcgcgggacggccggtattaggggtctgtgtcggcatgcagattttgttcgcccgcggtgtcgaattcggtgtggaaacaacaggctgtaggcagtggccgggcgttgtgacccggctcgacgccccggtggttccccatatgggctggaacgtagtcgattccgcttctggaagtgcgttgttcaagggcctagatgctggagtgcggttctatttcgtgcattcttatgccgcgcagcgttgggaaggctcatccaaggcgctgctgacatgggcaactcaccaagtaccgtttttggccgcggtggaagaaggaccactggttgccacccagttccatccggagaagagtggggacgctggagcaaccttgctgagcaattggcttggggaactttaa

SEQ ID NO: 30572 - protein, 206 aa, Mycobacterium leprae
MRSKSVVVLDYGSGNLWSVQRALQRVGAAVEVTADSAAGAAADGLLVPGVGAFEACMAGLRKIAGERTIAERIVAGRPVLGVCVGMQILFARGVEFGVETTGCRQWPGVVTRLDAPVVPHMGWNVVDSASGSALFKGLDAGVRFYFVHSYAAQRWEGSSKALLTWATHQVPFLAAVEEGPLVATQFHPEKSGDAGATLLSNWLGEL

SEQ ID NO: 30573 - DNA, 621 bp, Mycobacterium paratuberculosis
  CDS (1)..(621)
gtgacaagtaaatcggttgttgtcctcgactacggctcgggcaacctgcggtcggcgcagcgcgcgctggagcgggtcggcgcctcggtgcaggtgaccgccgacgccgacgccgccgcggccgccgacggactggtggtgcccggcgtcggcgcctacgaggcatgcatgaccgggctgcgcaagatcggcggggaccgcatcatcgccgagcgggtcgccgcggggcgtccggtgctgggcgtgtgcgtcgggatgcagatcctgttcgcccgcggcgtcgaattctcggtggagacctccggatgcgggcagtggccgggatcggtgacacgcctgcaggcgccggtgatcccgcacatgggctggaacgtggtcgaatccgggccggacagcgtgctgttccgcggcctcgacgctgacacccggttctacttcgtgcactcctacgccgcccaacagtgggagggttcgcccgaggcggtgctgacctggtcgcgccacgaggggccgtttctggccgcggtcgaggacggcccgctgtcggccacgcagtttcacccggagaagagcggggatgccggcgcggccgtgctgcgcaattggattgagcgcctgtga

SEQ ID NO: 30574 - protein, 206 aa, Mycobacterium paratuberculosis
MTSKSVVVLDYGSGNLRSAQRALERVGASVQVTADADAAAAADGLVVPGVGAYEACMTGLRKIGGDRIIAERVAAGRPVLGVCVGMQILFARGVEFSVETSGCGQWPGSVTRLQAPVIPHMGWNVVESGPDSVLFRGLDADTRFYFVHSYAAQQWEGSPEAVLTWSRHEGPFLAAVEDGPLSATQFHPEKSGDAGAAVLRNWIERL

SEQ ID NO: 30575 - DNA, 621 bp, Mycobacterium tuberculosis
  CDS (1)..(621)
gtgacagcaaaatcggttgtagtccttgactacggctcaggaaacctgcggtcggcccaacgtgcgctgcaacgagtaggcgccgaggtcgaagtaaccgccgataccgacgccgcaatgaccgctgacggactggtggtgccgggcgtcggtgctttcgcggcgtgcatggcgggcctgcgcaagatcagcggagagcgaatcatcgccgagcgggtggccgccggccgcccggtgctgggggtctgtgtcggtatgcagattctgtttgcttgcggggtcgaattcggtgtgcagacgccaggctgcgggcactggccgggggcggtcattcgacttgaggccccggtgattccgcacatgggctggaatgtcgtggattccgctgcgggcagcgcgctgttcaaagggttggacgtcgacgcccggttttatttcgtgcattcctatgccgcgcagcgatgggaaggctcacccgacgcgctgctgacctgggccacatatcgggcgccgttcctcgctgcggtggaggacggcgcattggccgccacccagtttcatccggagaagagtggcgatgccggtgcagccgtactgagcagctgggttgatggactttaa

SEQ ID NO: 30576 - protein, 206 aa, Mycobacterium tuberculosis
MTAKSVVVLDYGSGNLRSAQRALQRVGAEVEVTADTDAAMTADGLVVPGVGAFAACMAGLRKISGERIIAERVAAGRPVLGVCVGMQILFACGVEFGVQTPGCGHWPGAVIRLEAPVIPHMGWNVVDSAAGSALFKGLDVDARFYFVHSYAAQRWEGSPDALLTWATYRAPFLAAVEDGALAATQFHPEKSGDAGAAVLSSWVDGL

SEQ ID NO: 30577 - DNA, 639 bp, Neisseria meningitidis
  CDS (1)..(639)
atgcaaaccgccattatcgattacggtatgggcaacctgcattccgtattgaaatccgtccggacggcagggcagcttgccggaaaaaatgtcgaaatctttttaagcggcgaccccgaacgcgtgtcccgcgccgacaaagtcatttttcccgggcagggcgcgatgcccgactgtatggcggcactgacgcgcggcggcctggacgaggcagtcaaagatgccttaaaaaacaaaccctttttcggaatctgcgtcggcgcgcaacttttattcgaccacagcgaagaaggaaacaccgacggcttgggctggttcggcggcaaagtcagacgctttgagcgcgacctcctcgacccgcagggatgccgtctgaaagtcccgcatatgggctggaacaccgtgcgccaaacccaaaaccacccgctttttcaaggcatcccccaagacacgcgtttttacttcgtccacagctactatttcgcccccgaaaatcccgaaaccatattgggcgaaagcgactacccgtccccgtttgcctgcatcgtcggcaaagacaacgtattcgccacgcaatttcacaccgaaaaaagccacgatgccgggctgacgatgttgaaaaactttttaaactggtaa

SEQ ID NO: 30578 - protein, 212 aa, Neisseria meningitidis
MQTAIIDYGMGNLHSVLKSVRTAGQLAGKNVEIFLSGDPERVSRADKVIFPGQGAMPDCMAALTRGGLDEAVKDALKNKPFFGICVGAQLLFDHSEEGNTDGLGWFGGKVRRFERDLLDPQGCRLKVPHMGWNTVRQTQNHPLFQGIPQDTRFYFVHSYYFAPENPETILGESDYPSPFACIVGKDNVFATQFHTEKSHDAGLTMLKNFLNW

SEQ ID NO: 30579 - DNA, 639 bp, Nitrosomonas europaea
  CDS (1)..(639)
atgaactcgattgccgtcgttgattacggaatgggcaacctgcgatcagtatccaaagcactggaatatgtcgattcatctgctgtcgtcactgtaaccagtgatcccgaaaccatccgatctgccgcacgcgtcgttgttcccggtcagggtgcgatgcctcattgcatgcaggcgctggatgaccagggtttacgcgaatcagttatcgaggctgctaaaaacaagcctttcctcggtatctgccttgggttgcaaatgctgttcgaggaaagtgaagaaggcaatattcgtgcactgggcattctgcctggcagagtcaaaaaactggaatctacggatacagccgatagcgacattccgaaaatcaagatccctcatatgggctggaaccaggttcaccagactctggagcacccgttatggcacgggatcgataccgacacacgtttttacttcgttcacagttattacgtggcaacagatgaaccgcaaatagtggcaggcagcaccgaatatccggttccattcacctgcgcagtggccagggataatatttttgccattcagtttcaccctgagaaaagtcattctgcaggactggcgttattgagtaatttcctgaaatggacgccctga

SEQ ID NO: 30580 - protein, 212 aa, Nitrosomonas europaea
MNSIAVVDYGMGNLRSVSKALEYVDSSAVVTVTSDPETIRSAARVVVPGQGAMPHCMQALDDQGLRESVIEAAKNKPFLGICLGLQMLFEESEEGNIRALGILPGRVKKLESTDTADSDIPKIKIPHMGWNQVHQTLEHPLWHGIDTDTRFYFVHSYYVATDEPQIVAGSTEYPVPFTCAVARDNIFAIQFHPEKSHSAGLALLSNFLKWTP

SEQ ID NO: 30581 - DNA, 606 bp, Oceanobacillus iheyensis
  CDS (1)..(606)
ttgattgcaattattgattatggcgctggaaatataaaaagtcttcaatttgcattagataaattgaataaacattccattgttacaacagaagcagcagaaatcaaacaagcagattcaattattttacctggtgtcggagcattcaaagatgcaatggaagcaatccgtcagcttcaattagattccgttatacaagaggaagcgcaaaaaggaaaaccaatattagggatttgcctaggtatgcaactcttttatgaacaaagccttgaaaacggagattgggaaggattaggactgctaaaaggatccattaaacgaatctctggtgaagttaaagtaccacatatgggttggaatacattagacattcaacaagcttcgccactatttgattctaagttagaaaatccttatgtctatttcgttcactcctatgcagtttcttctttcgaggagaatactttacttgctagttctcaatatggacagctaattccagctatcgttcaaaaagggaatataaccggtatgcaatttcatccagagaagagcggcgagtttggaattgaattactaaaaagatatgaggagatgattagatga

SEQ ID NO: 30582 - protein, 201 aa, Oceanobacillus iheyensis
MIAIIDYGAGNIKSLQFALDKLNKHSIVTTEAAEIKQADSIILPGVGAFKDAMEAIRQLQLDSVIQEEAQKGKPILGICLGMQLFYEQSLENGDWEGLGLLKGSIKRISGEVKVPHMGWNTLDIQQASPLFDSKLENPYVYFVHSYAVSSFEENTLLASSQYGQLIPAIVQKGNITGMQFHPEKSGEFGIELLKRYEEMIR

SEQ ID NO: 30583 - DNA, 597 bp, Pasteurella multocida
  CDS (1)..(597)
atgcaaaatataactataatcaacacccgttgcgcgaacctttcttccgtcaaatttgcttttgaccgtttaggttaccacacagaaattaccgataatatcgaaaaaatccaatccgccgacaagctgattttgcctggtgtgggaacggcaaaagcagcgatgcaaaatttggcggatttaggcttaattgaggttatccaaagcctaactcaacctgttttggggatttgtttgggaatgcaattaatgaccgactattccgaagaaggcaatttggacttattaaaactgatgtcaggcaaaaccgaaaaattaccggattgtcagttgccgttaccgcatatgggctggaataaggtgcattatgccgccgatcacccgctctttgcagagattgctcaagacagctatttctattttgtgcatagctacggcgtgttgcccaatccgcacaccgttgccacttgcgactatggtgtgccattttctgcggtaatccaacataacaatttttatggtgcacaattccaccctgagcgttctggcaaggcaggcgcgttatttttgcgtaattttgtggaaaacattaaataa

SEQ ID NO: 30584 - protein, 198 aa, Pasteurella multocida
MQNITIINTRCANLSSVKFAFDRLGYHTEITDNIEKIQSADKLILPGVGTAKAAMQNLADLGLIEVIQSLTQPVLGICLGMQLMTDYSEEGNLDLLKLMSGKTEKLPDCQLPLPHMGWNKVHYAADHPLFAEIAQDSYFYFVHSYGVLPNPHTVATCDYGVPFSAVIQHNNFYGAQFHPERSGKAGALFLRNFVENIK

SEQ ID NO: 30585 - DNA, 606 bp, Photorhabdus luminescens
  CDS (1)..(606)
atgaaagttgtcattcttgatactggctgcgctaacttgtcatcggtaacttatgccatccgaaaattaggctatcaacctgaaatcagtcaggaaacagcaacgatcctggcagcagataaactacttttacctggtgtcggcactgccagtgccgcaatggatcaattgaaacaacgggaacttataccgttaattaaagtactcagccaacctgtgttaggtatttgccttggcatgcagctattcgctgccaccagcgaagaaagcgataatgttgcaggtaataatgtcaccctactcgaagttatggcttcccccgtccaaaaaatggctacgcatgggcttccattaccacacatgggctggaaccaagttctgccaaaagccgggcacccgctattccgtggtattgaagaccatgcctatttttattttgtccatagctacgcgatcccgctgaatacctacaccattgcgcaaactgaatatggcaatattttcagcagcgcaatcgccaaagataacttcttcggcgtacagtttcaccctgaacgttccggtgctgccggagccagactattaaagaattttctggagatgtag

SEQ ID NO: 30586 - protein, 201 aa, Photorhabdus luminescens
MKVVILDTGCANLSSVTYAIRKLGYQPEISQETATILAADKLLLPGVGTASAAMDQLKQRELIPLIKVLSQPVLGICLGMQLFAATSEESDNVAGNNVTLLEVMASPVQKMATHGLPLPHMGWNQVLPKAGHPLFRGIEDHAYFYFVHSYAIPLNTYTIAQTEYGNIFSSAIAKDNFFGVQFHPERSGAAGARLLKNFLEM

SEQ ID NO: 30587 - DNA, 633 bp, Photobacterium profundum
  CDS (1)..(633)
atggcgagtacaaatcaaaaagttgtcatcattgataccggctgcgccaatgtatcttctgttcgctttgcgattgaacgcttgggttataccgttacgataagtaaagaaacaagcgtggtactaaatgctgataagttatttcttcccggcgtaggcacggcaagtgaagccatgaaaaacctgcaagagcgagatttagttgaactcgtcaagcaagttgataagccattactcggcatctgtttagggatgcaattactgggtgcattgtcagaagaacaaggacaaaacggtaaagagcttgttccttgtttacacctttgcgatgcccccattaaaaaattaaaaacaggtaatttacccttgccacacatgggttggaatacgattacgcccattgacaatcacccattatttcagggtattccagcaggcagctacttctattttgtacatagttatgccatgccggtttcaacaggggtcaacgattacaccatcgcccagtgtgagtatggtcagccttttagtgcggcaattcaaagtggcaattattacggtgtgcagtttcatcctgaacgttcgagcaaagcaggctctcaactgattaagaattttttagagatgtag

SEQ ID NO: 30588 - protein, 210 aa, Photobacterium profundum
MASTNQKVVIIDTGCANVSSVRFAIERLGYTVTISKETSVVLNADKLFLPGVGTASEAMKNLQERDLVELVKQVDKPLLGICLGMQLLGALSEEQGQNGKELVPCLHLCDAPIKKLKTGNLPLPHMGWNTITPIDNHPLFQGIPAGSYFYFVHSYAMPVSTGVNDYTIAQCEYGQPFSAAIQSGNYYGVQFHPERSSKAGSQLIKNFLEM

SEQ ID NO: 30589 - DNA, 618 bp, Prochlorococcus marinus subsp
  CDS (1)..(618)
ttggctaaaataggactcatagattatgggatgggtaacatacattccgtaacaaaagccttagaaagccttgaagaagaaataattttaataaaaaataatcatcaaataaaagactgtaaagcattaatacttccaggagttggttcatttgatcctgctattaataatctcagtaaaacagagttaataattgatattaaaaattggattaaaagtggtaaatcatttttagggatttgtcttggattgcaattactttttgaatcaagtgatgaaggtacaattaatggacttggaatagtaaagggccaaataaaaaaaatccctcaattgtctgatcaaagaatccctcatgttggttggtgtgaacttcttcctacaagaaaaaatagcttattaaaagtggatgaattaaataattgggtatattttgttcattcttatcatgcggtaccatcgaataataatttaataactgcaaatgttagttatggttctgaaaaattaacagcaatgatagaacgagataatttaatggcttgccagtttcatcctgaaaaatcagggaaaactggtgaaaaacttttacgtcgatggattaagagtattcaataa

SEQ ID NO: 30590 - protein, 205 aa, Prochlorococcus marinus subsp
MAKIGLIDYGMGNIHSVTKALESLEEEIILIKNNHQIKDCKALILPGVGSFDPAINNLSKTELIIDIKNWIKSGKSFLGICLGLQLLFESSDEGTINGLGIVKGQIKKIPQLSDQRIPHVGWCELLPTRKNSLLKVDELNNWVYFVHSYHAVPSNNNLITANVSYGSEKLTAMIERDNLMACQFHPEKSGKTGEKLLRRWIKSIQ

SEQ ID NO: 30591 - DNA, 639 bp, Pseudomonas putida
  CDS (1)..(639)
atgcaaacggtagccgtaatcgactatggcatgggtaacctgcactcggtggccaaggcgcttgagcacgtaggtgccggtaaagtgctggttaccagcgatgcctcagtgatccgcgaggccgaccgtgtggtgttcccgggcgtgggcgcgattcgcgactgcatggccgagatccgccgcctgggcttcgacagcctggtgcgcgaagtcagccaggaccgcccgttcctcggcatctgcgtcggtatgcaggcgctgctcgagcacagtgaggaaaacgccggcgtcgactgcattggcctgttccctggccaggtgcgctttttcggcaaagacctgcaagaagagggcgagcacctgaaggtgccgcacatgggctggaacgaagtcagccagaccatcgaccacccgctgtggcacgacatccctgatcgcgcacgtttctacttcgtgcacagctactacatcaatgccggcaagccgggccaggtggtgggtcgcggtcactatggcgtcgatttcgccgcagcgctggccgacggttcgcgttttgccgtgcagttccacccggagaagagccatacccatggcctgcagctgctgcagaacttcatcgcctgggacgggcgctggtaa

SEQ ID NO: 30592 - protein, 212 aa, Pseudomonas putida
MQTVAVIDYGMGNLHSVAKALEHVGAGKVLVTSDASVIREADRVVFPGVGAIRDCMAEIRRLGFDSLVREVSQDRPFLGICVGMQALLEHSEENAGVDCIGLFPGQVRFFGKDLQEEGEHLKVPHMGWNEVSQTIDHPLWHDIPDRARFYFVHSYYINAGKPGQVVGRGHYGVDFAAALADGSRFAVQFHPEKSHTHGLQLLQNFIAWDGRW

SEQ ID NO: 30593 - DNA, 573 bp, Pyrobaculum aerophilum
  CDS (1)..(573)
gtgatcgtcggcgtagtggactataccgtcgggaacattgggagcgtgctaacggctttgaaaagagctggggcggtgcctgtggtggttaaaggagttgaggaggctgggcgcgtggacgccgtggtgttgccgggggttgggacttacgaggcggcttacgccctggcccgccagtttaaagaggtggtgttggaaaagcccacgcttgccatttgtctcggcatgcagctccttttcgagtccagcgaagagggaggggggcagggactgggcgtttttaaaggccgcgttgagagaataaaggcgaggaaagtcccaaacataggatggcggtatacccacgtggtcaagaacagcgaaattattgccgagggctattattactacctccacagctacggcgtccgttggggcgaaaacgaggcctacactgcctatattaagctggaggaaaaatatgtggcggctgtcgaaagggggcatattattggcgtgcaattccaccctgaaaggagcggcaggaccggcctggagcttatcaagcggtttctagccgtggcgaagagataa

SEQ ID NO: 30594 - protein, 190 aa, Pyrobaculum aerophilum
MIVGVVDYTVGNIGSVLTALKRAGAVPVVVKGVEEAGRVDAVVLPGVGTYEAAYALARQFKEVVLEKPTLAICLGMQLLFESSEEGGGQGLGVFKGRVERIKARKVPNIGWRYTHVVKNSEIIAEGYYYYLHSYGVRWGENEAYTAYIKLEEKYVAAVERGHIIGVQFHPERSGRTGLELIKRFLAVAKR

SEQ ID NO: 30595 - DNA, 585 bp, Pyrococcus furiosus
  CDS (1)..(585)
atggatagaattgcaatagtcgacctaggaattggtaatctagcaaacgtaaagaaggccctaaaaggatatataactagcgatccttacgagatagagaaagcagacaaaattgttcttcccggggttggcaatttcggggccgtggtggacaaactcgccccaataaaagatataatcattgagggaataaacgagggaaagcccttcctgggaatatgtcttggaatgcaacttcttttcgaggaaagtgaagaaagcccaggaaaagagggacttggaatattcaaaggaaaagttgtgaaactaaaaaatgtaagaaccccacatattggctggaaccaggtgtggataaagaaggaatgcaagctctttgaggggctaaagaatggcagctatttttactttgttcactcctatcatgccgtcccacaagaccccgatataatagcaacaactacagactatgaaaatgcagagtttgtctcctcagtatgctttgaaaacatatttggcgtccagttccacccagaaaagagtagcaaaaatggtcttatactcctaagaaactttaggaggttataa

SEQ ID NO: 30596 - protein, 194 aa, Pyrococcus furiosus
MDRIAIVDLGIGNLANVKKALKGYITSDPYEIEKADKIVLPGVGNFGAVVDKLAPIKDIIIEGINEGKPFLGICLGMQLLFEESEESPGKEGLGIFKGKVVKLKNVRTPHIGWNQVWIKKECKLFEGLKNGSYFYFVHSYHAVPQDPDIIATTTDYENAEFVSSVCFENIFGVQFHPEKSSKNGLILLRNFRRL

SEQ ID NO: 30597 - DNA, 654 bp, Ralstonia solanacearum
  CDS (1)..(654)
atgactacgattgcaattgtcgattacggcatgggcaacctgcgctcggtggcgcaggccctgagtaccgttgccccggacgccgatgtgcgcatcagtgcgcaggccgacgagatccgggccgccgaccgggtggtgctgccggggcagggcgccatgcccgactgcatggcggccttcgaccagtccggactgcgcgaagccgtgctcgaggccgcgcgcaccaagccgatgctcggcgtgtgcgtgggcgaacagatgctgctggagcgcagcgccgaggcgcgcgccggcgaggcgttcacggcgggcctggggctgatttccggcgatgtgatccgcttcgacctggacggccggttgcagccggacggttcgcggtacaaagtgcctcagatgggctggaaccgcgtgcaccagagccgaacccatgcgctgtgggccggcgtgccggaccagagctacttttacttcgtgcacagttactatgcacggccggcgcaccccgacgaatcggtcggggagaccgaatacggtgtgcggtttacctgcgccattgcccgggataatattttcgcaacacagtttcacccggaaaaaagtgcgcaggccggcttgcagatctaccggaatttcgtgcactggaagccctga

SEQ ID NO: 30598 - protein, 217 aa, Ralstonia solanacearum
MTTIAIVDYGMGNLRSVAQALSTVAPDADVRISAQADEIRAADRVVLPGQGAMPDCMAAFDQSGLREAVLEAARTKPMLGVCVGEQMLLERSAEARAGEAFTAGLGLISGDVIRFDLDGRLQPDGSRYKVPQMGWNRVHQSRTHALWAGVPDQSYFYFVHSYYARPAHPDESVGETEYGVRFTCAIARDNIFATQFHPEKSAQAGLQIYRNFVHWKP

SEQ ID NO: 30599 - DNA, 651 bp, Rhizobium loti
  CDS (1)..(651)
atgcgggtagcaatcatcgactacggctcgggcaatctgcgctcggccaccaaggccttcgagcgcgccgcgcgcgaaggaggcatatcggccgagatcgacctgacggccgatgccgaccgggtgcgcacggccgaccgcatcgtcctgcctggcgtcggcgcctatgccgactgcgcggccggcctgcgtgccgtcgacggcatgtgggaagcggtcgaggacgtcgccatcgctcagagccggcccttcctcggcatctgcgtcggtatgcagctgatgtctgagcgcggcctggaaaagaccgtcacccatggcttcggctggatctcgggcgacgtcaaggagatcacgcccaccgatccggcgctgaaaatcccgcagatcggctggaacacgatcgagctcaggcgccaacacccgctgtttgccggcatcccgaccggaccagaggggctgcacgcctatttcgtgcattcctaccatctcgacgcgaaaaagccggacgagattctggccgtcgccgactatggcggtccggtgacggcggccgtcgcccgcgacaatctcgtcggcacgcagttccatcccgaaaagagccaggcgctgggtctggcgctgatcaccaatttcctgcggtggaggccctga

SEQ ID NO: 30600 - protein, 216 aa, Rhizobium loti
MRVAIIDYGSGNLRSATKAFERAAREGGISAEIDLTADADRVRTADRIVLPGVGAYADCAAGLRAVDGMWEAVEDVAIAQSRPFLGICVGMQLMSERGLEKTVTHGFGWISGDVKEITPTDPALKIPQIGWNTIELRRQHPLFAGIPTGPEGLHAYFVHSYHLDAKKPDEILAVADYGGPVTAAVARDNLVGTQFHPEKSQALGLALITNFLRWRP

SEQ ID NO: 30601 - DNA, 651 bp, Rhizobium meliloti
  CDS (1)..(651)
atgcgggtcgccatcattgactacgggtcgggcaatctgcgctcggctacgaaggccttcgagcgcgccgcccgcgaggcgggcatcgcggccgaaatcgatctcaccgacaggccggaacgggtggccacggccgatcgcatcgtgctgccgggcgtcggcgcctatgccgattgccgccgcggcctcgccgtcgtggagggcatggaggaagcgctgacggaggcggtcgagaaaaccggccgccccttcttcggcatctgcgtcggcatgcagctcatgtcgtcccgcggactcgaaaagacggtgacgaaaggtttcggctggatcgccggcgatgtcgtcgggatgacgcccgaggacccctcgctcaagatcccccagatcggctggaacacgcttgatctcaagcgcccgcacccgctcttcgacggcattccgaccggcgagaacggtctgcacgcctatttcgtccattcctaccacctcgcggcggagcgtgccgaagacgtggtggccgaggcgggctatggcggcccggtgacggccttcgtcgcacgcgacaacaaggcgggctcgcagttccatccggaaaagagccaggcgctcggccttgccctcatttccaatttcctgcgctggaagccctga

SEQ ID NO: 30602 - protein, 216 aa, Rhizobium meliloti
MRVAIIDYGSGNLRSATKAFERAAREAGIAAEIDLTDRPERVATADRIVLPGVGAYADCRRGLAVVEGMEEALTEAVEKTGRPFFGICVGMQLMSSRGLEKTVTKGFGWIAGDVVGMTPEDPSLKIPQIGWNTLDLKRPHPLFDGIPTGENGLHAYFVHSYHLAAERAEDVVAEAGYGGPVTAFVARDNKAGSQFHPEKSQALGLALISNFLRWKP

SEQ ID NO: 30603 - DNA, 618 bp, Rhodopirellula baltica
  CDS (1)..(618)
atgatcaccatcgttgactatcaaatgggaaacctccgcagtgtccaaaaggcggtggaacgttcgggcgtggaggcggagatcaccagtgatgctagccagatcgcagcggccgagcgattgatcctgccgggtgtgggagcgtttggggatgcgattggcgagattcgtcgccgcgatctggagaagccgatcaaagatttcatcgcttcgggcaaaccctttttgggaatctgcctggggctgcagatgctgttcgagcaaggcttcgagggcggcacccacgaagggctcggcgtgttgggcggcgatgtggtcgcattcgaattgcccgccgagttcaaggtcccacacatgggttggaacgcggtcgatgtgaaggacgccggtgccgacctcgggattcaatccggaacgcatttctactttgtccactcctatttcgttcgcccggccgatccatcggtggtcgcattgacatgtgattacggtggcgagttttgtgccgccgtgcgtcgtggcaatttgatggcgacccagttccaccccgagaagagccagggagacggactgcgattgatgcagcgtttcgcgaccgcgccggtcgaagtcgcctga

SEQ ID NO: 30604 - protein, 205 aa, Rhodopirellula baltica
MITIVDYQMGNLRSVQKAVERSGVEAEITSDASQIAAAERLILPGVGAFGDAIGEIRRRDLEKPIKDFIASGKPFLGICLGLQMLFEQGFEGGTHEGLGVLGGDVVAFELPAEFKVPHMGWNAVDVKDAGADLGIQSGTHFYFVHSYFVRPADPSVVALTCDYGGEFCAAVRRGNLMATQFHPEKSQGDGLRLMQRFATAPVEVA

SEQ ID NO: 30605 - DNA, 651 bp, Rhodopseudomonas palustris
  CDS (1)..(651)
atgagcgttgcgatcgtcgactacggctccggcaacctgcactcggcggcgaaagcgttcgagcgcgcggcgcggagcatggaaaatcccgaaccgatcctggtgacccgcgatccggaccaggtgtttcgggccgaccgcgtcgtcctgcccggcgtcggcgccttcgccgactgccgcaagggactggattcgatcgacggcatggtccaagcgctgaacgagaccgtccgcgataaggcgcggccgttcttcggcatctgcgtcggcatgcagctgatggcgacccgcggcaaggagcatgttaccaccgatgggctgaactggatcgccggtgacgtcgtcaagatcgcgcccgatcgcgaggatctgaagatcccgcatatgggctggaatacgctcgatccggtccgtgaacacccggtgctcgaaaagctgccgctcggcccgaaaggcctgcacgcctatttcgtgcactccttccacctcgccgccgaacacgaaggcgacgtgctggcgcgcgctgactacggcgggcctgtcacggctgtcgtcggcaaggacaccgcgatcggtactcagtttcaccccgagaagagtcagcgcttcggcctggcgctgatctcgaattttttgaagtggaagccgtga

SEQ ID NO: 30606 - protein, 216 aa, Rhodopseudomonas palustris
MSVAIVDYGSGNLHSAAKAFERAARSMENPEPILVTRDPDQVFRADRVVLPGVGAFADCRKGLDSIDGMVQALNETVRDKARPFFGICVGMQLMATRGKEHVTTDGLNWIAGDVVKIAPDREDLKIPHMGWNTLDPVREHPVLEKLPLGPKGLHAYFVHSFHLAAEHEGDVLARADYGGPVTAVVGKDTAIGTQFHPEKSQRFGLALISNFLKWKP

SEQ ID NO: 30607 - DNA, 636 bp, Rhodobacter sphaeroides
  CDS (1)..(636)
atgctgacggtcctcgtcgattacgacagcggcaatctccactcggccgaaaaggcgttccagcgcatggcgaccgagaccggggccgggcaggtcctcgtgtcggacaggcccgaggatgtggcgcgcgccgaccggatcgtgctgccgggcgacggcgccttcccggcctgccgccgcgcgctcggcagctacggcggcctgtccgaggcgatcgaggaggcggtgacgcggcgcgcacggcccttcctcggcatctgcatcggcatgcagatgatggccacgcgcggtctcgaacatgaggagacgccgggcttcggctggatcgcggccgaggtggtgcggatcgcgccctccgacccgcatctgaaggtgccgcacatggggtgggaacgactgacggtcgaccatccccacccggtgctgacggggatcgagacgggcgatcacgcctatttcgtccattcctaccatttccaggtggcccacgatgccgagcggctggcccatgccgactatggcgcggacatcacggccatcgtggggcgcgacacgatggtgggcacgcagttccacccggagaagagccagaagaccgctgcgctgatcgccaacttcctgacctggaagccctga

SEQ ID NO: 30608 - protein, 211 aa, Rhodobacter sphaeroides
MLTVLVDYDSGNLHSAEKAFQRMATETGAGQVLVSDRPEDVARADRIVLPGDGAFPACRRALGSYGGLSEAIEEAVTRRARPFLGICIGMQMMATRGLEHEETPGFGWIAAEVVRIAPSDPHLKVPHMGWERLTVDHPHPVLTGIETGDHAYFVHSYHFQVAHDAERLAHADYGADITAIVGRDTMVGTQFHPEKSQKTAALIANFLTWKP

SEQ ID NO: 30609 - DNA, 666 bp, Shewanella oneidensis
  CDS (1)..(666)
atgtcagcaaacacagatgaatttgatgtggtcatcatagacacaggttgcgccaacttaagctcggtacgtttcgcctttgagcgcctaggcgcgaacgtcttagtgaccgacgacaaggccagcattaaagccgccaaacgtgtggtattgccgggtgtcggtagcgctggcgccgccatggcctcattaaccgaaaaagccttagtcgaattaatccaagggttaacccaacccgtgctgggcgtgtgtttagggatgcaaatgctcaccctgctctctaaagaacgcggcggtcaagccttagactgccaagctcatgattgcaagtgcttaggcattattccaaccgagattgacgagctaaacagtcaaacccttaaggccgaaggtttacctctgccgcacatgggctggaaccaactgacctttagtaatccctctcaggttcacccgctgttcgccggcgtggaagccggcagttacgtgtattttgtgcacagctaccgcgcgccattaagcgactacaccctcgcccaatgccgttatggtgaggactttagcgccgccatcggtaaagacaactttatgggcgtgcaattccaccctgaaaaaagtgccgccgtgggcgcgcaaatcctaggtaactttttaaaaatgcaataa

SEQ ID NO: 30610 - protein, 221 aa, Shewanella oneidensis
MSANTDEFDVVIIDTGCANLSSVRFAFERLGANVLVTDDKASIKAAKRVVLPGVGSAGAAMASLTEKALVELIQGLTQPVLGVCLGMQMLTLLSKERGGQALDCQAHDCKCLGIIPTEIDELNSQTLKAEGLPLPHMGWNQLTFSNPSQVHPLFAGVEAGSYVYFVHSYRAPLSDYTLAQCRYGEDFSAAIGKDNFMGVQFHPEKSAAVGAQILGNFLKMQ

SEQ ID NO: 30611 - DNA, 648 bp, Streptomyces avermitilis
  CDS (1)..(648)
gtggaattgagtaccgcgaagaaagtcgtggtgttcgactacggcttcggcaatgtgcgctccgccgagcgcgcgctcgcccgtgccggcgccgaggtcgagataacgcgtgacttcgacacggccatgaacgccgacggactgctggtgcccggtgtcggcgccttcgccgcctgcatgaaggggctgaaggaggcgcgcggcgactggatcgtcggccgccggctggccggcggccgccccgtgatgggcatctgcgtcggcatgcagatcctcttcgagcgcggcatcgagcacggtgtggagaccgagggcctcgacgagtggcccggcacggtcgggccgctcgaggccgagatcgtgccgcacatgggctggaacacggtcgaggcgcccgggggatcgcagctcttcgcggggctcgacgccgacgcgcgcttctacttcgtccactcgtacgccgtccacgactggtccctggacgtcgcgaacccggcgatgcgcgcacccctggtgacctggtcgacgcacggcaagccgttcgtggcggccgtcgagaacggcgccctgtgggccacgcagttccaccccgagaagtccggcgacgccggagcgcagctgctgaacaactggatcggaaccctctga

SEQ ID NO: 30612 - protein, 215 aa, Streptomyces avermitilis
MELSTAKKVVVFDYGFGNVRSAERALARAGAEVEITRDFDTAMNADGLLVPGVGAFAACMKGLKEARGDWIVGRRLAGGRPVMGICVGMQILFERGIEHGVETEGLDEWPGTVGPLEAEIVPHMGWNTVEAPGGSQLFAGLDADARFYFVHSYAVHDWSLDVANPAMRAPLVTWSTHGKPFVAAVENGALWATQFHPEKSGDAGAQLLNNWIGTL

SEQ ID NO: 30613 - DNA, 600 bp, Sulfolobus solfataricus
  CDS (1)..(600)
atgaaggcattagtaattaattatggtgtaggtaatttatatagtatctcatctgctctaaaaagagtaggatttgaagtaacaatagataataaaccaaggaatgattacgatctaattgtatttcctggtgtcggagcattttcagctgtagccgaatttatcttacgatatagggaacttttcaatgatctaagaaggagtgggactaattttttaggagtttgtctaggcatgcagataatgtttgaaaagggaaccgagggaaaagagagtaatggcttaggatggtttaagggtatagtggataagataaatgctaatgtgaaacttcctcacataggctgggatttagtatttgaagtgaaagattcttgtgaattaacttacggattagacaagaaatatgtttactatgtacatagctatgtagcttatcctactagtggagattatgtttacatgaaaagtcagtatgggatagaatatcctgcattggtatgtgataagaacgttgtaggaactcagtttcacccggagaaaagttcaaatactggtaaaatatttctcgagaatcttaaggggtggattaaacgttaa

SEQ ID NO: 30614 - protein, 199 aa, Sulfolobus solfataricus
MKALVINYGVGNLYSISSALKRVGFEVTIDNKPRNDYDLIVFPGVGAFSAVAEFILRYRELFNDLRRSGTNFLGVCLGMQIMFEKGTEGKESNGLGWFKGIVDKINANVKLPHIGWDLVFEVKDSCELTYGLDKKYVYYVHSYVAYPTSGDYVYMKSQYGIEYPALVCDKNVVGTQFHPEKSSNTGKIFLENLKGWIKR

SEQ ID NO: 30615 - DNA, 630 bp, Synechococcus elongatus
  CDS (1)..(630)
gtgagcgcaccagcgatcgccatcattgactatgatatgggaaatctgcactccgtcagcaaagcccttgaggtcgtcggcgcgaggcccctcattagcgatcgccccgcggagattttcgcagcggatgccgtggtacttcccggcgttggggcctttgatcccgccatggctcggcttcaagagcgagaattggtacccgtcattgagcagatcattgagcaggggatgccctttttggggatttgccttggtctccaagtgctctttgaatgtagtgaagaaggaacagaacctggtcttggcatttttgcaggtaaagtcaaacgctttcagtctgaacctggccttacaattccccacatgggctggaaccaactgaccttgaggccatctgcctctcccctttggcaacatctacccccgagcccttgggtttattttgtccactcctactttgttgcccctgaggatccgtcattagtggccgcaacggtgtgccatggtcagcaaacggtcacggcagcgatcgcccgcaacaacctatttgcttgtcaatttcaccccgaaaagtccggcgctgtgggtctgcaattgctgcgcaactttgttgccttggttaaagattga

SEQ ID NO: 30616 - protein, 209 aa, Synechococcus elongatus
MSAPAIAIIDYDMGNLHSVSKALEVVGARPLISDRPAEIFAADAVVLPGVGAFDPAMARLQERELVPVIEQIIEQGMPFLGICLGLQVLFECSEEGTEPGLGIFAGKVKRFQSEPGLTIPHMGWNQLTLRPSASPLWQHLPPSPWVYFVHSYFVAPEDPSLVAATVCHGQQTVTAAIARNNLFACQFHPEKSGAVGLQLLRNFVALVKD

SEQ ID NO: 30617 - DNA, 633 bp, Synechocystis sp
  CDS (1)..(633)
atgggttacatcgccgtcgttgattatgatatgggcaatctccactccgtctgtaagggtttggagaaagtgggaggcaatcccctggtaacggaccaggcccacgttatcgacggtgctacggctattgtcctgccgggggtaggttcctttgatccagcggtgcagcatttgcgggccaggggtttggaagaggtgctcaaaacggcgatcgccaagggaattccttttttgggcatttgtttaggttcccaactgctatttgacagttctgaagaaggccaggaaacggggctgggcattattcccggacaagtgaaacatttccgttccgagccgggactgaccattccccacatgggctggaatggattgcagtttaaccaaccggatttatgtctctggcaagatttacccccggaaccccaagtttacttcgtccactcctactacatggctccccttgatccccaggtaattgccgctagtaccacccacggcagtcaaaccatcgcagcggcgatcgccaaggataatgtgatggcggtgcaattccacccggaaaaatcctccaccctggggctaaaaattttggctaactttgtcaaaaaagttgctttgagcgatatttaa

SEQ ID NO: 30618 - protein, 210 aa, Synechocystis sp
MGYIAVVDYDMGNLHSVCKGLEKVGGNPLVTDQAHVIDGATAIVLPGVGSFDPAVQHLRARGLEEVLKTAIAKGIPFLGICLGSQLLFDSSEEGQETGLGIIPGQVKHFRSEPGLTIPHMGWNGLQFNQPDLCLWQDLPPEPQVYFVHSYYMAPLDPQVIAASTTHGSQTIAAAIAKDNVMAVQFHPEKSSTLGLKILANFVKKVALSDI

SEQ ID NO: 30619 - DNA, 606 bp, Thermotoga maritima
  CDS (1)..(606)
ttgaggatcggaataatctctgttggtccggggaacataatgaatctgtatcgcggagtgaaaagggcatccgagaattttgaggatgtttcgatagagctcgtggaatcacctcgaaacgacctgtacgatcttctgttcatcccgggtgtgggacacttcggcgaagggatgagacgtctcagggagaatgatctcatcgatttcgtaagaaaacacgtcgaagacgagaggtacgtggtcggagtttgtcttggaatgcagcttctttttgaagagagcgaagaggcacccggcgtgaaaggtctttctctcatagaaggaaacgtcgtgaaactgaggagcagaagacttccccacatgggctggaacgaggtgatcttcaaagacacgtttccgaacgggtattactacttcgtccacacctacagagctgtgtgcgaggaggaacacgttctgggaacaactgaatacgacggtgagatctttccatccgcggtgaggaaggggagaattctggggtttcagttccatcccgaaaagagttcaaaaatcggaagaaaactgcttgagaaggtgatcgaatgctcgttgtcccggcgatag

SEQ ID NO: 30620 - protein, 201 aa, Thermotoga maritima
MRIGIISVGPGNIMNLYRGVKRASENFEDVSIELVESPRNDLYDLLFIPGVGHFGEGMRRLRENDLIDFVRKHVEDERYVVGVCLGMQLLFEESEEAPGVKGLSLIEGNVVKLRSRRLPHMGWNEVIFKDTFPNGYYYFVHTYRAVCEEEHVLGTTEYDGEIFPSAVRKGRILGFQFHPEKSSKIGRKLLEKVIECSLSRR

SEQ ID NO: 30621 - DNA, 603 bp, Thermus thermophilus
  CDS (1)..(603)
atgaggatgaaggcgctgctcattgactacggctcaggcaacctgagaagcgccgccaaggccctggaggccgcgggcttctccgtggcggtggcccaggaccccaaggcccacgaggaggccgacctccttgtcctccccgggcagggccacttcggccaggtgatgcgggccttccaggagagcggcttcgtggagcgggtccgccgccacctggaaaggggcctacccttcctcggaatctgcgtggggatgcaggtcctctacgagggcagcgaggaggccccgggggtgagggggcttggcctcgttcccggggaggtgcggcgcttcagggcgggccgggtcccccagatgggctggaacgccctggagttcggcggggccttcgcccccctcacggggcgccacttttacttcgccaactcctactacggccccctcaccccctactccctggggaagggggagtacgagggcacccccttcactgccctcctcgccaaggaaaacctcctcgcgccccagttccaccccgagaagagcgggaaggcgggtctggccttcctcgccctagcccgccgctactttgaggtcctctag

SEQ ID NO: 30622 - protein, 200 aa, Thermus thermophilus
MRMKALLIDYGSGNLRSAAKALEAAGFSVAVAQDPKAHEEADLLVLPGQGHFGQVMRAFQESGFVERVRRHLERGLPFLGICVGMQVLYEGSEEAPGVRGLGLVPGEVRRFRAGRVPQMGWNALEFGGAFAPLTGRHFYFANSYYGPLTPYSLGKGEYEGTPFTALLAKENLLAPQFHPEKSGKAGLAFLALARRYFEVL

SEQ ID NO: 30623 - DNA, 612 bp, Thermoanaerobacter tengcongensis
  CDS (1)..(612)
ttgataggcattatagattatggaatgggaaatttgagaagcgttgaaaaagctttaaaatacgtgggatacgatgcgaagattacaagtgatgcaaaagaaataaaaaattttgaggccttgatacttcccggagttggagcctttccagatgccatcagggttttaatcaaaacaggtatggctgaagagataaaaatacacattgaaaagggaaagccttttttgggaatatgcttgggaatgcagcttttatttgagaaaagttttgagggaggcaagacagaggggcttaaaatatttaaaggcaatgttgtaggacttcctaaaggaaataaaatcccccatgtagggtggaacagtttgaccataaaaaaagacacaccatttcttaaaggaataaaaaatggagattatgtgtattttgtccattcttattatgtaaatggcaatgaaaaagattttgaatacgcagttactgaatatgggatagaaattccagctgtcattattaaagacaatgttttttcctgtcagtttcatccagaaaaaagcggagagacagggcttaaaattttaaaaaattttggagagatgataaaatgcttgtaa

SEQ ID NO: 30624 - protein, 203 aa, Thermoanaerobacter tengcongensis
MIGIIDYGMGNLRSVEKALKYVGYDAKITSDAKEIKNFEALILPGVGAFPDAIRVLIKTGMAEEIKIHIEKGKPFLGICLGMQLLFEKSFEGGKTEGLKIFKGNVVGLPKGNKIPHVGWNSLTIKKDTPFLKGIKNGDYVYFVHSYYVNGNEKDFEYAVTEYGIEIPAVIIKDNVFSCQFHPEKSGETGLKILKNFGEMIKCL

SEQ ID NO: 30625 - DNA, 615 bp, Vibrio parahaemolyticus
  CDS (1)..(615)
gtgacagaacaaaaagttgtcattatcgatacgggctgtgccaacgtttcttcggtgaagtttgccattgaacgcttaggctatgacgtaacgatttcaaaagatcctcaagtggtgttgtcagcagacaagttgttcctacctggtgtgggtacagccagcgaagcgatgaaaaaccttgaagagcgtgatcttatcaatctcgttaagcaagttgaaaagccattgcttggtatctgtttaggtatgcagttattgggtaagttttcccaagaaaaagggcagaaagcagatgagttagttgagtgtcttgggctttgtgatggcgaagtgaagctgctacaaactggcgatttgccactgccacacatggggtggaataccgtttctgcaaaagcaggcaatccgttgttcaaagacattgaagagggtgagtacttctattttgtgcacagctttgcgatgcctgttggagactacaccattgccgaatgtgattacggaaatccattcactgctgcggttcaaagtggtaactattatggtgtgcaattccacccagagcgttcttcaaaggcgggcgcgaagcttattcaaaacttcttagaattataa

SEQ ID NO: 30626 - protein, 204 aa, Vibrio parahaemolyticus
MTEQKVVIIDTGCANVSSVKFAIERLGYDVTISKDPQVVLSADKLFLPGVGTASEAMKNLEERDLINLVKQVEKPLLGICLGMQLLGKFSQEKGQKADELVECLGLCDGEVKLLQTGDLPLPHMGWNTVSAKAGNPLFKDIEEGEYFYFVHSFAMPVGDYTIAECDYGNPFTAAVQSGNYYGVQFHPERSSKAGAKLIQNFLEL

SEQ ID NO: 30627 - DNA, 618 bp, Wolinella succinogenes
  CDS (1)..(618)
atggtcggaattgtcaattacaacattgggaatcttgccagtgttttaaacgctcttgtgaaagtgggagccaaggcgcagatcgaaaaagaaccttcgcgcctcttggagtatgatcggctgattttgccgggtgtgggggcatttggcgatgcgatggagcatcttgttcaaagcggtatgaaagaggcagtgctggagtttgccaagagcggtaaacccctccttggaatctgccttggaatgcaactcctttttgagaagagctatgagtttggcgagcacgcgggactagggcttttagagggagagattatcccttttgataaaacgcgtatgggagaggggtataaaatccctcaaatgggatggaatcgcttctatgctaaaaagaaaagtccgcttttaaagggcttggaggaggggttttatctctactatgtgcatagttttcatgcggtggccaagagggaggaggatgtgctgggagagagcgtttatggctatccttttgtgagcgccatagagcgcgataatgtggcaggcttccagcctcaccccgaaaagagccatgatgtggggcttaggatattgaagaatttttgtgaaattgggtaa

SEQ ID NO: 30628 - protein, 205 aa, Wolinella succinogenes
MVGIVNYNIGNLASVLNALVKVGAKAQIEKEPSRLLEYDRLILPGVGAFGDAMEHLVQSGMKEAVLEFAKSGKPLLGICLGMQLLFEKSYEFGEHAGLGLLEGEIIPFDKTRMGEGYKIPQMGWNRFYAKKKSPLLKGLEEGFYLYYVHSFHAVAKREEDVLGESVYGYPFVSAIERDNVAGFQPHPEKSHDVGLRILKNFCEIG

SEQ ID NO: 30629 - DNA, 603 bp, Xanthomonas campestris
  CDS (1)..(603)
atgaccgatctcgcgctcatcgacgccggcggtgccaatctgggctcggtgcgctatgcgctcgagcgcctgggcgtggaagcgcgcgtggtgcgtgatgcgcagggcctgcagggcgccgagcgcgtcatcctgccgggcgtgggcgcagcgccggaggccatggcgcgcctgcgtgcgcagggcctgattgaaccgctgcagcaattgcaggtgccgctgatcggtatttgcctgggcatgcagctgttgttcgagcattccgaagaaggcgatgtggactgcctgggaatgctgccgggcatcgtgcggcacatgacgccggcgcttggcattcgcgtaccgcacatgggctggaaccagctggtgccgatgcgtgactccgcgctgcttgctggattgccggagcgtgccagcgcctatttcgtgcatggctatgccgcgccagtcaccgccgacaccgtggccgcctgcgaccacggcgggctgttcaccgcggtggtgcagagcggcttgcggtgcggcgcgcaattccaccccgagcgttccgccgacaccggcgcgcgcatcctgcgcaattttcttgagatgagcttcccatga

SEQ ID NO: 30630 - protein, 200 aa, Xanthomonas campestris
MTDLALIDAGGANLGSVRYALERLGVEARVVRDAQGLQGAERVILPGVGAAPEAMARLRAQGLIEPLQQLQVPLIGICLGMQLLFEHSEEGDVDCLGMLPGIVRHMTPALGIRVPHMGWNQLVPMRDSALLAGLPERASAYFVHGYAAPVTADTVAACDHGGLFTAVVQSGLRCGAQFHPERSADTGARILRNFLEMSFP

SEQ ID NO: 30631 - DNA, 603 bp, Xylella fastidiosa
  CDS (1)..(603)
atgaccgaggttgctttgattgatgccggtggtgccaatcttggttcggtgcgctacgccttgcagcgtttgggggtagaaccgcgcttagtgtgcgatgcccgcggactggagggggctgcgcgggtgattctccccggggtcgggagcgcacctgaagcgatggcacggctcaacaatcaaggcttgattgagccattgctccggctacaggtgccgctgattgggatctgcctgggcatgcaattgttgtttgagcactctgaggaaggcgatgtgccctgcttgggattgctgcctggccgcgtccgccgcctgacgccggctcctagcatccgtgtgccgcacatgggctggaatcgcttgttgccgctgcgcgcttcgccattgctggcggaggtgcccgagggggcgaacgcttattttgtgcatagctatgcagtgcccttgaccacggcagcggtggccgcctgcgatcacggcggcatgtttaccgcgattgtgcagcagggagtgcgttgtggcgcgcaattccatccagagcgttcggccgaaacaggcgcacgtatcctgcgtaattttcttgaaatggatgccgcatga

SEQ ID NO: 30632 - protein, 200 aa, Xylella fastidiosa
MTEVALIDAGGANLGSVRYALQRLGVEPRLVCDARGLEGAARVILPGVGSAPEAMARLNNQGLIEPLLRLQVPLIGICLGMQLLFEHSEEGDVPCLGLLPGRVRRLTPAPSIRVPHMGWNRLLPLRASPLLAEVPEGANAYFVHSYAVPLTTAAVAACDHGGMFTAIVQQGVRCGAQFHPERSAETGARILRNFLEMDAA

SEQ ID NO: 30633 - DNA, 1659 bp, Saccharomyces cerevisiae
  CDS (1)..(1659)
atgccggtcgttcacgtgattgacgttgaaagtggtaacctacagtcactaaccaatgcaattgagcatttaggttacgaagtacaactggtgaaatcaccaaaggattttaacatatcaggcacgtcaagattgattttgcctggtgtcggaaattatggccatttcgtcgacaatttatttaatagaggattcgaaaagccgataagagaatacattgaatctggaaaaccaataatgggaatttgcgtcgggctacaagcgctctttgccggttccgtggaaagccctaagagtacgggtctgaactacattgattttaagttgtccaggttcgatgattcagaaaagccagtaccagaaataggttggaattcttgcattccctcggaaaacctattctttggattggatccatacaagaggtactatttcgtccattcttttgctgccattctgaattcagaaaagaaaaaaaacctagaaaatgacggttggaaaattgcaaaagctaagtacggttcagaggaatttattgcggcagtcaacaagaataatatattcgctactcagttccatcctgaaaaatcaggtaaagctggtttgaacgtcattgagaattttttgaagcaacaaagtcctccgattccaaactatagtgcggaagagaaggaactcttaatgaatgactattcaaattatggtctaacacgcagaattattgcttgtcttgatgtacgtactaatgaccaaggtgatttggtggttactaaaggtgatcaatacgatgtacgtgaaaaaagtgatggtaaaggtgttagaaaccttggtaagcctgttcagttggcacagaaatattaccaacagggtgcggatgaagtaacatttttgaatataacttcttttagagattgtcctttgaaggatactccgatgctagaggttctgaaacaagccgcaaagacagtctttgttccattgacagtcggtggggggatcaaggatattgtcgatgttgatggaaccaaaatacctgctttagaagttgcaagtctatacttcagatctggtgctgataaagtatcgatcggtacggatgcagtctatgcagccgaaaaatactacgagttgggtaacagaggagatggaacgtcaccaatagagacaatctcgaaagcatacggtgctcaggcagttgttatttctgtcgaccctaagagagtatatgtaaattcacaagcagatacgaagaacaaagtcttcgagacagaatatccgggccccaatggagagaaatactgctggtaccaatgtacaatcaaaggtggaagagaatctagagaccttggtgtgtgggaattaacaagggcatgtgaagctctaggtgctggggagattttattgaactgcatagacaaggatggctctaattctggttatgatctggaattgatagaacatgttaaagatgcggtcaagattcccgtcattgcatccagtggcgccggtgtacccgaacatttcgaagaggccttcctaaagacccgcgcagatgcttgcttgggtgcaggtatgttccacagaggtgaattcactgttaacgatgtaaaggagtatttactagagcacggattaaaggttagaatggatgaagagtaa

SEQ ID NO: 30634 - protein, 552 aa, Saccharomyces cerevisiae
MPVVHVIDVESGNLQSLTNAIEHLGYEVQLVKSPKDFNISGTSRLILPGVGNYGHFVDNLFNRGFEKPIREYIESGKPIMGICVGLQALFAGSVESPKSTGLNYIDFKLSRFDDSEKPVPEIGWNSCIPSENLFFGLDPYKRYYFVHSFAAILNSEKKKNLENDGWKIAKAKYGSEEFIAAVNKNNIFATQFHPEKSGKAGLNVIENFLKQQSPPIPNYSAEEKELLMNDYSNYGLTRRIIACLDVRTNDQGDLVVTKGDQYDVREKSDGKGVRNLGKPVQLAQKYYQQGADEVTFLNITSFRDCPLKDTPMLEVLKQAAKTVFVPLTVGGGIKDIVDVDGTKIPALEVASLYFRSGADKVSIGTDAVYAAEKYYELGNRGDGTSPIETISKAYGAQAVVISVDPKRVYVNSQADTKNKVFETEYPGPNGEKYCWYQCTIKGGRESRDLGVWELTRACEALGAGEILLNCIDKDGSNSGYDLELIEHVKDAVKIPVIASSGAGVPEHFEEAFLKTRADACLGAGMFHRGEFTVNDVKEYLLEHGLKVRMDEE

SEQ ID NO: 30635 - DNA, 591 bp, Yersinia pestis
  CDS (1)..(591)
atggatgtggtgatcctggataccggttgtgccaatctctcctctgtcacctatgcggtacagcgtttgggttatacaccggttatcagccgcgacccggcagtcgtcttgcgagcagacaaactgtttatgccgggtgtgggcaccgcccatgccgccatggaacaattgaggcaacgcgagcttatcgaactgatcaaaagttgtactcaacccgtgctggggatctgccttggtatgcagttgctggcaaccagcagtgaggaaagtggcgggatcaccaccctcgggatgattgatgcaccagtaaaaaagatgactgattttggtctgccgctgccgcatatggggtggaatcagattaccgcacaagccggtaaccatctgttccgtggtatccctgacggaacctatttctacttcgtgcatggatatgcaatgccaatatgcccaaataccatcgcccaaaccaactacggcgagccatttaccgccgcagtagaaaaagacaacttctttggcgtgcagtttcatccggaacgttccggagcggctggggcccaattgatgaaaaactttctggagatgtaa

SEQ ID NO: 30636 - protein, 196 aa, Yersinia pestis
MDVVILDTGCANLSSVTYAVQRLGYTPVISRDPAVVLRADKLFMPGVGTAHAAMEQLRQRELIELIKSCTQPVLGICLGMQLLATSSEESGGITTLGMIDAPVKKMTDFGLPLPHMGWNQITAQAGNHLFRGIPDGTYFYFVHGYAMPICPNTIAQTNYGEPFTAAVEKDNFFGVQFHPERSGAAGAQLMKNFLEM

SEQ ID NO: 30637 - DNA, 24 bp, Primer
atgaacgtggtgatccttgatacc

SEQ ID NO: 30638 - DNA, 26 bp, Primer
ttacatctccaggaagtttttcagca

SEQ ID NO: 30639 - protein, 98 aa, consensus
  MISC_FEATURE (1)..(98): consensus for the disclosure of xaa see table XV
XXXXXXXXXNXXXXXXXXXXXXXXXXXXXXXXXXXXXXXXXXXXXXXXPGXGXXXXXXXXXXXXXXXXXXXXXXXXXXXXXXXXXCXGXXXXXXXXXE

SEQ ID NO: 30640 - protein, 94 aa, consensus
  MISC_FEATURE (1)..(94): consensus for the disclosure of xaa see table XV
XXXXXXXXXXXXXXXXXXXXXXXXXXXXXXXXXXXXXXXPXXGWXXXXXXXXXXXXXXXXXXXXXXXXXXXXXXXXXXXXXXXXXXXXYXXXXX

SEQ ID NO: 30641 - protein, 20 aa, consensus
  MISC_FEATURE (1)..(20): consensus for the disclosure of xaa see table XV
XXQFHXEXSXXXGXXXXXXX

SEQ ID NO: 30642 - DNA, 342 bp, Escherichia coli
  CDS (1)..(342)
atgacaatgaacattaccagcaaacaaatggaaattactccggccatccgccaacatgtcgcagaccgtctcgccaaactggaaaaatggcaaacacatctgattaatccacatatcattctgtccaaagagccacaagggtttgttgctgacgccacaatcaatacacctaacggcgttctggttgccagtggtaaacatgaagatatgtacaccgcaattaacgaattgatcaacaagctggaacggcagctcaataaactgcagcacaaaggcgaagcacgtcgtgccgcaacatcggtgaaagacgccaacttcgtcgaagaagttgaagaagagtag

SEQ ID NO: 30643 - protein, 113 aa, Escherichia coli
MTMNITSKQMEITPAIRQHVADRLAKLEKWQTHLINPHIILSKEPQGFVADATINTPNGVLVASGKHEDMYTAINELINKLERQLNKLQHKGEARRAATSVKDANFVEEVEEE

SEQ ID NO: 30644 - DNA, 288 bp, Idiomarina loihiensis L2TR
  CDS (1)..(288)
atgcaaattaatttgaccggtcatcacatcgatattaccgaagctctgcgtgactacgtggacacaaaatttgccaagctggaaagacattttgaccatataactaatgttcacgtcatcctaaatgttgaaaaaacgattcaaaaagcggaagctacgctgcacgtgaatggcggtgagcttttcgccgacgcaaaacacgaagatatgtacgcggccatcgacggtttaattaataaactggaccgtcaggtgattaaacacaaagagaaaatgaaacaacattaa

SEQ ID NO: 30645 - protein, 95 aa, Idiomarina loihiensis L2TR
MQINLTGHHIDITEALRDYVDTKFAKLERHFDHITNVHVILNVEKTIQKAEATLHVNGGELFADAKHEDMYAAIDGLINKLDRQVIKHKEKMKQH

SEQ ID NO: 30646 - DNA, 564 bp, Silicibacter pomeroyi DSS-3
  CDS (1)..(564)
atgcgttatcaaatcagcggaaaacagatcgacatcggtgctgccctgcaaagtcatgttcagaccgagctgggcgaggtggtgtcgaaatatgcgcagcgtccgaccgacgctcatgtcgtgttttcccgttcggcgcatgaatatgtatgcgaagccaccgtgcatctgtcgaccggtctgaccgcccaggccaaggcgcatgcgaccgagatctatgccgccttcgatgggtgctgcgagaagatggacaagcagttgcggcgctacaagcggcggctgaaggaccaccacaaggaccgggccgagccggttgaactcttcggagcctcgtcttatatcctcgcttctgaagaaccggacgcgcaaagcgagcccgactcgctgcaaccgatgatcgtcgccgagatggagaccaagattccatcgctgtcagtgggtgaagccgtgatgcagatggaactggctggcgccccggtgctggtatttcggaatgaaagcaaggacggattgaacgtcgtgtatcgccgcgaagacggcaatatcggctggatcgatccgtaa

SEQ ID NO: 30647 - protein, 187 aa, Silicibacter pomeroyi DSS-3
MRYQISGKQIDIGAALQSHVQTELGEVVSKYAQRPTDAHVVFSRSAHEYVCEATVHLSTGLTAQAKAHATEIYAAFDGCCEKMDKQLRRYKRRLKDHHKDRAEPVELFGASSYILASEEPDAQSEPDSLQPMIVAEMETKIPSLSVGEAVMQMELAGAPVLVFRNESKDGLNVVYRREDGNIGWIDP

SEQ ID NO: 30648 - DNA, 297 bp, Francisella tularensis subsp. tularensis
  CDS (1)..(297)
atgaatattcaaattactggtagacatgtggaagttactgattcaattaaaaactatgttaatgaaaaagtaggtaaggttgagcactattttgataatatcacttcgactaaagttatattagatgttgagaaagatcatcaagtagcagaggctatagttacagttcctggtagtgaatttgttgcaaaggctgaagacaaagatttatatgcagctatagatatgcttgaagataagttagcacgtcagttaaaaaagcacaaagataaaatgagatgtaatcacggcgaatag

SEQ ID NO: 30649 - protein, 98 aa, Francisella tularensis subsp. tularensis
MNIQITGRHVEVTDSIKNYVNEKVGKVEHYFDNITSTKVILDVEKDHQVAEAIVTVPGSEFVAKAEDKDLYAAIDMLEDKLARQLKKHKDKMRCNHGE

SEQ ID NO: 30650 - DNA, 537 bp, Thermotoga maritima MSB8
  CDS (1)..(537)
atggagtacaggataacgggaaagggtgtagaaatttccgaagccatcaaaaattatctggaaaaaaggctcgataaaattgacagggtgatttacgatgatgacctcgtttccttcaacgttagaatagaaaaagatggtaagaatcaatatgtggttaagttcaatatgaatctgaaagggaacatcatcaatgtagaagaaagacacccggatatttacaccgcgatagattttgcctcggatgctctagaaaaacaggtgaaaagattgaaagagaggctgaagaaccaccctcatagaagttctgcactcgttgaaactcctcttgaagagccaggtgaattttccccatctgacaaggtctcttctgtaaaaagagtttctcttctcaacctcgatctcgatgaagcagttatgcagatggatgagttgaaccatcgattcctcgttttcagaaacgtcaatactggcgaaataaatctcctctacagggacgaaaacggagacattcatctcatcgagatggcagagtaa

SEQ ID NO: 30651 - protein, 178 aa, Thermotoga maritima MSB8
MEYRITGKGVEISEAIKNYLEKRLDKIDRVIYDDDLVSFNVRIEKDGKNQYVVKFNMNLKGNIINVEERHPDIYTAIDFASDALEKQVKRLKERLKNHPHRSSALVETPLEEPGEFSPSDKVSSVKRVSLLNLDLDEAVMQMDELNHRFLVFRNVNTGEINLLYRDENGDIHLIEMAE

SEQ ID NO: 30652 - DNA, 327 bp, Vibrio cholerae O1 biovar eltor str. N16961
  CDS (1)..(327)
atgaaaatcaacatcactggtaaaaacatcgaagtcacctctgcaatccgcaatcatatcgagggtaaactcaaaaaattagaaaaatggcaagtcgacattattggctgccaagccagcttcagcgaagagcccaacaaacagaaaaaatttgaagcagtcgttagcattccacgcggtcagttagtggcttctgcaattcacgaagatttgtatgccgccattaacgaggtagagcaaaaactcgaacgacaattgaataaactacgccacaaaccagaagctcgccgagcggataaaacggaactgagcgaagaagtggaataa

SEQ ID NO: 30653 - protein, 108 aa, Vibrio cholerae O1 biovar eltor str. N16961
MKINITGKNIEVTSAIRNHIEGKLKKLEKWQVDIIGCQASFSEEPNKQKKFEAVVSIPRGQLVASAIHEDLYAAINEVEQKLERQLNKLRHKPEARRADKTELSEEVE

SEQ ID NO: 30654 - DNA, 564 bp, Bacillus halodurans C-125
  CDS (1)..(564)
atgatcttcaatgtacgtggtgaaaacttggaagtaactccggctttaagagaatatgtcgaaaaaaaggtggggaagcttgagcgatattttgacacgactccagttgcggatgtgaatgttagaatgcaagtactgaataatctacacatcattgaagtaacgattccaatgtctaggttgctgctaagggcggaagaaaagcatagtgacatgtatgcagcgattgaccttgtgattgaaaaacttgaaagacaaattcgcaaacataaaacaaaggtgaatcgaaaatttcgccaagaaggcagtttaaaatatatgtttaaaaatgatttagagccaatggacggcatgcgcgaagagatattgcttgaggaggaagatgatcttcaagtcgtacgtaagaaacgatttaatttgaagccgatggatacagaagaagcgattttgcaaatggacatgttaggtcataacttctttgtcttttcaaacgcaattagtggtgatacgaatgtagtttatcgccgcaaagatggaaaatacgggctaattgaacctgaataa

SEQ ID NO: 30655 - protein, 187 aa, Bacillus halodurans C-125
MIFNVRGENLEVTPALREYVEKKVGKLERYFDTTPVADVNVRMQVLNNLHIIEVTIPMSRLLLRAEEKHSDMYAAIDLVIEKLERQIRKHKTKVNRKFRQEGSLKYMFKNDLEPMDGMREEILLEEEDDLQVVRKKRFNLKPMDTEEAILQMDMLGHNFFVFSNAISGDTNVVYRRKDGKYGLIEPE

SEQ ID NO: 30656 - DNA, 318 bp, Pasteurella multocida subsp. multocida str. Pm70
  CDS (1)..(318)
atgactctaaacatcacaagcaaacaaatggaaatcactcctgcaatccgtgctcacgtcgaagatagacttgctaaattaggtaaatggcaaactcaattaattaatccccactttattttaaacaaaataccaaaaggtttttcggttgaggcatcgattggtaccccgcttggcgatttgtttgcaaaagcagagtcagaagatatgtataaagccgtcaacgaagtagaagaaaaattagagcgtcagttaaataaattacaacataaaggcgaagcgcgtcgtgccgatgaacgcttaaaagattctttctaa

SEQ ID NO: 30657 - protein, 105 aa, Pasteurella multocida subsp. multocida str. Pm70
MTLNITSKQMEITPAIRAHVEDRLAKLGKWQTQLINPHFILNKIPKGFSVEASIGTPLGDLFAKAESEDMYKAVNEVEEKLERQLNKLQHKGEARRADERLKDSF

SEQ ID NO: 30658 - DNA, 558 bp, Lactococcus lactis subsp. lactis Il1403
  CDS (1)..(558)
atgatcaaatttaatatccgtggcgaaaacgtcgaagtgactgatgcaatccgcgcttatgttgaagataaaatcggaaaacttgataaatatttcaacgatggtcatgaagtaacagcctatgttaatcttaaagtttacagcgaaaaacgagctaaagttgaagtaactcttccagctaaaaatgtcactttacgtgcagaagatacttcacaagatatgtattcttcaattgattttgtagaagaaaaactcgaacgtcaaattcgtaaatataagacacgtatgaaccgtaaaccacgcaatgctgtcccaacaggacaagcttttggcgatgagtttgcaccattagaaaaagccgatgaagttgctgaggatcacgtagatattgtacgtactaagcatgttgctttaaaaccaatggatgccgaagaagcagtgcttcagatggatatgttgggacatgatttctacgtctttacagatgctgatagtaacggaacccacgtcgtttaccgtcgtacagatggtcgttatggtttaattgaaacagaataa

SEQ ID NO: 30659 - protein, 185 aa, Lactococcus lactis subsp. lactis Il1403
MIKFNIRGENVEVTDAIRAYVEDKIGKLDKYFNDGHEVTAYVNLKVYSEKRAKVEVTLPAKNVTLRAEDTSQDMYSSIDFVEEKLERQIRKYKTRMNRKPRNAVPTGQAFGDEFAPLEKADEVAEDHVDIVRTKHVALKPMDAEEAVLQMDMLGHDFYVFTDADSNGTHVVYRRTDGRYGLIETE

SEQ ID NO: 30660 - DNA, 525 bp, Clostridium acetobutylicum ATCC 824
  CDS (1)..(525)
atgaaattaatagttagtggaaaaaatttagaagtcacagaaggccttagagaggctgttgaaaagcaaatatccaaacttgagaagtactttaaacctgaagtagaagcacatgtcactctaagtgtcgagaaaaatagacagatagtagaagttacaataccttttaatggagttattttaagaggagaagaaacaaataatgacatgtatgcttcaatagatattgttggagataagttggaaagacaagtcagaaaacaaaaaacaaaattagaaagaagaaaatattcggattcgcttaagttccaaaatattcctgattatcacaaggaagaacaagaaccagaaatagtaaaaactaaaagatttgctataaagccaatgtctgaagaagaagcagtacttgagatggaattattaggacacaacttttttgtatttcaaaatggagattcaaatgaggtaaatgttgtatataaacgaaaagatggcaattatggattgattgaacctgagttttag

SEQ ID NO: 30661 - protein, 174 aa, Clostridium acetobutylicum ATCC 824
MKLIVSGKNLEVTEGLREAVEKQISKLEKYFKPEVEAHVTLSVEKNRQIVEVTIPFNGVILRGEETNNDMYASIDIVGDKLERQVRKQKTKLERRKYSDSLKFQNIPDYHKEEQEPEIVKTKRFAIKPMSEEEAVLEMELLGHNFFVFQNGDSNEVNVVYKRKDGNYGLIEPEF

SEQ ID NO: 30662 - DNA, 573 bp, Staphylococcus aureus subsp. aureus Mu50
  CDS (1)..(573)
atgattagatttgaaattcatggagataacctcactatcacagatgctattcgcaactatattgaggaaaaaattggtaagttggaacgttattttaatgacgtaccaaatgcagtggcgcatgttaaagttaaaacttattcaaattcagctactaaaattgaagtaacaattccattgaaaaatgttacgttaagagctgaagagcgaaacgatgatttatacgcaggtattgatttaattaataataaacttgaaagacaagttcgaaaatataaaacacgtattaatcgtaagagccgtgatcgaggagatcaagaagtgtttgttgccgaattacaagaaatgcaagaaacacaagttgataatgacgcttacgatgataacgagatagaaattattcgttcaaaagaattcagcttaaaaccaatggattcagaagaagcggtattacaaatgaatctattaggtcatgacttctttgtattcacagacagagaaactgatggaacaagtatcgtttaccgacgtaaagacggtaaatatggcttgattcaaactagtgaacaataa

SEQ ID NO: 30663 - protein, 190 aa, Staphylococcus aureus subsp. aureus Mu50
MIRFEIHGDNLTITDAIRNYIEEKIGKLERYFNDVPNAVAHVKVKTYSNSATKIEVTIPLKNVTLRAEERNDDLYAGIDLINNKLERQVRKYKTRINRKSRDRGDQEVFVAELQEMQETQVDNDAYDDNEIEIIRSKEFSLKPMDSEEAVLQMNLLGHDFFVFTDRETDGTSIVYRRKDGKYGLIQTSEQ

SEQ ID NO: 30664 - DNA, 324 bp, Haemophilus influenzae Rd KW20
  CDS (1)..(324)
atgacacttaatattaccagtaaacaaatggacatcactcctgcaattcgtgaacacttggaggaacgacttgcgaagttaggtaagtggcaaacgcagttaattagcccacattttgttttaaacaaagtacctaatggatttagtgtcgaagcctctattggcacacccttaggcaatttattagccagtgcaacttcagatgatatgtataaagcaattaatgaagtggaagaaaaattagaacgtcagcttaataaacttcaacataaaagtgaatctcgccgagctgatgaacgtttaaaagattcttttgaaaactaa

SEQ ID NO: 30665 - protein, 107 aa, Haemophilus influenzae Rd KW20
MTLNITSKQMDITPAIREHLEERLAKLGKWQTQLISPHFVLNKVPNGFSVEASIGTPLGNLLASATSDDMYKAINEVEEKLERQLNKLQHKSESRRADERLKDSFEN

SEQ ID NO: 30666 - DNA, 339 bp, Salmonella typhimurium LT2
  CDS (1)..(339)
atgacaatgaacattaccagtaaacaaatggaaattactccggcaatccgccaacatgtcgcagaccgtctcgccaaactggaaaaatggcaaactcacctgattaatcctcatatcattctgtctaaagagccacagggctttattgctgacgccaccattaatacaccgaacggacatctggtcgccagcgcaaaacacgaagatatgtacaccgctattaatgaattgatcaacaagctggaacggcagctcaataaagtgcagcacaaaggcgaagcccgtcgtgccaccgcatcggtgaaagatgccagcttcgtcgaagcagaagaagagtag

SEQ ID NO: 30667 - protein, 112 aa, Salmonella typhimurium LT2
MTMNITSKQMEITPAIRQHVADRLAKLEKWQTHLINPHIILSKEPQGFIADATINTPNGHLVASAKHEDMYTAINELINKLERQLNKVQHKGEARRATASVKDASFVEAEEE

SEQ ID NO: 30668 - DNA, 564 bp, Listeria monocytogenes EGD-e
  CDS (1)..(564)
atgcttaagtacaacattcgtggagaaaatattgaagtaacagaaccgattcgagattatgttgaaaagaaaatcgataaattagaacgatattttacggagactccagacgctaacgttcatgttaatttaaaagtatattccgataaaaatgcgaaagttgaagtgaccattccgctcccaaatcttgtgctacgtgcagaagaaacaagtggagatttatatgctagcatcgatttaattgtagataaattagaaagacaaattcgcaaacataaaacaaaagtaaaccgcaagttccgcgacaaaggtgcagaaagagattattttgcttattctgatgttaacggcagcacaccaccagaagaaaatgaaggagattttgatcttgaaattgtaagaacaaaacaattttcattgaaaccgatggatagtgaagaagctgttttacaaatgaacttgttaggtcatagtttctatgtatacactgatgcagaaacaaatggtactaatatcgtttattctcgtaaagacggtaagtatggtttgattgaaacaaactaa

SEQ ID NO: 30669 - protein, 187 aa, Listeria monocytogenes EGD-e
MLKYNIRGENIEVTEPIRDYVEKKIDKLERYFTETPDANVHVNLKVYSDKNAKVEVTIPLPNLVLRAEETSGDLYASIDLIVDKLERQIRKHKTKVNRKFRDKGAERDYFAYSDVNGSTPPEENEGDFDLEIVRTKQFSLKPMDSEEAVLQMNLLGHSFYVYTDAETNGTNIVYSRKDGKYGLIETN

SEQ ID NO: 30670 - DNA, 318 bp, Xanthomonas campestris pv. campestris str. ATCC 33913
  CDS (1)..(318)
atgcgtatcgagacgtatggccaccagcttgaagtgacccccgccctgcgggactacgtggcaagcaagctgcagcgcctgcagcgccacttcgaccagcactgtgaagtccgaacccagctggccgtccgcaagccagaccaccatgtggttgccaccgtcaacctccccggccgcactctgcacgccgatgccagcggttccaccatgtacgccgccatcgacctgttggtcgacaagctcgaccgcctggtgctcaagcacaaagagaagaaatgtaaccaccacgcccgcgaggtgcgcgacaatcccgcatga

SEQ ID NO: 30671 - protein, 105 aa, Xanthomonas campestris pv. campestris str. ATCC 33913
MRIETYGHQLEVTPALRDYVASKLQRLQRHFDQHCEVRTQLAVRKPDHHVVATVNLPGRTLHADASGSTMYAAIDLLVDKLDRLVLKHKEKKCNHHAREVRDNPA

SEQ ID NO: 30672 - DNA, 543 bp, Bacillus anthracis str. A2012
  CDS (1)..(543)
atgaaattcaacattcgtggtgaaaatattgaagtaactccagcattaaaggaatatgtagagaaaaaactaagtaagttagagcgttattttgatacattcccagagattaaagttaatttaaaagtatactctgacaagcaacgtgtcgaggtaacaattccatttactgatttattacttcgtgcagaagaaactaatagcgatatgtacgctgctatcgatttagtagttgataaactagagcgacaaattcgtaaacataaaacaaaagtaaatcgtaagttacgtgagaaaggttctatgaaaacgaactttatccttccagaagcagtagctgttctggatgcggtagaagaggatgaattagagcttgtacgtacaaaacgattcgatttaaaaccgatggacgttgaggaagcaatcctacaaatggatatgctaggacataatttcttcgtcttcacaaatgctgatacaaatgaaactaatgttgtatatggccgtaaagatgggaaatatggtttaatcgaaactaaataa

SEQ ID NO: 30673 - protein, 180 aa, Bacillus anthracis str. A2012
MKFNIRGENIEVTPALKEYVEKKLSKLERYFDTFPEIKVNLKVYSDKQRVEVTIPFTDLLLRAEETNSDMYAAIDLVVDKLERQIRKHKTKVNRKLREKGSMKTNFILPEAVAVLDAVEEDELELVRTKRFDLKPMDVEEAILQMDMLGHNFFVFTNADTNETNVVYGRKDGKYGLIETK

SEQ ID NO: 30674 - DNA, 465 bp, Yersinia pestis KIM
  CDS (1)..(465)
ttgcaaaaagtgacaaaaaaaagtgatctcgatcatacattctacggtaaagcgaggtatgctgaagttatccaagacggagtagacagagaggtaagtcatatgacagttaatattaccagcaagcaaatggatattaccccggcaattcgtaaacacgttgaggaccgtctcaccaaactggataaatggcaggcccagttaataaacccacacattgtactgtctaaagagccacaaggttttgttgccgatgcctctatcagtacaccaatgggtcccttggtcgccagcgccaagcatgatgatatgtatgctgccattaatgaactgatcaccaaactagaacgccaattaaataaagttcaacacaaaggtgaagctcgtcgtgcggcaagcagcgttaaagacgctaatttggagtctgtagatgaagaggaaacagaatccgaaccggaacaatag

SEQ ID NO: 30675 - protein, 154 aa, Yersinia pestis KIM
MQKVTKKSDLDHTFYGKARYAEVIQDGVDREVSHMTVNITSKQMDITPAIRKHVEDRLTKLDKWQAQLINPHIVLSKEPQGFVADASISTPMGPLVASAKHDDMYAAINELITKLERQLNKVQHKGEARRAASSVKDANLESVDEEETESEPEQ

SEQ ID NO: 30676 - DNA, 558 bp, Oceanobacillus iheyensis HTE831
  CDS (1)..(558)
atgaagtttaatattcgaggcgaaaatattgaagttactggagcaatcaaagaatatgttgagaaaaaaattagtaaactagaaagatattttgattcagctccaaatacggatgtacatgtcaatttaagtgtctacaatgatgaacaacgaatcgaagttacgattcctatgaccaatttgcttctccgaggagaggtacagcatattgatctctatgccgcagtggatttagtcgttgataagttagaaagacaaattcgtaagcataaaacaaaaataaatcgtaagttcagacaaaatggttctcctaaacatgcttttgcagaaatggaaaaagaagctagactagctgaagatgaagaagatgaaaatcaattagaaattgttcgtacaaaaagatttaatttaaaaccgatggactccgaagaagcgatcttacaaatggacatgttaggacatgagttcttcgtatttaccaatgacgattctggtgaaacgaatgttgtttatagacgtagagatgggaaatacggtttgatagaaccacatgtttaa

SEQ ID NO: 30677 - protein, 185 aa, Oceanobacillus iheyensis HTE831
MKFNIRGENIEVTGAIKEYVEKKISKLERYFDSAPNTDVHVNLSVYNDEQRIEVTIPMTNLLLRGEVQHIDLYAAVDLVVDKLERQIRKHKTKINRKFRQNGSPKHAFAEMEKEARLAEDEEDENQLEIVRTKRFNLKPMDSEEAILQMDMLGHEFFVFTNDDSGETNVVYRRRDGKYGLIEPHV

SEQ ID NO: 30678 - DNA, 357 bp, Shewanella oneidensis MR-1
  CDS (1)..(357)
atgaaaattaatctttctggtcaccatgtcgatgttactgattctgtaaaagaacacgttaacgaaaagttttctaaaatcgccactcatttccccacactcatcgggctcgatatcattattgctaaggagcatggcgagtttcaggttgaaattcgaacaaattacgaaggcagtcgcatctccgcctctggtacggatgaagtcatgtatcccgcgattgcaaacgccgccaaaaaacttgatgcagcacttaaacatcgcaaaggtcagctaaaggcggatttacatgaaaaaccgacttgcactacgccacctattgcccatgaaatcatccaagagatggatttgcgctag

SEQ ID NO: 30679 - protein, 118 aa, Shewanella oneidensis MR-1
MKINLSGHHVDVTDSVKEHVNEKFSKIATHFPTLIGLDIIIAKEHGEFQVEIRTNYEGSRISASGTDEVMYPAIANAAKKLDAALKHRKGQLKADLHEKPTCTTPPIAHEIIQEMDLR

SEQ ID NO: 30680 - DNA, 357 bp, Shewanella oneidensis MR-1
  CDS (1)..(357)
atgctaaagattacgagcaaacaattagaagtaactgccccaatccgtgaacgcattgaaagccgtttcgagaaactttctaggcacgatgtgcagttgattaatccccatgtcattatcaccgaggagaaacctggtttcaaaattgaagcatcggttggcatcccaaatggagaactttttgctcaagctaaacacgataatctttatgcagctatcactgctatgggtcaaaaattagagaaacagctcaatcgattaacccataaacccgaggcacaacgttttgcatcaattgatcactctgaagaagcaataaatgtagaggaggattacgaggaggaagatgccgcctaa

SEQ ID NO: 30681 - protein, 118 aa, Shewanella oneidensis MR-1
MLKITSKQLEVTAPIRERIESRFEKLSRHDVQLINPHVIITEEKPGFKIEASVGIPNGELFAQAKHDNLYAAITAMGQKLEKQLNRLTHKPEAQRFASIDHSEEAINVEEDYEEEDAA

SEQ ID NO: 30682 - DNA, 570 bp, Staphylococcus epidermidis ATCC 12228
  CDS (1)..(570)
atgattagatttgaaattcatggagataacctcactatcacagatgcaattcgcaactatattgaggagaaagtaggtaaattagaaagatactttaacaatgtgccaaatgctgtagcacatgttagagttaaaacttattctaattctacaactaaaattgaagttacaattcctttaaaagatgtcactcttagagctgaagaaagacatgatgatttatatgcaggcattgatttaattactaacaaattggaaagacaagtacgtaaatacaaaactcgtgtaaatcgtaaacatagagatcgtggagatcaagatatctttgttgctgaagtacaagagtctacaacaaacaatcatgcagatgatatagaaagtgaaaatgatattgaaattattcgttctaaacaattcagcttaaaaccaatggattctgaagaagcagtattgcaaatgaatttattgggacatgatttctttatttttaccgatagagaaactgatggcacaagcattgtttatagacgaaaagatggcaaatacggtctgattgaaacaactgaataa

SEQ ID NO: 30683 - protein, 189 aa, Staphylococcus epidermidis ATCC 12228
MIRFEIHGDNLTITDAIRNYIEEKVGKLERYFNNVPNAVAHVRVKTYSNSTTKIEVTIPLKDVTLRAEERHDDLYAGIDLITNKLERQVRKYKTRVNRKHRDRGDQDIFVAEVQESTTNNHADDIESENDIEIIRSKQFSLKPMDSEEAVLQMNLLGHDFFIFTDRETDGTSIVYRRKDGKYGLIETTE

SEQ ID NO: 30684 - DNA, 318 bp, Xylella fastidiosa Temecula1
  CDS (1)..(318)
atgcacatcgaaacttatgggcaacagatcgaagtcactcctgctttacgggagtatgtggaaacgaagctaaaacgcctccaacgccacttcagccaccactgcgaaatccgcacccaactgtccatgagtaaaatcgaccatcatgttaccgctacaatcaatatcccaggccgtactttgaatgccaacgccagtgcatcaaccatgtacgcagccattgatctggtagcagacaaacttgatcgattaatactcaagcacaaggaaaaaaaatgcgaccaccacgccaaggaggtacgcgatcacctagaatga

SEQ ID NO: 30685 - protein, 105 aa, Xylella fastidiosa Temecula1
MHIETYGQQIEVTPALREYVETKLKRLQRHFSHHCEIRTQLSMSKIDHHVTATINIPGRTLNANASASTMYAAIDLVADKLDRLILKHKEKKCDHHAKEVRDHLE

SEQ ID NO: 30686 - DNA, 531 bp, Clostridium tetani E88
  CDS (1)..(531)
atgagaataacagtgacaggaaagaatattgagattacaaatgctctaaggaatgtggttgaaaagaaattagaaaagttagataagtattttaaacctgatgtagaagcccaagttacattgagtgttgaaaaaaacagacaaataatagaagtaacaattccttttaatggagttattctaagaggagaagaagctaatgaagatatgtatgcttctatagatttagtaatagataaactagagagacaaataagaaaacaaaaaactaaattacaaaaaaggatgcatggtgattcattaagatttcaatttatacctgattatgaaggagacaaatttaaagaagaatcaaaaatagttaaaacaaaaagatttgcaataaagccaatgtcatcagaagaagcagttttacaaatggaacttataggacataacttttttgtatttgaaagtgcagatacaggagaagtaaacgtagtttataaaagaaaagatggaaattatggtttgatagaaccagaattctaa

SEQ ID NO: 30687 - protein, 176 aa, Clostridium tetani E88
MRITVTGKNIEITNALRNVVEKKLEKLDKYFKPDVEAQVTLSVEKNRQIIEVTIPFNGVILRGEEANEDMYASIDLVIDKLERQIRKQKTKLQKRMHGDSLRFQFIPDYEGDKFKEESKIVKTKRFAIKPMSSEEAVLQMELIGHNFFVFESADTGEVNVVYKRKDGNYGLIEPEF

SEQ ID NO: 30688 - DNA, 567 bp, Lactobacillus plantarum WCFS1
  CDS (1)..(567)
atgctaaattttaatattcgcggtgaaaatatcgaagtgacccaagcaattcgggactacgttcaaaaacgggtgggtaagttacagaagtactttgacaataatgttgactcaattgcccatgtcaacttaaaagttcacccagacaagacggctaaagtcgaagtcaccattccacttccctatttagttctccgggcagaagaaacttctcctgatatgtatgctagtgttgatttggttactgacaagttggaacgccaaatccgcaagtataaaactaaggttaaccgcaaatcccgtgaaaagggttataaagcgattgattttgcagcgactgatgaaacagttgccgctgccgacaatgatcaggacgataagttagacgttgtacgtacgaagcgagtggctttaaagccaatggataatgaagaagcgattctgcaaatggatatgctcggccatgacttctttatctacgaagacgcggaaacggacgcaattaacatcgtctatcggcgtaacgatggtcgttacggtttgattgaaaccgacgacaatcactaa

SEQ ID NO: 30689 - protein, 188 aa, Lactobacillus plantarum WCFS1
MLNFNIRGENIEVTQAIRDYVQKRVGKLQKYFDNNVDSIAHVNLKVHPDKTAKVEVTIPLPYLVLRAEETSPDMYASVDLVTDKLERQIRKYKTKVNRKSREKGYKAIDFAATDETVAAADNDQDDKLDVVRTKRVALKPMDNEEAILQMDMLGHDFFIYEDAETDAINIVYRRNDGRYGLIETDDNH

SEQ ID NO: 30690 - DNA, 327 bp, Vibrio parahaemolyticus RIMD 2210633
  CDS (1)..(327)
atgacaatgaatatcactggcaaaaacatcgaaatcacctctgcaatccgtgctcatattgagagcaagtttaaaaaactggagaaatggcaagtagacattattggatgccaagcaactttcagtgaggaaccgaataaacagaagaaattcgaagcggtaattaaagttcctaaaggccaacttgtcgcctcagcaactcacgaagatctttacgcagctatcaatgaagtggagcaaaaactagaacgacaactgaataagctgacccacaaacctgaagctcgtcgtgccaataagcctgagctagtggaagaagaagagtaa

SEQ ID NO: 30691 - protein, 108 aa, Vibrio parahaemolyticus RIMD 2210633
MTMNITGKNIEITSAIRAHIESKFKKLEKWQVDIIGCQATFSEEPNKQKKFEAVIKVPKGQLVASATHEDLYAAINEVEQKLERQLNKLTHKPEARRANKPELVEEEE

SEQ ID NO: 30692 - DNA, 552 bp, Enterococcus faecalis V583
  CDS (1)..(552)
atgtttagatataatgtacgtggagaaaatatcgaggtaaccgaagcgattcgagactatgttgagaaaaaagtcggtaaattagaaagatatttcagcgattcacctgaagcaacggttcacgtgaatttgaaagtgtacactgaaaaaacagccaaagtcgaggttactattcctcttccttatctagttttacgagctgaagaaacgtcacctgatttatacgcaagtattgatttggttgtcgataaattagaacgacaaattcgtaaatttaaaacaaaaatcaacagaaaatctcgtgaaacaggacgtaacaatacaaaagccgctgtcttcttagttggtgaagaaacagaagaaacaccttcagaattagacatcgttcgtacaaaacgtctatcattaaaaccgatggacagtgaagaagctgttttacaaatgaacatgttaggacacaacttcttcatttttgaagatgctgaaacaaatggaacaagcattgtttaccgtcgtaaagatggcaaatatggcttgattgaaacagactaa

SEQ ID NO: 30693 - protein, 183 aa, Enterococcus faecalis V583
MFRYNVRGENIEVTEAIRDYVEKKVGKLERYFSDSPEATVHVNLKVYTEKTAKVEVTIPLPYLVLRAEETSPDLYASIDLVVDKLERQIRKFKTKINRKSRETGRNNTKAAVFLVGEETEETPSELDIVRTKRLSLKPMDSEEAVLQMNMLGHNFFIFEDAETNGTSIVYRRKDGKYGLIETD

SEQ ID NO: 30694 - DNA, 291 bp, Coxiella burnetii RSA 493
  CDS (1)..(291)
atgcatattcaaatgacaggccaaggggtggatatttcacccgcattacgcgaactcactgaaaaaaaattacaccgcatacaaccttgtcgcgatgaaatttctaatatccacatcatcttccatattaataaactgaaaaaaatcgtcgatgcgaatgttaaattaccgggaagcaccatcaatgcgcaggcagaatcggatgacatgtataaaacagtcgatctgttgatgcataaattagaaactcaactttcaaagtacaaagctaaaaaaggcgatcaccgctaa

SEQ ID NO: 30695 - protein, 96 aa, Coxiella burnetii RSA 493
MHIQMTGQGVDISPALRELTEKKLHRIQPCRDEISNIHIIFHINKLKKIVDANVKLPGSTINAQAESDDMYKTVDLLMHKLETQLSKYKAKKGDHR

SEQ ID NO: 30696 - DNA, 861 bp, Streptomyces avermitilis MA-4680
  CDS (1)..(861)
atgccgcgggttttctgcaatcacccgcaccggtggggtggagatctcgcccacgggggaggaggaggtggacgtcaccgagtccgaggttccggtgctcaccggggcctggtgcaaaagggagatgctccgccagggatgcggagtgatccgggaacggagttctgcgtggacatcgtcgtcaagggccgcaagaccgaggtgcccgagcggttccgcaagcacgtggccgagaagctgaagctggagaagatccagaagctcgatggcaaggtgatcagcctcgacgtcgaggtgtccaaggagcccaacccccggcaggccgaccgttgcgaccgagtggagatcacgctccgctcccgcggaccggtgatccgggcggaggcagcggccagcgatccgtacgcggcgctcgacctggcggcggacaagctcgaagcccggctgcgcaaggagcacgacaagcgccacacccgccgcggtgcgggcaggctctccgccgcggacgtcgccgacaccgttccgggcgcagcgacgctgaacgggagcggcggcatcgtcagtgaggcggagtcggacggtatcccgaccaagaagatcggctcgctcgaggtcaagggcgaaggccccctcgtggtccgcgagaagacccacgttgcttccccgatgtcgctcgaccaggcgctctacgagatggagctggtcgggcatgacttctatctgttcgtcgactccgagaccaaggagcccagtgtcgtctaccggcggcacgcatacgactacggcgtcatccacctcagcacggacccgatggtcgcccaggcgcagtcggccgacgcgggcggtgcactcggcggctga

SEQ ID NO: 30697 - protein, 286 aa, Streptomyces avermitilis MA-4680
MPRVFCNHPHRWGGDLAHGGGGGGRHRVRGSGAHRGLVQKGDAPPGMRSDPGTEFCVDIVVKGRKTEVPERFRKHVAEKLKLEKIQKLDGKVISLDVEVSKEPNPRQADRCDRVEITLRSRGPVIRAEAAASDPYAALDLAADKLEARLRKEHDKRHTRRGAGRLSAADVADTVPGAATLNGSGGIVSEAESDGIPTKKIGSLEVKGEGPLVVREKTHVASPMSLDQALYEMELVGHDFYLFVDSETKEPSVVYRRHAYDYGVIHLSTDPMVAQAQSADAGGALGG

SEQ ID NO: 30698 - DNA, 336 bp, Nitrosomonas europaea ATCC 19718
  CDS (1)..(336)
atgaatttgaatctcaccggcaatcatgtagaaattacacctgccatgcgcgactatgttttgtccaaaattgagaggattacacgtcattttgacaatatcatcgatatcaacgtgatcctttccgtagataaactcaaacaaaaagccgaagccacagtcaatctgcgtggcaaggaaatttttgttgaagcggatggtctcgatatgtatgcctcgattgataacctggtagataagcttgatcgccagatccttaaatataaggaaaaaaatattgatcgacgtgataatcaaggtggattgaaagatcaggaatttgaacaatccgagtaa

SEQ ID NO: 30699 - protein, 111 aa, Nitrosomonas europaea ATCC 19718
MNLNLTGNHVEITPAMRDYVLSKIERITRHFDNIIDINVILSVDKLKQKAEATVNLRGKEIFVEADGLDMYASIDNLVDKLDRQILKYKEKNIDRRDNQGGLKDQEFEQSE

SEQ ID NO: 30700 - DNA, 339 bp, Bordetella bronchiseptica RB50
  CDS (1)..(339)
atgaacctgagcatctgcggtcgtcacctcgacgtcaccccggcaatccgggaatatgtcatgaacaagctggcgcgagtgctgcggcatttcgatcatgttatcgatacccaggtcatgctttcggtagagcccctgcggcacaaggccgaaatcaccatgcgtctgcgcggcaaggatatccattgcgaagccgtcgacgagaacctctatgcagccatcgatctactggtcgacaaaatagaccgtcaggtcatcaagcacaaagacaaggttcagagccactccgccgagtccgcaaagcgacaagccgctgcgctggccgcgcagcaaccgtag

SEQ ID NO: 30701 - protein, 112 aa, Bordetella bronchiseptica RB50
MNLSICGRHLDVTPAIREYVMNKLARVLRHFDHVIDTQVMLSVEPLRHKAEITMRLRGKDIHCEAVDENLYAAIDLLVDKIDRQVIKHKDKVQSHSAESAKRQAAALAAQQP

SEQ ID NO: 30702 - DNA, 333 bp, Chromobacterium violaceum ATCC 12472
  CDS (1)..(333)
atgaacctcaaagtaactggcctgcacctggaagtcaccccgtcgctgcgcgaatacatcgagaacaagctggagcgcattacccgccatgtcgaccatgtgatcgacatctccgtcaccctgtcggtggacaagctggtccagaaggccgaagtcaatgtgcacctgtccggcaaggacatccacatcgaggcttccgaggccgatctctacgccgccatcgatatcctgatggacaagctggaccgccaggtcctgaaatacaaggaaaagctgaccgagcaccgcgcgctgggctcgggcgaggcctcgcagacccaggcttcgctgtaa

SEQ ID NO: 30703 - protein, 110 aa, Chromobacterium violaceum ATCC 12472
MNLKVTGLHLEVTPSLREYIENKLERITRHVDHVIDISVTLSVDKLVQKAEVNVHLSGKDIHIEASEADLYAAIDILMDKLDRQVLKYKEKLTEHRALGSGEASQTQASL

SEQ ID NO: 30704 - DNA, 363 bp, Photorhabdus luminescens subsp. laumondii TTO1
  CDS (1)..(363)
atgatagtgaatattaccagcaaacaaatggagattaccccggcaattcgcaaccacgtcgaaaaacggttaaacaaactaaataaatggcgagtaaatctaataaatcctcatattattctatcaaaagggcctcaaatttttagggctgatgcaaccataagtacaccaaatggtatgttagttgccggtgcaaagcatgaagatatgtatattgctatcaatgaattattaacaaaactggagcgccaattgaataaagtacagcataagggagaagcacgccgtactgacaacagtgttaaagaatcaaaccttaatctagaaacaccactagaaacagaaccagaaatatcacaataa

SEQ ID NO: 30705 - protein, 120 aa, Photorhabdus luminescens subsp. laumondii TTO1
MIVNITSKQMEITPAIRNHVEKRLNKLNKWRVNLINPHIILSKGPQIFRADATISTPNGMLVAGAKHEDMYIAINELLTKLERQLNKVQHKGEARRTDNSVKESNLNLETPLETEPEISQ

SEQ ID NO: 30706 - DNA, 288 bp, Photorhabdus luminescens subsp. laumondii TTO1
  CDS (1)..(288)
atgcaactcaaaataaccggccacaatattgaaattactgatgcattacgcgacattatcactgcaaaatgcagcaaactggatcaatatttcgacaggatcaacctgactcaggtaatcctccgagtggaaaaggtacaacaaatcgccgaagctactgtacacattaacggaggtgagttgcacgcatcatcagaacatgaagatatgtatgcagcaattgatggactggtcgataaactggcgcgtcaattaaccaagcataaagacaaactgaaacatcattaa

SEQ ID NO: 30707 - protein, 95 aa, Photorhabdus luminescens subsp. laumondii TTO1
MQLKITGHNIEITDALRDIITAKCSKLDQYFDRINLTQVILRVEKVQQIAEATVHINGGELHASSEHEDMYAAIDGLVDKLARQLTKHKDKLKHH

SEQ ID NO: 30708 - DNA, 606 bp, Rhodopseudomonas palustris CGA009
  CDS (1)..(606)
atgaccatccggatatccggcaaaagcatcagcatcggcgaagcgctgcgcagccgcgtgagcgaacgcaccgaggaggtgctgcgcaagtatttcgatgggaattactcggggcacttcacgctcagcaaagacggcttcggcttccgcaccgattgtgcgctgcacctcgattccggcatcacccttgaagccgagtccaatgcggccgacgcctatgtcagcgccgatcaagctctggtgcagatcgagaagcgcctgcgccgctacaagagccggctgaaggatcgctcgtcccgcaaggctcatgcggaagccaacgcgctcgccgagctcagcacgccggtcgatgcggccagctacgtcatcgaagcgcccggcgacgaagagcatcacgaggacgcctacaacccggtgatcatcgccgaagccaccaccgcgatgaagcggctgtcggtgagcgaggcggtggtcgagctcgatcttacgggtgcaccggtggtggtgttcctgcacggcagctcgggccgcgtgaacatcatttatcgccgcgccgacggcaatatcggctggatcgacccgccggtgctgaacggcgcgaactga

SEQ ID NO: 30709 - protein, 201 aa, Rhodopseudomonas palustris CGA009
MTIRISGKSISIGEALRSRVSERTEEVLRKYFDGNYSGHFTLSKDGFGFRTDCALHLDSGITLEAESNAADAYVSADQALVQIEKRLRRYKSRLKDRSSRKAHAEANALAELSTPVDAASYVIEAPGDEEHHEDAYNPVIIAEATTAMKRLSVSEAVVELDLTGAPVVVFLHGSSGRVNIIYRRADGNIGWIDPPVLNGAN

SEQ ID NO: 30710 - DNA, 546 bp, Geobacter sulfurreducens PCA
  CDS (1)..(546)
atgcagattacgacgacattcagacacatggagcagagcgaggcccttaagagctacgccgctgaaaagctggagagggtaaagaaatatatcgatgagccgattaccgctcaggtatttctcacggtggagaagatccgccacatcgccgaagtgacccttaccgccaagggaattaccatcaaggctgcggaagaaaccaatgacatgtatgccgcactggatgcggtgatcgacaagattgagcgccagcttcgccgctacaaagagcggctcaaagagcacaagccgtccgccgacgatcgggccctggaaatccagaagagcgttgttacggccgaaagcatcgagcaacggaccgaacccgtcgtgatcaggagcaagaccatctccatcaagcctatgtccgtggaagaggctgtgatgcaaatggatcttctgcacaaggattttctcgtgttcaccgacgcatccactgaggctatcaatgttgtctatcgcaggaaggacggcaactacggtctcatcgagccccagcgcaagtag

SEQ ID NO: 30711 - protein, 181 aa, Geobacter sulfurreducens PCA
MQITTTFRHMEQSEALKSYAAEKLERVKKYIDEPITAQVFLTVEKIRHIAEVTLTAKGITIKAAEETNDMYAALDAVIDKIERQLRRYKERLKEHKPSADDRALEIQKSVVTAESIEQRTEPVVIRSKTISIKPMSVEEAVMQMDLLHKDFLVFTDASTEAINVVYRRKDGNYGLIEPQRK

SEQ ID NO: 30712 - DNA, 546 bp, Lactobacillus johnsonii NCC 533
  CDS (1)..(546)
atgttaaaatacaatgttcgtggagaaaatgtcgaagttactgatgccttaagagattatgttcaaaagagattgaataagctcgaaaagtacttcgaaatcaattctgatgtaattgctcatatcaatttaaaggtttatccagatcatactgctaaggtggaagtaacaattccacttccatacctagttttacgtgcagaagacacaactgatgatatgtacaagagtattgattttgtttctgaaaaactagaacgtcaaatcagaaaatacaagactcgtattaacagaaagagtcgtgagaagggcttaaaagatttcttctatgaagacttagaagaagaaaagaaagcacctaaagaatttgatattgttcgtaacaagcatttggatttaaagccaatgagtgcagaagaagccgttttacaaatggacttgttgggccatgatttctttgtttttgaagatgcagatacaaatggaacaagcattgtatatcgcagaaatgatggtcgttatggcttgattgaaactaacgaataa

SEQ ID NO: 30713 - protein, 181 aa, Lactobacillus johnsonii NCC 533
MLKYNVRGENVEVTDALRDYVQKRLNKLEKYFEINSDVIAHINLKVYPDHTAKVEVTIPLPYLVLRAEDTTDDMYKSIDFVSEKLERQIRKYKTRINRKSREKGLKDFFYEDLEEEKKAPKEFDIVRNKHLDLKPMSAEEAVLQMDLLGHDFFVFEDADTNGTSIVYRRNDGRYGLIETNE

SEQ ID NO: 30714 - DNA, 561 bp, Thermus thermophilus HB27
  CDS (1)..(561)
atgaacatctacaagctcatcgggcgcaacctggagatcacggacgccatccgggactacgtggagaagaagctcgcccgcctggaccgctaccaagacggggagctcatggccaaggtggtcctttccctggcgggaagcccccacgtggagaagaaggcccgggcggagatccaggtggacctcccgggcggcctcgtgcgcgtggaggaggaggacgccgacctctacgccgccatagaccgggcggtggaccgcctggaaacccaggtgaagcgcttcagggagcggcgctacgtgggcaagcgccactcctaccagggccccccgcctcccgaggtgcgggacctcgaggccctgcgcaagcccgaggaagaggaaggccccaggatcgtccgcgtcaagcgctttgagatgaagcccatggaccccgaggaggccgccttccagatggaggccctgggccacagcttcttcgtcttccgcaacgccaagaccgacgagatcaacgtcatctaccggaggaaggacggcaactacggcctcatagagcccgcctga

SEQ ID NO: 30715 - protein, 186 aa, Thermus thermophilus HB27
MNIYKLIGRNLEITDAIRDYVEKKLARLDRYQDGELMAKVVLSLAGSPHVEKKARAEIQVDLPGGLVRVEEEDADLYAAIDRAVDRLETQVKRFRERRYVGKRHSYQGPPPPEVRDLEALRKPEEEEGPRIVRVKRFEMKPMDPEEAAFQMEALGHSFFVFRNAKTDEINVIYRRKDGNYGLIEPA

SEQ ID NO: 30716 - DNA, 636 bp, Parachlamydia sp. UWE25
  CDS (1)..(636)
atgaatcgcaaagcaaaagccttagaatttgtagatactgaatataatgttaaaattacaggtcggcatgtcgaaattacagattccatgaaaagttatgccatggaaaaaatttctaagattgagcgattcatggatcgcatcattgatgtgaatgtgatcatggatatccaaaaaattgaccacaaagtagaaattatcttaaaagcagggcatacaaaaatccaaagccaagcagcaacacctgatatgtatgcttcaattgataaagcgattgcaagacttgaagctcaaattcgtcgttacaaatcaaaaattcaagaccatcacgcaaaaagcttagctattattgatatgaatgtaaatgtgcttcgcaatcctagtgctgaagaggaaatggaagaggaagaaagtgaattttctgcttctgtcaccaatggccacattgttggcggacatgaaattgtcaaacgagaaacacgccctcttaaaaccttgacatttgatgaagctattatgaaaatggagctttctcaagatgtgtttttgatcttcaaaaatgaagaagatcaaaaattgaaagtgatttacagacgtaaagatggtcactatggaattattgatttaaacagctaa

SEQ ID NO: 30717 - protein, 211 aa, Parachlamydia sp. UWE25
MNRKAKALEFVDTEYNVKITGRHVEITDSMKSYAMEKISKIERFMDRIIDVNVIMDIQKIDHKVEIILKAGHTKIQSQAATPDMYASIDKAIARLEAQIRRYKSKIQDHHAKSLAIIDMNVNVLRNPSAEEEMEEEESEFSASVTNGHIVGGHEIVKRETRPLKTLTFDEAIMKMELSQDVFLIFKNEEDQKLKVIYRRKDGHYGIIDLNS

SEQ ID NO: 30718 - DNA, 354 bp, Acinetobacter sp. ADP1
  CDS (1)..(354)
gtgagggatagaactatgcagataacaattcgtggacatcatttaactataacacctgccattgaagaaaatatcaaatctaaatttggtgagatgaccaagcatttagatcaagtcaatagtatgcaggtgaaactttcgaaagatcatcaaattgataaaagaacgcacaaagggagttcaaatcatattgctgaagcaattgtacgcctaccaggcattgaactttttgcacaagcgtctgctgatgacatgtatacatcaattaaaaaattatctgaaaaattgaaacgtcaattacaaaaacatcgaaaaatacaatgtacatatcagcaagttattgttcctatttaa

SEQ ID NO: 30719 - protein, 117 aa, Acinetobacter sp. ADP1
MRDRTMQITIRGHHLTITPAIEENIKSKFGEMTKHLDQVNSMQVKLSKDHQIDKRTHKGSSNHIAEAIVRLPGIELFAQASADDMYTSIKKLSEKLKRQLQKHRKIQCTYQQVIVPI

SEQ ID NO: 30720 - DNA, 288 bp, Erwinia carotovora subsp. atroseptica SCRI1043
  CDS (1)..(288)
atgcagctcaacattaccggacaccacatcgagatcactgaaccactgcgtgattttgtgaatggcaaatttgccaaattagagcagtattttgaccggattaatcaggtcaatgtggtattgagagtggaaaaagttcagcaaattgccgaggctacgctccatgttaatggtggagagctgcatgcaacctctgaagcggaagatatgtacgccgcgatagatttattgattgataagctggcgagacagctcaataagcataaagataaactcaagcagcactaa

SEQ ID NO: 30721 - protein, 95 aa, Erwinia carotovora subsp. atroseptica SCRI1043
MQLNITGHHIEITEPLRDFVNGKFAKLEQYFDRINQVNVVLRVEKVQQIAEATLHVNGGELHATSEAEDMYAAIDLLIDKLARQLNKHKDKLKQH

SEQ ID NO: 30722 - DNA, 342 bp, Erwinia carotovora subsp. atroseptica SCRI1043
  CDS (1)..(342)
atgactattaatattaccagtaagcaaatggatatcacccccgcaattcgtcaacatgtcgaagaccgtctttctaagctggataagtggcaaacccagctgattaacccacatattattctgtcaaaggaaccacagggttttgtggctgatgccacgatcagtacgccaaatggtccactggttgccagcgccaaacatgacgatatgtatgcagccatcaatgagttaattaccaagctcgaacgccagttggacaaactccaacacaaaggtgaagccagacgcgcggtagctggtgttaaagaagctaatctacaaccgacgcaagaagaagagtaa

SEQ ID NO: 30723 - protein, 113 aa, Erwinia carotovora subsp. atroseptica SCRI1043
MTINITSKQMDITPAIRQHVEDRLSKLDKWQTQLINPHIILSKEPQGFVADATISTPNGPLVASAKHDDMYAAINELITKLERQLDKLQHKGEARRAVAGVKEANLQPTQEEE

SEQ ID NO: 30724 - DNA, 537 bp, Symbiobacterium thermophilum IAM 14863
  CDS (1)..(537)
atgcaggttgcggtacgcggtaagaacatcgagatcaccaaggcgcttcgcgagtacgtcgagaagaagcttggcaagatcgagaagttcgtcgaccatccgatcaaggcgcaggccaacctctatgtggagcgcggacggcacatcatcgaagttaccgcagacttgaacgggtggatcctgcggggcgaggaggccacgggcgacatgtatgcctccatcgatctcgtggccgacaagctggagaagcaggtccagcggtaccgtgcccggctccgccggcgaggtggcgcaggggcctcgcccgaggccgccgtcgccggcgccgaggaccagggcgtggatgccgagctggacggcaaggtggtcaaggtcaagcggttccccgtcaaacccgttaccgtggacgaggcaatcctgcagatggacctgctctcgcacgacttcttcgtcttcgtcaacagcgacacgggcaaggtgaatgtgctctatcgccgccacgacggcgactacggtctgttggtgccggaatactaa

SEQ ID NO: 30725 - protein, 178 aa, Symbiobacterium thermophilum IAM 14863
MQVAVRGKNIEITKALREYVEKKLGKIEKFVDHPIKAQANLYVERGRHIIEVTADLNGWILRGEEATGDMYASIDLVADKLEKQVQRYRARLRRRGGAGASPEAAVAGAEDQGVDAELDGKVVKVKRFPVKPVTVDEAILQMDLLSHDFFVFVNSDTGKVNVLYRRHDGDYGLLVPEY

SEQ ID NO: 30726 - DNA, 321 bp, Mannheimia succiniciproducens MBEL55E
  CDS (1)..(321)
atgacactaaatatcacaagtaaacaaatggacattactcccgcaattcgtacccacgtagaagagagacttgcaaaattagaaaaatggcacactcagttaattaatccccatttcattttgagcaagattccaaacggtttccaagtcgacgcctcaatcggcactccaataggcaatctgcaggctaccgctcaatcggatgatatgtataaagcaattaatgaagttgaagaaaaattagaaaaacaattgaataaattgcagcataaagatgaatctcgcagagcaagcgaacgtttaaaagattcttttgaataa

SEQ ID NO: 30727 - protein, 106 aa, Mannheimia succiniciproducens MBEL55E
MTLNITSKQMDITPAIRTHVEERLAKLEKWHTQLINPHFILSKIPNGFQVDASIGTPIGNLQATAQSDDMYKAINEVEEKLEKQLNKLQHKDESRRASERLKDSFE

SEQ ID NO: 30728 - DNA, 300 bp, Legionella pneumophila subsp. pneumophila str. Philadelphia 1
  CDS (1)..(300)
atgcaaatcaacattactggacatggtatggatgtcactcctgcactaagagcattcactgaagaaaaatttgataagcttgagcgtcattttgatcacatcagagcaattaatgtagtatttgatgtcgaaaaagtaagacaaatagcagaagcgaccgtattggttaccaaaggcgagttgcatgccagttcagaatcagaagacatgtatgctgctattgatactttggtagacaaattaaatcgacaactgattaaacataaagaaaaacttttagcccatagagacagggattaa

SEQ ID NO: 30729 - protein, 99 aa, Legionella pneumophila subsp. pneumophila str. Philadelphia 1
MQINITGHGMDVTPALRAFTEEKFDKLERHFDHIRAINVVFDVEKVRQIAEATVLVTKGELHASSESEDMYAAIDTLVDKLNRQLIKHKEKLLAHRDRD

SEQ ID NO: 30730 - DNA, 360 bp, Burkholderia mallei ATCC 23344
  CDS (1)..(360)
atgaacctgaagatcagtggacaccatctcgaagtcacgcctgctatccgcgaatacgtgatcaccaagctcgacagggtgctacgccatagcgatcaggtcatcgatggcgccgtgatcctcacggtcgacaatcacaaagagaaggacaagcggcaaaaggccgaaatcacgctgcatctgaagggcaaggacatcttcgtcgaaagcgcgaacggcgacatgtatgcggcgatcgatctgctgatcgacaagctcgaccgtcaggtcgtcaagcacatggagcgcctgcagacgcatgcgcacgagccgctcaagcaccagcaggccgccgagcagatcgagcttccgccgcaatga

SEQ ID NO: 30731 - protein, 119 aa, Burkholderia mallei ATCC 23344
MNLKISGHHLEVTPAIREYVITKLDRVLRHSDQVIDGAVILTVDNHKEKDKRQKAEITLHLKGKDIFVESANGDMYAAIDLLIDKLDRQVVKHMERLQTHAHEPLKHQQAAEQIELPPQ

SEQ ID NO: 30732 - DNA, 297 bp, Methylococcus capsulatus str. Bath
  CDS (1)..(297)
atgcaactcagcatcagcggacaccatatcgacgtcaccgacgccctgaaaaactacactatcgggaaattccggagactggaacgccatttcaaccaactgttcgacgtccacgtcatcctgtcggtggaaaaactgctgcagaaggccgaagccacggtccaggtggcaggcacgcaactgtttgccgaagacgtccaggaagacctgtatgccgccattgacggcctcgtcgacaaactggaccgccagatcctcaagcacaaggaaaaactcaatgaccacggccgcccataa

SEQ ID NO: 30733 - protein, 98 aa, Methylococcus capsulatus str. Bath
MQLSISGHHIDVTDALKNYTIGKFRRLERHFNQLFDVHVILSVEKLLQKAEATVQVAGTQLFAEDVQEDLYAAIDGLVDKLDRQILKHKEKLNDHGRP

SEQ ID NO: 30734 - DNA, 351 bp, Photobacterium profundum SS9
  CDS (1)..(351)
atgacattagaaattactggtaaaaacattgatattactcctgctatccgtgaacgtctcgagtttaaattcaagaagttagagaagtttcagctaccactagtcaataagcatgtgatgattagtaaagagccaagtaagacatttaaaattgaagcatccgccgctattcctggaggaaagattgtcgcctcagcggagcacaatgacctattcggtgctatcaccgagctttatcaaaaactagaacgtcaaattaataagcaagcacacaaacctgcagcacgccgtgctagtcacagtgacaaaccagtcattgaagaagatgaagtcgaagcagtagatgcatag

SEQ ID NO: 30735 - protein, 116 aa, Photobacterium profundum SS9
MTLEITGKNIDITPAIRERLEFKFKKLEKFQLPLVNKHVMISKEPSKTFKIEASAAIPGGKIVASAEHNDLFGAITELYQKLERQINKQAHKPAARRASHSDKPVIEEDEVEAVDA

SEQ ID NO: 30736 - DNA, 294 bp, Photobacterium profundum SS9
  CDS (1)..(294)
atgtctatgcaaatcaatatcactgggcaccatgttgaagttactcaagctcttcgcgaatatgtcacgactaaatttgacaagctagagcgctttttcgataagattaataatgttcaagtgattttgaccgtagataaactacatcaaatagccgaagctaccttgcacattaatggtggtgaaatccacgcaaaagcggattctgaaaatatgtatgccgctatagactcattgactgataaactcgtccgtcaattaaacaaacataaagataagctcaacagtcactaa

SEQ ID NO: 30737 - protein, 97 aa, Photobacterium profundum SS9
MSMQINITGHHVEVTQALREYVTTKFDKLERFFDKINNVQVILTVDKLHQIAEATLHINGGEIHAKADSENMYAAIDSLTDKLVRQLNKHKDKLNSH

SEQ ID NO: 30738 - DNA, 591 bp, Lactobacillus gasseri
  CDS (1)..(591)
atgtgtaaagaaaaacgtcataagacgttggaaggagaatctacaatgttaaaatacaatgttcgtggagaaaatatcgaagttactgatgccttaagagattatgttcaaaagagattggataagctcgaaaagtacttcgaaattaattctgatgtgattgctcatatcaatttaaaagtttacccagaccacactgctaaggtcgaagtgacaattccacttccatatttagttttacgtgctgaagatacaactgatgatatgtacaagagtattgactttgtttctgaaaaattagagcgtcaaattagaaaatacaagactcgtattaatagaaagagccgtgaaaagggattgaaggacttcttctatgaagacttagaagaagaaaagaagactcctaaggaatttgatattgttcgtaacaagcacttagatttgaagccaatgaatgcagaagaagcagttttgcaaatggatttattggggcatgacttctttgtttttgaagatgcagatactaacggtacaagtattgtatatcgcagaaatgatggtcgttatggcttaattgaaactaacgaataa

SEQ ID NO: 30739 - protein, 196 aa, Lactobacillus gasseri
MCKEKRHKTLEGESTMLKYNVRGENIEVTDALRDYVQKRLDKLEKYFEINSDVIAHINLKVYPDHTAKVEVTIPLPYLVLRAEDTTDDMYKSIDFVSEKLERQIRKYKTRINRKSREKGLKDFFYEDLEEEKKTPKEFDIVRNKHLDLKPMNAEEAVLQMDLLGHDFFVFEDADTNGTSIVYRRNDGRYGLIETNE

SEQ ID NO: 30740 - DNA, 546 bp, Leuconostoc mesenteroides subsp. mesenteroides ATCC 8293
  CDS (1)..(546)
atgttagattacaatgtacgtggtgaaaatatcacagtcacagatgcaattcgtgaatatgtggaaaaacgcttgacgaaattaaatcgttatatcgaagaaaatgccaaggccaacgttaacttgcgcacatacaagtctgacaattctggtaaggttgaagtaactattgtgttgccttacgtagttttgcgagctgaagatactaatcaagatttatacgcagctgttgataatgtttctgaaaaagtagaacgacaaattcgtaagtataagacaaagatcaatcgtaaatccagagaaactggatttaaaggtattgattcgaagggtgaaattcctgaagaagaggtagatgattctgctctacaaattgttcgtactaagcaggttgatttgaaacctatgtcacctgaggaagctgccttgcaaatggatttactaggacatgtgttctttatcttcaaagatgcagagtcaaatactgattcagtaatctataagcgggctgatggaaagtatggcttgcttgaaacagctgaatga

SEQ ID NO: 30741 - protein, 181 aa, Leuconostoc mesenteroides subsp. mesenteroides ATCC 8293
MLDYNVRGENITVTDAIREYVEKRLTKLNRYIEENAKANVNLRTYKSDNSGKVEVTIVLPYVVLRAEDTNQDLYAAVDNVSEKVERQIRKYKTKINRKSRETGFKGIDSKGEIPEEEVDDSALQIVRTKQVDLKPMSPEEAALQMDLLGHVFFIFKDAESNTDSVIYKRADGKYGLLETAE

SEQ ID NO: 30742 - DNA, 309 bp, Azotobacter vinelandii
  CDS (1)..(309)
atgcaagtcaacatcagtggacatcaactggatgtgaccgacgccctgcgcgactatgtcgaggagaagatcagccggctcgaacgccatttcgaccgcatcaccagtgtccaggtgatcatgacggtcgagaagctcaagcaaaagatcgaagcgaccctgcatgtctccggcgccgaagtggtcgccaatgccgagcacgaagacatgtatgcggccatcgatctgctggccgacaagcttgatcgccaactgatcaagcacaaggaaaagcagatcgaacgccagcagggcgcaacggcccgctga

SEQ ID NO: 30743 - protein, 102 aa, Azotobacter vinelandii
MQVNISGHQLDVTDALRDYVEEKISRLERHFDRITSVQVIMTVEKLKQKIEATLHVSGAEVVANAEHEDMYAAIDLLADKLDRQLIKHKEKQIERQQGATAR

SEQ ID NO: 30744 - DNA, 645 bp, Nostoc punctiforme PCC 73102
  CDS (1)..(645)
atgaagcttgtcatccacagcaaaaatattgaaatcaccgatgcgattcgggaatatgtacatcaaaagattgaaaaagcagctagtcactttcagagcatcacaaatgaagtggatgtgcatcttagcgtagcccgtaatcctcggattaatactagacaagcagctgaagtaactatttacgctaatggcagcgttatccgtgccgaggaaagtagcgaaaatctatatgccagcattgacttagtagcagataaaattgcccgtcaactgcggaaatataaagaacgccgtcaagatcagaaaactcagtcccaaccaacagaagtagttgttgcagagtcggtagtcccagatttaattggcgatcgcactcctgaattgcccaacgaagtcgtccgcaccaaatacttttccatgccaccgatgacccttgcagaagccctggaacaactgcaacttgtgggacacgacttttatatgttccgcaattctgaaactggagagattaatgtaatttacgaacgcaaccacggcggttatggtgtgattcatccccgcaatggtaacggtcatactaacggcaagaatggcaagtcaagccacactaatattgccatgccggaaaagtcgcattctaaatag

SEQ ID NO: 30745 - protein, 214 aa, Nostoc punctiforme PCC 73102
MKLVIHSKNIEITDAIREYVHQKIEKAASHFQSITNEVDVHLSVARNPRINTRQAAEVTIYANGSVIRAEESSENLYASIDLVADKIARQLRKYKERRQDQKTQSQPTEVVVAESVVPDLIGDRTPELPNEVVRTKYFSMPPMTLAEALEQLQLVGHDFYMFRNSETGEINVIYERNHGGYGVIHPRNGNGHTNGKNGKSSHTNIAMPEKSHSK

SEQ ID NO: 30746 - DNA, 318 bp, Haemophilus somnus 2336
  CDS (1)..(318)
atgactctaaatatcacaagtaaacaaatggaaatcacccctgcaatccgttcacatatagaggaaagacttgctaaattaggaaaatggcaaactcaattgattaatccgcattttattttaaataaagtaccgcagggttttgctgttgaagttgccataggtacgccttatggcgatttatttgcaagtagcgagtctgatgatatgtacaaagcaattaacgaagttgaagaaaaattagaaagacaattgaataaattacaacataaaggagaagctcgccgagctagtgaaagactaaaagacttgttttga

SEQ ID NO: 30747 - protein, 105 aa, Haemophilus somnus 2336
MTLNITSKQMEITPAIRSHIEERLAKLGKWQTQLINPHFILNKVPQGFAVEVAIGTPYGDLFASSESDDMYKAINEVEEKLERQLNKLQHKGEARRASERLKDLF

SEQ ID NO: 30748 - DNA, 315 bp, Actinobacillus pleuropneumoniae serovar 1 str. 4074
  CDS (1)..(315)
atgacaatcaatatttcaagcaaacaaatggatgtaacccctgcaattcgtactcatattgaagaacgcttagcgaaactcgaaaaatggcaaactcagttaatcaatccgcattttatgatccataaattgccgaatagttatgaagttgaagcgtctatcggtaccccggtcggagaactttttgcgaaggcaaataacgaagatttatatttagcgattaatgaagtcgaaaccaaactcgaaacgcaattaaataaattagtacataaaaatgaagcgcgtcgtacggacagtactttaaaaaacgtttaa

SEQ ID NO: 30749 - protein, 104 aa, Actinobacillus pleuropneumoniae serovar 1 str. 4074
MTINISSKQMDVTPAIRTHIEERLAKLEKWQTQLINPHFMIHKLPNSYEVEASIGTPVGELFAKANNEDLYLAINEVETKLETQLNKLVHKNEARRTDSTLKNV

SEQ ID NO: 30750 - DNA, 327 bp, Dechloromonas aromatica RCB
  CDS (1)..(327)
atgaatctgcagattagtggtcaccacatcgaagttacccccgccctgcgcgaatacgtcgaaaacaagctggatcccgtggtccgtcatttcgacaaggtaaccggcgttagcgtcgttttgtccgtcgaaaagctgaagcagaaagcggaagtgactgtgcacgtgccaggcaaggacatgcatgccgaagagtccggcgacgacctgtacgctgccattgatgcgctgttcgacaagctggaccgccaagttcagaaatacaagcaaaaggttcaggatcaccatcgcggtgacaagccgggactgattgacgctgctgaataa

SEQ ID NO: 30751 - protein, 108 aa, Dechloromonas aromatica RCB
MNLQISGHHIEVTPALREYVENKLDPVVRHFDKVTGVSVVLSVEKLKQKAEVTVHVPGKDMHAEESGDDLYAAIDALFDKLDRQVQKYKQKVQDHHRGDKPGLIDAAE

SEQ ID NO: 30752 - DNA, 354 bp, Ralstonia eutropha JMP134
  CDS (1)..(354)
atgaacttcaagatcagtggacaccacctggacatcacgcctccgctgcgtgagtacgtggaaacgaagctggagcgtatcgtcaggcatttcgatcaagtcattggcgttagcgtgctactttcagtcgataaccataaggaaaaggacaggcggcagtacgcggaaatcaatctgcaccttcggggcaaggacatctttgttgaagcccatcacgaagacctgtatgcggccatcgacgcacttgtcgacaagctggaccgccaggtgcttcgctacaaggatcgcgtgcaaggccacgaccgcgaagcggtcaagtaccagatggccgaagcgcaactacagcagcaatga

SEQ ID NO: 30753 - protein, 117 aa, Ralstonia eutropha JMP134
MNFKISGHHLDITPPLREYVETKLERIVRHFDQVIGVSVLLSVDNHKEKDRRQYAEINLHLRGKDIFVEAHHEDLYAAIDALVDKLDRQVLRYKDRVQGHDREAVKYQMAEAQLQQQ

SEQ ID NO: 30754 - DNA, 564 bp, Exiguobacterium sp. 255-15
  CDS (1)..(564)
atgatctacaacattcgcggtgaaaacttggacgtcacagatgctctcaaggattacgtcgagaaaaagcttgaaaagttaactcgttattttacaactcctacggaagcgcaaacggcttatgtcaatctcaaagtcaacaatgagaagcaaaaagtcgaagtgacgattccaatgccaaacctcttgctacgggcggaggatgtcaatggcgatatgtacgcagccatcgacctcgtcgtcgataagcttgaacgccaaatccggaaacataaaacgaagatcaaccggagaggccgtgccaaagatggcggtattggggagtacttcaaaacgctcgaaggaccggaggcagaagcacctgtctacgaagaggatgaagcggaactcgaactcgttcgaacaaaacgtttcacactcaagccgatggatacggaagaagcgattcttcaaatggatatgctcggtcacacgttcttcgtcttctcagacgcagaaacgggtaacacgaacgtcgtttaccgtcggaaagacggccgttacggcttaattgaaccagaataa

SEQ ID NO: 30755 - protein, 187 aa, Exiguobacterium sp. 255-15
MIYNIRGENLDVTDALKDYVEKKLEKLTRYFTTPTEAQTAYVNLKVNNEKQKVEVTIPMPNLLLRAEDVNGDMYAAIDLVVDKLERQIRKHKTKINRRGRAKDGGIGEYFKTLEGPEAEAPVYEEDEAELELVRTKRFTLKPMDTEEAILQMDMLGHTFFVFSDAETGNTNVVYRRKDGRYGLIEPE

SEQ ID NO: 30756 - DNA, 381 bp, Psychrobacter sp. 273-4
  CDS (1)..(381)
atgaatgtttctatcagtggtcaccatatcagtattaccgatgccatggacaccgcagttcgcgaaaaacttgaaaaagtagagcgtcactttgatcggattcaaagtcttcaagtgattctatcgctagataacagcggtgctaaaaagagccataaggctgaagctatcatgcgagtctcgggtaaagagatgtttgttcaagctcttgatgatgatatgtataaagccataaatgagatggcagacaaacttgatagacaagtacgcaaatataaaaccaaattggagagtaaaaagacacagggtgctgggcgtgatggacgctatgaagatttgatgacggctgaagcagagcctgcagtagaggctgcagtttag

SEQ ID NO: 30757 - protein, 126 aa, Psychrobacter sp. 273-4
MNVSISGHHISITDAMDTAVREKLEKVERHFDRIQSLQVILSLDNSGAKKSHKAEAIMRVSGKEMFVQALDDDMYKAINEMADKLDRQVRKYKTKLESKKTQGAGRDGRYEDLMTAEAEPAVEAAV

SEQ ID NO: 30758 - DNA, 309 bp, Pseudomonas syringae pv. syringae B728a
  CDS (1)..(309)
atgcaagtcaacatcagtggacaccaactggaagtgaccaaaccccttcgtgaatacgttgagctcaagctcaagaagctcgaggggcattttgacaagattaccaacgtgcaggtcacgatgacggtcgaaaagctcaagcagaagatcgaagccacgttgcacatccatggtggagaggtcgttgccaatgctgaacatgatgacatgtatgctgccatcgacctgctcactgacaagctagaccgacaattgctcaagcataaggaaaagcagcaaagcatcctcaaaggtgcggccgctcgctaa

SEQ ID NO: 30759 - protein, 102 aa, Pseudomonas syringae pv. syringae B728a
MQVNISGHQLEVTKPLREYVELKLKKLEGHFDKITNVQVTMTVEKLKQKIEATLHIHGGEVVANAEHDDMYAAIDLLTDKLDRQLLKHKEKQQSILKGAAAR

SEQ ID NO: 30760 - DNA, 543 bp, Bacillus cereus G9241
  CDS (1)..(543)
atgaaattcaacattcgtggtgaaaatattgaagtaactccagcattaaaggaatatgtagagaaaaaactaagtaagttagagcgttattttgatacattcccagagattaaagttaatttaaaagtatactctgacaagcaacgtgtcgaggtaacaattccatttactgatttattacttcgtgcagaagaaactaatagcgatatgtacgctgctatcgatttagtagttgataaacttgagcgacaaattcgtaaacataaaacaaaggtaaatcgtaagttgcgtgagaaaggttctatgaaaacaaactttatccttccagaagcagtagctgttctggatgaggtagaagaggatcaactagagcttgtacgtacaaaacgattcgatttaaaaccgatggacgttgaggaagcgattctacaaatggatatgctaggacataatttcttcgtcttcacaaatgctgatacaaatgaaactaatgttgtatatggccgtaaagatgggaaatatggtttaatcgaaactaaataa

SEQ ID NO: 30761 - protein, 180 aa, Bacillus cereus G9241
MKFNIRGENIEVTPALKEYVEKKLSKLERYFDTFPEIKVNLKVYSDKQRVEVTIPFTDLLLRAEETNSDMYAAIDLVVDKLERQIRKHKTKVNRKLREKGSMKTNFILPEAVAVLDEVEEDQLELVRTKRFDLKPMDVEEAILQMDMLGHNFFVFTNADTNETNVVYGRKDGKYGLIETK

SEQ ID NO: 30762 - DNA, 345 bp, Rubrivivax gelatinosus PM1
  CDS (1)..(345)
atgaacctgacgatcagcggacaccatctcgaagtgacgccttctctgcgtgagtatgtacttacaaagctagatcgggtcactcgacatttcgatcaggtcgtcgacatcaatgtcctgctgagcgtcgagaagcagaaggagaaggagaagcggcagaaggccgaggtcaacgtgcacgtcaagggcaaggacatcttcgtcgaatcggcccacgaggacctgtacgccgccatcgacgagctgatggacaagctcgaccgccaagtctgccgccacaaggacaaggtgcaggaccaccaccacgcctcggccaagcgcctcgatgcaccagatctgcagtaa

SEQ ID NO: 30763 - protein, 114 aa, Rubrivivax gelatinosus PM1
MNLTISGHHLEVTPSLREYVLTKLDRVTRHFDQVVDINVLLSVEKQKEKEKRQKAEVNVHVKGKDIFVESAHEDLYAAIDELMDKLDRQVCRHKDKVQDHHHASAKRLDAPDLQ

SEQ ID NO: 30764 - DNA, 354 bp, Ralstonia metallidurans CH34
  CDS (1)..(354)
atgaacttcaagatcagtggacaccacctcgacatcacgccgccgctgcgtgagtatgtggaaacgaaactggagcgaattgtcagacatttcgatcaggtcattggcgtaagcgtgctgctatccgtagacaaccataaggaaaaggacaagcgtcagtacgcggaaatcaacctgcacctcaagggcaaggacatcttcgtcgaagcgcatcatgaagacctttatgctgcaatcgactgcctggtcgacaagctcgaccgccaggtgatccgctacaaggaccgcgtgcaagggcatgaccgggaagcggtcaagtaccagatggccgccgaacaactacaacaacaataa

SEQ ID NO: 30765 - protein, 117 aa, Ralstonia metallidurans CH34
MNFKISGHHLDITPPLREYVETKLERIVRHFDQVIGVSVLLSVDNHKEKDKRQYAEINLHLKGKDIFVEAHHEDLYAAIDCLVDKLDRQVIRYKDRVQGHDREAVKYQMAAEQLQQQ

SEQ ID NO: 30766 - DNA, 519 bp, Geobacter metallireducens GS-15
  CDS (1)..(519)
atggagcagagcgatgccctcaagggctacgctgccgaaaaactggaaagggttaagaaatatattgacgaacccattaccgcacaggtcttcctcaccgtggagaaaatccgccacatggccgaggtgaccctgaccgcaaagggagtcaccatcaaggccgccgaagaaactaacgacatgtacgctgccattgacgctgtcgtggacaagatcgagcgccagctccggcggtataaggagcgccttaagaaccacaagccggccgtcgacaatcgagccctcgaagtgcagaagaccatccttactgccgagagtatcgaccagcagcaagagccggttattgtccgcagcaagaccataaccatcaagccgatgtccgtcgaggaggcggttatgcagatggatctcctccacaaggacttcctcgttttcaccgattccaccaccgaagtcatcaatgtcgtctaccgtcgcaaggacggaaactacggtctcatagagccgtcgcgcaaataa

SEQ ID NO: 30767 - protein, 172 aa, Geobacter metallireducens GS-15
MEQSDALKGYAAEKLERVKKYIDEPITAQVFLTVEKIRHMAEVTLTAKGVTIKAAEETNDMYAAIDAVVDKIERQLRRYKERLKNHKPAVDNRALEVQKTILTAESIDQQQEPVIVRSKTITIKPMSVEEAVMQMDLLHKDFLVFTDSTTEVINVVYRRKDGNYGLIEPSRK

SEQ ID NO: 30768 - DNA, 534 bp, Clostridium thermocellum ATCC 27405
  CDS (1)..(534)
atgagattcaaagttgtcggaaaaaacattgtcgtaactgaagctttaaaagaagcggctgttaaaaaagtcggaaaactggacaagtacttccgtcgcgatgctgaagcaacaatcacaatgagcgtgcagaaaaacaggcacatagtggaagttacaatacccttcgaaggaggattgctcagagctgaagaagacagtccggatatgtacgcttcaatcgacaaagttatagacagtctcgaaagacagataagaagaaacaagaccaaacttgaaaagaaagtccatgacggcagcttaaggtttgaaaacattaaatttgatgatgatgaagtcgaagaagaaccaaaatttgaagttgtaagaacgaaaaaatttgccataaaacccatgacggttgaagaagctattttgcaaatgaaccttttgggacatcaattctttatgttctccaatgctgaaaccaatgaagcaaatgtggtatacaggagaaaagacggaaattatggtttgattgaaccggaattttaa

SEQ ID NO: 30769 - protein, 177 aa, Clostridium thermocellum ATCC 27405
MRFKVVGKNIVVTEALKEAAVKKVGKLDKYFRRDAEATITMSVQKNRHIVEVTIPFEGGLLRAEEDSPDMYASIDKVIDSLERQIRRNKTKLEKKVHDGSLRFENIKFDDDEVEEEPKFEVVRTKKFAIKPMTVEEAILQMNLLGHQFFMFSNAETNEANVVYRRKDGNYGLIEPEF

SEQ ID NO: 30770 - DNA, 555 bp, Pediococcus pentosaceus ATCC 25745
  CDS (1)..(555)
atgcttgattttaatgtacgtggtgaaaatattgaggtaacagaagcaattcgggattatgttgagaaacgaattggtaagattgaaaaatactttgaacaaggtgccaatccaaaggctcacgttaacttgaaagtataccaagacaaaacggctaaggttgaagtaacgattccattgccatacttggtattacgagcagaagaaacttcgcctgatttatatgcgagtgttgacttagtaactgataaattggaacgtcaactacgtaaatacaaaacaaaaattaaccgcaaatcgcgtgaaacaggatacaaaggggttgaaatccctagtggtgatattgtagagaacgaagaggaagccagtcaatttgatatcgttcgtactaaacaagtatccttgaaaccaatgggaagtgaagaagcaatcttgcaaatggacatgctaggacataacttctttatctatgaagatgcagaaagtggatcagttgatattgtttatcgccgtcgcgatggacgctatggtttgatcgaatctgctaacgattag

SEQ ID NO: 30771 - protein, 184 aa, Pediococcus pentosaceus ATCC 25745
MLDFNVRGENIEVTEAIRDYVEKRIGKIEKYFEQGANPKAHVNLKVYQDKTAKVEVTIPLPYLVLRAEETSPDLYASVDLVTDKLERQLRKYKTKINRKSRETGYKGVEIPSGDIVENEEEASQFDIVRTKQVSLKPMGSEEAILQMDMLGHNFFIYEDAESGSVDIVYRRRDGRYGLIESAND

SEQ ID NO: 30772 - DNA, 528 bp, Moorella thermoacetica ATCC 39073
  CDS (1)..(528)
atggaattaatcatccgcggcaaaaaccttccggtcaccgacgctttacggcagtacatcgctaagaggttgggtaaaatcgaacgctacctggatggtgtcgatgagatccaggtcaacctggccgtgaccagggataaacacgtggtcgaagtgactattcccctgaacgggtatatcctgcggggcgaggaagccacgggggatatgtatggttccgtcgacctggtggttgaaaaattagagaaacagatcgccaaatataaaacccggcttaataaaaaaataaagaacgggaccattaaagaatttgctgccggccagccggaggaagaaaacgggcctgaaccgcgcttgatccgaaccaagcgttttcccatcaagcccatgccggtggaggaagccatcctgcagatgaatctcctgggccacagcttctttgtcttttccaatgcggaaaccgaggaagtcaacgtcctttaccgccgccgggacggtaattacggcttgatcgaaccggagtattaa

SEQ ID NO: 30773 - protein, 175 aa, Moorella thermoacetica ATCC 39073
MELIIRGKNLPVTDALRQYIAKRLGKIERYLDGVDEIQVNLAVTRDKHVVEVTIPLNGYILRGEEATGDMYGSVDLVVEKLEKQIAKYKTRLNKKIKNGTIKEFAAGQPEEENGPEPRLIRTKRFPIKPMPVEEAILQMNLLGHSFFVFSNAETEEVNVLYRRRDGNYGLIEPEY

SEQ ID NO: 30774 - DNA, 336 bp, Thiobacillus denitrificans ATCC 25259
  CDS (1)..(336)
atgaatttgacgatttccggccatcacctggaagtgaccccagccatccgcaactacgtttccgagaagctcgaccgcgtcaagcgccacttcgaccacgtcatcaacgtcaccgtgatcatgcaggtcgaaaaactggtccacaaggtcgaggccacgctgcacgtcaagggacatgatttccatgcccgcggcgaagacggcaacatgtacgccgcgatcgatttcctcgccgacaaactcgatcgccagatcgtcaagcacaaggaaaaactgtccgaggtccatcaggaagctggcggcctcaagcaccagccgaccgaaaacccggcctga

SEQ ID NO: 30775 - protein, 111 aa, Thiobacillus denitrificans ATCC 25259
MNLTISGHHLEVTPAIRNYVSEKLDRVKRHFDHVINVTVIMQVEKLVHKVEATLHVKGHDFHARGEDGNMYAAIDFLADKLDRQIVKHKEKLSEVHQEAGGLKHQPTENPA

SEQ ID NO: 30776 - DNA, 330 bp, Polaromonas sp. JS666
  CDS (1)..(330)
atgaacttgacgatcagcggtcaccatcttgaagttacccccgcgctgcgcggttatgtgacaagcaagctggatcgaattacccggcacttcgaccaggtagtagatgtaaaagtcctgttgacagtggacaacatgaaggaaaaggaaagacgccagcgggccgaatgcaatgtgcatgtcaagggccgcgatctgtttgccgagagttctcacgctgatctttacgccgccgttgatgaattgactgacaagcttgaccgtcaggtcgggcgctacaaaaccaaaaccaaggatcaccaccacgttgccgccaagcgacaagcctga

SEQ ID NO: 30777 - protein, 109 aa, Polaromonas sp. JS666
MNLTISGHHLEVTPALRGYVTSKLDRITRHFDQVVDVKVLLTVDNMKEKERRQRAECNVHVKGRDLFAESSHADLYAAVDELTDKLDRQVGRYKTKTKDHHHVAAKRQA

SEQ ID NO: 30778 - DNA, 288 bp, Vibrio alginolyticus
  CDS (1)..(288)
atgcaaatcaatattcaaggccatcacgttgatcttaccgattcaatgcaagactatgtaaattctaagtttcagaagctcgaaaggttcttcgaccatatcaatcaagtacatgttgtactaaaagttgaaaaaatcactcaaatcgcggaagctacgcttcatataaatcaaggcgaaatccacgcatcagctgatgacgaaaatatgtatgccgcgatcgattcgctggtagataaattggttcgccaactcaataagcacaaagaaaaactaaacagtcattaa

SEQ ID NO: 30779 - protein, 95 aa, Vibrio alginolyticus
MQINIQGHHVDLTDSMQDYVNSKFQKLERFFDHINQVHVVLKVEKITQIAEATLHINQGEIHASADDENMYAAIDSLVDKLVRQLNKHKEKLNSH

SEQ ID NO: 30780 - DNA, 309 bp, Pseudomonas stutzeri
  CDS (1)..(309)
atgcaagtcaagatcagcggtgttcatctggaagtaaccgacgccctgcgtgactacatcgaggagaaattcgagcgtcttgcccgtcatttcgaccgcatcatcagtgtccaggtgattctccaggtcgagaagctcaagcagaaagccgaagcaactctgcacgtcgccggccgcgaagtagtggccatcgccgaacacgaagacatgtacgctgccatcgacctgctcgccgacaagcttgatcgtcagctgatcaagcacaaggaaaagcagctcgaccacactcagggcgccgtcacccgctga

SEQ ID NO: 30781 - protein, 102 aa, Pseudomonas stutzeri
MQVKISGVHLEVTDALRDYIEEKFERLARHFDRIISVQVILQVEKLKQKAEATLHVAGREVVAIAEHEDMYAAIDLLADKLDRQLIKHKEKQLDHTQGAVTR

SEQ ID NO: 30782 - DNA, 312 bp, Pseudomonas aeruginosa
  CDS (1)..(312)
atgcaagtcaacatcagtggccatcaactggatgtgaccgacgccctgcgcgactatgtcggcgagaaactgagccgtctggagcgccatttcgacaagatcaccaatgttcaggtgatcatggaggtcgagaaactgaagcagaagatcatcgaagccaccctgcgcatcgccggtggcgagatcgtagccaatgcggaacatgaggacatgtacgcggccatcgacctgctgatcgacaaactcgaccgtcaactgatcaaacacaaagagaagtatctcgaacggcagcagggcgtaggcgcccgctga

SEQ ID NO: 30783 - protein, 103 aa, Pseudomonas aeruginosa
MQVNISGHQLDVTDALRDYVGEKLSRLERHFDKITNVQVIMEVEKLKQKIIEATLRIAGGEIVANAEHEDMYAAIDLLIDKLDRQLIKHKEKYLERQQGVGAR

SEQ ID NO: 30784 - DNA, 333 bp, Pseudomonas fluorescens
  CDS (1)..(333)
atgcactggcaacgaaggagaagctgtatgcaagtcaacatcagtggacaccaactcgaagtgactgaacccctgcgcgtctacatcggcgaaaaactcgaccggctggagaggcacttcgacaagattaccaatgtgcaggtcaccatggctgtcgagaagctgaagcagaaaatcgaagccaccctgcacatccacggtggggaggtcgttgccaacgcagaacatgacgatatgtatgccgcaatcgacctgctcacggacaagcttgaccgccaactgaaaaagcataaggaaaagcaactccaccttctccaaggcacgggtcgctaa

SEQ ID NO: 30785 - protein, 110 aa, Pseudomonas fluorescens
MHWQRRRSCMQVNISGHQLEVTEPLRVYIGEKLDRLERHFDKITNVQVTMAVEKLKQKIEATLHIHGGEVVANAEHDDMYAAIDLLTDKLDRQLKKHKEKQLHLLQGTGR

SEQ ID NO: 30786 - DNA, 288 bp, Vibrio fischeri
  CDS (1)..(288)
atgcaaataaacatcgcaggtcaaaacgtcgaactaaccgatagccttcgtgagtatgtgaataccaaattccaaaaattagagcgtttttttgaacacattaataatgtacatgttgtattaaaattagaaaaagtacaacatgtagcagaagcaacacttcacgtaaatcaaggtgacatacacgctcattctgactcagaagatatgtatgcagctattgatggtttggttgataaattgatccgccaactcaataaacataaagaaaaactaagtagtcattaa

SEQ ID NO: 30787 - protein, 95 aa, Vibrio fischeri
MQINIAGQNVELTDSLREYVNTKFQKLERFFEHINNVHVVLKLEKVQHVAEATLHVNQGDIHAHSDSEDMYAAIDGLVDKLIRQLNKHKEKLSSH

SEQ ID NO: 30788 - DNA, 309 bp, Pseudomonas stutzeri
  CDS (1)..(309)
atgcaagtcaacatcagcggtgttcatctggaagttaccgatgccctgcgtgactacatcgaggagaaattcgaccgactggcccgtcatttcgaccgcatcatcagcgtccaagtggtcctgcaggtcgagaaactcaagcagaaagccgaagccaccctgcacgtcgccggccgcgaagtggtgggcaatgccgaacacgaagacatgtacgctgccgtggacctgctggtcgacaagctcgaccgtcagctgatcaagcacaaggagaagcagctcgaccacacccagggtgccgtcacccgctga

SEQ ID NO: 30789 - protein, 102 aa, Pseudomonas stutzeri
MQVNISGVHLEVTDALRDYIEEKFDRLARHFDRIISVQVVLQVEKLKQKAEATLHVAGREVVGNAEHEDMYAAVDLLVDKLDRQLIKHKEKQLDHTQGAVTR

SEQ ID NO: 30790 - DNA, 558 bp, Lactobacillus delbrueckii
  CDS (1)..(558)
atgttaaagtacaatgttcgtggcgaaaatattgaagtcactgaagctttgagagactatgttgaaaagcgcttgaccaagttggaaaagtactttgatctgagccaggacgtaatcgctcatgtaaatctgaaggtataccgtgaccactcagctaaggttgaagtaaccattccgcttccatacctggttttgagagctgaagaaactacggatgacatgtaccgcagcattgactttgtttccgaaaagcttgaacgccaaatcagaaagtacaagacccgcgtcaaccgcaagagccgtgaaaagggcgttgaagaattcttcatccctgaagatgctccggttgaagaggagaaggtagaaaaggctccaatgttcaagattgtccgcaacaagcgggttaacttgaagccaatggacccagaagaagccatcttgcaaatggacatgctggaacacgacttcttcgtcttccaagacgctgaaaccaacggcaccagcgtggtttaccgccgcaacgacggcagctacggtttgattgaaactaacgaatag

SEQ ID NO: 30791 - protein, 185 aa, Lactobacillus delbrueckii
MLKYNVRGENIEVTEALRDYVEKRLTKLEKYFDLSQDVIAHVNLKVYRDHSAKVEVTIPLPYLVLRAEETTDDMYRSIDFVSEKLERQIRKYKTRVNRKSREKGVEEFFIPEDAPVEEEKVEKAPMFKIVRNKRVNLKPMDPEEAILQMDMLEHDFFVFQDAETNGTSVVYRRNDGSYGLIETNE

SEQ ID NO: 30792 - DNA, 393 bp, Alcaligenes eutrophus
  CDS (1)..(393)
atgaacttcaagatcagtggacaccacctcgacatcacgccgccgctgcgtgagtatgtggaaacgaaactggagcgaattgtcagacatttcgatcaggtcattggcgtaagcgtgctgctatccgtagacaaccataaggaaaaggacaagcgtcagtacgcggaaatcaacctgcacctccagggcaaggacatcttcgtcgaagcgcatcatgaagacctttatgctgcaatcgactgcctggtcgacaagctcgaccgccaggtgatccgctacaaggaccgcgtgcaagggcatgacgggaagcggtcaagtaccagatggccgccgaacaactacaacaacaataagttggcggcgacaccaggtcgccccttagaggatagatag

SEQ ID NO: 30793 - protein, 130 aa, Alcaligenes eutrophus
MNFKISGHHLDITPPLREYVETKLERIVRHFDQVIGVSVLLSVDNHKEKDKRQYAEINLHLQGKDIFVEAHHEDLYAAIDCLVDKLDRQVIRYKDRVQGHDGKRSSTRWPPNNYNNNKLAATPGRPLEDR

SEQ ID NO: 30794 - DNA, 288 bp, Vibrio harveyi
  CDS (1)..(288)
atgcaaatcaatattcaaggccatcacgttgatcttaccgattcaatgcaagaatatgttgactctaagtttcaaaagctcgagcggttcttcgaccacatcaatcaagtccatgtcgtattaaaagttgaaaaacttaaccaaatagccgaagctacgctccacatcaatcaaggcgaaatccacgcgtcatcgaacgacgaaagtatgtatgcagcaattgattcgctggtggataaattagttcgtcaacttaacaagcacaaagaaaaactaaacagtcattaa

SEQ ID NO: 30795 - protein, 95 aa, Vibrio harveyi
MQINIQGHHVDLTDSMQEYVDSKFQKLERFFDHINQVHVVLKVEKLNQIAEATLHINQGEIHASSNDESMYAAIDSLVDKLVRQLNKHKEKLNSH

SEQ ID NO: 30796 - DNA, 558 bp, Lactococcus lactis
  CDS (1)..(558)
atgatcaaatttaatatccgtggcgaaaacgtcgaagtgaccgatgcaatccgcgcttatgttgaagacaaaatcggaaaactcgataaatatttcaacgatggtcatgaagtaacagcctatgttaatcttaaagtttacactgaaaaacgagctaaagttgaagtaactcttccagccaaaaatgtaactctccgtgcagaagacacttcacaagatatgtactcatcgattgattttgttgaagaaaaactcgaacgtcaaattcgtaaatacaagacacgtatgaaccgtaaaccacgtaatgctgtcccaactggacaagtttttggtgatgaatttgctccattagatacaactgatgaagttgctgaggatcacgtagatattgtacgaactaaacatgttgctttaaaaccgatggatgctgaagaagcagtacttcaaatggacatgttaggtcatgatttctacgtctttacagatgctgacagtaatggaacacatgtcgtttaccgtcgtacagatggtcgttatggcttaattgaaacagaataa

SEQ ID NO: 30797 - protein, 185 aa, Lactococcus lactis
MIKFNIRGENVEVTDAIRAYVEDKIGKLDKYFNDGHEVTAYVNLKVYTEKRAKVEVTLPAKNVTLRAEDTSQDMYSSIDFVEEKLERQIRKYKTRMNRKPRNAVPTGQVFGDEFAPLDTTDEVAEDHVDIVRTKHVALKPMDAEEAVLQMDMLGHDFYVFTDADSNGTHVVYRRTDGRYGLIETE

SEQ ID NO: 30798 - DNA, 288 bp, Shewanella violacea
  CDS (1)..(288)
atgcacataaacctaactggacaccatatagagatcacgacatcgctaagacattatgtcgaagaaaagttcactaagctcgaacgacatttcgatcagatcaataatgtgcacgttattttaaatgttcaaaaaatgcagcaaaaagccgaagctaaactccaccttgccggtggtgaggttttcgccatgtcagagaatgctgacatgtatgccgcaatagactccctgattgataagctcgaccgtcaggttattaaacacaaagagaagctaacaaagcattaa

SEQ ID NO: 30799 - protein, 95 aa, Shewanella violacea
MHINLTGHHIEITTSLRHYVEEKFTKLERHFDQINNVHVILNVQKMQQKAEAKLHLAGGEVFAMSENADMYAAIDSLIDKLDRQVIKHKEKLTKH

SEQ ID NO: 30800 - DNA, 342 bp, Acinetobacter genomosp
  CDS (1)..(342)
atgcaaattacaatccgtggacatcacttaagtattacaccagcaatagaagaaaatattcgagatcgatttacccagatgaccaagcatattgatcaggtcaatagtatgcaggtcaagctgagtaaagatcatcaattggataaaagatcaaaaaaaggcagtgcaaatcatattgctgaggcaattgttcgtttgccgggtatagagcttttcgcccaagcgagcgctgatgatatgtataatgcgattacaaaattgacagataaattaaaaaggcaattagataagcatcggaaaatgcagttggattatcaaccaatggaaattttagcgacataa

SEQ ID NO: 30801 - protein, 113 aa, Acinetobacter genomosp
MQITIRGHHLSITPAIEENIRDRFTQMTKHIDQVNSMQVKLSKDHQLDKRSKKGSANHIAEAIVRLPGIELFAQASADDMYNAITKLTDKLKRQLDKHRKMQLDYQPMEILAT

SEQ ID NO: 30802 - DNA, 393 bp, Alcaligenes eutrophus
  CDS (1)..(393)
atgaacttcaagatcagtggacaccacctggacatcacgccccctctgcgtgagtacgtggaaacgaagctggagcgaatcgtcaggcatttcgatcaagtcattggcgttagtgtgctgctctctgtcgacaaccacaaggaaaaggaccggcgtcagtacgcggaaatcaatctacatctcaagggcaaggacatctttgtcgaagcgcatcacgaagacctgtatgcagcgatcgacgcactcgtcgacaagctggaccgtcaggtgatccgctacaaggatcgcgtgcaaggccacgacgcgaagcggtcaagtaccagatggccgcagcgcaaatgcagcaatgaccgtgcccggcagccccgcagcgggctgctgaatcaggattga

SEQ ID NO: 30803 - protein, 130 aa, Alcaligenes eutrophus
MNFKISGHHLDITPPLREYVETKLERIVRHFDQVIGVSVLLSVDNHKEKDRRQYAEINLHLKGKDIFVEAHHEDLYAAIDALVDKLDRQVIRYKDRVQGHDAKRSSTRWPQRKCSNDRARQPRSGLLNQD

SEQ ID NO: 30804 - DNA, 324 bp, Azotobacter vinelandii
  CDS (1)..(324)
atgcaagtcaacatcagtggacatcaactggatgtgaccgacgccctgcgcgactatgtcgaggagaagatcagccggctcgaacgccatttcgaccgcatcaccagtgtccaggtgatcatgacggtcgagaagctcaagcaaaagatcgaagcgaccctgcatgtctccggcgccgaagtggtcgccaatgccgagcacgaagacatgtatgcggccatcgatctgctggccgacaagcttgatcgccaactgatcaagcacaaggaaaagcagatcgaacgccagcagggccaacggcccgctgactctcctgtcccatga

SEQ ID NO: 30805 - protein, 107 aa, Azotobacter vinelandii
MQVNISGHQLDVTDALRDYVEEKISRLERHFDRITSVQVIMTVEKLKQKIEATLHVSGAEVVANAEHEDMYAAIDLLADKLDRQLIKHKEKQIERQQGQRPADSPVP

SEQ ID NO: 30806 - DNA, 612 bp, Bradyrhizobium japonicum
  CDS (1)..(612)
atgactctccgcatttcgggaaagagcgtcagtgtcggcgaggccctgcgcggccgcgtttccgaccggaccgaagaggtcctgcgcaaatatttcgacggcaattattccggccacatcacgctgagcaaggatggcttcggcttccggaccgattgcgcgctgcatctcgattcgggaattacgctggaggccgattcgaacgcgccggatgcctatgccagcgccgaccaggcgctcgtgatgatcgagaagcggctcaagcgctacaagagccggctcaaggaccgctcggcccgcaaggcccatgtcgcctccgccgctctcgcggccatggacgccaccagctacgtgctggaagcgccgggcgagggtgaggacgaggacgaggtcaccggctacagcccggtgatcatcgccgaggcaaccacctcgctgaagcagctgtcggtcagcgaagccgtcatggaactcgacctcagcggggcaccctgcctggtgttccagcatggctccagcggccgggtgaacatcatttaccgccgggccgacggcaatgtgggctgggtcgacccgcccggaggcaaggcagatggcaaagcgggcggttag

SEQ ID NO: 30807 - protein, 203 aa, Bradyrhizobium japonicum
MTLRISGKSVSVGEALRGRVSDRTEEVLRKYFDGNYSGHITLSKDGFGFRTDCALHLDSGITLEADSNAPDAYASADQALVMIEKRLKRYKSRLKDRSARKAHVASAALAAMDATSYVLEAPGEGEDEDEVTGYSPVIIAEATTSLKQLSVSEAVMELDLSGAPCLVFQHGSSGRVNIIYRRADGNVGWVDPPGGKADGKAGG

SEQ ID NO: 30808 - DNA, 288 bp, Escherichia coli
  CDS (1)..(288)
atgcagctcaacattaccggaaataacgtcgagatcaccgaggcactgcgcgaatttgttacagctaaatttgccaaacttgagcaatattttgaccgaatcaaccaggtctatgttgttctgaaagtggagaaagtcacccacacctcagatgcaacactgcatgtaaacggtggtgaaattcatgccagcgcggaaggtcaggacatgtacgctgccattgatggcttaattgataagctggcacgccagttgaccaaacataaagataaactgaaacaacactaa

SEQ ID NO: 30809 - protein, 95 aa, Escherichia coli
MQLNITGNNVEITEALREFVTAKFAKLEQYFDRINQVYVVLKVEKVTHTSDATLHVNGGEIHASAEGQDMYAAIDGLIDKLARQLTKHKDKLKQH

SEQ ID NO: 30810 - DNA, 288 bp, Salmonella typhimurium
  CDS (1)..(288)
atgcagctcaatatcaccggacataatgtcgaaattactgaagccctgcgtgaatttgtgacgacaaaattcgccaaacttgaacagtattttgagcggattaatcaggtatacgtggtgttgaaagtggagaaggtcacgcacatctcggatgcgacgctacacgttaacggcggcgaaattcacgccagcgcggaaggccaagatatgtatgccgccattgacggcttgattgataaactggcaaggcagttaaccaggcataaagataaactgaaacaacactaa

SEQ ID NO: 30811 - protein, 95 aa, Salmonella typhimurium
MQLNITGHNVEITEALREFVTTKFAKLEQYFERINQVYVVLKVEKVTHISDATLHVNGGEIHASAEGQDMYAAIDGLIDKLARQLTRHKDKLKQH

SEQ ID NO: 30812 - DNA, 576 bp, Deinococcus radiodurans
  CDS (1)..(576)
gtgcagatttatcagctctctggccgcaacgtcgaagtcaccgaacccatgcgcgagtacgtggaagaaaagctctcgcgcctcgaccggtacaccgaccagatcaccgacgcccgcgtgaccctgaccgtgcgtgacgtgcgcaacaacgagcggcgcaaccgggtggaagtgcagctcaatgtgcccggcggcatcattcgtgccgaggagcaccacgccgatatgtacgcggccatcgacaaggccagtgacgtgctggaacgccagctgcgcaaattcaagacccgctacatgaagcagcgccaggaaggccgccccgagcccctgcccggccccgccgaggccgaggtcaatgcccagggcagcggcgcagcaatggacgacgtgtccgaatttcaccccgaaatcgtgcgccagaagcgcttcgaactgcgcccgatgtccgccgaggacgccgtggtgcagatggaagccctcgggcacgacttctacgtctttcaggacctgcaaggccagaccggcgtggtctaccgccgccgtgacgggcactacggcctaatcggctcgagctga

SEQ ID NO: 30813 - protein, 191 aa, Deinococcus radiodurans
MQIYQLSGRNVEVTEPMREYVEEKLSRLDRYTDQITDARVTLTVRDVRNNERRNRVEVQLNVPGGIIRAEEHHADMYAAIDKASDVLERQLRKFKTRYMKQRQEGRPEPLPGPAEAEVNAQGSGAAMDDVSEFHPEIVRQKRFELRPMSAEDAVVQMEALGHDFYVFQDLQGQTGVVYRRRDGHYGLIGSS

SEQ ID NO: 30814 - DNA, 570 bp, Bacillus subtilis
  CDS (1)..(570)
atgaactataacatcagaggagaaaatattgaagtgacacccgcgttaaaggatcatgtcgagaggaagatcggcaagctggagcgctattttgaccatagcgtggatgctgatgtgaacgtcaacttgaagttttacaatgacaaggagtctaaggttgaggttacgattccgatgacagatctggcgcttcggtccgaggtgcataacgaggatatgtacaacgcaattgatctcgcaacaaacaaactggaacgtcaaatccgtaagcataaaacgaaagtaaaccgtaaattccgtgagcagggctctccaaaatatttattggcaaacggtcttggctctgatacagatattgcggttcaggatgacatagaagaggaggagagcttggacatcgtccgtcagaaacgctttaatttaaagccgatggatagtgaagaagcgatcttgcaaatgaatatgctcggccataatttctttgttttcacaaatgcggaaacaaaccttacaaatgtcgtgtaccgcagaaatgacgggaaatatggcttaattgaaccgactgaataa

SEQ ID NO: 30815 - protein, 189 aa, Bacillus subtilis
MNYNIRGENIEVTPALKDHVERKIGKLERYFDHSVDADVNVNLKFYNDKESKVEVTIPMTDLALRSEVHNEDMYNAIDLATNKLERQIRKHKTKVNRKFREQGSPKYLLANGLGSDTDIAVQDDIEEEESLDIVRQKRFNLKPMDSEEAILQMNMLGHNFFVFTNAETNLTNVVYRRNDGKYGLIEPTE

SEQ ID NO: 30816 - DNA, 25 bp, Primer
atgacaatgaacattaccagcaaac

SEQ ID NO: 30817 - DNA, 27 bp, Primer
ttactcttcttcaacttcttcgacraa

SEQ ID NO: 30818 - protein, 25 aa, consensus
  MISC_FEATURE (1)..(25): consensus for the disclosure of xaa see table XV
XXXXXXXXXXXXXXXXXXXXXXXXX

SEQ ID NO: 30819 - protein, 41 aa, consensus
  MISC_FEATURE (1)..(41): consensus for the disclosure of xaa see table XV
XXXXXXXXXXXXXXXXXXXXYXXXXXXXXXXXXXXXXXXXX

SEQ ID NO: 30820 - DNA, 1161 bp, Escherichia coli
  CDS (1)..(1161)
atgacatcggaaaacccgttactggcgctgcgagagaaaatcagcgcgctggatgaaaaattattagcattactggcagagcggcgcgaactggccgtcgaggtgggaaaagccaaactgctctcgcatcgcccggtacgtgatattgatcgtgaacgcgatttactggaaagattaattacgctcggtaaagcgcaccatctggacgcccattacattactcgcctgttccagctcatcattgaagattccgtattaactcagcaggctttgctccaacaacatctcaataaaattaatccgcactcagcacgcatcgcttttctcggccccaaaggttcttattcccatcttgcggcgcgccagtatgctgcccgtcactttgagcaattcattgaaagtggctgcgccaaatttgccgatatttttaatcaggtggaaaccggccaggccgactatgccgtcgtaccgattgaaaataccagctccggtgccataaatgacgtttacgatctgctgcaacataccagcttgtcgattgttggcgagatgacgttaactatcgaccattgtttgttagtctccggcacgactgatttatccaccatcaatacggtctacagccatccgcagccattccagcaatgcagcaaattccttaatcgttatccgcactggaagattgaatataccgaaagtacgtctgcggcaatggaaaaggttgcacaggcaaaatcaccgcatgttgctgcgttaggaagcgaagctggcggcactttgtacggtttgcaggtactggagcggattgaagcgaatcagcgacaaaacttcacccgatttgtggtgttggcgcgtaaagccattaacgtgtctgatcaggttccggcgaaaacgacgttgttaatggcgaccgggcaacaagccggtgcgctggttgaagcgttgctggtactgcgcaaccacaatctgattatgacccgtctggaatcacgcccgattcacggtaatccatgggaagagatgttttatctggatattcaggccaatcttgaatcagcggaaatgcaaaaagcattgaaagagttaggggaaatcacccgttcaatgaaggtattgggctgttaccctagtgagaacgtagtgcctgttgatccaacctga

SEQ ID NO: 30821 - protein, 386 aa, Escherichia coli
MTSENPLLALREKISALDEKLLALLAERRELAVEVGKAKLLSHRPVRDIDRERDLLERLITLGKAHHLDAHYITRLFQLIIEDSVLTQQALLQQHLNKINPHSARIAFLGPKGSYSHLAARQYAARHFEQFIESGCAKFADIFNQVETGQADYAVVPIENTSSGAINDVYDLLQHTSLSIVGEMTLTIDHCLLVSGTTDLSTINTVYSHPQPFQQCSKFLNRYPHWKIEYTESTSAAMEKVAQAKSPHVAALGSEAGGTLYGLQVLERIEANQRQNFTRFVVLARKAINVSDQVPAKTTLLMATGQQAGALVEALLVLRNHNLIMTRLESRPIHGNPWEEMFYLDIQANLESAEMQKALKELGEITRSMKVLGCYPSENVVPVDPT

SEQ ID NO: 30822 - DNA, 1863 bp, Archaeoglobus fulgidus DSM 4304
  CDS (1)..(1863)
gtgatttctgtgaagattcttatctacggcgttggaaacatgggaaagcttttcagagacatcttctacggcaagggatactacgtcaggggatacgacatagaccagatgaagagagacacaaacagcatttcaggttttgacgtcatattcgtctgcactcccatgtatgctcttgaagaggccttagagcacataaagagggaggcgaaaaaggaggccttgcttgtggacgtttcgtctgtcaagaaggtttccgttccgctgtttgaggaatctggattcgacttcctgagcatccatccgatgcttggcggggacagcgagatttccctctcaaacgtaatagtcgttagggagtcgggaagggaggaggagaaggtaatcctcgaggagctcaggaaatgcggagccgtgctcagcaggctcgacgttgaggagcacgacaggaagatggccgagattcaggggatagctcacttcgctctcgtttcaatggccgactttctcaggtacggcaaggaagagctcaaatacgcatcaccgattttcaccgtcctctacaagctcgcaagcagaataataaaccagaactgggagatgtatttccagattcagaagaacgccgaggatgtcagggaggagtatctcagaagggctatggagttgcacgaaaaaatgaaggacagagagagcttcagagaaatcttcgagagtttgagaaaaatctacaccgactacgagtcgagcacgattatcctcgaatcctacaaagccaccaaaaaggctgaaagcatagaggagcttcgggggctgataaagtccatagactcgctgattctgaggctcatagagaggagaatcgacgcggcaaggcagattgcgaggataaagatggagcggggggagccgattgagctgaaggatgtggaggaggagaagctctgggaggttatgtcgaaaactacactgaatccggttaagctgaaggagatttttgagggaataatgagcctcgcaaaggaggaggagtacaaggtagcgggagtgaagtatacaatcgccgttctcggtcctcagggaagtttcagcgaggagatggctttgaagctcgttggctcacgcgtcccgcttcgctactgctccaccacagatgaaataatcaagctcgttgagagcggtgaggtggactacggccttgttccgatagagaactccgtcaacggaacggttttgccggtcatcgatgctctgctgaaccacgatgttgaggtcttcggagaggctaagcttgaggtcaaccactgcctcgttgcaaagagaaaaatagagctgaaggagataaaaacaatttactcccatccccaggctgtcgctcagtgcatgggcttcataaacaactacctgccgtcggttgcgataagatacacgacatcaaccagcgatgcagcgaggatgctcgatgactattcggcagcgataatgtctgagaacgccgcaaggttttacaggctgcacgtgctcagaaagggaatacaggatttgaaaggcaggaacataacgaggttctacctcataagaagaaggtcgggaaggagtgaggggaagataacctccctcttcttcggagttgaagataagccgggagcactgaaggatgtgctggaggtcttccacaaaaaggggtttaacctcagaaagctcgaatcgaggcctgccggaacgggtctgggggactacgtcttcttcgttgaggtagaggcgcctctgagggaagaggacctgttggacttgaaacaggtcacgaccttctacaaagtggttggagtttttgatgaggtcaagaggatgagcaccctctaa

SEQ ID NO: 30823 - protein, 620 aa, Archaeoglobus fulgidus DSM 4304
MISVKILIYGVGNMGKLFRDIFYGKGYYVRGYDIDQMKRDTNSISGFDVIFVCTPMYALEEALEHIKREAKKEALLVDVSSVKKVSVPLFEESGFDFLSIHPMLGGDSEISLSNVIVVRESGREEEKVILEELRKCGAVLSRLDVEEHDRKMAEIQGIAHFALVSMADFLRYGKEELKYASPIFTVLYKLASRIINQNWEMYFQIQKNAEDVREEYLRRAMELHEKMKDRESFREIFESLRKIYTDYESSTIILESYKATKKAESIEELRGLIKSIDSLILRLIERRIDAARQIARIKMERGEPIELKDVEEEKLWEVMSKTTLNPVKLKEIFEGIMSLAKEEEYKVAGVKYTIAVLGPQGSFSEEMALKLVGSRVPLRYCSTTDEIIKLVESGEVDYGLVPIENSVNGTVLPVIDALLNHDVEVFGEAKLEVNHCLVAKRKIELKEIKTIYSHPQAVAQCMGFINNYLPSVAIRYTTSTSDAARMLDDYSAAIMSENAARFYRLHVLRKGIQDLKGRNITRFYLIRRRSGRSEGKITSLFFGVEDKPGALKDVLEVFHKKGFNLRKLESRPAGTGLGDYVFFVEVEAPLREEDLLDLKQVTTFYKVVGVFDEVKRMSTL

SEQ ID NO: 30824 - DNA, 1062 bp, Thermotoga maritima MSB8
  CDS (1)..(1062)
atgaggcacaaaatcaggttgatagatttcatactgctcaggtttatcgaagagagaatgaaagtggcaagagatgtcgcaaaggaaaagaaaaagacagactctcccatcgttataagggatatagaagaacagaagataaaggagattctggacaggacagatctcaatcctgttagaatgagacgcatattcgaggaaataatgaagcttgccaaagaagaggagtacagattacttggaatttccaagacggtggccgtgctggggcccatgggaagtttcagtgatgagatggccatgaaactgataggttcaagaatacccctgaagtactgttccacaactgacgagatcatagaaatggtggaaaaaggtgaggtagattatggaatcgtgcctattgagaattccacctatggaacggtcatccctgtactggacgccttgctcaaccacgaagtggaggtgtttggtgaggcaaagctcgagatacaccactgtctcgtggcaaagaaaaaactggatctgaaggagataaaaaggatctactctcatccccaggccatatctcagtctcttggattcatcaacacgtacctttcgcacgctgagattcggtacacttcttcgacgagcgacgctgtaaacctcctggatgacgaatccgctgccatcatgtcagagagtgccgcaaagatgtatgggttactcatactgaggaggagcattcaggacttgaaagaaaagaatataacgaggttctacatcataagaaggaaaacaggaaagatggaaggaaaatacacctcccttttctttggagttcaggacagaccgggctctttgaaggcagttctggatatcttcgcaagcagaggaataaacctcagaaagctggagtcaaggcccgcaaggacgttcttgggagattacgtgttctttgtggaagttgaggcacctttgaaagaagaggatattagggacctggaaagggtcacggcgttttacaagatcataggtgtgtttgatgaggtagaagagctcgatgtgttcaaatga

SEQ ID NO: 30825 - protein, 353 aa, Thermotoga maritima MSB8
MRHKIRLIDFILLRFIEERMKVARDVAKEKKKTDSPIVIRDIEEQKIKEILDRTDLNPVRMRRIFEEIMKLAKEEEYRLLGISKTVAVLGPMGSFSDEMAMKLIGSRIPLKYCSTTDEIIEMVEKGEVDYGIVPIENSTYGTVIPVLDALLNHEVEVFGEAKLEIHHCLVAKKKLDLKEIKRIYSHPQAISQSLGFINTYLSHAEIRYTSSTSDAVNLLDDESAAIMSESAAKMYGLLILRRSIQDLKEKNITRFYIIRRKTGKMEGKYTSLFFGVQDRPGSLKAVLDIFASRGINLRKLESRPARTFLGDYVFFVEVEAPLKEEDIRDLERVTAFYKIIGVFDEVEELDVFK

SEQ ID NO: 30826 - DNA, 1176 bp, Vibrio cholerae O1 biovar eltor str. N16961
  CDS (1)..(1176)
atgacagacaaacaatactcactcgacgatattcgcttacggctaaacgaactcgacgatcaactgctaaacctgctgtcagaacgacgcaaaatgagtattgaggtcgccaaaagcaaagtcgaaaccgcgaaacctgtacgtgatccggctcgtgaacagcagctactggtaaaactcatcaatgctggcaaagagaaatatcagctcgatcctcaatacatcaccaaaattttccacaccatcattgaagattcggttttgcttcagcaatcctatctgcaaaaccttgcgaatccacaaagtcgtaagccattggctagagtcgcctttttaggcgctaaaggctcttattcacatctggcgactcgcgagtatttcagccgcaaaaatacagagctgattgagctcaactgcgaccattttaaagaggtggcaagaaccgtggaatccggccatgcggattatggtgtgctaccgattgaaaacaccagctcaggctccatcaacgaagtttacgatttgctgcagcacaccacactgtacatagtgggtgagttaacgcagccaatagagcattgcctggtggccacgcaagagattcgtttggaggatctgaaagtcctctattcccatccacagcctcaccagcagtgcagcgaatttcttagccgcttaaaaggggtcaagttagaaagttgcgccagtactgcagatgccatgaaaaaagtgcaagagctcaatcgtgcggatgtagcagcgattggcaactcagccagtggaaagctgtacggactgcaaccgattcaaggaaatattgccaaccaaaccgaaaatcacactcgctttatcgtggtggctcgtaaacccgtcgacgtttcaccacaaattccagccaaaaccaccttgattatgtcaacttcacaagaggcgggctcgctggtttcgaccttactcgtgctgcaacgttacggcattaatatgactaagctggaatcgcgtccgattatgggtaatccgtgggaagaaatgttctacgtagatttagaagcgcacattgactccgatgagatgcagcaagcgttggcagaactcactcaactgactcgacaccttaaagtgcttggctgctaccctagtgaaaacgtcaaacccactcaggtgaaattcatttag

SEQ ID NO: 30827 - protein, 391 aa, Vibrio cholerae O1 biovar eltor str. N16961
MTDKQYSLDDIRLRLNELDDQLLNLLSERRKMSIEVAKSKVETAKPVRDPAREQQLLVKLINAGKEKYQLDPQYITKIFHTIIEDSVLLQQSYLQNLANPQSRKPLARVAFLGAKGSYSHLATREYFSRKNTELIELNCDHFKEVARTVESGHADYGVLPIENTSSGSINEVYDLLQHTTLYIVGELTQPIEHCLVATQEIRLEDLKVLYSHPQPHQQCSEFLSRLKGVKLESCASTADAMKKVQELNRADVAAIGNSASGKLYGLQPIQGNIANQTENHTRFIVVARKPVDVSPQIPAKTTLIMSTSQEAGSLVSTLLVLQRYGINMTKLESRPIMGNPWEEMFYVDLEAHIDSDEMQQALAELTQLTRHLKVLGCYPSENVKPTQVKFI

SEQ ID NO: 30828 - DNA, 1164 bp, Pasteurella multocida subsp. multocida str. Pm70
  CDS (1)..(1164)
atgtctttggatttaagtgagattcgtcaacagatcacacaacttgatcgaaatttattgaaattattgtcagagcgtcatcgcttagcctttgatgtggcgcgcagtaaagaaatcacgcagaaaccccttcgtgatcttgagcgtgaacaacaattgttgcaagaactcattcaatttgctgaaaatcaaaactaccaattagaagcacaatatattaccgatatttttcagcgtattattgaagattccgttgccacacaacaagtttatttgcaaaaaaaactgaatgcgcaacgtgaacagaatatccatattgcgtttttaggcaaacgtggctcttattcacatttggcggcgagaagttatgcaacgcgttatcaagaaacctttgtggaactgagctgtcgctcatttgatgagatttttgagaaagtcagcgcaggcgaggcagattatggtgtgttacctctggaaaataccacgtcgggtgctattaatgaagtgtatgatttattgcaacataccgatctttctttagtaggtgagctggcgtatccgattcggcattgtgtcttagtgaatggacaggatgatttgaatcaaattgaaacattatatagtcatccgcaagttatccaacaatgtagccaatttattaaaggcttagaacgtgttcacattgaatattgtgaaagcagctctcatgcgatgcaattagtggcaagcttaaataagccgaatattgcagcgttaggaaatgcggatggcggggcgttatacggtttaacggtattgaaatcagatatagccaaccaacccaacaatattactcgtttcattgtggtagcgaagaaaccattgcaagtgtcaccacagattcacacgaaaacgctattgttgatgaccacatcgcaacaagcgggggcattagttgatgctttattcgtgtttaaaaagcatcaaattaatatgaccaaactggaatcacgtccaatctatggtaagccatgggaagaaatgttttatcttgaaattgaggcgaatattcataatccggagacacagcaagctttagacgagctaaaacaatatagtcattatttaaaagtattgggctgttatccaagtgaaattattaagcctgttgagctcacaccttaa

SEQ ID NO: 30829 - protein, 387 aa, Pasteurella multocida subsp. multocida str. Pm70
MSLDLSEIRQQITQLDRNLLKLLSERHRLAFDVARSKEITQKPLRDLEREQQLLQELIQFAENQNYQLEAQYITDIFQRIIEDSVATQQVYLQKKLNAQREQNIHIAFLGKRGSYSHLAARSYATRYQETFVELSCRSFDEIFEKVSAGEADYGVLPLENTTSGAINEVYDLLQHTDLSLVGELAYPIRHCVLVNGQDDLNQIETLYSHPQVIQQCSQFIKGLERVHIEYCESSSHAMQLVASLNKPNIAALGNADGGALYGLTVLKSDIANQPNNITRFIVVAKKPLQVSPQIHTKTLLLMTTSQQAGALVDALFVFKKHQINMTKLESRPIYGKPWEEMFYLEIEANIHNPETQQALDELKQYSHYLKVLGCYPSEIIKPVELTP

SEQ ID NO: 30830 - DNA, 1098 bp, Pseudomonas aeruginosa PAO1
  CDS (1)..(1098)
atggcggaccaggaccagctcaaggccttgcgcctgcgcatcgacagcctcgacgagaagttgctcgagctgatcagcgagcgtgcccgttgcgcccaggacgtggcgcgagtcaagacccagaccctgggcgagggcgaggcgccggtgttctaccgtcccgagcgcgaagcctgggtgctcaagcacatcatgcaattgaacaaggggccgctggacaacgaagaggtcgcgcggctgttccgcgagatcatgtcgtcctgcctggcgctcgagcagccgctgaaagtggcctatctcggacccgagggcacctttacccaggccgcggcactcaagcatttcggcaacgcggtgatcagcacgccgatggcggcgatcgacgaggtgttccgcgaggtcgccgccggcgcggtgaacttcggcgtggtgcctgtggaaaactccaccgagggggcggtcaaccataccctcgacagcttcctcgagcacgacatggtgatctgcggcgaagtcgaattgcgtatccaccatcacctgctggtcggcgaaaccaccaagaccgacaacatcacccggatctattcccatgcccaatccctcgcgcaatgtcgcaagtggctggactcgcactacccgagcgtcgagcgggtggcggtgtcgagcaacgccgacgcggccaagcgggtgaagagcgagtggaattcggcggcgatcgccggcgacatggcggccagcctgtacgacctgagcaagctgcacgagaagatcgaggaccgcccggacaactccacgcgcttcctgatcatcggcaaccaggaggtgccgccgaccggcgacgacaagacctcgatcatcgtttccatgcgcaacaagccgggggccctgcacgagctgctggtaccgttccacaacaatggtatcgacctgacccgcatcgaaacccgcccgtcgcgcagcggcaaatggacctacgtgttcttcatcgatttcgtcggccaccataaagaaccgctgatcaaggacgtcctggagaagatcggccaggaagccgtcgccctgaaggtcctgggctcctatccgaaagcggtgctctga

SEQ ID NO: 30831 - protein, 365 aa, Pseudomonas aeruginosa PAO1
MADQDQLKALRLRIDSLDEKLLELISERARCAQDVARVKTQTLGEGEAPVFYRPEREAWVLKHIMQLNKGPLDNEEVARLFREIMSSCLALEQPLKVAYLGPEGTFTQAAALKHFGNAVISTPMAAIDEVFREVAAGAVNFGVVPVENSTEGAVNHTLDSFLEHDMVICGEVELRIHHHLLVGETTKTDNITRIYSHAQSLAQCRKWLDSHYPSVERVAVSSNADAAKRVKSEWNSAAIAGDMAASLYDLSKLHEKIEDRPDNSTRFLIIGNQEVPPTGDDKTSIIVSMRNKPGALHELLVPFHNNGIDLTRIETRPSRSGKWTYVFFIDFVGHHKEPLIKDVLEKIGQEAVALKVLGSYPKAVL

SEQ ID NO: 30832 - DNA, 1089 bp, Neisseria meningitidis MC58
  CDS (1)..(1089)
atgtcccaaactatcgacgaactcctccttccccaccgcaacgccatcgacaccatcgatgccgaaatcctgcgcctgctcaacgaacgtgcgcaacacgcccacgccatcggcgagctgaaaggcacgggcgcagtgtaccgccccgaacgcgaagtcgccgtgttgcgccgcattcaggatttgaacaaaggcccgctgcccgacgaatcggtagcacgcctgtttcgggaagtgatgagcgagtgcctcgccgtcgaacgcccgctgaccatcgcctatctggggccgcagggcacgtttacccagcaggcggcaatcaaacatttcggacacgccgcgcacaccatggcgtgtccgaccatagacgactgcttcaagcaggttgaaacgcgtcaggcggattatctggtcgcccccgtggaaaattcgaccgaaggctcggtcggtcgcacgttagacctgcttgccgttaccgcgttgcaggcgtgcggcgaaatcgttttgcgcatccaccacaaccttttgcgtaaaaacaacggcagcaccgaaggcattgccaaagtcttttcccacgcgcaggcgttggcgcagtgcaacgactggttgggcagacacctgcccaacgccgaacggattgccgtgtccagcaatgccgaagccgcaaggctggttgccgaatcggacgacggtacggttgccgccatcgccggacgcacggcggcggaaatctacggactcgatatggttgccgagtgcatcgaagacgaaccgaacaacaccacgcgcttcttggtgatgggacatcacgaaaccggtgcaagcggcagcgacaagacttcgctggccgtttccgcgcccaaccgggcaggcgcggttgcctcgctgctgcaaccgctgaccgaatcgggtatttccatgaccaagtttgagagccgtccgagcaaatccgttttgtgggaatacctgttcttcatcgacatcgaaggacaccgccgggacgcgcagattcagacggcattggaacgcttgggcgaacgcgcttcgttcgtcaaagtcatcggttcgtacccgaccgccgttttgtag

SEQ ID NO: 30833 - protein, 362 aa, Neisseria meningitidis MC58
MSQTIDELLLPHRNAIDTIDAEILRLLNERAQHAHAIGELKGTGAVYRPEREVAVLRRIQDLNKGPLPDESVARLFREVMSECLAVERPLTIAYLGPQGTFTQQAAIKHFGHAAHTMACPTIDDCFKQVETRQADYLVAPVENSTEGSVGRTLDLLAVTALQACGEIVLRIHHNLLRKNNGSTEGIAKVFSHAQALAQCNDWLGRHLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKVIGSYPTAVL

SEQ ID NO: 30834 - DNA, 1074 bp, Campylobacter jejuni subsp. jejuni NCTC 11168
  CDS (1)..(1074)
atgccaaatttagaagaatttagaaataaaatcgatgcggttgatgataaaattttagatcttttaaatgaaagaatgacttatgttaaaagtataggtgagcttaagcaaagtagtgggggaagtatttatcgtcctgagcgtgaaagagccattatcaatcgtttaaaaaatgcaaatttaggacttttagatcaaaatgccatagaggcaatttatcaagaaatttttgcagtttcaagaaatttagaaatgcctcaaactatagcttatttagggcctgaaggaacttatacacatcaagcagcaagaagtcgttttggtgcgatgagtcgttatatagccttggctaatatcgaagatgtttttaaagagttaagcaacaaagaagcaaaatatggtgttgtacctatagaaaataataccgaaggtgcagtgggcattactttagattgtctaggtaagtataatgagcttaaaatttttggcgaaatttatatggatattcatcattcttttgtaggaattaatgaaaatttaaaagaaatcaaacgcatttattcgcatccgcaaggttataatcaatgtcgtaaatttttagaaagtcatgaacttagtgctatagaatttgttccttcaaaatctacagctaatgcagcttacctagcttcgcaagataaatatgcggcagcaatttgttctagaatagcggctaagctttataatgtgcctgtactttttgataaaatagaagataatgcagccaataaaacaagatttttaattttaagcgatattaaaaatcctaaaatgccaaattgtaaaacttctattttagcacacacagcacataaacctgggggacttagctttttattagagcagtttaaaaaagaaaatatcaatcttactaagcttgaatctcgccctgtaaaatcaaaagaatttttacacagtttttatatagattttgaagggcatattgatgatgaaaatgtaaaaaaagccttaaaagatatacaagagattgtttggcttggatcttatttatcaggagaaaaagatgaaatttaa

SEQ ID NO: 30835 - protein, 357 aa, Campylobacter jejuni subsp. jejuni NCTC 11168
MPNLEEFRNKIDAVDDKILDLLNERMTYVKSIGELKQSSGGSIYRPERERAIINRLKNANLGLLDQNAIEAIYQEIFAVSRNLEMPQTIAYLGPEGTYTHQAARSRFGAMSRYIALANIEDVFKELSNKEAKYGVVPIENNTEGAVGITLDCLGKYNELKIFGEIYMDIHHSFVGINENLKEIKRIYSHPQGYNQCRKFLESHELSAIEFVPSKSTANAAYLASQDKYAAAICSRIAAKLYNVPVLFDKIEDNAANKTRFLILSDIKNPKMPNCKTSILAHTAHKPGGLSFLLEQFKKENINLTKLESRPVKSKEFLHSFYIDFEGHIDDENVKKALKDIQEIVWLGSYLSGEKDEI

SEQ ID NO: 30836 - DNA, 1161 bp, Salmonella typhimurium LT2
  CDS (1)..(1161)
atgacatcggaaaacccattactggcgctgcgagataaaatcagcgctttagacgaagagttactggccttactggcaaaacgacgcgcgctggcgattgaagtgggacaagcaaaactactgtcgcatcgtccggttcgggatatcgatcgtgaacgcgcgctgctggacaggctcatccatctcggtaaagcccaccatctcgacgcacactacattacccgtctgttccagcttatcattgaagactccgtgcttactcagcaggcgctgctgcaacaacatctgaataatactcaccctcattcggcacgtattgcgtttcttgggccgaaaggctcctattctcatctcgcggcgcgccagtatgctgcacgccattttgagcaatttattgagagcggttgcgcaaaattcaccgatatttttcatcaggtcgaaaccggccaggccgattacgccgtggttccgatagagaacaccagctccggcgctatcaatgatgtgtacgacttattgcaacacaccagtctgtcgattgtcggtgagatgactgtcactatcgatcactgcgtgctggtttccggcgctacagatctgaataccatcgaaacggtgtacagccatccgcagccgtttcagcagtgcagtaaatttttgagccgctatccgcactggaaaatcgactataccgagagtacgtcggcagcgatggaaaaagtcgcgcaggcaaactctccgcgcgtcgcggcgctcggcagcgaggcaggcggcatgttgcacggattacaggtgctggaacgcatcgccgcaaaccagacgcagaatatcacccgctttctggtactggcgcgcaaagccattaatgtttccgatcaggttccggcaaaaaccactctgttaatcgccaccgggcagcaagctggcgcgctggtcgaagcgctgctggtgctgcgtaaccacaatctcatcatgacgaaactggagtcgcgccccattcacggcaatccgtgggaagagatgttttatctcgatattcaggcgaacctggagtcgcaggtaatgcaaagcgcgctaaaagagctgggcgagatcacgcgctcaatgaaagtgcttggctgctatcccagcgaaaacgtcgtgccggtagaacctgcctga

SEQ ID NO: 30837 - protein, 386 aa, Salmonella typhimurium LT2
MTSENPLLALRDKISALDEELLALLAKRRALAIEVGQAKLLSHRPVRDIDRERALLDRLIHLGKAHHLDAHYITRLFQLIIEDSVLTQQALLQQHLNNTHPHSARIAFLGPKGSYSHLAARQYAARHFEQFIESGCAKFTDIFHQVETGQADYAVVPIENTSSGAINDVYDLLQHTSLSIVGEMTVTIDHCVLVSGATDLNTIETVYSHPQPFQQCSKFLSRYPHWKIDYTESTSAAMEKVAQANSPRVAALGSEAGGMLHGLQVLERIAANQTQNITRFLVLARKAINVSDQVPAKTTLLIATGQQAGALVEALLVLRNHNLIMTKLESRPIHGNPWEEMFYLDIQANLESQVMQSALKELGEITRSMKVLGCYPSENVVPVEPA

SEQ ID NO: 30838 - DNA, 1116 bp, Ralstonia solanacearum GMI1000
  CDS (1)..(1116)
atgaccagtcagtcagacgaaacgagtcaaaacaaggacgccgcattggcggcggagctggcacccctgcgcgcgcagatcgatgccatcgacagccaactgctcaccctgctgtcggaccgcgccaaggtggcgcaggccgtgggcgaggtgaagaagcactatgcgtcgccggcattccggccggaccgcgagctgcaggtcatccgcaagatgcagtcgggcaatccggggccgctgcacggcgagagcatcgcggccatctggcgcgaggtgatgtcggcatgccggggcctggagcaggcgctgcgcattggctatctcggcccggtgggcacgttcacggagcaagccgtgttcgcgcacttcggccacgagatccagccgatgccgtgcccgagtatcgacgaggtgttccgcgcggcagaggccggcacggtcgattgcggtgtggtgccggtcgagaattcgaccgagggcgtggtgtcgcgcacgctcgatctgttcttgcagacgtcgctgaagatcagcggcgagatcgcgctgcgggtgcaccacaacctgctgcacaagaccggcgacatgtcgcaggtgaaggtggtgcgggcgcatgcgcaggcgctggcgcagtgccagcgctggctcaacacgaactacccgaacctggcgcgcgaggcggtgtcgagcaacgccgaggccgcgcgcatggccggcgaagacgagaccgtcgccgcgctggcgagcgtgcaggcggccaaccgctatgggctgcacgtggtgcgggccaacgtggaggacgacccgcacaaccgcacacgcttcgtggtgatcggcaactacgagaccgagccgagcgggcgcgaccagacctcgctgatcctctcggtgccgaatgaggccggggcggtctaccggctgctggcgccgctcgccgagaacggcgtgtcgatgtgccgcttcgagtcgcggccggcgcgcagcggcgcgtgggagtactacttctacgtcgacgtggaaggccaccagcgcgacccgcaggtggcgcgcgcgctggagaagctgcgccacgacgccgcgtatttcaaagtgctggggtcctatccctcggcacactga

SEQ ID NO: 30839 - protein, 371 aa, Ralstonia solanacearum GMI1000
MTSQSDETSQNKDAALAAELAPLRAQIDAIDSQLLTLLSDRAKVAQAVGEVKKHYASPAFRPDRELQVIRKMQSGNPGPLHGESIAAIWREVMSACRGLEQALRIGYLGPVGTFTEQAVFAHFGHEIQPMPCPSIDEVFRAAEAGTVDCGVVPVENSTEGVVSRTLDLFLQTSLKISGEIALRVHHNLLHKTGDMSQVKVVRAHAQALAQCQRWLNTNYPNLAREAVSSNAEAARMAGEDETVAALASVQAANRYGLHVVRANVEDDPHNRTRFVVIGNYETEPSGRDQTSLILSVPNEAGAVYRLLAPLAENGVSMCRFESRPARSGAWEYYFYVDVEGHQRDPQVARALEKLRHDAAYFKVLGSYPSAH

SEQ ID NO: 30840 - DNA, 1221 bp, Xanthomonas campestris pv. campestris str. ATCC 33913
  CDS (1)..(1221)
ttgaaggaaagccccccgatggctcccaagcccaagaacaccaacgccgctggcggcaccgccaagtcggctaccaaggccagcagcaagaaagccaccaagttggctggcaaggacagcgccaagccactggcaaccgctgccccagtgctggccgatgtgcgtgccaagatcgacgagatcgaccgtggcatccaggcgttgatcgccgagcgcgccaacttcgcgcatcaggtcggcaaggccaagggcaagctggcagcggcggtggattactaccgccccgagcgcgaagcgcaggtgctgcgcatggtggtggaccgcaacgaaggaccactcagcgatgaagtgctggtgcatgtgttccgcgaaatcatgtctgcgtgccttgcgcagcaggagccgctgaagatcgggtatctcggcccggaaggcaccttcagccagcaggcggtgctcaagcatttcggccggtcggcggtgggtctgccgatggcgaccatcgaagaagtgtttcaggaagtggaagccggcaatgccgatttcggcgtggtgccggtagaaaattccggccagggcacgatccaggtcacgctggacatgttcctcacctccaacctcaagatctgcggcgaagtcgagttgcgtgtgcatcagtacctgctttcgcgcaacgggcgcctggaagacatcgaacgcatctacgcgcattcgcagtcgtttgcgcagaccgccggctggctgcgttcgcacttgcccaaggtggaaaagattgcggtctccagcaatgccgaaggcgcgcgccgtgcgcgtaatgccgaggacgcggcggccatcggtggcgaaagcgccgcgcacgtgtatggcttgaaaaaagtcatcatgaaatcgatcgaggacgacgacgacaacaccacgcgctttctggtgatcggccggcagatctttccatcgtccgggcatgaccggacctcggtgctggtgttcatccacgacaagccgggcgcgttgttcgatgtactcagcccgttcgcgcggcatggcatcagcatgaaccgcatcgagtcgcggccgtcgcaccaggccaagtgggaatacggcttctttatcgacctggccggccatgtggaggacgagtcgatgaaacaggcactggccgaactggaagcgcattcggcacagatcaaggtgctgggctcgtatccggtcgccattccctga

SEQ ID NO: 30841 - protein, 406 aa, Xanthomonas campestris pv. campestris str. ATCC 33913
MKESPPMAPKPKNTNAAGGTAKSATKASSKKATKLAGKDSAKPLATAAPVLADVRAKIDEIDRGIQALIAERANFAHQVGKAKGKLAAAVDYYRPEREAQVLRMVVDRNEGPLSDEVLVHVFREIMSACLAQQEPLKIGYLGPEGTFSQQAVLKHFGRSAVGLPMATIEEVFQEVEAGNADFGVVPVENSGQGTIQVTLDMFLTSNLKICGEVELRVHQYLLSRNGRLEDIERIYAHSQSFAQTAGWLRSHLPKVEKIAVSSNAEGARRARNAEDAAAIGGESAAHVYGLKKVIMKSIEDDDDNTTRFLVIGRQIFPSSGHDRTSVLVFIHDKPGALFDVLSPFARHGISMNRIESRPSHQAKWEYGFFIDLAGHVEDESMKQALAELEAHSAQIKVLGSYPVAIP

SEQ ID NO: 30842 - DNA, 1209 bp, Xanthomonas axonopodis pv. citri str. 306
  CDS (1)..(1209)
atggcccccaagtccaacaagcccacggccgccacaggcggcaacaaaaagccgaccaagacagcgacgagtgcttcagccggcaagcctgcaaacacgccggctgaaaaggccgcgatcaagaccgccgcgccggtgctggccgatgtgcgtgccaagatcgacgagatcgaccgcaatatccaggcgctgattgccgagcgcgccaacttcgcgcatcaggtcggcaaggccaagggcaagcttgcggcggcggtggattactaccgccccgagcgcgaggcgcaggtgctgcgcatggtggtggaccgcaacgaaggcccgctcagcgacgaagtgctggtgcacgtctaccgcgaaatcatgtcggcgtgcctggcccagcaggagccgctgaagatcggttatctcggcccggaaggcaccttcagccagcaggcggtgctcaagcatttcggccgctcggcggtgggcttgccgatggcgaccatcgaagaagtgttccaggaagtggaggcaggcaatgccgacttcggcgtggtgccggtggaaaattcggggcagggcaccatccaggtcaccctggacatgttcctgacctccaacctgaaaatctgcggcgaagtcgagctgcgagtgcatcaatatctgctctcgcgcaacggccggctggaagatatcgaacgcatctacgcgcattcgcagtcgttcgcgcagaccgcgggttggttgcgctcgcatttgcccaaggtggaaaagatcgcagtgtccagcaacgccgaaggcgcacgccgcgcacgcaatgctgaagatgccgcggccatcggcggcgaaagcgcagcgcatgtgtatggcttgaagaaagtcatcatgaagtcgatcgaggacgacgacgacaacaccacgcgcttcttggtgatcgggcggcagatctttccttcgtccgggcacgaccgcacgtcggtgctggtgttcatccacgacaagccgggtgcgttgttcgacgtgctcagcccattcgcacgccacggcatcagcatgaaccgcatcgaatcgcggccctcgcatcaggccaagtgggaatacggcttcttcatcgatctgatcggccatgtcgaagacgatgcgatgaagcaggcgctggccgaactgaaagcgcactcggcacagatcaaggtgctgggttcgtatccggtggccattccctga

SEQ ID NO: 30843 - protein, 402 aa, Xanthomonas axonopodis pv. citri str. 306
MAPKSNKPTAATGGNKKPTKTATSASAGKPANTPAEKAAIKTAAPVLADVRAKIDEIDRNIQALIAERANFAHQVGKAKGKLAAAVDYYRPEREAQVLRMVVDRNEGPLSDEVLVHVYREIMSACLAQQEPLKIGYLGPEGTFSQQAVLKHFGRSAVGLPMATIEEVFQEVEAGNADFGVVPVENSGQGTIQVTLDMFLTSNLKICGEVELRVHQYLLSRNGRLEDIERIYAHSQSFAQTAGWLRSHLPKVEKIAVSSNAEGARRARNAEDAAAIGGESAAHVYGLKKVIMKSIEDDDDNTTRFLVIGRQIFPSSGHDRTSVLVFIHDKPGALFDVLSPFARHGISMNRIESRPSHQAKWEYGFFIDLIGHVEDDAMKQALAELKAHSAQIKVLGSYPVAIP

SEQ ID NO: 30844 - DNA, 1107 bp, Leptospira interrogans serovar Lai str. 56601
  CDS (1)..(1107)
atgatctactcgaagatgagtgatttagatcagcaattaaaaatctttagagatcagatcgattctttggatcgagaaatcgtaaagtctatccagactcgtgcagagtttgcgtctaagatcggagagattaaaagagaaagaaacgagccggtcttccgaccagatagagaaaaggaagtttacgaaaagataaagtcttttagccccggtccacttccagacaaagtgttgcttgcaatttaccgtgaaatcatgtccggttctatttccgtagaaaaaggattagagattggttatttaggaccggcaggttctttttccaatcaggcggttcgttctcgttttggagcttcgatcaacgctttagagttcaattcgattccagacgtttttcgcgccgtagaaaccgataaaatcgattacggagttgtgcctgtggaaaattccagcgaaggtttagtcaactccactttagaccaatttttagtttccgatcttctgatttactcggaacactatttaagaatcaatatcagcctacttggattggaacatgatctttctaagattaaaacgttatacggaatcaaaatcgccaattctcagtgtaaaaattggatcgccgccaatcttcctcacgtagaaatcgtagaaacttcttctactgccaaagcggctcaaatcgtagcggaaaaaaaagacgcctgtgccgcagttgcttcttccatcgctgcggaaatctatgggctcagtctgattcgcgaatctatcgaagatcttcctgataatactacccgctttttgatcataggaaaaaatcaatgtcctcctacggggaatgataaaacttcgatcgttttttcctgccccgataaaccgggtgcactttatcgtgtactaaaacctttttttgattatcaactcaatttgagcaaaatagaatccagacccacaagaagaaactcctgggaatataacttttttatagactttcacggtcatcaaaaggatccatcgatccaaaacgttctcgccggtctgaaagaaaatactatttttttgagagtactcggttcttatccgatgtctccgcaaaacctgtga

SEQ ID NO: 30845 - protein, 368 aa, Leptospira interrogans serovar Lai str. 56601
MIYSKMSDLDQQLKIFRDQIDSLDREIVKSIQTRAEFASKIGEIKRERNEPVFRPDREKEVYEKIKSFSPGPLPDKVLLAIYREIMSGSISVEKGLEIGYLGPAGSFSNQAVRSRFGASINALEFNSIPDVFRAVETDKIDYGVVPVENSSEGLVNSTLDQFLVSDLLIYSEHYLRINISLLGLEHDLSKIKTLYGIKIANSQCKNWIAANLPHVEIVETSSTAKAAQIVAEKKDACAAVASSIAAEIYGLSLIRESIEDLPDNTTRFLIIGKNQCPPTGNDKTSIVFSCPDKPGALYRVLKPFFDYQLNLSKIESRPTRRNSWEYNFFIDFHGHQKDPSIQNVLAGLKENTIFLRVLGSYPMSPQNL

SEQ ID NO: 30846 - DNA, 2016 bp, Shewanella oneidensis MR-1
  CDS (1)..(2016)
atgcaaaaaccacagcctttaaatcacactcgagaacaaattacccagctcgacaatgatcttctctcattactcgccgaacgtcgccgtctaagccttgaagtggcgcgcagtaaagaggttgatgttagacccattcgcgacacccaaagggaaaaagaactactagcaagattagtgactgcagggcgggaaaaaggcttagacgcccattatgttatctcgctgtatcaaagcattatcgaagactcggtactgaatcaacaggcttatcttcacggccgtgctaaccctgaaacgcaaaaacaacagtattgtatcgcctacctcggtgcccgaggttcgtattcttaccttgccgcttctcgctactgtcaacgtcgtcaggttgagatgctcgatttaggctgccaaagtttcgatgaaattgtccaagccgttgaatcaggacacgccgactatggctttttgccaattgaaaatacctcatcgggttcaatcaacgaagtgtatgacgtactccaacataccagtctatccatcgtgggcgagacgactatcgaagtgagtcattgtctattaggtaaacccggcagcaaactcagtgagattaaaaccgtctacgcccatccgcagcccatcagtcagtgcagccgctatctcagtcaacacaaagccttaaggctagaatattgctcaagtagcgctgaagcgatggaaaaggtaaaccaatctcccgataatagcgccgccgcgattggcagcgcagagggtggcgcgctgtaccaactcgagtcgattgagtcaggccttgccaaccaaaaaattaaccaaagtcgctttattgttgtggctcgtaaagccgttgccgttcctgaacaactgcccgccaaaaccaccctaattatggccactggccaaaaggcgggggcgttggttgaagccctattggtacttaaagcgcatcagctgaatatgagtaaactcgaatcccgcccaatccctggcacaccgtgggaagaaatgttttatctggatatcgatgccaatatctccagcgaagcgatgcagcaagggctcaaacagctagaaaggatcacgcgttttatcaaagtgttaggttgttacccctgcgaaacggtaacaccaacacagctcagcaacagccaattactaattgaacctaatacctctaaagccgaagtattaagtgaagtaagcactaagcagtctccctatcgttacagtaaggcttataaagcacaggcgagtgaaattcactgcggcccttttaccattggcgcagggcatattggtgccattgccaaggtcactctgagtaaaagcctgttgcatttagagtcatcgcacgctgcggcacatattgccttatccgcgtttgagcacaaaatcaaacaactgaaagaagtaggcttccaagcggtgattttagaaggatgccagcaacttgcatcgaaagaagcaatcatccctaagctgcgacagacgctgcaccaatatgatttgctttgtgtgattgccatcgagcaagcggcggatatgccgctggcaactgagcatgccgatatgttgttcttaaccggtaagcagatgtttaatcaggccttgctgactcaggctgggacgctacccataccattattccttgagcgcaacgatatggccagttacgaggagtttttggcggcaacggaaaccattttaagccaaggtaaccaacaacttatactatgtgactcgggcattcgtacctacaacaatgccaatttacccaccttggacttagcaagtcttattctaatcaaggcaaatagccacttaccgattgtgattaatccttgttatgccattaacgaagatgcattggtgctgcaaacccaaggtattaagcagttaaaagctgatggcatagtgcttaattacgccctcgaagaggacaaagcccatcattcacttgcgcttatgggcgaagttgtcagggagctgtatcgctaa

SEQ ID NO: 30847 - protein, 671 aa, Shewanella oneidensis MR-1
MQKPQPLNHTREQITQLDNDLLSLLAERRRLSLEVARSKEVDVRPIRDTQREKELLARLVTAGREKGLDAHYVISLYQSIIEDSVLNQQAYLHGRANPETQKQQYCIAYLGARGSYSYLAASRYCQRRQVEMLDLGCQSFDEIVQAVESGHADYGFLPIENTSSGSINEVYDVLQHTSLSIVGETTIEVSHCLLGKPGSKLSEIKTVYAHPQPISQCSRYLSQHKALRLEYCSSSAEAMEKVNQSPDNSAAAIGSAEGGALYQLESIESGLANQKINQSRFIVVARKAVAVPEQLPAKTTLIMATGQKAGALVEALLVLKAHQLNMSKLESRPIPGTPWEEMFYLDIDANISSEAMQQGLKQLERITRFIKVLGCYPCETVTPTQLSNSQLLIEPNTSKAEVLSEVSTKQSPYRYSKAYKAQASEIHCGPFTIGAGHIGAIAKVTLSKSLLHLESSHAAAHIALSAFEHKIKQLKEVGFQAVILEGCQQLASKEAIIPKLRQTLHQYDLLCVIAIEQAADMPLATEHADMLFLTGKQMFNQALLTQAGTLPIPLFLERNDMASYEEFLAATETILSQGNQQLILCDSGIRTYNNANLPTLDLASLILIKANSHLPIVINPCYAINEDALVLQTQGIKQLKADGIVLNYALEEDKAHHSLALMGEVVRELYR

SEQ ID NO: 30848 - DNA, 1095 bp, Pseudomonas syringae pv. tomato str. DC3000
  CDS (1)..(1095)
atgtccgagcaagaactcaaggcgcttcgcgtccgtatcgacagcctcgacgagaaggtcctggagctgatcagtgagcgcgctcgctgtgctcaggaagtggccagggtgaagatgtcttcgctggcagaaggcgaagtgcctgtgttctatcgcccggaacgcgaagcggcggtgcttcggcgggtcatggatcgcaatcgcggccccttgagcaatgaagagatggcgcggctgtttcgcgaaatcatgtcgtcttgcctggccctcgagcagccgctcaaggtcgcctatctcgggcctgagggtacgttcacccaggccgccgccatgaagcacttcggccatgcggttatcagtctgccgatggctgccatcgatgaagtgttccgtgaagtggttgcgggtgcggtgaactttggcgtggtcccggtggaaaactccaccgaaggcgcggtcaaccacacgctggacagctttcttgagcacgacatggtcatctgtggcgaagtcgagttgcgcattcaccatcatttgctggtcggtgagagcaccaagacgcaaagcatttcgcgtatctattcccacgcgcaatcgctggcccagtgccgcaaatggctggacgcccattatccgaacgtcgagcgtgttgccgtggccagcaacgccgaagccgccaagcgggtcaagggcgaatggaactcggcggccattgctggcgatatggcggcaggtctttatggtctgacccgcctggcggaaaagatcgaagaccgcccggacaactctacgcgcttccttatcatcggcaatcaggaagtcccgccaaccggtgacgacaagacctcgatcattgtttcgatgagcaacaagccgggtgcgctgcacgaattgctggtgcctttccatgagaatggtctggacctgacacgtatcgaaacccgtccgtcgcgcagtggcaagtggacctacgtgtttttcatcgacttcgtcggccatcaccaggacccgctggtcaaagccgtactggaaaaaatcagcagtgaagccgttgccttgaaggtgctgggttcctacccgaaagcggttctttga

SEQ ID NO: 30849 - protein, 364 aa, Pseudomonas syringae pv. tomato str. DC3000
MSEQELKALRVRIDSLDEKVLELISERARCAQEVARVKMSSLAEGEVPVFYRPEREAAVLRRVMDRNRGPLSNEEMARLFREIMSSCLALEQPLKVAYLGPEGTFTQAAAMKHFGHAVISLPMAAIDEVFREVVAGAVNFGVVPVENSTEGAVNHTLDSFLEHDMVICGEVELRIHHHLLVGESTKTQSISRIYSHAQSLAQCRKWLDAHYPNVERVAVASNAEAAKRVKGEWNSAAIAGDMAAGLYGLTRLAEKIEDRPDNSTRFLIIGNQEVPPTGDDKTSIIVSMSNKPGALHELLVPFHENGLDLTRIETRPSRSGKWTYVFFIDFVGHHQDPLVKAVLEKISSEAVALKVLGSYPKAVL

SEQ ID NO: 30850 - DNA, 1179 bp, Vibrio parahaemolyticus RIMD 2210633
  CDS (1)..(1179)
atgactgaccaacctatttcccttgaagaaattcgtttacgcttgaatgagctcgatgaccagctccttagcttgctgtctgaacgccgtaaactcagcattgaagtagccaaaagcaaagtacaaacctcaaaaccagttcgtgatgccgttcgagaacaacaactgttggttaagctgatttccaacggccgagacaaatacgaactcgacgctcagtacatcaccaaacttttccacaccatcattgaagattcggtcttacttcaacaaggttatctgcaaaaccttgtgaacccacaacaaagccgcaagccacttgcacgcgtcgctttcttgggagccaaaggttcttactcgcacttggcaagccgcgaatatttcagtcgtaaaaataccgagcttatcgagctaaattgtgagcatttcaaagaagtgactcgaacggtggaatctggccatgctgattacggtgtgctgcccatcgaaaacaccagctcgggctcgatcaatgaagtatatgacctactacaacacaccacgctgtatattgttggtgagctgactcaacctatcgagcactgcttagttgcaacgaaagacattcgcctcgaagacatcaaaacactgtactcgcatccgcaaccgcaccaacagtgcagcgaattcttaagccgtatgaaaggcgtgaaacttgagtcttgcgcaagcacagcagacgcgatgcaaaaagtccaagagatgaatcgtgatgatgtggccgcaattggtaatgcttcaagtggtaagttgtacggcctgcaagcgatccaaggcaacatcgcaaaccaaaccgaaaaccacacacgctttattgtcgtcgcgcgtaaaccagttgaagtctcaacacaaattccagccaaaacgacgttgattatgtcgacctcccaggaagcgggctcattggttgaaactctactggtactgcaacgctacggcatcaatatgactaagttagaatcgcgtccaatcatgggtaatccgtgggaagaaatgttctacgttgatctagaagcgcacctaggctcaaccgaaatgcagcaagcattgcaagagctaacaaaaatcactaaacacttgaaagtactgggttgttatccaagcgaaaacatcaaaccaacgcaagttaaattgagctaa

SEQ ID NO: 30851 - protein, 392 aa, Vibrio parahaemolyticus RIMD 2210633
MTDQPISLEEIRLRLNELDDQLLSLLSERRKLSIEVAKSKVQTSKPVRDAVREQQLLVKLISNGRDKYELDAQYITKLFHTIIEDSVLLQQGYLQNLVNPQQSRKPLARVAFLGAKGSYSHLASREYFSRKNTELIELNCEHFKEVTRTVESGHADYGVLPIENTSSGSINEVYDLLQHTTLYIVGELTQPIEHCLVATKDIRLEDIKTLYSHPQPHQQCSEFLSRMKGVKLESCASTADAMQKVQEMNRDDVAAIGNASSGKLYGLQAIQGNIANQTENHTRFIVVARKPVEVSTQIPAKTTLIMSTSQEAGSLVETLLVLQRYGINMTKLESRPIMGNPWEEMFYVDLEAHLGSTEMQQALQELTKITKHLKVLGCYPSENIKPTQVKLS

SEQ ID NO: 30852 - DNA, 1068 bp, Nitrosomonas europaea ATCC 19718
  CDS (1)..(1068)
atgacagaacagcttaaacaactgcgcaatgaaatcgatgcagtcgatgatgagttgctccgattgatcagcactcgcgcgcggcttgcacagcaagtcggccgacagaagtccggcactgcttatcgtcctgagcgtgaatcacagattttttcccgtttgcagcaatccaatccggggccgttgcgagatgagcatattgtgcacctgtttactgaaatcatatcggtttgccgtgcgctggaagagcccttgactgttgcttatctggggccgcagggcacattttcggaagaagcggttaccaaacgttttggcagtgctgttacttcactgccttgcagttcgatcgacgatatttttcgcaaggtcgaatccggcgctgccagctatggtgtcgttccggttgaaaattctaccgagggagcagtcggtagaaccatggatctgctgttgcagacaccgttgaagatatgtggcgagctcgagctgcctgtacaccagtgcctgatggcacaacagactgatctgaccgctattcgaaaaatttattctcacccgcagtcatttgcacaatgtcaggtatggatcaacgagaatttgcaaagtctgacggctgtcgaccggatcgatgccgccagtaatgcagatgctgcccgtcaggctgccgccgacagcagtgccgcagccattgccggaaagaaggctgccgaagtattcgggctgaaagtttgtgccgctaacattgaggataatccgaataacacaactcgatttctggtcattggcagtcgggatgttgcgcgttccgggagggataaaacttcactcgccatggctacgcataaccggcccggtgcggtgcacgagcttcttgcaccctttgcacgctatcaggtcagtatgacccgtctggaatcacgtccttcgcgtgccagtctgtgggagtatgttttttttaccgatattgcaggacatcaggaagatgaaaatgtagccagggcactgcaagcactgcgtgataatacaacctttctgaagattttcggttcttatcctgctgcatga

SEQ ID NO: 30853 - protein, 355 aa, Nitrosomonas europaea ATCC 19718
MTEQLKQLRNEIDAVDDELLRLISTRARLAQQVGRQKSGTAYRPERESQIFSRLQQSNPGPLRDEHIVHLFTEIISVCRALEEPLTVAYLGPQGTFSEEAVTKRFGSAVTSLPCSSIDDIFRKVESGAASYGVVPVENSTEGAVGRTMDLLLQTPLKICGELELPVHQCLMAQQTDLTAIRKIYSHPQSFAQCQVWINENLQSLTAVDRIDAASNADAARQAAADSSAAAIAGKKAAEVFGLKVCAANIEDNPNNTTRFLVIGSRDVARSGRDKTSLAMATHNRPGAVHELLAPFARYQVSMTRLESRPSRASLWEYVFFTDIAGHQEDENVARALQALRDNTTFLKIFGSYPAA

SEQ ID NO: 30854 - DNA, 1098 bp, Helicobacter hepaticus ATCC 51449
  CDS (1)..(1098)
atgcctcaaataccacaagatacgatactccaaactctccgtaatgagattgatagcattgattcggagatttttgatgctttgcaaaagcgtatggcgcttgtagcacaagtaggagcacataagaccaagcaaggcggagcaatttatcgcccagagcgagagagggaaattattgaacgtttgagtcaaagagaaagtaaatatttaaatgaacgtgccattgaggcaatttatcaagaaatttttgctatttcgcgcaatttggagttacctgaaaaagtggcatttttaggacctgtagggagttatacgcatcaggcggcagaagaacgatttggcgcaatgagcaagtatataccacttaatactatcagtgcagtttttgaatctcttgcttataaacgtgtaaaatatggcgtaataccacttgagaataatacaaatggtatggtaggtgagagtattgactttttagcatattatgattttaaaattattgcagaaatcattttgcctattcatcatagttttttgagtagctgtgagcatttgagcgaagtgaaaaagattttttctaaagatattgcatttgggcaatgtcaaaaatttcttcacgcacataatcttcatcatattgaacagattcctacagattcaacagcacgtgctgtgcaacttgctgctagtaacccgcaaagtgcggctattggctctaaaattgcaggaaagctttataatttgccattgatgtttgaacatattgaggattcccaaaataataaaactcgttttgtgatagtgagtgattttgcgaatgcacctagtggaaaggataaaacctctctttttgtgaatctcaaaaatgatgaccaagtaggcactttatttcgtttattgggtgattttgaaaaagagggtattaatcttacaaaaatagattcgcgtccgattcgctcaaatgagagctttaaaacaggattttttattgattgtgaggggcattaccttgataaaccattgcagcgactttttgctaagagaagtgatgaaataaaatggcttggaagttatatttttactgatattaaaaaataa

SEQ ID NO: 30855 - protein, 365 aa, Helicobacter hepaticus ATCC 51449
MPQIPQDTILQTLRNEIDSIDSEIFDALQKRMALVAQVGAHKTKQGGAIYRPEREREIIERLSQRESKYLNERAIEAIYQEIFAISRNLELPEKVAFLGPVGSYTHQAAEERFGAMSKYIPLNTISAVFESLAYKRVKYGVIPLENNTNGMVGESIDFLAYYDFKIIAEIILPIHHSFLSSCEHLSEVKKIFSKDIAFGQCQKFLHAHNLHHIEQIPTDSTARAVQLAASNPQSAAIGSKIAGKLYNLPLMFEHIEDSQNNKTRFVIVSDFANAPSGKDKTSLFVNLKNDDQVGTLFRLLGDFEKEGINLTKIDSRPIRSNESFKTGFFIDCEGHYLDKPLQRLFAKRSDEIKWLGSYIFTDIKK

SEQ ID NO: 30856 - DNA, 1164 bp, Haemophilus ducreyi 35000HP
  CDS (1)..(1164)
atgcctttaaatttatcaaacataagaactcaaattacacaattagatcacgacttactcaaactacttgctgaacgtcatcaattagcctttgatgtgctgcgtgataaacaaataaccgagatcccattacgcgatcgtacacgggaaactgaattattgaatgcattaataaaatatgctgaagcgcagcaatatgatcttgatgaagaatatatcactcaaatctttcaatgcattatgaaagattccattcttacacaacaagcctatttcaaagataatctaaaacaagaaagagaaaataataagaaaatatctatcgctttcttaggtatggctggctcttattcaagtatggctgccaagcaatttgcgaaaaaacaacaaaatgtaatgattgagctaaactgtaattcatttcaagaagtgtttgaaaaagttgaaggcgatttagcacaaattggtatcttaccattagaaaattccacctcaggctcaatcaatgaagtatacgatcttttacaacacaccaatttaactatcattgatgaaatcgtttatccgattaaacactgtattttagctaatcgagaagcaacgttagaagatattgataccatctatatgcatcccgaacacgagaaacagtgtagtcaagccttagaaaagttaggcaaaattgatattaaatattgcaaaagtagttcgcatgcaatgagtttagccgcttgtctaaataaacccaatattgcagcgttgtctagtgaagcgggcggtaaattatacgatctgactaatattaaaacgaatattaccaatcaagaacataatattactcgctttatcatcgtagcgaaaaaagccgtgcccgtttcaccacaacttcaaactaaaatattgttactgatgacaagcaaaaaacaagcgggtattttagttgatgtattaagcatttttaaacaacataaaattcgcatgctcaaattagtatcacgcccaatttatggcgaggattgggaagaaatgttttacgttgaattagaagcaaatattgattcagccaaaacccaacaagctttagctgaattgcaaaagataacgtgctacttaaaagtagtcggctgttaccctagtgaagtagtgcagccagtacagccttaa

SEQ ID NO: 30857 - protein, 387 aa, Haemophilus ducreyi 35000HP
MPLNLSNIRTQITQLDHDLLKLLAERHQLAFDVLRDKQITEIPLRDRTRETELLNALIKYAEAQQYDLDEEYITQIFQCIMKDSILTQQAYFKDNLKQERENNKKISIAFLGMAGSYSSMAAKQFAKKQQNVMIELNCNSFQEVFEKVEGDLAQIGILPLENSTSGSINEVYDLLQHTNLTIIDEIVYPIKHCILANREATLEDIDTIYMHPEHEKQCSQALEKLGKIDIKYCKSSSHAMSLAACLNKPNIAALSSEAGGKLYDLTNIKTNITNQEHNITRFIIVAKKAVPVSPQLQTKILLLMTSKKQAGILVDVLSIFKQHKIRMLKLVSRPIYGEDWEEMFYVELEANIDSAKTQQALAELQKITCYLKVVGCYPSEVVQPVQP

SEQ ID NO: 30858 - DNA, 1086 bp, Bordetella bronchiseptica RB50
  CDS (1)..(1086)
atggatgattccctgcaggacaagctgcggccgctgcgcgaccgcatcgacgccatcgacgcccagatcctcgacctgctgtcgcagcgcgcgcgcaccgcgcaggaagtgggctcggtcaagcacgccgcgcacgcggatggcccggtgctgcgccccgagcgcgaagccgaagtgatccgccgcttgcagcacagcaacccggggccgttccccaaggccgccgtggcagccgtctggaccgagatcatgtccgcgtgccgcggcctggagcgcggcatgaccgtggcctatctcgggccgcagggctcgttctccgaacaggccgcgctcgagcatttcggccattcggtgcagcagctgccgtgcccttcgttcgatgaggtgttccgtgccgtcgaggccgggcaggccgacgtcggcatggtgccggtggaaaactccaccgagggcgcggtcaaccgcagcctggacctgctgctgaacacgccgctgaccatcctgggcgagcgctcgctggtgatccgccactgcctgatgagccagtccggcacgatggacggcatcaagacgatctcggcgcatccccaggcgctggcacagtgccagggatggctgacgcgccattacccggacctcaatcgcgtggcggcggccagcaattccgaggctgcccgcgtggccgccgaggacccgacggtcgcggccatcgctggcgaagtcgccgcgccggcctggaacctgcgcgtcgtggccgccggcatccaggacgatccgcagaaccgcacgcgcttcctggctgtcggccatatcgagccattgagcagcggcaaggacaagaccagcctgatcctggccgtgcccaaccgcgccggcgccgtctatgacatgctggcgccgatggcggccaacggcgtttccatgacgcgcttcgaatcgcgcccggcgcgcacgggccagtgggaatactatttctacgtcgacgtgctgggccatcgcgatgacgcgaacgtggcccgcgcactggcggcattgcaggcgcaggtggccttcttcaaggtgctgggttcgtatccggcgcaatag

SEQ ID NO: 30859 - protein, 361 aa, Bordetella bronchiseptica RB50
MDDSLQDKLRPLRDRIDAIDAQILDLLSQRARTAQEVGSVKHAAHADGPVLRPEREAEVIRRLQHSNPGPFPKAAVAAVWTEIMSACRGLERGMTVAYLGPQGSFSEQAALEHFGHSVQQLPCPSFDEVFRAVEAGQADVGMVPVENSTEGAVNRSLDLLLNTPLTILGERSLVIRHCLMSQSGTMDGIKTISAHPQALAQCQGWLTRHYPDLNRVAAASNSEAARVAAEDPTVAAIAGEVAAPAWNLRVVAAGIQDDPQNRTRFLAVGHIEPLSSGKDKTSLILAVPNRAGAVYDMLAPMAANGVSMTRFESRPARTGQWEYYFYVDVLGHRDDANVARALAALQAQVAFFKVLGSYPAQ

SEQ ID NO: 30860 - DNA, 1074 bp, Chromobacterium violaceum ATCC 12472
  CDS (1)..(1074)
gtgtctgaagaacgtctcaagcaacaccgcaacgccatcgacgccatcgacgtcgaagtcctcaaactgctgaaccagcgcgccagccatgcccgcgagatcggagagatcaagggcggcggcgtcatctaccgcccggaacgggaggctcaggtgctgcgccggctgaaggatctgaatcccggtccgctgcccagcgagtccgtcgcccgcctgttccgcgaggtgatgtcagaatgcctggcgttggaaaagccgttgtccatcgcctacctggggccggaaggcaccttcagccagctggccaccatcaagcacttcggccacgcggcccgcgccgtggcctgtagttcgatagacgaggcgttccggctggtggagtcgcgcgcgctcgactacgtggtggcgccggtggagaattccaccgaaggcgccgtgggccgcacgctggacttgatggtgagctcgccgttgaagatctgcggcgaggtagtgctgcgcatccatcaccacctgctgcgcaaggtggagggcgtggacggcatccgccgcgtgtatgcccacgcccaggcgctggcgcaatgccatgaatggctgaacaagaacctgccggccgacgtggagcgcgtgtcggtggccagcaacgccgaggccgctcgcctggccgcggaggatgacaccgccgcggccatcgccggccaggccgctgccgaacgttacgcgctggtcaagctggcggaaaatgtcgaagacgagccgaacaataccacccgcttcctggtgctgggattgcaggatgtcggccccagcgggcaggacaagacctccatcgtggtctccgcgcccaaccggccgggtgcggtccaccagttgctggagccggtggcggccaacggcgtgtcgatgagcaagttcgagtcgcgcccatcgcgcgcggggctgtgggactacgtgttcttcatagacctggaaggccaccggcaggacgagcgcgtattgaaggcgctggctggcctgggtgagcgcacgtccttcgtcaaagtgttgggctcttatccgaccgcggtgttgtga

SEQ ID NO: 30861 - protein, 357 aa, Chromobacterium violaceum ATCC 12472
MSEERLKQHRNAIDAIDVEVLKLLNQRASHAREIGEIKGGGVIYRPEREAQVLRRLKDLNPGPLPSESVARLFREVMSECLALEKPLSIAYLGPEGTFSQLATIKHFGHAARAVACSSIDEAFRLVESRALDYVVAPVENSTEGAVGRTLDLMVSSPLKICGEVVLRIHHHLLRKVEGVDGIRRVYAHAQALAQCHEWLNKNLPADVERVSVASNAEAARLAAEDDTAAAIAGQAAAERYALVKLAENVEDEPNNTTRFLVLGLQDVGPSGQDKTSIVVSAPNRPGAVHQLLEPVAANGVSMSKFESRPSRAGLWDYVFFIDLEGHRQDERVLKALAGLGERTSFVKVLGSYPTAVL

SEQ ID NO: 30862 - DNA, 1068 bp, Wolinella succinogenes DSM 1740
  CDS (1)..(1068)
atggatttgcaaaaatttcgtgaagagattgattcggttgatgatcagattctccgactgctcaatcagcgcatggaggtggtgaagctcatcggccgccacaaaaaaatggaaggaagcgtcatctaccgccctgaaagagagcgcgagatcatcgctagactcaactccctcaatcaagggcttttgaacgaagcagcgattgaggcaatctatttagagatttttgccgtgagtcgcaatcttgaactccctgagcgtgtcgcctatctaggacctctgggaagctacacccatcaagccgccgagagtcgctttggggcgatgagcgaatacctctccatgaacaacattgcttctgtctttaaaaccgttgaatccaagcgcgccaaatacggggttgtccccatcgaaaacaacaaaaacggaatcgtgggcgagacgctcgatcttttgggcaaatcgagcctcaaaatcgtcgcagaactcaccatgcccatccatcatacctttgccacgcagtgcgattcgctcaaagagatcaggcgaatctactccaaagatatcgcctttggccaatgcctcaacttcctcagtgaatacaatcttgaagaggtggagcgcattcctgtcgattctacagccaaggcggctcagctcgccgctagcgagccccacaccgcagccatctgctcacatattgccgccaagctctatcacctgcctatcctctttgaaaacattgaggattcctcgcacaacaagactcgattcgtcattatcagcgattttaagaatcaggcgagtggctcggataaaacctccatctttgcggatatcagccacaccgataagccaggtgcgctccttggtctgctcaaagacatcagcggcctagggctcaacatgaccaaaatcgaatcacgcccacgcattgatgcagccaaagactttgccttttgcttctttatcgattttgaggggcatattgatgatgagaacgttcaagagttgctcaaaagacgaggagatgagattaagtggctggggagttatgtgagaggctag

SEQ ID NO: 30863 - protein, 355 aa, Wolinella succinogenes DSM 1740
MDLQKFREEIDSVDDQILRLLNQRMEVVKLIGRHKKMEGSVIYRPEREREIIARLNSLNQGLLNEAAIEAIYLEIFAVSRNLELPERVAYLGPLGSYTHQAAESRFGAMSEYLSMNNIASVFKTVESKRAKYGVVPIENNKNGIVGETLDLLGKSSLKIVAELTMPIHHTFATQCDSLKEIRRIYSKDIAFGQCLNFLSEYNLEEVERIPVDSTAKAAQLAASEPHTAAICSHIAAKLYHLPILFENIEDSSHNKTRFVIISDFKNQASGSDKTSIFADISHTDKPGALLGLLKDISGLGLNMTKIESRPRIDAAKDFAFCFFIDFEGHIDDENVQELLKRRGDEIKWLGSYVRG

SEQ ID NO: 30864 - DNA, 1158 bp, Photorhabdus luminescens subsp. laumondii TTO1
  CDS (1)..(1158)
atggatcaaaataatttgctgaaaatacgggaaaaagtcagcgaacttgatttaaagttactgattttattagcagagcgtcgccaattagcttttgatattgcccaaactaagttacaggataatcgccctatcagagacaaggatcgcgaacgagaactactagatgttctgattaaaaaaggaaaaagctacgggcttgatggcttttatatttctcgtctctttcagatgatcattgaagattccgtcctcactcaacaagcattattgcagcaacacctaaatcaaacaccccaagattcagcacgtattgcattcctcggtcctagaggttcctactctcatatcgcagcccgccaatatgccgcccgccatttcaatcaattaattgaatgtagctgccataagttccaggatatcttctccttggttgaaacaggccaagcggattacggaatgttacccattgaaaataccagctcgggttccatcaatgatgtttatgacttattgcaacataccaatttgtcaattgtgggagaaataaccattcctattaaccattgcctactcgttgcaacagacacaacgctatcggagatcaaaacggtttacagtcaccctcaaccattccaacaatgtagccaatatattaatcaattcccgcattggaaaattaaatattgcgaaagcactgccgcagcgatgcaaaaagtcgccgaacagaattcaccagaaattgcagcgttagggagtgaagcgggcggtgcactttatcagttacaggttctggaacagaatctcgcaaatcaatcacataatattactcgttttattattgttgcccgtcagcctatcgaagttgcagaacaagtaccggccaaaacgacatttattatggcaaccggacagcaggcaggagcactggtagatgcgctaatggtgctgaaaaaacataatattattatgagtaaactggaatcccgcccgatcaacggaaatccgtgggaagagatgttttatattgatgtccaagctaatattcgttcaattaatatgcaacacgttctgaaagcattggcgaaaatcactcattcattaaaggtattgggatgttaccctacagaaagcgtggtaccggttaacccctcctga

SEQ ID NO: 30865 - protein, 385 aa, Photorhabdus luminescens subsp. laumondii TTO1
MDQNNLLKIREKVSELDLKLLILLAERRQLAFDIAQTKLQDNRPIRDKDRERELLDVLIKKGKSYGLDGFYISRLFQMIIEDSVLTQQALLQQHLNQTPQDSARIAFLGPRGSYSHIAARQYAARHFNQLIECSCHKFQDIFSLVETGQADYGMLPIENTSSGSINDVYDLLQHTNLSIVGEITIPINHCLLVATDTTLSEIKTVYSHPQPFQQCSQYINQFPHWKIKYCESTAAAMQKVAEQNSPEIAALGSEAGGALYQLQVLEQNLANQSHNITRFIIVARQPIEVAEQVPAKTTFIMATGQQAGALVDALMVLKKHNIIMSKLESRPINGNPWEEMFYIDVQANIRSINMQHVLKALAKITHSLKVLGCYPTESVVPVNPS

SEQ ID NO: 30866 - DNA, 1077 bp, Geobacter sulfurreducens PCA
  CDS (1)..(1077)
ttgagcgcgacacgcaatctcgacgcactgcggcgcgagatcgacgccattgacgatgccatcctcgatctgctcaaccgccgtgccggactggtcatggaggtgggacaggtcaagaccgtggagaagcgcgattttcacgtgccgaaccgtgaacgggagatttacgagcggctgctcgcccacaacaccggcccctttccggccgaggcggtcaagagcgtgttccgggagatcatctccgcttcactcgcccttgaggcgcccatgaaggtggcgttcctggggccccgggcgaccttcacccacctggccaccatgcagcacttcggcctggccgcggagctggtcgcccagaaatcgatccctgccgtgttcgaggaagtggagaagggccgcgctctctacggtgtcgtgccggtcgagaactccaccgaggggatggtttcccacaccctcgacatgttcatggagagcgacctcaagatcaacgccgaggttctgctggaagtgtcccacgacctcctctcccgcaccggccggctggacgacgtgaagaaggtctattcgcatccccaggcccttgcccagtgccgcaagtggctcgacgacaacctgccgggtgtgccggtggtggacgtggcgtccactgccctggccgcccagatcgtgagcgaggattacgcggccgcggccattgccagcgagttcgccgcggcccagtacgacctgaaggtagtgcgcacgagaattgaggaccaggtcaacaacttcacccgcttcctcgtcatcggccggaagatggcggatcggagcggcgacgacaagacctcgctcatgttttccgtcaaggacgagccgggcatcctctaccggatgctggagcccttcgcctcccgcggcgtcaacctgtccaagatcgaatcccgccccctcaagaagaaggcgtgggaatacattttttacctggacctggccggccacatcaccgatccggtggttgccgaggcggttcaggacctgggacgctactgccagttcgtgaaaattctcggctcctatcccagggcgaaatga

SEQ ID NO: 30867 - protein, 358 aa, Geobacter sulfurreducens PCA
MSATRNLDALRREIDAIDDAILDLLNRRAGLVMEVGQVKTVEKRDFHVPNREREIYERLLAHNTGPFPAEAVKSVFREIISASLALEAPMKVAFLGPRATFTHLATMQHFGLAAELVAQKSIPAVFEEVEKGRALYGVVPVENSTEGMVSHTLDMFMESDLKINAEVLLEVSHDLLSRTGRLDDVKKVYSHPQALAQCRKWLDDNLPGVPVVDVASTALAAQIVSEDYAAAAIASEFAAAQYDLKVVRTRIEDQVNNFTRFLVIGRKMADRSGDDKTSLMFSVKDEPGILYRMLEPFASRGVNLSKIESRPLKKKAWEYIFYLDLAGHITDPVVAEAVQDLGRYCQFVKILGSYPRAK

SEQ ID NO: 30868 - DNA, 1776 bp, Nanoarchaeum equitans Kin4-M
  CDS (1)..(1776)
atggttatgatattaattattggatttggaagattaggccagtatttttataattatttaaaaagaaaagggttaaatgttaaagtatattctcgatcgattaaagaaattgaagaaaacgagtttagcaaatttaaatatgctatattggctataccagaaaattcttataatgaaatattatcaaaattaaaagaaaacaattttaatggggtaataatagatttagcctctaaaaaagatgtagtaattcctataatagaacagtatggttttaagtttttatctttgcatcctttgtttgggcccagcatctatgaggaattctctaaaatagttgtaataaaagaaagcacagacaaaagctttttgcaatttttggattttgatttaattgaaatgtctttagaggaacatgaaaaaataaatgaattgcaagttgtaactcatttattgttaatatcttattatcatttcgctaggagattcccaataaaaacagcatctgccgaagctttatatagattgtcagaaagattgttagaacagaacccgcaaatcttattagatatacaaaaagaaaagaatgctaaaacctatagagagaactacatcaaatttttgaaagaagtatcaaacaatatagaagattatataccaaaagagagggtagaaggtttctctagggcattgttattgaatttatcaaaactatggaacaaagatattagaaaacaaattatggttattgacaaactaattttagacttaataaaaataagaaacgatttggcaaagcaaataaaagaaataaaagaactaagaaatttacctatagaggataaaaaatgggaaatagaaaagagaaatattttactagaattcgccaaagaaagagagcttaatcctttgtatacagatcaattaattgaattgctaatatcttgggctaagcatatagaaaatccaaagccttggataggagttttgggcccaataggaagttttagtgatgaagtagcactaaaattaaataaaaccaggctaaatataaaatattatagaaagatatcccatatttttgatgcattggaaaataacgaaattgctttgggtatagtgcctatagagaatgttttaggaggtagtgtgaatgaaaccttggattccctaataaaatacaatgttaaaattgtgggcgagtatatacatagaataaacctatgtttagttggtaaaaatgttaaagaagtaaaaagaataatatctcacccccaagctattgcacaatctatggaatatatttcgaaaaaattccctaatgcagagatagtttattcaaattcaacttctgaagcaatatctatgttagacgagtattctttagcaataacatcaaaaactgcagcaatattctatgggctaaaaatttatgatgagcatatcgaggataataaagaaaacaaaactagatttataattattggtaaaaagcaattgcccaatccaaagtatagcgctttagttttctctttagaagataagcctggctctttaaaagaagtgttggagatattccataaacacaatataaatttaagaaaattagagtctaggcccgacaaaagagagataggtaaatatttattttatgtggaatcagatttgttaaataacaaaatattagaagaaataagagcaaaagctaattgggttaaacatctgggtaactttagagaaataaatgaaatcgaattccctaagattctagattaa

SEQ ID NO: 30869 - protein, 591 aa, Nanoarchaeum equitans Kin4-M
MVMILIIGFGRLGQYFYNYLKRKGLNVKVYSRSIKEIEENEFSKFKYAILAIPENSYNEILSKLKENNFNGVIIDLASKKDVVIPIIEQYGFKFLSLHPLFGPSIYEEFSKIVVIKESTDKSFLQFLDFDLIEMSLEEHEKINELQVVTHLLLISYYHFARRFPIKTASAEALYRLSERLLEQNPQILLDIQKEKNAKTYRENYIKFLKEVSNNIEDYIPKERVEGFSRALLLNLSKLWNKDIRKQIMVIDKLILDLIKIRNDLAKQIKEIKELRNLPIEDKKWEIEKRNILLEFAKERELNPLYTDQLIELLISWAKHIENPKPWIGVLGPIGSFSDEVALKLNKTRLNIKYYRKISHIFDALENNEIALGIVPIENVLGGSVNETLDSLIKYNVKIVGEYIHRINLCLVGKNVKEVKRIISHPQAIAQSMEYISKKFPNAEIVYSNSTSEAISMLDEYSLAITSKTAAIFYGLKIYDEHIEDNKENKTRFIIIGKKQLPNPKYSALVFSLEDKPGSLKEVLEIFHKHNINLRKLESRPDKREIGKYLFYVESDLLNNKILEEIRAKANWVKHLGNFREINEIEFPKILD

SEQ ID NO: 30870 - DNA, 1158 bp, Yersinia pestis biovar Medievalis str. 91001
  CDS (1)..(1158)
atgaccgataatccattactggtgctgcgtgaacgtatcagtgcattagatttaaaactgctggctttgctggcagaacggcgtgaactggcagtggatgtggccaaagccaagcagctccatcatcgcccaattcgcgataaagaacgtgagcgtgacttattagacgcactgatcgatgccgctaagccttataatcttgatggattctatgtcacacgcctgtttcagctgattattgaagattccgtattgacccagcaggctttattgcaacatcagcttaaccaaaccgccctgctctctgcccgtatcgccttccttggccctaagggctcctattcacatctggcagctcgccaatatgcagcacgtcattttgagcaattaattgaatgcggttgcctgaaattccaagacatttttacccaggttgagaccgggcaagcggattacgccgtactgccgatcgagaataccagttcaggttctattaatgatgtgtatgacttactccaacacaccagcttgtctattgtgggcgaaataaccaaccctatcgagcactgcgtactcattgccacagaaacagatttgaacaaaattgagactgtatacagccatcctcagcctttccagcaatgcagccagttcattaatcgtttcccacattggaaaattgagtattgtgagagtacggctgccgcgatggaaaaagttgcaggaatgaaatcaccaacggcggctgcattaggtagcgaagcgggcggtgcgctctataatctgcaagtgctggagcacaatctggcaaatcagcaacaaaatattactcgattcattgtccttgcccgcaaacccattgatgtatctgagcaaatcccggccaaaaccaccttaattatggcgaccgggcagcaatccggggcattggtagaggctttgctggtactcagagagcatggcattatcatgacgaaactggagtcccggccaattaatggcaacccgtgggaagagatgttttatattgatgtgcaggccaatatacgttcagaagcgatgcaaaaagcattggccgatctaacaccgattacccgttccttaaaagtgttgggctgctacccaagtgagaacgtcgttcccgtcgagcctcggtaa

SEQ ID NO: 30871 - protein, 385 aa, Yersinia pestis biovar Medievalis str. 91001
MTDNPLLVLRERISALDLKLLALLAERRELAVDVAKAKQLHHRPIRDKERERDLLDALIDAAKPYNLDGFYVTRLFQLIIEDSVLTQQALLQHQLNQTALLSARIAFLGPKGSYSHLAARQYAARHFEQLIECGCLKFQDIFTQVETGQADYAVLPIENTSSGSINDVYDLLQHTSLSIVGEITNPIEHCVLIATETDLNKIETVYSHPQPFQQCSQFINRFPHWKIEYCESTAAAMEKVAGMKSPTAAALGSEAGGALYNLQVLEHNLANQQQNITRFIVLARKPIDVSEQIPAKTTLIMATGQQSGALVEALLVLREHGIIMTKLESRPINGNPWEEMFYIDVQANIRSEAMQKALADLTPITRSLKVLGCYPSENVVPVEPR

SEQ ID NO: 30872 - DNA, 1176 bp, Desulfovibrio vulgaris subsp. vulgaris str. Hildenborough
  CDS (1)..(1176)
gtgagcgcacccgaacccgtgaacggcacaccgcctgatgtggcgcaacggctacaggccatccgcgtgaccatcgacggtctcgaccgcgacctgcttgcgctgctcaatcgacgcgccgcactgagtcttgaggtcggccgcatcaaggccaccgaccccggcatcgtcttccgccccttccgtgagcgcgaggtgttcgacaacctcgaagccgccaatgaagggccgttgcccgacgaacacctgcgagccatctggcgcgagatcatctcctcgtcgcgcagcctgcaacgcccgcagcgtgtggcctacctcggccctgaaggcaccttctcgtatttcgcaggcatggagttcctcggcagggccatggactacaggccgcagcccggtctgcccgacgtgttccgcgccgtgcacgaccgccagtgcgaactgggcatcgtgccgctggagaactcgttgcagggtacggtggggcagagtctcgacctcttcctgcaacacgaggtgttcatacaggccgaactcttctgccgcatcagccactgcctgcttggcacggcggcggcactggcggacatcgacaccgtgtactcgcacccgcagccgctggcccagtgcggcgggtggctgcgtgcgcacctgcccaacgcccgcatcatccccaccgaatccaccgccgcggcagcccgcagggcggcgggcgaggcgggggccgccgccatcggtcaccgcagcctcgctgaccttctcgggctcaacgtgctggaacggggtatcgaagaccagccagacaactggacgcgcttcgtggtcatcgcccccgcccctgccgaccagcagggacgcgagaagacctccatgctcttctccctgccagacaaggcaggtgcgctggctggagtgctcgaactgctggcccgcgagggcatcaacatgaagaagctcgaatcgcgtcccttgcggggcgagaagtggcagtacgtcttcttcgtggacgtggaatgcgacctcggcactgaacggtacgcccgtctcgtcgaagaactgcgcacactgtgccacacgttgcgcattctcggcagctatcctgtggggccgcatttcgacatggcggcgcatgaagcgttgcccggtctgcccgatcagataggccagggaggcctgtga

SEQ ID NO: 30873 - protein, 391 aa, Desulfovibrio vulgaris subsp. vulgaris str. Hildenborough
MSAPEPVNGTPPDVAQRLQAIRVTIDGLDRDLLALLNRRAALSLEVGRIKATDPGIVFRPFREREVFDNLEAANEGPLPDEHLRAIWREIISSSRSLQRPQRVAYLGPEGTFSYFAGMEFLGRAMDYRPQPGLPDVFRAVHDRQCELGIVPLENSLQGTVGQSLDLFLQHEVFIQAELFCRISHCLLGTAAALADIDTVYSHPQPLAQCGGWLRAHLPNARIIPTESTAAAARRAAGEAGAAAIGHRSLADLLGLNVLERGIEDQPDNWTRFVVIAPAPADQQGREKTSMLFSLPDKAGALAGVLELLAREGINMKKLESRPLRGEKWQYVFFVDVECDLGTERYARLVEELRTLCHTLRILGSYPVGPHFDMAAHEALPGLPDQIGQGGL

SEQ ID NO: 30874 - DNA, 1110 bp, Acinetobacter sp. ADP1
  CDS (1)..(1110)
atgatccatgatgatcagaaaccttcatcttctctcgacttgcaagaaatccggattcagatcgatagcgtagatcaacagattcaggaacttattaatcgccgtgcaactttggcagaagctgtggcaaaagccaaatttgcttcggaagaaaatccattgttttatcggccagagcgagaagcacaggttttacgtaaggtcatggagcgcaatcaagggcctctttcagatgtcaccatggcacgtttgtttcgtgaaatcatgtctgcttgtctggcacttgaagcacctcaaagtattgcatttttagggcctgaaggaacctttactcagtctgctgcactcaagcactttgggaaagatgcggtggtacgcccacttccgacgattgatgaagtatttcgtgaagttgaagcaggtagtgcacactatggtgtggttcctgttgaaaactcatctgaaggtgtcgtcaatcatacactcgactgttttagaacttctcagttaaatgtgattggtgaagttgaattacgcattcaccatcaatttctggtgtctcacaatacccgtaaagacagtattaaacagatttatgcgcatcagcaggccttggctcagtgcagacagtggctagatacacactatcctggtgttgagcgagttgccttgagttctaatgccgaggctgcacgccgtattcgtaatgagtggcattcggctgccattgcctctgatattgcagcatctatgtatgatcttgaaatttttcatagcaatatcgaagataatccagaaaacaccacacgctttttagtcattgggcgtgagaaaattcctcaaagtggtaatgataaaacttcattactgatttctgcacatgatcgtgctggtgctttgcttgaaattctagctccttttgcaaaacacaagattagcttgaccagtatcgaaactcgtccagccttacctgaaaaatgggcatatgtgttctttatagacctagaaggacacatcgaacaggaaaatgttgcagcagcaattgatgatattcgtccacttgtaaaagagttgcgtattttagggtcttatcctgctgcggtattgtaa

SEQ ID NO: 30875 - protein, 369 aa, Acinetobacter sp. ADP1
MIHDDQKPSSSLDLQEIRIQIDSVDQQIQELINRRATLAEAVAKAKFASEENPLFYRPEREAQVLRKVMERNQGPLSDVTMARLFREIMSACLALEAPQSIAFLGPEGTFTQSAALKHFGKDAVVRPLPTIDEVFREVEAGSAHYGVVPVENSSEGVVNHTLDCFRTSQLNVIGEVELRIHHQFLVSHNTRKDSIKQIYAHQQALAQCRQWLDTHYPGVERVALSSNAEAARRIRNEWHSAAIASDIAASMYDLEIFHSNIEDNPENTTRFLVIGREKIPQSGNDKTSLLISAHDRAGALLEILAPFAKHKISLTSIETRPALPEKWAYVFFIDLEGHIEQENVAAAIDDIRPLVKELRILGSYPAAVL

SEQ ID NO: 30876 - DNA, 1107 bp, Desulfotalea psychrophila LSv54
  CDS (1)..(1107)
atgaaacaagactccaatataccaaaggtacgagaatccatagatacaattgataatagtatcttggaattacttaaaaaacgaatcggtctcgctaaggagattggtagactcaaaagcgaagataacaggtcaaaatgggatcctctcagagaacgtgagatctatgaacgacttatcaccagtaatgagggtgattttccagatgaatcacttcgctcgatctttcatgaaataataaccacctgcagactatcgcaaaaaaaagcagtggtagcctatctcgggccggaggccaccttttctcaccttgccggagtaaagtactttggtcactctacagactataaaccccttgaaaccattgacgaggtgtttgccgaggtggaaaaaggccgggttcagtacggtatagttccggtggagaactcaattgaaggggccgttttctccaccctcgattcttttatgaagtacaagattaagatctgtggagagatgcaactggccatctcccataatcttgtctgtaaatctggaaatatcgaggatattcagacggtagcctcccacaatcaaccccttgcccagtgtcgggattggttacgtaagcatctgcccaacacccccaccctgcctgtcttctccacgggtcttgccgcaaaaatggcggctgataatcccaatataggggcaatagcatcctctcttgccatcagcacctacgatcttcaggtcgtggttaagggcattgaggattatgagggaaatactacccggttcttaatcattggtaaggagtcaccgggcatcagcggccgcgatcgcacctcccttctcattggcctgatggatcgacctggagcccttaatgagatactgtcagttctctcagaagagggcatcaacctggccaagattgaatcccgaccaatcaagggtaaacagtggaagtacctattcttccttgatatgattggccatatagaggatgagcagatcaagaggggctgtgcccgtctcaagcaggagtgctcatatttcgaatggctcggttcctacccgcaggacgagaatagcctcgagtattcacccgccaatccgtga

SEQ ID NO: 30877 - protein, 368 aa, Desulfotalea psychrophila LSv54
MKQDSNIPKVRESIDTIDNSILELLKKRIGLAKEIGRLKSEDNRSKWDPLREREIYERLITSNEGDFPDESLRSIFHEIITTCRLSQKKAVVAYLGPEATFSHLAGVKYFGHSTDYKPLETIDEVFAEVEKGRVQYGIVPVENSIEGAVFSTLDSFMKYKIKICGEMQLAISHNLVCKSGNIEDIQTVASHNQPLAQCRDWLRKHLPNTPTLPVFSTGLAAKMAADNPNIGAIASSLAISTYDLQVVVKGIEDYEGNTTRFLIIGKESPGISGRDRTSLLIGLMDRPGALNEILSVLSEEGINLAKIESRPIKGKQWKYLFFLDMIGHIEDEQIKRGCARLKQECSYFEWLGSYPQDENSLEYSPANP

SEQ ID NO: 30878 - DNA, 1161 bp, Mannheimia succiniciproducens MBEL55E
  CDS (1)..(1161)
atggctcttgatttaagtgaaattcgccaacaaatcacgcaaattgaccgtagtttgttgaaattattatcggaacgtcatcgtcttgcttttgatgtcgttcgtagcaaagagataacgcaaaaacctttgcgtgatgaaaaacgggaacaacaacttttacaagaactgattaatttttccgaaaacgaaaattaccagttagaacctcaatatatcactcaaattttccaaaaaattattgaagactccgtactcacccaacaggtttatttacaaaaaaaactgaatgaacaaagagagcagagtattcacatcgcttttttaggtaaacgcggatcttattcgcatttagccgcacgaagttatgcaacccgttatcaggaacaattaattgaattaagctgcagctctttcgaacagatctttgaaaaggtcagttccggcgaagcggattacggtgtattgcctttggaaaacaccacatccggctcaatcaacgaagtttatgatttactgcaacatacggatctatcgcttgtgggcgaactcacatatccgattaaacattgcgtattggttaacgggcaggatgatttgagcaaaatcgataccttatacagccatccgcaggttattcagcaatgcagccagtttattcgcagtttaaataaagtacatattgaattttgcgaaagcagttctcatgcaatgcagttggtttccagtttaaataaaccgaatatcgccgcattaggcaatgaagacggcggacatttatatggattgacggtgttaagaagcaatatcgcgaatcaggaaaacaatattacacgctttattgttattgcccgcaaagctattaccgtatcgccgcaaatccatacaaaaactttattattaatgactaccggacaggaagccggctcattagtcgatgcgttaaccgtgtttaaaaagtatcaaattaaaatgactaaattagagtctcgcccgatttacggtaagccgtgggaagaaatgttttacctggaaattgaagccaatactaaccatccggatactcaagcggcgctggaggaacttagacaatacagcacttatttaaaagtattgggctgttatccaagtgaaatcgtcaaaccggtggatgtaagataa

SEQ ID NO: 30879 - protein, 386 aa, Mannheimia succiniciproducens MBEL55E
MALDLSEIRQQITQIDRSLLKLLSERHRLAFDVVRSKEITQKPLRDEKREQQLLQELINFSENENYQLEPQYITQIFQKIIEDSVLTQQVYLQKKLNEQREQSIHIAFLGKRGSYSHLAARSYATRYQEQLIELSCSSFEQIFEKVSSGEADYGVLPLENTTSGSINEVYDLLQHTDLSLVGELTYPIKHCVLVNGQDDLSKIDTLYSHPQVIQQCSQFIRSLNKVHIEFCESSSHAMQLVSSLNKPNIAALGNEDGGHLYGLTVLRSNIANQENNITRFIVIARKAITVSPQIHTKTLLLMTTGQEAGSLVDALTVFKKYQIKMTKLESRPIYGKPWEEMFYLEIEANTNHPDTQAALEELRQYSTYLKVLGCYPSEIVKPVDVR

SEQ ID NO: 30880 - DNA, 1083 bp, Burkholderia mallei ATCC 23344
  CDS (1)..(1083)
atggacgacgaactcaattcccgcctgaagcctctgcgcgagcgcatcgacgcgatcgacacgcaactgatcgcgctgctgaatcagcgcgcggcggtcgcgctcgaggtcggcgaggtcaagaagcacttcaacgcgcccgtgttccggccggagcgcgagcagcaggtgatcgcgcgcttgcaggacatgagcgccgggccgctcgcgagcgagcacatcagcgcgatctggcgcgagatcatggcggcgagccgcgatctcgagcagacgatacacgtcgcgttcctcgggcccgtcggcacctatagcgaacaggcgatgttcgactacttcggccaatcgatcgaggggctgccttgcccgtcgatcgacgaggtgttccgctcggtcgaggcgggcgccgcgacgttcggcgtcgtgccggtcgagaattcgtcggaaggcgcggtgtcgcgcacgctcgatctgctgctgcatacgcagcttctgatcggcggcgagctgtcgctgccgattcatcacaatctgctcacgcaaacaggcaagctcgacggcgtgaagcgcgtgtgcgcgcatgcgcaggcgctcgcgcagtgccagcaatggctcgcgtcgaacgcgccgcatctcgagcggcaggcggtcgcgagcaacgcggaagccgcgcggctcgcggccgacgacgcgacggtcgccgcgatcgcgggcgaccgcgcggcgacgcactacgggctgcagatcgcctatgcgctgatccaggacgatccgcacaaccgcacgcgcttcgcggtgatcggccaggagccggcggggccgagcgggcatgatcagacctcgctcatcgtgtcggtgaagaacgagccgggcgcggtgttcaagctgctcgagccgcttgcacggcacggcgtgtcgatgacgcgcttcgagtcgcgcccggcgcgggtcggcacgtgggagtattacttctacatcgacatcgaagggcatcgcgacgacgccgctgtccagggtgcgctcgcggagcttggcaggaaggcggcttttctgaagattctcggttcgtatccgcgcgcgcggtga

SEQ ID NO: 30881 - protein, 360 aa, Burkholderia mallei ATCC 23344
MDDELNSRLKPLRERIDAIDTQLIALLNQRAAVALEVGEVKKHFNAPVFRPEREQQVIARLQDMSAGPLASEHISAIWREIMAASRDLEQTIHVAFLGPVGTYSEQAMFDYFGQSIEGLPCPSIDEVFRSVEAGAATFGVVPVENSSEGAVSRTLDLLLHTQLLIGGELSLPIHHNLLTQTGKLDGVKRVCAHAQALAQCQQWLASNAPHLERQAVASNAEAARLAADDATVAAIAGDRAATHYGLQIAYALIQDDPHNRTRFAVIGQEPAGPSGHDQTSLIVSVKNEPGAVFKLLEPLARHGVSMTRFESRPARVGTWEYYFYIDIEGHRDDAAVQGALAELGRKAAFLKILGSYPRAR

SEQ ID NO: 30882 - DNA, 1089 bp, Methylococcus capsulatus str. Bath
  CDS (1)..(1089)
atggcgaacgatccttctctcgcggaactgcgcaagcgcatcgacgaactcgacgaccgggtgctggaactgctcaaccagcgggcgaggtgtgcccagcgggtggccgacatcaaggtggcggcaggcgagaccgactgcttctaccgtcccgaacgggaagcggaaatcctgcagcggttgacagcgcacaatcccggcccgctcggccgagaggccgtggtccgctttttccgcgaagtgatgtcggaatgcctggccctcgaaaagccgctgagcgtcgccttcctcggaccggaaggaaccttcacccaacaggcggcctacaggcatttcggtcatgccatccaggccgtcccgatgccggccatcgacgaaatcttccgggctgtggagagcggtgcctgtcattacggtgtggtgccggtcgagaattcgactgaaggcgtcatcacccacaccctggatagcttcgtgcgcttcagcctgatcatcgccggggaggtgcagctgcgcatccaccacaacctgctgtgcaggacaccgaccgcgctgaccgagctgaccgaagtgttctcccatccgcagtcgctggcgcaatgccggggctggctggaccgttttctgccgggtgtacgccgcacccccctcggcagcaacgccgaagccgcccggcgggcggcggaaaccgccggtacggcggcgatcgccggcgaagtggcggcgggactctatggcctggagatcctgaaccgcaacatcgaagacgaacccgacaataccacccggttcctggtcatcggcggccagccggtgggaccgactggccacgacaaaacttcgctgttactgtccacccgcaatgacccgggtgcgcttttccgcctcatcgagccattcgcgcgcctggggatcagcatgaccaagatcgaatcgcggccttcgcggcgcggcatgtgggactacttttttttcatcgacgtggaagggcatcaggctgatcccaccctggcgcaggccctcgccgaggtgcgtgaacactgctgcatgatgcgtatcctcggttcctatccacgcgcactgagctga

SEQ ID NO: 30883 - protein, 362 aa, Methylococcus capsulatus str. Bath
MANDPSLAELRKRIDELDDRVLELLNQRARCAQRVADIKVAAGETDCFYRPEREAEILQRLTAHNPGPLGREAVVRFFREVMSECLALEKPLSVAFLGPEGTFTQQAAYRHFGHAIQAVPMPAIDEIFRAVESGACHYGVVPVENSTEGVITHTLDSFVRFSLIIAGEVQLRIHHNLLCRTPTALTELTEVFSHPQSLAQCRGWLDRFLPGVRRTPLGSNAEAARRAAETAGTAAIAGEVAAGLYGLEILNRNIEDEPDNTTRFLVIGGQPVGPTGHDKTSLLLSTRNDPGALFRLIEPFARLGISMTKIESRPSRRGMWDYFFFIDVEGHQADPTLAQALAEVREHCCMMRILGSYPRALS

SEQ ID NO: 30884 - DNA, 1176 bp, Photobacterium profundum SS9
  CDS (1)..(1176)
atgaccgaacaacactactcacttgatgatattcgtaaaaatgttagccacattgataacgagatacttaaactactgtctgaacgacgcttactgagcttagaagtcgctaaaagtaaaattggtactgcgaaaccagtacgcgatcaagcacgagagcaagaactcttgcttcgtttgattaaaacaggcaagacgcagcagctcgatgctttatatgtaacgcaaatttttcataccattattgaagactcggtattatttcaacaagcgtatctgcaaaaattagcgaaccctgatagcttacagcctgtggctcgtgtgtctttccttggagcgaaaggttcatactctcaccttgcaagccgtaactactttagccgtaagcaaaccaaactcgttgagatgagctgttctacattccgtgatgtgttgaacattgttgaaacaggcaatgctgattatggtgtgttgccaattgaaaataccagctctggttcaatcaatgaagtgtatgacttactgcaacacactagcttatcgatcgtcggtgaaataacgcaaccgattgaacattgcttgctcactgttggtgatgtcgatgtcaaaggaattaacaccttatattcccaccctcagccgcaccaacagtgcagtgaatacttacattcaatgggcgacatcacacaagagtactgctctagtactgccgaagcgatgcaaaaagtggcagagttgaacctaccgaatgtggctgccattggtaatgcatcaagtggtaaactttacggtcttacccctgtaaaagggaatattgccaatcaacaagaaaacttcactcgcttcattgttgttgcccgtaaacctgtcgatgtcacgtcattgatcccagcaaaaagtaccttgattatgtctacggctcagaaagcgggttcactggtcgaatgtttaatggtattgcgtaacttgaacattaatatgaccaagctagagtcacgcccagtgatcggtaacccatgggaagagatgttctatttagatgttgaagagaatttaaaatctgatgtgatgcagcaagcattagaagagttaacacgtctgacgcgcttcattaaagtgctaggttgttacccaagcgagaatataaaacctacagaagttgagatcgaagaatag

SEQ ID NO: 30885 - protein, 391 aa, Photobacterium profundum SS9
MTEQHYSLDDIRKNVSHIDNEILKLLSERRLLSLEVAKSKIGTAKPVRDQAREQELLLRLIKTGKTQQLDALYVTQIFHTIIEDSVLFQQAYLQKLANPDSLQPVARVSFLGAKGSYSHLASRNYFSRKQTKLVEMSCSTFRDVLNIVETGNADYGVLPIENTSSGSINEVYDLLQHTSLSIVGEITQPIEHCLLTVGDVDVKGINTLYSHPQPHQQCSEYLHSMGDITQEYCSSTAEAMQKVAELNLPNVAAIGNASSGKLYGLTPVKGNIANQQENFTRFIVVARKPVDVTSLIPAKSTLIMSTAQKAGSLVECLMVLRNLNINMTKLESRPVIGNPWEEMFYLDVEENLKSDVMQQALEELTRLTRFIKVLGCYPSENIKPTEVEIEE

SEQ ID NO: 30886 - DNA, 1125 bp, Xylella fastidiosa Ann-1
  CDS (1)..(1125)
atgactaagccggttaatactactgctgacaaggttgctctgtctgacacggcattggccaatatccgcactaaaatcgataagattgaccgtgatattcagacattaattgccgaacgtgcgtgttatgcccagcaagtcggtcaggcaaaaagcaaacttgccgctgcgatggattactaccgccccgagcgtgaagcgcaggtgctacgtatggtggtggaacgcaatgaaggtccgttgtcagatgaagtgctagtccgcttattccgtgaaattatgtctgcctgtttagcccagcaggaaccattgaagattggttaccttggtccggaaggcacctttagccaacaagcagtgctcaaacactttggccattatgtccttggcgagcctatggccagtattgaggaggtgttccaggaggtcgaggccggtcataccgatttcggagtagtgccggtggagaattcaggtcatggaacaatccaggttacgctggatttgtttttgaattctaaattgaaaatctgtggcgagattgagttgcgcgtgcatcaatatctgatgtctcgtagtggtcgccttgaagacattcatcggatctatgcgcacccgcagtcgtttgcgcagaccgcctgttggctacgtgccaatctgcctcatgttgagaaaatccctgtgtctagcaacgccgaaggtgcacgtcgtgcctccaatgctaacgatgcagcttcgatcggtagcgagagcgccgcgcgagtgtatgcgttgagcaaggtgttcatacactcaattgaagatgagcaggacaatacaacgcgttttctggtgatcggtcgtcggatatttgcgccttccggatgcgatcgtacttcgattcttgtgtttattcgtgacaaccctggcgcattgtttgaagtgcttggttcatttgcgcgtcacggtatcaacatgaatcgtattgaatcgcgcccttcccatcaggtcagatgggagtatgtcttttttattgatttgcttggccatgttgaggatgaaccgatgaaacaggcactggctgaattggagcaacatgcggtgaaggtcaagatcctcggagcctatccaattgcccttctatga

SEQ ID NO: 30887 - protein, 374 aa, Xylella fastidiosa Ann-1
MTKPVNTTADKVALSDTALANIRTKIDKIDRDIQTLIAERACYAQQVGQAKSKLAAAMDYYRPEREAQVLRMVVERNEGPLSDEVLVRLFREIMSACLAQQEPLKIGYLGPEGTFSQQAVLKHFGHYVLGEPMASIEEVFQEVEAGHTDFGVVPVENSGHGTIQVTLDLFLNSKLKICGEIELRVHQYLMSRSGRLEDIHRIYAHPQSFAQTACWLRANLPHVEKIPVSSNAEGARRASNANDAASIGSESAARVYALSKVFIHSIEDEQDNTTRFLVIGRRIFAPSGCDRTSILVFIRDNPGALFEVLGSFARHGINMNRIESRPSHQVRWEYVFFIDLLGHVEDEPMKQALAELEQHAVKVKILGAYPIALL

SEQ ID NO: 30888 - DNA, 1098 bp, Azotobacter vinelandii
  CDS (1)..(1098)
atgagcgaccaggatcagctcaaggctctgcgcgtacgcatcgacagcctcgacgagaagatcctcgagctgatcagcgagcgtgcgcgctgcgccgaggaagtggcgcgggtgaagatggcctcgctcaagcccggcgagtcgccggtgttctaccggcccgaacgcgaggcctgggtgctcaggcacatcatggaaatcaacaaggggccgctgggcaacgaggaggtcgcccggctgttccgcgagatcatgtcctcctgtctggccctggaacacccgctcaaggtcgcctacctcggtccggaaggcaccttcacccaggccgccgcgctcaagcacttcggccatgcggtgatcagcctgcccatggcggcgatcgacgaggtgttccgcgaggtcgccgccggcgcggtcaacttcggtgtggtgccggtggagaattccaccgagggggcggtcaaccacaccctggacagctttctcgagcacgacctggtgatctgcggcgaggtggagctgcgcatccaccatcatctgctggtcggcgaaaacaccaggaccgacaagatttcgcgcatctattcccatgcccagtcgctggcgcaatgccgcaagtggctggatgcgcactacccgagcgtcgagcgcgtggcgctgtcgagcaacgccgacgcggcccgccgggtgaagagcgaatggaacagcgcggctatcgccggcgacatggcggcccagctctacggcctgaccaagctcgccgaaaagatcgaggatcgtccggacaattccacgcgctttctgatcatcggcaaccaggaagtgccgccgatcggtgacgacaagacctcgatcatcgtctcgatgaacaacaagcccggggccctgcatgcgctcctgatgcccttccacgagaacggtatcgacctgacccgcatcgagacccgtccttcgcgcagcggcaaatggacctacgtgttcttcatcgacttcgtcggtcaccgccacgacccgctggtcaagagcgtgctggagcggctcagccaggaggtcgtggcgctcaaggtgctcggttcctatcccaaggcagtactgtga

SEQ ID NO: 30889 - protein, 365 aa, Azotobacter vinelandii
MSDQDQLKALRVRIDSLDEKILELISERARCAEEVARVKMASLKPGESPVFYRPEREAWVLRHIMEINKGPLGNEEVARLFREIMSSCLALEHPLKVAYLGPEGTFTQAAALKHFGHAVISLPMAAIDEVFREVAAGAVNFGVVPVENSTEGAVNHTLDSFLEHDLVICGEVELRIHHHLLVGENTRTDKISRIYSHAQSLAQCRKWLDAHYPSVERVALSSNADAARRVKSEWNSAAIAGDMAAQLYGLTKLAEKIEDRPDNSTRFLIIGNQEVPPIGDDKTSIIVSMNNKPGALHALLMPFHENGIDLTRIETRPSRSGKWTYVFFIDFVGHRHDPLVKSVLERLSQEVVALKVLGSYPKAVL

SEQ ID NO: 30890 - DNA, 1158 bp, Haemophilus somnus 129PT
  CDS (1)..(1158)
atgtcattagatttaagcgaaattcgtcaacaaattacacaaattgaccgcagtttattaaagttgctttcggagcgtcatcgtttagcatttgatgtcgtacgtagtaaagaaatctcgcagaaagcattacgtgatgttgaacgtgagcagcaattattgaaagagttggttcaatttgcggaaaatgaaaattatcaattggaaccacaatatattactcagattttccaaaaaattatcgaagattccgtgttgactcagcaagtatatttgcaaaagaaattgaatgagcaaagagagaagaatattcatattgcttttttaggtaaaagaggttcttactcgcatttagccgccagaaattatgcaactcgttatcaggagcaactaattgagctaagttgtgcgtcttttgatgaagtattttcctctgtgcaaaatgaggaggcaagttatggcattttaccgttggagaatacaacctcaggagcgattaatgaagtgtatgatttattacagcatacagatctttctttagtaggtgaattggcttatccaattaaacattgtgttctggtaaatgctcaagatgatttggataagattgatactttatacagtcatcctcaagtgattcagcaatgtagccaatttattcgtactttagcgcgagttcatattgaatattgtgaaagcagctcacatgcaatgcaacttgttgccagcttaaataaacctaatattgcagctttaggcaatgaagatggtgggaatttatatggtttaaaagtattaaagtccggtatagcaaaccaagaaaacaatattacgagatttattgttcttgctaagaatccgattgcagtatcaccgcaaattcatacaaagacattattattaatgagtactgcacaaaaagcgggggcattagttgatgctttattggtcttcaaaaaatataacatcaatatgacgaagttagagtcacgtccaatttatggtaaaccatgggaagagatgttttatttagaaattgaggctaatattaataaccctatcgctcagcaagcttttactgaactaaaagcattcagtaactacttgaaaatcttaggttgttatccaagtgaaattgtgaaacctgccgaagtctaa

SEQ ID NO: 30891 - protein, 385 aa, Haemophilus somnus 129PT
MSLDLSEIRQQITQIDRSLLKLLSERHRLAFDVVRSKEISQKALRDVEREQQLLKELVQFAENENYQLEPQYITQIFQKIIEDSVLTQQVYLQKKLNEQREKNIHIAFLGKRGSYSHLAARNYATRYQEQLIELSCASFDEVFSSVQNEEASYGILPLENTTSGAINEVYDLLQHTDLSLVGELAYPIKHCVLVNAQDDLDKIDTLYSHPQVIQQCSQFIRTLARVHIEYCESSSHAMQLVASLNKPNIAALGNEDGGNLYGLKVLKSGIANQENNITRFIVLAKNPIAVSPQIHTKTLLLMSTAQKAGALVDALLVFKKYNINMTKLESRPIYGKPWEEMFYLEIEANINNPIAQQAFTELKAFSNYLKILGCYPSEIVKPAEV

SEQ ID NO: 30892 - DNA, 1110 bp, Desulfovibrio desulfuricans G20
  CDS (1)..(1110)
atgggcagcgtacgtgaagatatagacgccgtggacagagagctgctggcccttttgaacaggcgggcggaactcagtctggaagtgggccgcataaagcgcgacgaccccggcgtcatattcaaaccgttccgcgagcgtgatgtgctggaaaaactgcgcagcctcagcgcaggcccgctgccggaagaacacctgcggtccatataccgcgagatactgtcgtcttcacgcagtctgcagcgtcctcagcgtgtggcctatctggggccggaaggtacgttttcatattttgcgggcattcagtttctggggcattccgtagagtttctgccccagaaggatctgcatggtgtcatccgctccgtgcacgcccgcgaatgcgaactgggcgtcctgccgcttgaaaattcgctgcacggcaccgtggggcagagtcttgatctgtttctgcgctacgaggtgttcatcaatgccgaactgttctgtcgtatcagccattcattgctgacggcggaaaaacggctttccgacatcaccaccgtgtattcgcacccgcagccgctggcacagtgcggcgaatggctgcggcttaatctgcccggtgcgcgtattattcccaccgaatcaacggcagctgcggctcggcgtatcaaaggcgaaaagggcgctgcggccatcggtcacggcaaccttgccgaacgtctgggactgagtgtgcttgcttctgccattgaagaccagcccgataactggacccggtttgtggtggtggggccggtgccggccgacagggaaggcagggacaaaacatccatgctgttcaccctgcctgacaaatccggttcgctggcgcaggtgctcaatatcctcgcgcgggaggatatcaatatgaaaaagctggaatcccgcccgttgcgcggcgaaaaatggcagtatgtgttttttgtggatgtggaatgcgacctgaaccatgaagattaccggcagcttgtggacgagttgaagcatgtctgccacagcctgcggattctgggcagctatcctgccggaatgtattttgatgtggcccgcacggccgatggttcggaacggctggtgaccgaatag

SEQ ID NO: 30893 - protein, 369 aa, Desulfovibrio desulfuricans G20
MGSVREDIDAVDRELLALLNRRAELSLEVGRIKRDDPGVIFKPFRERDVLEKLRSLSAGPLPEEHLRSIYREILSSSRSLQRPQRVAYLGPEGTFSYFAGIQFLGHSVEFLPQKDLHGVIRSVHARECELGVLPLENSLHGTVGQSLDLFLRYEVFINAELFCRISHSLLTAEKRLSDITTVYSHPQPLAQCGEWLRLNLPGARIIPTESTAAAARRIKGEKGAAAIGHGNLAERLGLSVLASAIEDQPDNWTRFVVVGPVPADREGRDKTSMLFTLPDKSGSLAQVLNILAREDINMKKLESRPLRGEKWQYVFFVDVECDLNHEDYRQLVDELKHVCHSLRILGSYPAGMYFDVARTADGSERLVTE

SEQ ID NO: 30894 - DNA, 1158 bp, Actinobacillus pleuropneumoniae serovar 1 str. 4074
  CDS (1)..(1158)
atgtctttagatttatccgatatccgccaacaaattacccaacttgaccgccatttactcaaattacttgccgagcgtcatcgtctcgcttttgatgtggtgcgtagcaaagaaatcacacaaaagccgttacgtgatatcgaacgggaaaaagcgttattacaagcattggtgagccatgccgaagcggaaaattatcaattagatccgcaatatgtcacacaaatattccagcgtattatcgaagattcggtgctgactcagcaaaattatctgcaaaataaattaaatgcgcaaaaagaacaaaatgtatcgattgccttcctaggtatgcgcggttcttattccaatatggcgtctcgtcaatttgcgaaaaaatatcaaggttctttaattgaattgagctgtgattcgttccaacaagtgtttgataaggtgagtgggggtgaagccgaattcggtgtacttccgcttgaaaacaccacttctggttcaatcaatgacgtatatgatttactgcaacataccgatttggcggtggtcggcgaattggcttatccgattaaacattgcgtattggcaaacggtaatattgagcttactgaaattgatactttgtacagccacccgcaagtcatccaacaatgcagccagtttattcaaagtctgaataaagtccatatcaaatattgtgaaagcagctcgcacgccatgcagatggtcgctcgtttgaataagccgaatattgtcgcattaggcaatgaggacggcggaaagctctacggtttaactaatatcaaaaccgatattgccaaccaacagaataatatcacgcgctttatcgtagtagcaaaacaagcgattaacgtttcgccgcagctacaaacaaaaacgttattactgatgaccacatctcaacaagccggtgcgttagcggatgcgttgatggtctttaaacagcatcaaatccgcatgaccaaattggaatctcgtccgatttacggtaagccttgggaagagatgttctatatagaattacaagcgaatattcattccgaaaatacgcaacaagcgttaaaagcattggaaaacgtaaccagctatatcaaagtattaggctgttacccgagtgaaattattgagccggtaaagctgtaa

SEQ ID NO: 30895 - protein, 385 aa, Actinobacillus pleuropneumoniae serovar 1 str. 4074
MSLDLSDIRQQITQLDRHLLKLLAERHRLAFDVVRSKEITQKPLRDIEREKALLQALVSHAEAENYQLDPQYVTQIFQRIIEDSVLTQQNYLQNKLNAQKEQNVSIAFLGMRGSYSNMASRQFAKKYQGSLIELSCDSFQQVFDKVSGGEAEFGVLPLENTTSGSINDVYDLLQHTDLAVVGELAYPIKHCVLANGNIELTEIDTLYSHPQVIQQCSQFIQSLNKVHIKYCESSSHAMQMVARLNKPNIVALGNEDGGKLYGLTNIKTDIANQQNNITRFIVVAKQAINVSPQLQTKTLLLMTTSQQAGALADALMVFKQHQIRMTKLESRPIYGKPWEEMFYIELQANIHSENTQQALKALENVTSYIKVLGCYPSEIIEPVKL

SEQ ID NO: 30896 - DNA, 1182 bp, Psychrobacter sp. 273-4
  CDS (1)..(1182)
atgagtgagcagtcaccagaacaaaaaaatgataatctaaaccaaaccaccgcaagcaacagcgctacagcaacggataaagagtttttaaatacattgcgaggcagtatcgatgcggtagactgcgaaattcagacgctgattaacaatcgtgccaaattggctcagcaagtggcgaccgtgaaaaaaaatcacattgccaatgatcctgctgctgaaaataccaaccctattttttatcgtccagagcgtgaggcgcaagttttaaaagccgtcatggagcgtaataccggacctatcgccgatgaaaaaatggcacgtttgttccgtgagattatgtcggtatgccttgatttagaagcgccgcagcgcattgcatttttgggtccagtaggtacttttacccatgccgctgcattaaaacactttggcaaagctgcggatactgtaccgctcaatactatcactgatgtctttcgtgaagtcgaagcgggcacagcaatgtatggcgtcgtgcccgttgaaaactcatctgagggcgtcgttaatcatacgttagatggctttttatcctctactctaaaaataatcggtgaagttgagctgccgattcatcaaaactttttggtcgctgagcataccaagattgacgggttaagccgtatctactcgcaccagcaatcgttagcacagtgtcgtcactggcttgatgtgaatttccccaatgtcgagcgtgttgcggtatcgagtaatggtgaagcggcacgtcgcttgaagaatgagtggcattcagcagcgattgcaggtgacgtggcggctgcagagtatgatttgcataagctgtattcaaatatcgaagacaatccaagtaatactactcgtttcttgattattggtcacgaagcgatagagccatcaggtcaagacaaaacctcgattatggtgtcagcgcatgacaaagcgggtgctctgatcgaaatcttaaaacctttatcgtatcatggcgtgtcgatgaccagtattgaaacgcgtcctgagcgtcctaataagtgggcttacgttttctttatcgatattaatgggcacattgcagacccaaatgtgagcgccgctatcgctgatatccgcccattggtcaaagatttacgtgtattgggctcttatccaaaagcggtactataa

SEQ ID NO: 30897 - protein, 393 aa, Psychrobacter sp. 273-4
MSEQSPEQKNDNLNQTTASNSATATDKEFLNTLRGSIDAVDCEIQTLINNRAKLAQQVATVKKNHIANDPAAENTNPIFYRPEREAQVLKAVMERNTGPIADEKMARLFREIMSVCLDLEAPQRIAFLGPVGTFTHAAALKHFGKAADTVPLNTITDVFREVEAGTAMYGVVPVENSSEGVVNHTLDGFLSSTLKIIGEVELPIHQNFLVAEHTKIDGLSRIYSHQQSLAQCRHWLDVNFPNVERVAVSSNGEAARRLKNEWHSAAIAGDVAAAEYDLHKLYSNIEDNPSNTTRFLIIGHEAIEPSGQDKTSIMVSAHDKAGALIEILKPLSYHGVSMTSIETRPERPNKWAYVFFIDINGHIADPNVSAAIADIRPLVKDLRVLGSYPKAVL

SEQ ID NO: 30898 - DNA, 1092 bp, Dechloromonas aromatica RCB
  CDS (1)..(1092)
atgagcgacgatctgcaaaaggccttggctggcgttcgtaccgatattgatcgcattgacggggaactgctcaagctgctgaacgaacgcgctcgctgtgcgcagcgggttggcgagatcaaggctgaacacggcgaagcggggcatatctaccgtccggaacgtgaagctcaggttttgcgccgcttgcaggaggccaacccggggccgctccctggcgagaacatcaccttcttcttccgtgaagtgatgtcggcctgcttgtcgctggaagagcccttgggtattgcctttctcgggccgctgggcaccttctccgaatctgcggccaccaagcattttggtcatgccgcacgcttgctgccgcaatcgtcgatcgacgacgtcttccgcgaggttgagtccggccacgcccattatgccgtcgtcccggtcgagaattcgactgaaggtgcggtcggtcggaccatggatttgttgctggccacaccgctgaaaatctgcggcgaagtcgtgctgcgtatccaccagaacctgctgaccaacgaaaccgacctgggcaagattaccaaggtctattcgcatgcccagtcgttggctcaatgccacgagtggctgaaccgagtcttgcccaaggcgcagcgtatctccgttggcagcaatgcccaggccgcccagaacgcagccgctgagccaggtacggcggcgattgccggtgaagctgccgcagcgcgctataacttgccgaaattggtcgagaacatcgaggatgagccgaacaatacgacccgtttcctggtccttggcaagcatgactccggtatttccgggcgtgacaagacgtcactgatcatgtcggcacccaaccggaccggcgccttgcatgagttgctgctcccgctgtctaccgccggggtttcgatgtgtcgtcttgaatcccgtccagcccgcaatgcgctgtgggaatacgtcttctacgttgatatcgagggccatcgcgacgaaccagcgatcaaggcggcgctcgaaaaactggctggctatgccgcctatctgaaaatcctcgggtcctacccggttgccgtttattga

SEQ ID NO: 30899 - protein, 363 aa, Dechloromonas aromatica RCB
MSDDLQKALAGVRTDIDRIDGELLKLLNERARCAQRVGEIKAEHGEAGHIYRPEREAQVLRRLQEANPGPLPGENITFFFREVMSACLSLEEPLGIAFLGPLGTFSESAATKHFGHAARLLPQSSIDDVFREVESGHAHYAVVPVENSTEGAVGRTMDLLLATPLKICGEVVLRIHQNLLTNETDLGKITKVYSHAQSLAQCHEWLNRVLPKAQRISVGSNAQAAQNAAAEPGTAAIAGEAAAARYNLPKLVENIEDEPNNTTRFLVLGKHDSGISGRDKTSLIMSAPNRTGALHELLLPLSTAGVSMCRLESRPARNALWEYVFYVDIEGHRDEPAIKAALEKLAGYAAYLKILGSYPVAVY

SEQ ID NO: 30900 - DNA, 1149 bp, Ralstonia eutropha JMP134
  CDS (1)..(1149)
atgacaagcgaagacaacaacaccgcgcgcgaggagacgcagcagagcggtgcttccccgagcgcggcggaacgtgccctcggtgccgaactggccccgttgcgcgagcagatcgataccgtcgaccgtgaactgctggccatgctgaaccggcgcgcgcagcttgcgctcgatgtcggcgaggtaaagaagaagtacggcgcgccggtgttccgccccgagcgcgaactgcaggtcattcgcaaggtgcaggccgccaatccgggtccgctgctcggcgagagcgtggcgtcgatctggcgcgaggtcatgtcggcatgccgtggcctggaaaagccgcttgagatcgccttcctcggcccggccggtacgttctcggaacaggctttgtacgcgcacttcggccatgaagtgagcggcgtgccgtgcccgagcatcgacgaagtattccgcgccgttgaggcggggaccgtcgagtacggcgtggttccggtggaaaactccaccgagggcgccgtgtcgcgcacgctggacctgtttctgcagacctcgctgaagatcagcggcgaaatcgcgctgaaggtgcaccacaacctgatggccgcttcgccggacatgaacggcgtgaaggtcgtgcgcgcgcatgcgcaggcgctcgcgcagtgccagcactggctgacggcgaactatccgcacctcgagcggcaggccgtatcgagcaatgccgaggcggcgcgcatggcgagcgaagatcccacggtcgcggccattgccggcgaatcggctgctaatcgctatcacctccatatcatccggccgcatatccaggacgatccgcacaaccgcacgcgctttgccgtgattggccggtacgagaccgagccgtcgggcagcgaccagacttcgatgatcctgtcggtgcccaacaaggccggcgcggtctaccagttgctcgcgccgctggcggagaacggtgtgtcgatgtgccgcttcgaatcgcgccccgcgcgcagtggtgcatgggagtactacttctacgtcgatgtggaaggccaccagcacgagccggccgtggcgcgcgcgatcgagacgctgcggcgcaacgcagcgtacctgaaggtgctcgggtcgtacccgtcgagcaagtaa

SEQ ID NO: 30901 - protein, 382 aa, Ralstonia eutropha JMP134
MTSEDNNTAREETQQSGASPSAAERALGAELAPLREQIDTVDRELLAMLNRRAQLALDVGEVKKKYGAPVFRPERELQVIRKVQAANPGPLLGESVASIWREVMSACRGLEKPLEIAFLGPAGTFSEQALYAHFGHEVSGVPCPSIDEVFRAVEAGTVEYGVVPVENSTEGAVSRTLDLFLQTSLKISGEIALKVHHNLMAASPDMNGVKVVRAHAQALAQCQHWLTANYPHLERQAVSSNAEAARMASEDPTVAAIAGESAANRYHLHIIRPHIQDDPHNRTRFAVIGRYETEPSGSDQTSMILSVPNKAGAVYQLLAPLAENGVSMCRFESRPARSGAWEYYFYVDVEGHQHEPAVARAIETLRRNAAYLKVLGSYPSSK

SEQ ID NO: 30902 - DNA, 1068 bp, Methylobacillus flagellatus KT
  CDS (1)..(1068)
atgagtgatattctgaaaggttgccgcgaccagatcgatgcgatcgacgagcaattgctcgagctaatcaatgcccgggctgccttggcaagggagatcggtgagctcaagggcgaggggccgatttatcgtcccgagcgcgaagcccaggtattacgccgactattggaaaagaataccggtccgttgtctgcagaggcagtgaccgcgatttttcgtagcgtgatgtccaattgccgtgcgttggagcgcgagctttcagtagcttttctgggaccgcaaggcacatatagtgaagaggctgccatcaagcagttcggtggcctgaataatcccaagccctgtatgtcgattgatgaggtgttccgcatggtcgaatccggcaatgcggattatgccgtggtgcctgtggaaaactccaccgagggtgcggttggccgcacactggatttgctcacgaccaccagtctgcatatctgtggtgaggttgctctacctatccatcattgcttgcttcgtcgcaggcatgccgacggggaaatccggcgtatctattcccacgcccaatctttgggacagtgccatgagtggctcaacctcaatctgggcggtgttgagcgcgtgagtactggcagcaatgcccaggcagcggagctggccgcacaggatgcatttgccgtggccattgctggcaggcgcgccgctgatatcttcggcctggatatcctggccgagaacattgaagacgatccgaagaacgtgacacgtttcctggtgcttggcaagcatgaggcagccccctcaggccaggacaagacctcgctgctgctggccacgaaaaatgtgccgggcgccattgtagggctgctgacgccccttgccgagcatggcgtggatatgacggagctgggctcgcggccttccaagcttgggatatgggattatgtgttctttgttgatatcaaaggacattatcaggatcccgctgtcgcaagggccctgcatgagcttgagcaacgtgcctccatgttcaaaatcttgggttcttatcctgttgctgttatatga

SEQ ID NO: 30903 - protein, 355 aa, Methylobacillus flagellatus KT
MSDILKGCRDQIDAIDEQLLELINARAALAREIGELKGEGPIYRPEREAQVLRRLLEKNTGPLSAEAVTAIFRSVMSNCRALERELSVAFLGPQGTYSEEAAIKQFGGLNNPKPCMSIDEVFRMVESGNADYAVVPVENSTEGAVGRTLDLLTTTSLHICGEVALPIHHCLLRRRHADGEIRRIYSHAQSLGQCHEWLNLNLGGVERVSTGSNAQAAELAAQDAFAVAIAGRRAADIFGLDILAENIEDDPKNVTRFLVLGKHEAAPSGQDKTSLLLATKNVPGAIVGLLTPLAEHGVDMTELGSRPSKLGIWDYVFFVDIKGHYQDPAVARALHELEQRASMFKILGSYPVAVI

SEQ ID NO: 30904 - DNA, 1116 bp, Rubrobacter xylanophilus DSM 9941
  CDS (1)..(1116)
atgtattccaccgaccagcccgcaggagccggggagcgcgggatctccgagcttcgcgccgggatagacgagatcgacgccgagatagtccgcctgctcgaccgccgggcgcggctcgccaggaagatcggcgagttcaagcgcaggaacgggctcgaggcctacgtgccggcccgcgagcgggcggtgctggacagggtgctgaggatcagcgagggggacttcccccgccgggggctcgagacggtcttccgggagatcatctcctcctccatctcgcttgaggagcggatgaaggtggcctacctggggccggagaccaccttcacccacgaggcggccctgcgggccttcggggccagcgtggagctggagccgcaggccacggtctccgacgtcttcgcccgggtggagcggggcgaggcccagcacggggtggtgccgctcgagaactccatggagggggcggtgacccacaccctcgacgagctgatgaacagcccgctgaagatctgcggggaggtctacctcccgatcatgcagaacctcctctcccgcgaggactccctcgagaaggtgagggtcgtctgctcccacccgatggccctcgcgcagtcggcgccctggctgcggaagaacctccccgccgcccggctgcaggaggtcgagtccacgggggaggcggcccgtatggcggcctcccgccccgggttcgccgcggtggggagcgccctcgccgccgagtcctacggcctcaaggtgctcgcccgcggcatccaggacgcccgcaccaacaccacccggtttatcgtgctggggcggaagtgggcgggcaggacgggccgggacaagaccagcgtggtcttctccgtcaaggaccgcccgggcgtgctgcgcgacgcgctctcggccttcgccgaggaggggataaacctcacccggatagagagccgcccgagccgcaagcgggcctggacgtacgtgttcttcgcggacttccagggccaccccgaggaggagcgggtcgggcgggcgctggaggcgctggaggagcactgcccgtacgtggtcctgatcggggcctaccccgaggcgcgcgacccggaggggctctag

SEQ ID NO: 30905 - protein, 371 aa, Rubrobacter xylanophilus DSM 9941
MYSTDQPAGAGERGISELRAGIDEIDAEIVRLLDRRARLARKIGEFKRRNGLEAYVPARERAVLDRVLRISEGDFPRRGLETVFREIISSSISLEERMKVAYLGPETTFTHEAALRAFGASVELEPQATVSDVFARVERGEAQHGVVPLENSMEGAVTHTLDELMNSPLKICGEVYLPIMQNLLSREDSLEKVRVVCSHPMALAQSAPWLRKNLPAARLQEVESTGEAARMAASRPGFAAVGSALAAESYGLKVLARGIQDARTNTTRFIVLGRKWAGRTGRDKTSVVFSVKDRPGVLRDALSAFAEEGINLTRIESRPSRKRAWTYVFFADFQGHPEEERVGRALEALEEHCPYVVLIGAYPEARDPEGL

SEQ ID NO: 30906 - DNA, 1083 bp, Burkholderia cepacia R1808
  CDS (1)..(1083)
atggacgacgaactgaattcccgcctgaaaccgctgcgcgaccgcatcgatgcgatcgacgcgcagctgatcgcgctcctcaaccagcgcgctgcggtggcgctcgaggtgggcgaggtcaagaagcacttcaacgcgccggtgttccggccggagcgcgagctgcaggtcatcgcgcgcctgcaggacatgagcgccgggccgctcgcgggcgagcacatcagcgcgatctggcgcgagatcatggccgcgagccgcgcgctcgagcagacgatccacgtcgcgttcctcgggccggtgggcacgtacagcgaacaggcgatgttcgagtatttcggccagtcgatcgaaggactgccgtgcccgtcgatcgacgaagtattccgctcggtcgaggcgggcgcggccgccttcgggatcgcgccggtcgagaattcgaccgagggcgcggtgtcgcgcacgctcgacctgctgctgcagacgcagttgctgatcagcggcgagcttgcgctgccgatccatcacaacctgctcacgcaaagcggcacgctcgccggcgtgacgcgcgtctgcgcgcacgctcaggcgctcgcgcaatgccagcagtggctcgcggcgaacgcgccgcagctcgagcggcaagccgtgtcgagcaatgccgaggccgcgcgtctcgcggcggccgacccgagcgtcgcggcgatcgccggcgatcgtgcggccgcgcactacgggctgcaggtcgcgttctcattgatccaggacgatccgcacaaccgcacgcgcttcgtgatcgtcggcaagcagccggccggccagagcggtcacgaccagacgtcgctgatcgtctcggtgaagaacgagccgggcgcggtgttcaagctgctcgagccgctcgcgcggcacggcgtgtcgatgacgcgcttcgaatcgcggccggcgcgggtcggcacgtgggagtactacttctacatcgacatcgaagggcaccgggacgacgcggcggtggccgccgcgctcgcggagctcggccagaaagcagcgttcctgaagatactcggttcgtatccgcgcgcgcgctga

SEQ ID NO: 30907 - protein, 360 aa, Burkholderia cepacia R1808
MDDELNSRLKPLRDRIDAIDAQLIALLNQRAAVALEVGEVKKHFNAPVFRPERELQVIARLQDMSAGPLAGEHISAIWREIMAASRALEQTIHVAFLGPVGTYSEQAMFEYFGQSIEGLPCPSIDEVFRSVEAGAAAFGIAPVENSTEGAVSRTLDLLLQTQLLISGELALPIHHNLLTQSGTLAGVTRVCAHAQALAQCQQWLAANAPQLERQAVSSNAEAARLAAADPSVAAIAGDRAAAHYGLQVAFSLIQDDPHNRTRFVIVGKQPAGQSGHDQTSLIVSVKNEPGAVFKLLEPLARHGVSMTRFESRPARVGTWEYYFYIDIEGHRDDAAVAAALAELGQKAAFLKILGSYPRAR

SEQ ID NO: 30908 - DNA, 1113 bp, Rubrivivax gelatinosus PM1
  CDS (1)..(1113)
atggctgattccgctgcctcccccctcgaccccgcgctgctgggcttgcgccagcagatcgacgccgtcgaccgcgagttgctggccctgctgaaccgccgtgcgtcgctagcgcaagaagtaggcggcatcaaaaagcgcgaaggctcggtggtgttccgccccgagcgcgaggcccaggtgatcgacggcctgaaagcctcgaatcccggcccgctgcaggcagacagcgtggcaccgatctggcgggagatcatgtcggcctgccgcgccctagagacgccgacgcgcgtggcctaccttggcccggccggcaccttcagcgaactcgcggccctgggctacttcggcagctcgatcgtgcgcgtgccctgcgccagcatcgatgaggtgttccgtaccacgaccgcagccgcggccgacttcggcgttgtccccgtcgaaaactcgaccgagggcgtggtggcgcggtcgctggacctgctgctgacgacgccgctgttcctgatcggcgagaccagcctgttcgtgcgccacaacctgctgcgccagaccaattcgctggcgggcatccaggccgtgtgcgcgcatccccaggcgctcgcgcaatgccacggctggctcagctaccacctgcccgatgtcgagcgtcggccggttgccagcaatgccgagggggcccggttggcttcgctcgaccccggcctcgccgccgtggcgagcgaacgtgccggcagcgagttcggactgcacgtcgtcgcgccggccatccaggatgacccgcacaaccgcacccgcttcgtgatcgtcacgcaccccgatcggcacccgcagcccaaggcctccggccacgactgcaccagcctcgtggtgtcggtcaacaaccggcccggtgcggtgcacgacatgctggtgccgctgaagcagcacggcgtgtcgatgacgcgcttcgagtcgcgccccgcccgcagcgccgatcagtgggagtactacttctacatcgacctgcagggccaccccgacgagccggccgtcgccgcggcgctggccgaattgcgcgcggcctgctccttcttcaagctgttgggcacgtacccgctcgacgtccactga

SEQ ID NO: 30909 - protein, 370 aa, Rubrivivax gelatinosus PM1
MADSAASPLDPALLGLRQQIDAVDRELLALLNRRASLAQEVGGIKKREGSVVFRPEREAQVIDGLKASNPGPLQADSVAPIWREIMSACRALETPTRVAYLGPAGTFSELAALGYFGSSIVRVPCASIDEVFRTTTAAAADFGVVPVENSTEGVVARSLDLLLTTPLFLIGETSLFVRHNLLRQTNSLAGIQAVCAHPQALAQCHGWLSYHLPDVERRPVASNAEGARLASLDPGLAAVASERAGSEFGLHVVAPAIQDDPHNRTRFVIVTHPDRHPQPKASGHDCTSLVVSVNNRPGAVHDMLVPLKQHGVSMTRFESRPARSADQWEYYFYIDLQGHPDEPAVAAALAELRAACSFFKLLGTYPLDVH

SEQ ID NO: 30910 - DNA, 1095 bp, Pseudomonas fluorescens PfO-1
  CDS (1)..(1095)
atgtccgagcaggagctcaaggcgctgcgcgttcgcatcgataacctggatgagaagatcctccagctgatcagcgatcgcgcgcgctgcgccgaagaagttgcccgggtcaagatggccagtctggccgaaggcgagcagcccgtgttctatcgtcccgagcgtgaggcgcaggtccttaagcgcgtgatggagcgcaacaagggaccactgggcaacgaagagatggcgcgcttgttccgcgaaatcatgtcttcgtgcctggccctcgagaacccgctgaaagtggcttatctcggtccggaaggcaccttcacccaggcggcggccatgaagcacttcggtcacgcggtgatcagcaagccgatggcggcgatcgacgaagtgttccgtgaagtggcggccggtgcggtgaactttggcgtggtgccggtggagaactccaccgaaggcgcggtcaaccacaccctcgacagcttcctcgagcacgacatggtgatctgcggcgaagtcgagctgcgcattcaccaccacctgctggtcggtgaaaacaccaagaccgacagcatcagccgtatctattcccacgcccagtcgctggcccagtgccgcaaatggctggacgcccattatccgaatgtcgagcgcgtggcggtttccagcaacgccgaggcggccaagcgggtcaagggcgaatggaactcggcggcgatcgccggtgacatggcggccgggctctatggcctgacccgtctggccgagaagatcgaggatcgcccggacaactccacgcgcttcctgatgatcggtaatcaggaagtgccgccgaccggcgatgacaagacttcgatcatcgtgtccatgagcaacaagcccggcgctctccacgagctgctggtgccgttccatgacaacgggatcgacctgacccggatcgaaacccgtccgtcgcgcagcggcaaatggacctacgtgtttttcatcgacttcgtgggccatcaccgtgatccgctgatcaagggtgtactggaaaagatcagtcaggaagcagtagcactcaaggtgctgggttcctacccgaaagcagttctttaa

SEQ ID NO: 30911 - protein, 364 aa, Pseudomonas fluorescens PfO-1
MSEQELKALRVRIDNLDEKILQLISDRARCAEEVARVKMASLAEGEQPVFYRPEREAQVLKRVMERNKGPLGNEEMARLFREIMSSCLALENPLKVAYLGPEGTFTQAAAMKHFGHAVISKPMAAIDEVFREVAAGAVNFGVVPVENSTEGAVNHTLDSFLEHDMVICGEVELRIHHHLLVGENTKTDSISRIYSHAQSLAQCRKWLDAHYPNVERVAVSSNAEAAKRVKGEWNSAAIAGDMAAGLYGLTRLAEKIEDRPDNSTRFLMIGNQEVPPTGDDKTSIIVSMSNKPGALHELLVPFHDNGIDLTRIETRPSRSGKWTYVFFIDFVGHHRDPLIKGVLEKISQEAVALKVLGSYPKAVL

SEQ ID NO: 30912 - DNA, 1164 bp, Ralstonia metallidurans CH34
  CDS (1)..(1164)
atgacagagcaagacaagtcccccgccgccgatgcccccgcacaggaagccgggcgccaggacgctcctggacccagcgcgcaggagcaggcgttgtcggccgatctggcgccgttgcgcacccagatcgacaccgtcgaccgtgaactgctggcgctgctcaatcgtcgcgcccagctcgccctcgacgtgggcgaggtcaagaagaagtacggcgccccggtatttcgtcccgaacgcgagttgcaggtgatccgcaaggtgcagggcgccaatcccggaccgctgctcgacgaaagcgtggcatcgatttggcgcgaggtgatgtccgcgtgccgcggcctggaaaagccgctcgagatcgccttcctgggcccggccggaacgttctccgagcaggcgctctacgcgcacttcggccacgaggtgacgggcgtgccgtgccccagcattgacgaggtgttccgtgccgtggaggctggtaccgtcgagtacggcgtggtgccggtagagaactcgactgagggcgcggtgtcgcgcacgctcgatctgttcctgcagacgtcgctcaagatcagcggcgagatcgcgctgaaggtccaccacaatctcatggcttccacgccggacatgaagggtgtgaccgtcgtgcgtgcccatgcgcaggcgctggcgcagtgccagaactggctgtccgcgaactatccgcatctggagcgccaggccgtgtccagcaatgccgaagccgcacgcatggccagtgaggaccctaccgttgcggcgattgccggtgaaacggcggccaatcgctatcacctgcacattatccgttcgcacatccaggacgatccgcacaatcgcacccgtttcgcggtgatcggccgctatgagacggagccttctggcagcgatcagacctcgttgatcctgtcggtgccgaacaaggcgggcgccgtgtatcaactgctggcaccactggccgagaacggcgtatcgatgtgcaggtttgaatcgcgcccggcgcgcagtggcgcgtgggaatactacttctacgtggatgtggaaggccatcagcatgaaccggccgtgacgcgcgcgatcgagatgctgcgtcgcaatgccgcgtacctgaaggtcctgggttcgtatccatccagcaaataa

SEQ ID NO: 30913 - protein, 387 aa, Ralstonia metallidurans CH34
MTEQDKSPAADAPAQEAGRQDAPGPSAQEQALSADLAPLRTQIDTVDRELLALLNRRAQLALDVGEVKKKYGAPVFRPERELQVIRKVQGANPGPLLDESVASIWREVMSACRGLEKPLEIAFLGPAGTFSEQALYAHFGHEVTGVPCPSIDEVFRAVEAGTVEYGVVPVENSTEGAVSRTLDLFLQTSLKISGEIALKVHHNLMASTPDMKGVTVVRAHAQALAQCQNWLSANYPHLERQAVSSNAEAARMASEDPTVAAIAGETAANRYHLHIIRSHIQDDPHNRTRFAVIGRYETEPSGSDQTSLILSVPNKAGAVYQLLAPLAENGVSMCRFESRPARSGAWEYYFYVDVEGHQHEPAVTRAIEMLRRNAAYLKVLGSYPSSK

SEQ ID NO: 30914 - DNA, 1107 bp, Magnetococcus sp. MC-1
  CDS (1)..(1107)
atgtcccatgatccgatagatcttaacccttccacattggtggagctgcgtgatggtattgatgccattgatgatcgcatccatgatctgctgatgaagcgggctgagctggtgatgcgggtgggggagcttaagggcaaggggccggcgggtacgcctttttatcggccggagcgggaggcgcagatccatcgtcgtttggaggggcggcatggggggccgttgccggtggaggcggtgcatcggatttttcgcgagattatttcggcttcgttaaatttggagaagcagctttcggtggcctatttggggccggaggcgacttttacgcacgaggcggcgttgaagcagtttgggtcggcttttacgatgttttcgacccgtacgattaccgaggtgtttcacgaggtagagattggtcgcgccaattttggggtggttccggtggagaattcgctggagggggtggtgattcatacattggatcgttttgtgcggtcgcctttgaatatatgtggtgaggttttgatgccggtggagcttaatttactggctcggggtggggtattgggtgaggtacgggtcatttacggtcattttagtgcgttggatcagtgtgcgcagtggcttagccactatttaccgcaggttaagcgggtggaggttgcttcgacggcggaggcggcggagcgggctcggcgggaggagggggcgggggcgatttgtggtccttttgcggccaatcgttatggattggtggtgatcgcggagcatattgaggatcaggcgcggttggagaatcgttttttggtggtgggtcgggagagtccggccccttcgggtgcggacaagacgagcattatggtttcatttttggatgatcctggttttttgcatcgcattcttggggtctttgcggagcgaggcattaatttaagccgcattgagtcgcggcctacgcaggagcgggcgtgggattatcttttttttattgatatggaggggcatcgtcaagatgagggggtatctgctgcgttggaggcgctgggggcgttatctggggtatcggtaaagattcttggctcatatccacaacacgcgctgtag

SEQ ID NO: 30915 - protein, 368 aa, Magnetococcus sp. MC-1
MSHDPIDLNPSTLVELRDGIDAIDDRIHDLLMKRAELVMRVGELKGKGPAGTPFYRPEREAQIHRRLEGRHGGPLPVEAVHRIFREIISASLNLEKQLSVAYLGPEATFTHEAALKQFGSAFTMFSTRTITEVFHEVEIGRANFGVVPVENSLEGVVIHTLDRFVRSPLNICGEVLMPVELNLLARGGVLGEVRVIYGHFSALDQCAQWLSHYLPQVKRVEVASTAEAAERARREEGAGAICGPFAANRYGLVVIAEHIEDQARLENRFLVVGRESPAPSGADKTSIMVSFLDDPGFLHRILGVFAERGINLSRIESRPTQERAWDYLFFIDMEGHRQDEGVSAALEALGALSGVSVKILGSYPQHAL

SEQ ID NO: 30916 - DNA, 1068 bp, Geobacter metallireducens GS-15
  CDS (1)..(1068)
atgaaaacgctccaagagctgcgtcgtgatatcgacgccattgatgatcagatcctggatcttcttaacagccgctcccggctggccatagaggtcggcaaggtcaaagcgggagagaaccgcgacttccacgtcccgagccgtgaacgggaaatctatgagcggcttgcggccgggaattctggacccttcccgaacgaggcggtccggagcgtcttccgggagatcatttctgcttcccttgccctcgaatcccccatgaaggttgcctttctcggccccaaggcgacgttcactcatcttgcttccctgcagcatttcggcctgtcggcggaactcgtcccccagaagtctatccctgctgttttcgaggaggtcagcaaggggcgttccctctacggcgtggttccggtggaaaactccaccgaggggatggtttcccacaccctcgacatgttcatggagagcgatctcaaaatcaacgcggagatactcctggaggtttcccatgatctcctctcccgcaccggccgcttggaggatgtgaagaaggtctactcccacccccaggccattgcccagtgccgcaactggctcgacgagaatctgtcgggcgtgccggtggtggatgtggcctccacggccctggcggcccagatcgtcggggaggactataccgccgccgccattgccagcgagtttgctgcggcgctgtatgatctgaaagtggtgcgccacaggatcgaggaccaggtgaacaacttcacccgcttcctggttgtggggcggaaaatggcagatcggtgcggcgacgacaagacctccctcatgttttcggtcaaggacgagccgggaatcctccaccggatgctggagccctttgccaaacggggggtcaacctgtccaagatcgagtcgcgccccctcaagaaaaaggcctgggagtacatatttttcctcgatctggccggccacatctcagatccggtggtgtccgacgcggtccaggaactgaagaactactgccagtttgtcaagatcctcggatcatacccccgggcgaaatag

SEQ ID NO: 30917 - protein, 355 aa, Geobacter metallireducens GS-15
MKTLQELRRDIDAIDDQILDLLNSRSRLAIEVGKVKAGENRDFHVPSREREIYERLAAGNSGPFPNEAVRSVFREIISASLALESPMKVAFLGPKATFTHLASLQHFGLSAELVPQKSIPAVFEEVSKGRSLYGVVPVENSTEGMVSHTLDMFMESDLKINAEILLEVSHDLLSRTGRLEDVKKVYSHPQAIAQCRNWLDENLSGVPVVDVASTALAAQIVGEDYTAAAIASEFAAALYDLKVVRHRIEDQVNNFTRFLVVGRKMADRCGDDKTSLMFSVKDEPGILHRMLEPFAKRGVNLSKIESRPLKKKAWEYIFFLDLAGHISDPVVSDAVQELKNYCQFVKILGSYPRAK

SEQ ID NO: 30918 - DNA, 1122 bp, Microbulbifer degradans 2-40
  CDS (1)..(1122)
atgagtgataaatccgagccaattagtgcagaagaagcggcgcttcttggtgaattgcgcgtaaaaatagacgatatagatcagcagattggcgacttaatatgtgctcgcgcaaattgtgcggtagaagttgcccatgtaaaaaaacgcttttctaatatcaccgagccaaagttttatcgcccagagcgcgaagcacaggtattgcgcaatgctatggcgcgtaacaagggtccgttgtctaacgaagagtttgcccgtttatttcgcgaaataatgtctgcttgcttggctttagaagcaccagtaaaagtggcttacttggggccagaaggcacctatacccagcaagccgcacttaagcatttcggtcattccgctcaagctgtttctttgcccgctattgatgaagttttccgcgaagtagcatctggtgctgcgcactatggtgtagtgccggtagaaaactccaccgaaggcgtggttacgcacaccttagataactttttaggcagtagcgtaaaaatttgtggtgaagttgtactgcgtattcatcaccacctgttagtttctgatgtaacacacgtacaaaatatttcgcgcatttattctcatgcgcagtctttggcgcaatgcagaaaatggttagatgcacattaccctcgtgcagagcgtatagcggtaagcagtaatgcagaagcagcacgccgaataaaaggcgagtggaattcagctgccattgcaggcgctatggcggcagatttatacggccttactagccacgcacaaaatattgaagaccagccagataactccacgcgctttttaattattggtgcagaaagcgtaggtgcaagcggcgaagataaaacttctattgttgtgtctatgaaaaacgagccgggtgcgttgcacaatttgctagagccattccatcagcacggcatagatttaacccgcgtagaaactcgtccatcgccaaccggtgcgtggaactacgtgttttttatagattttgccggccatgccagcgagccagttgctaaaaaagtgctagaggaagtggggcgcagagcctcagatctgaaaatattaggctcataccctaaaggcgtactttga

SEQ ID NO: 30919 - protein, 373 aa, Microbulbifer degradans 2-40
MSDKSEPISAEEAALLGELRVKIDDIDQQIGDLICARANCAVEVAHVKKRFSNITEPKFYRPEREAQVLRNAMARNKGPLSNEEFARLFREIMSACLALEAPVKVAYLGPEGTYTQQAALKHFGHSAQAVSLPAIDEVFREVASGAAHYGVVPVENSTEGVVTHTLDNFLGSSVKICGEVVLRIHHHLLVSDVTHVQNISRIYSHAQSLAQCRKWLDAHYPRAERIAVSSNAEAARRIKGEWNSAAIAGAMAADLYGLTSHAQNIEDQPDNSTRFLIIGAESVGASGEDKTSIVVSMKNEPGALHNLLEPFHQHGIDLTRVETRPSPTGAWNYVFFIDFAGHASEPVAKKVLEEVGRRASDLKILGSYPKGVL

SEQ ID NO: 30920 - DNA, 1098 bp, Thiobacillus denitrificans ATCC 25259
  CDS (1)..(1098)
atgaaggaccaggcagggactaggcccgacgtgtcggcggaactcggtgcgctgcgcgcgcgtattgacagcatcgacgacacgctccttgcgctgatttcggagcgcgccgcgctcgcgcagcaggtcgggcacgcgaagcagggtgagcgcatctatcggcccgagcgcgaagcgcagatcgtacgcaggctgcgtgagtcgaatcccggcccgctgtcgggcgagaccgtcgagcgcctgatccgcgaaatcatgtcggcctgccgcgcggtcgaggaagtgacgcgggttgcctatctcggcccggccggaacgttcagcgagcaggccgtgcacaagcagttcggccatgaagtcgacgcgctcgccgaggccgacatcgacgcgtgcttccatgccgtcgagaccggccgcgccgattttgccgtggtgccggtcgagaactcgaccgacggcgcggtcgggcgcacgctcgacctcgtcgtggcaagcccgctcagcatctgcggcgaagtcatgctgccgatccatcagaccttgatgcgcaaacacggcgatctcgacggcatccgccgcgtctacggtcacgcgcaatcgctcgcccagtgccagcactggctgagccgccacctgcccgacgccgagcgcgtcagcgtcgtcagcaacagcgagggcgcgcgccgcgccgcggcagagccggtagcggcgacgctcggcagcgaagcggccgctgcgctttacggactttccgtggtcgccgcgcgggtcgaggacgaggcgagcaacacgacgcgctttctggttctcggcgcgcacgacgcggcaccgtcggggcgcgacaagacctcgctcgtgatgggcgcgaagaaccagccgggcgccgtggtcaagctgctgcagccgctcgccgacgcgggcgtgtcgatgagcaagttcgagtcgcgaccggcccgctcgggcacctgggaatacctgttcttcgtcgtctgcgaaggtcaccgcaaggacgcacggctcgccgcggcgctcgccgaaatcgattcgcgggcggccttcctcaagatcctcggctcctaccctgcggcgtcggcatga

SEQ ID NO: 30921 - protein, 365 aa, Thiobacillus denitrificans ATCC 25259
MKDQAGTRPDVSAELGALRARIDSIDDTLLALISERAALAQQVGHAKQGERIYRPEREAQIVRRLRESNPGPLSGETVERLIREIMSACRAVEEVTRVAYLGPAGTFSEQAVHKQFGHEVDALAEADIDACFHAVETGRADFAVVPVENSTDGAVGRTLDLVVASPLSICGEVMLPIHQTLMRKHGDLDGIRRVYGHAQSLAQCQHWLSRHLPDAERVSVVSNSEGARRAAAEPVAATLGSEAAAALYGLSVVAARVEDEASNTTRFLVLGAHDAAPSGRDKTSLVMGAKNQPGAVVKLLQPLADAGVSMSKFESRPARSGTWEYLFFVVCEGHRKDARLAAALAEIDSRAAFLKILGSYPAASA

SEQ ID NO: 30922 - DNA, 1083 bp, Polaromonas sp. JS666
  CDS (1)..(1083)
atgactgccaacctcgccgatttgcgcgtccagattgacgccatagacaaggaattgctggcactcctgaaccgccgcgcgcaggtcgccgagcaggtgggagatgtcaaaaaactcgaaggcacgccctttttccggcccgaccgggttgcccaggtcattgagcagatccagcaagccaacaccggtccgctcaagaacgaacatgttgcagccgtctggcgcgaaatcatgtcggcctgcctggccctcgaatcgccggtgcgtgtggcctacctggggcctgccggcacgttcagcgaacaggcggcccttcaattttttggcgccagcattgaacatgtgccctgcatcagcattgatgaagtgtttcgtgccacggcggcgggcagtgccggttatggcgtggtgccggttgagaactccaccgaaggcgtggtgtcgcgctcgcttgacctcttcctgaactcgccgctgcacatcgtcggcgagatcagcctgatggtgcggcacaacctgctgcggttgtctgactccctggacgacatcgaggccgtgtatgcacatcctcaggccctggcacagtgccagggatggctgaccacccacctgcccaatgcggaacgccgggccgcgtcgagcaacgcagaaggtgcacgcctggcctcgaccaatccggcgtgggccggcatcgccagcgatcgggcggcagcgcaattcggcctgcacacggcagcccacgccatccaggacgacgcctttaaccgcacccgttttgccgtggtctgcctcccgcagacgctgccctcgccacccgcctcgggcaaggactgcgtgagcctggtggtgtccgtgcccaatcgcccgggcgccgtgcacgacatcctggtgccgctgaaaacccacggggtttcgatgacccgcttcgagtcacgtccggcacgatcgggccagtgggaatactatttctatattgacctgcaaggccacccgtcccagccccacgtcaaggcagcgctggctgatttgcagcaactgtgcgcgttttacaaggttctcggcacctaccccgtcagcgattga

SEQ ID NO: 30923 - protein, 360 aa, Polaromonas sp. JS666
MTANLADLRVQIDAIDKELLALLNRRAQVAEQVGDVKKLEGTPFFRPDRVAQVIEQIQQANTGPLKNEHVAAVWREIMSACLALESPVRVAYLGPAGTFSEQAALQFFGASIEHVPCISIDEVFRATAAGSAGYGVVPVENSTEGVVSRSLDLFLNSPLHIVGEISLMVRHNLLRLSDSLDDIEAVYAHPQALAQCQGWLTTHLPNAERRAASSNAEGARLASTNPAWAGIASDRAAAQFGLHTAAHAIQDDAFNRTRFAVVCLPQTLPSPPASGKDCVSLVVSVPNRPGAVHDILVPLKTHGVSMTRFESRPARSGQWEYYFYIDLQGHPSQPHVKAALADLQQLCAFYKVLGTYPVSD

SEQ ID NO: 30924 - DNA, 1128 bp, Neisseria meningitidis
  CDS (1)..(1128)
atgttagaatgcacgataaattactgttcaggcgaaattatgtcccaaactatcgacgaactcctccttccccaccgcaacgccatcgacaccatcgatgccgaaatcctgcgcctgctcaacgaacgtgcgcaacacgcccacgccatcggcgagctgaaaggcacgggcgcagtgtaccgccccgaacgcgaagtcgccgtgttgcgccgcattcaggatttgaacaaagggccgctgcccgacgaatcggtagcacgcctgtttcgggaagtgatgagcgagtgcctcgccgtcgaacgcccgctgaccatcgcctatctggggccgcagggcaacgtttaccagcaggcggcgatcaagcatttcggacacgccgcgcacaccatggcgtgtccgaccatagacaactgcttcaagcaggttgaaacccgtcaggcggattatctggtcgcgcccgtggaaaactcgaccgaaggctcggtcgggcgcacgttggatttgcttgccgttaccgcgttgcaggcgtgcggcgaagtcgttttgcgcatccaccacaaccttttgcgtaaaaacaacggcagcaccgaaggcattgccaaagtcttttcccacgcgcaggcgttggcgcagtgcaacgactggttgggcagacacctgcccaacgccgaacggattgccgtgtccagcaatgccgaagccgcaaggctggttgccgaatcggacgacggtacggttgccgccatcgccggacgcacggcggcggaaatctacggactcgatatggttgccgagtgcatcgaagacgaaccgaacaacaccacgcgcttcttggtgatgggacatcacgaaaccggtgcaagcggcagcgacaagacttcgctggccgtttccgcgcccaaccgggcaggcgcggttgcctcgctgctgcaaccgctgactgagtcgggtatttccatgaccaagtttgagagccgtccgagtaaatccgttttgtgggaatacctgttcttcatcgacatcgaaggacaccgccgggacgcgcagattcagacggcattggaacgcttgggcgaacgcgcttcgttcgtcaaagtcatcggttcgtacccgaccgccgttttgtag

SEQ ID NO: 30925 - protein, 375 aa, Neisseria meningitidis
MLECTINYCSGEIMSQTIDELLLPHRNAIDTIDAEILRLLNERAQHAHAIGELKGTGAVYRPEREVAVLRRIQDLNKGPLPDESVARLFREVMSECLAVERPLTIAYLGPQGNVYQQAAIKHFGHAAHTMACPTIDNCFKQVETRQADYLVAPVENSTEGSVGRTLDLLAVTALQACGEVVLRIHHNLLRKNNGSTEGIAKVFSHAQALAQCNDWLGRHLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKVIGSYPTAVL

SEQ ID NO: 30926 - DNA, 1089 bp, Aquifex aeolicus
  CDS (1)..(1089)
atggaagagctaaaggaactcagaaaagagatagacaggatagacgaagagatactcaggctcttaaacgaaagggcaaagcttgcaaagaggataggggaaataaagtcaaaggcaaacctccccatacacgtccccgaaagggaaagggaaatttttgaaaaaatactgaggcttaacaaagaagtttacggcggtgtttttcctcaagaggcactcgttcacatatacagggagattatctccgcttgtctttccttagaaaagaaaataaaagtagcctaccttggtccaaaggctacatttacccatcaagctgcccttgagtttttcggattttctgctcactacacaccatgttccaccataagggacgtgttcgtggaagtggaaacgaaaagggcggattacggcgtagttcccgtggaaaacacgatagagggagtagttaattacacccttgacatgttcctggaaagtgacgtaaagattgcgggagagatagtgatacccataacgctacacttgctctcggcttcggatagtatagaaaacgttgaaaaggtttattcccataaaatggcccttgcccagtgcaggagttggcttgagaaaaatcttccgagtgtacaggttatagaagtagagagcaccgcaaaagcttgtgaaatcgcccttgaagatgagagagctggagccgtagcctcggaagttgcggcctacacttaccacctcaacatactcgcaagaaacattcaggattcgggagacaacttcacgaggttcttagttatagcgaagagggatttaaaacccacgggaagcgataagacgagcatacttttcggtgtaaaagacgagcccggagctctctacaaagccttagaagtcttttacaaacacggaattaacttaaccaagatcgaatcaagaccatcaaagaagaaggcttgggattacgtctttttcgtagatttagaaggacacaaggaagaagagagagtagaaaaggcattgaaagaactcaaagaaaaaacccaattcctgaaggttctcggttcttaccccaaggccttgcttcaggagtaa

SEQ ID NO: 30927 - protein, 362 aa, Aquifex aeolicus
MEELKELRKEIDRIDEEILRLLNERAKLAKRIGEIKSKANLPIHVPEREREIFEKILRLNKEVYGGVFPQEALVHIYREIISACLSLEKKIKVAYLGPKATFTHQAALEFFGFSAHYTPCSTIRDVFVEVETKRADYGVVPVENTIEGVVNYTLDMFLESDVKIAGEIVIPITLHLLSASDSIENVEKVYSHKMALAQCRSWLEKNLPSVQVIEVESTAKACEIALEDERAGAVASEVAAYTYHLNILARNIQDSGDNFTRFLVIAKRDLKPTGSDKTSILFGVKDEPGALYKALEVFYKHGINLTKIESRPSKKKAWDYVFFVDLEGHKEEERVEKALKELKEKTQFLKVLGSYPKALLQE

SEQ ID NO: 30928 - DNA, 1158 bp, Buchnera aphidicola
  CDS (1)..(1158)
atgcctgctaacaattccttgctaatctttcgtgacgaaattaataacattgataaaaaaatagtaaaattattggccgaaagaaaaaatttagtatttaaaatagctcaatcaaaaatagaaaataatcaggcgataagagatatagaacgtgaaaaaaaaatgttgcaaaaattaatttttttggggaaaaaatacaatttaaaatccgaatatatcactcaattatttcaactaataattgaagaatctgtggcaactcaaaaaaagttattaaagaaattttgcaatcataataaattaattcctgctaatttttcatttctcggtcctaaaggttcttactctcatattgctgcttataaatatgcagatctcaattttcaaaaatgtattacaaatgaatgctcaacatttgaagaagtagttctatcagtcgaaaataatcaatcagattatgctgttttaccaattgaaaacacctgttctggttctattaatgaagtttttgatattttaaaaaaaactaatttatttattattggagaaattaatatttttataaaccataatttacttactcttaaaaaaattgaactaaataagattaaaacaatatatagtcatcctcagccatttcaacaatgcagtgattttattaaaaaatttccagaatggaaaattaaatatactaagagtactgcagatgcaatgaaaaaaattaagaaatataatgacgtaactaatgcagcattaggaagcgaaataggaagcaaaatttacggattagaaatattaatgaaaaatttagcaaataaagaaaataatattacgagatttattttattaaatcgcaatcctaaaaaaatttctaaaaacataccaactacaacaacattaatatttactacaggacaagaagcaggatctctttctaaagtattatcaatattgcaagaaaaaaaattaattatgaaaaaattaacttctcaaaaaatttacaaaaatccatgggaggaaatgttttatattgatattcaagtcaatttatcatcaacactaatgcaagatgctcttgaaaaaatcaaaaaaattactagatttataaaaattttaggctgttatcctagtgaaaaaataacaccaatagcaccgtaa

SEQ ID NO: 30929 - protein, 385 aa, Buchnera aphidicola
MPANNSLLIFRDEINNIDKKIVKLLAERKNLVFKIAQSKIENNQAIRDIEREKKMLQKLIFLGKKYNLKSEYITQLFQLIIEESVATQKKLLKKFCNHNKLIPANFSFLGPKGSYSHIAAYKYADLNFQKCITNECSTFEEVVLSVENNQSDYAVLPIENTCSGSINEVFDILKKTNLFIIGEINIFINHNLLTLKKIELNKIKTIYSHPQPFQQCSDFIKKFPEWKIKYTKSTADAMKKIKKYNDVTNAALGSEIGSKIYGLEILMKNLANKENNITRFILLNRNPKKISKNIPTTTTLIFTTGQEAGSLSKVLSILQEKKLIMKKLTSQKIYKNPWEEMFYIDIQVNLSSTLMQDALEKIKKITRFIKILGCYPSEKITPIAP

SEQ ID NO: 30930 - DNA, 1158 bp, Buchnera aphidicola
  CDS (1)..(1158)
atgccatctaaaaatgatttattaagttttcgaagtgaaatcaacaacatcgacaaaaatattgttcaattattggcaaaaagaaaaaaattagtattaaatatagcagaatctaaaataaaaaataatcaacctatacgagacatagaaagagaaaaaattttattagaaaaactaactaatttaggaaaaaaaaataatttaaatactaattatataacacgtttattccaattaataattgaagaatctgtattaacacaaaaaaaattattaaataagttttgcaatgataataatcttgaccttgctagtttttcttttcttggtcctaaaggttcttattcacatattgctgcatctcaatatgcagaacaaaatttcaaaacatgtattgaaaatgcatgtttaagttttaacgaagttatacaatcagttgaaaacaatcaaacagattatgctgttctaccgatagaaaatagttgttctggatttattaatgaaatatttgatattttaaaaaaaacaaacttatttattattggagaaattaacatttcgataaatcattgcttacttgcaataaaaaaaatagagcttaacaaaattaaagcagtatatagtcatcctcaaccatttcaacaatgcagttattttataaaaaaatttccaaattggaaaattcaatatactaatagtactgcagatgcaatgaaaaaaattgtcaaatacaacataacaaccaatgctgctttaggaagtgaattaggaagtaaaatttatggattaaaggtattgtacaaaaatttagcaaataaaaagaaaaatattacaagatttatcttattatcaagaaaacctgttagtatttcttcaaaaatccctacaaaaacaacgttaatattcaatacaggtcaagaatcaggcgctctcgctgaagtattattaatcttgaaaaagaataaattaattatgaaaaaattaacttctcaaaatatttataaaaatccatgggaagaaatgttttatattgatgttcaagctaatttatcatcttccttaatgcaagaaactcttgaaaaaataggtaaaattactaaatttataaaaattctaggttgttatccaagtgaaaatataacaccaataatcccataa

SEQ ID NO: 30931 - protein, 385 aa, Buchnera aphidicola
MPSKNDLLSFRSEINNIDKNIVQLLAKRKKLVLNIAESKIKNNQPIRDIEREKILLEKLTNLGKKNNLNTNYITRLFQLIIEESVLTQKKLLNKFCNDNNLDLASFSFLGPKGSYSHIAASQYAEQNFKTCIENACLSFNEVIQSVENNQTDYAVLPIENSCSGFINEIFDILKKTNLFIIGEINISINHCLLAIKKIELNKIKAVYSHPQPFQQCSYFIKKFPNWKIQYTNSTADAMKKIVKYNITTNAALGSELGSKIYGLKVLYKNLANKKKNITRFILLSRKPVSISSKIPTKTTLIFNTGQESGALAEVLLILKKNKLIMKKLTSQNIYKNPWEEMFYIDVQANLSSSLMQETLEKIGKITKFIKILGCYPSENITPIIP

SEQ ID NO: 30932 - DNA, 1116 bp, Buchnera aphidicola
  CDS (1)..(1116)
atgacattaaaaaatgctttactagcattcagaaacgccattaatattttagataaaaatttaattaatcttttggcaaaacgtaaacaactatccttaaatatagcccataccaaagtcaaaaataactatccagtgagagatattgaacgagaacaaatgttattgaaaaatcttacaatattaggagaaaaacattttcttaataaaaaatatattgaaagtttattttcaattattcttgaagattcagtattgactcaaaaaaaatggataaaaaaatataacctaaacaagtataaattggaaaaaatctcatttttaggttcttttggatcttattcgcacctagcagcacaaaaatatgctaaaaaacattcaaaaatattaactgacaagatctataaaaatttttctgatgtaattacttcagtcgaacagcagcaatcaacttatgctattttaccaattgaaaatcaatcttctggattaattatagaagtatataagttgttacaaaaaacccctttgttcataattggaaatatttacattcatgcaaaccattgtttattagcaaaaaaatatactccaatacttaaaatacaaaaaatttacagtcatatacaaccatttaaacaatgtagcaaatttatcagcctttttcccaactggaaattaagcaatactactagtacatcagaagctatacaacatgttgcaaaagaaaatgataacactatagccgcattaggaaatgaatcttatggtgaattaaataaattagaagttatagcaaaaaacatttcaaataaacgtaataacattactcaatttattatactagcacaaaaaaaaacatatataacaaacaaaaaaactcatttaaaaacaataatactgatttcaaaaaaaaatgaaaattgcgaaaaaataatacgaaatatacttcataaaaataaaattactttattaaaattaaaatattatgtcacatctaaagttcttctagaaaaaatattttttattgaaatagaaaatatctattgtataaaacatattctaaaacaatttactatagaaattaaatgtataaaaatattagggtgtttttaa

SEQ ID NO: 30933 - protein, 371 aa, Buchnera aphidicola
MTLKNALLAFRNAINILDKNLINLLAKRKQLSLNIAHTKVKNNYPVRDIEREQMLLKNLTILGEKHFLNKKYIESLFSIILEDSVLTQKKWIKKYNLNKYKLEKISFLGSFGSYSHLAAQKYAKKHSKILTDKIYKNFSDVITSVEQQQSTYAILPIENQSSGLIIEVYKLLQKTPLFIIGNIYIHANHCLLAKKYTPILKIQKIYSHIQPFKQCSKFISLFPNWKLSNTTSTSEAIQHVAKENDNTIAALGNESYGELNKLEVIAKNISNKRNNITQFIILAQKKTYITNKKTHLKTIILISKKNENCEKIIRNILHKNKITLLKLKYYVTSKVLLEKIFFIEIENIYCIKHILKQFTIEIKCIKILGCF

SEQ ID NO: 30934 - DNA, 1164 bp, Erwinia herbicola
  CDS (1)..(1164)
atgaatcccgataatccattgctggcgctacgcgacaaaatcagcgccgtggataaaaaacttctgacgctgctggccgagcgtcgtttgctggcagtggaagttgcacaagcgaaactggcgacgcatcgcccgattcgggatgtggagcgcgaacgcgcgctactggagaatctcatcgtactgggtaaggcacacaacctggatgcgcactacatcacccgtctgttccagctggtaattgaagattccgtgctgactcagcaagcgctgctgcaaaaaaacctcaaccatccccatgcgcatgccgcccgtatcgcctttctgggcccgaaaggctcttattcgcatcttgcagcacgcaactacgcgtcgcgccatttcgatagcatggtggagtgtggctgcctgaagtttcacgacatcatcaaacaggtcgaaaatggcgtagctgattacgccgtgatgccgattgagaataccagttcaggctcgatcaacgatgtctacgatctgctgcaacagaccagcctctcaatcgtgggcgagctgacattgcctatcgaccactgcgtgctggtgaatggccccaccgatcttcagcagattgagacggtttacagccatcctcaaccgttccagcagtgcagccagtttattaatcgtttcccgcactggaaaatcgaatacaccgagagtaccgcggcagcgatggagaaagtggctgcgctcaactcacctaaggtggcggcgctgggcagtgaggccggcggcgaactgtatcagctgcaggtgctggaacgtaatctggcgaatcagcagcagaaccacacccgctttatcgtgctggcccgcaaagcaatcgaggtttctgaccaggtgccagcgaaaaccacgctgattatggcaaccggccagcaggcgggtgcgctggtcgacgcgctgctggtactgcgtcagcacaacctgattatgagcaagctggagtcccgcccgattaatggtaatccgtgggaagagatgttttacattgatgtgcagggcaacctgcaatcagagcggatgcagcaggcgctgcaggaattacagaccatgacccgctctctgaaggtactgggctgttaccccagcgaaaatgtggtgcccgctgaacctggccggtaa

SEQ ID NO: 30935 - protein, 387 aa, Erwinia herbicola
MNPDNPLLALRDKISAVDKKLLTLLAERRLLAVEVAQAKLATHRPIRDVERERALLENLIVLGKAHNLDAHYITRLFQLVIEDSVLTQQALLQKNLNHPHAHAARIAFLGPKGSYSHLAARNYASRHFDSMVECGCLKFHDIIKQVENGVADYAVMPIENTSSGSINDVYDLLQQTSLSIVGELTLPIDHCVLVNGPTDLQQIETVYSHPQPFQQCSQFINRFPHWKIEYTESTAAAMEKVAALNSPKVAALGSEAGGELYQLQVLERNLANQQQNHTRFIVLARKAIEVSDQVPAKTTLIMATGQQAGALVDALLVLRQHNLIMSKLESRPINGNPWEEMFYIDVQGNLQSERMQQALQELQTMTRSLKVLGCYPSENVVPAEPGR

SEQ ID NO: 30936 - DNA, 1158 bp, Haemophilus influenzae
  CDS (1)..(1158)
atggcattagaattatctgacattcgccaacaaattacgcaaatagatcgtagtttattaaaattactttctgagcgtcatcgtttagctttcgatgtagtgagaagtaaagagatctcgcaaaaatctttacgtgatgtagagcgagaacagcaacttttacaagaactagtgcaatttgcagaaaatgaaaattatcagcttgaagcacaatatatcacttcaattttccaaaaaatcattgaagactcggtattgacccagcaagtctatttgcaaaataaacttaatgaacaacgtaatcaaaatttacatatcgcttttttaggtaaacgtggttcttattctaatttagctgcacgtaattatgctgctcgttatcaaaaacaatttgtagaactaggatgtcagtcttttgagcaagtatttgaaaaagttcagactggagaagctgactttggtgtgttacctttagaaaatacaacatcgggtgcaattaatgaagtttatgatttacttcagcatactgatttatcattagtgggagagttggcatatccaatcaaacattgcgtacttgtcaatgataagacagatttgaaccaaattgatacgttgtatagtcatcctcaagtgattcaacaatgtagtcaatttattcatagccttgatcgcgtgcatattgaatattgcgaaagtagttcacacgcaatgcaattagtcgcaagtttgaataaacctaatattgcagcattgggcaatgaagacggtggaaaattgtatggacttagtgtattaaaaactaatattgctaatcaagagaacaatattacgcgttttattgtggtggctaaagagcctcgcgaagtttcatcacagattcccacaaagaccttattattaatgacaacttcacagcaagctggtgcgttagtggatgctttattggtgtttaaaaagcatcaaatcaatatgacaaaactggaatctagaccgatttatggtaagccttgggaagaaatgttttatctagaaattgaagcaaatattcatcatccagatacaaaacaggctttggaagaactaaaaaattatagtaattacttaaagattttaggctgttatcctagtgaaattgtaaagcctgtgagcgtgtaa

SEQ ID NO: 30937 - protein, 385 aa, Haemophilus influenzae
MALELSDIRQQITQIDRSLLKLLSERHRLAFDVVRSKEISQKSLRDVEREQQLLQELVQFAENENYQLEAQYITSIFQKIIEDSVLTQQVYLQNKLNEQRNQNLHIAFLGKRGSYSNLAARNYAARYQKQFVELGCQSFEQVFEKVQTGEADFGVLPLENTTSGAINEVYDLLQHTDLSLVGELAYPIKHCVLVNDKTDLNQIDTLYSHPQVIQQCSQFIHSLDRVHIEYCESSSHAMQLVASLNKPNIAALGNEDGGKLYGLSVLKTNIANQENNITRFIVVAKEPREVSSQIPTKTLLLMTTSQQAGALVDALLVFKKHQINMTKLESRPIYGKPWEEMFYLEIEANIHHPDTKQALEELKNYSNYLKILGCYPSEIVKPVSV

SEQ ID NO: 30938 - DNA, 1098 bp, Pseudomonas stutzeri
  CDS (1)..(1098)
atgagcgaggctgaccagctcaaggccctgcgcgtacgcatcgacagtctggacgagcggattctcgatctgatcagcgagcgtgcccgttgcgcccaggaagtggcgcgggtcaagaccgcgtcgtggccgaaggcggaggaggcggtgttctaccgccccgagcgtgaagcctgggtgctcaagcacatcatggagctgaacaaggggccgctggacaacgaggaaatggcgcgcctgttccgcgaaatcatgtcctcctgcctggctctggagcagccgctgcgggtcgcctatctcggcccggaaggcaccttctcgcaggcagcggcgctcaagcatttcggtcattcggtgatcagcaagccgatggcggccatcgacgaggtgttccgcgaggtggtcgccggtgcggtgaacttcggcgtggtgccggtggaaaactccaccgaaggcgcggtcaaccacacgctggacagcttcctcgagcacgatatcgtcatctgcggcgaagtcgagctgcgcatccaccatcacctgctggtgggcgagacgaccaagaccgatcgcatcacccgcatttattcccacgcccagtcgctggcccaatgccgcaagtggctggacgcgcactaccccaacgtcgagcgcgtggcggtatcgagcaacgccgacgccgccaagcgagtgaagagcgagtggaattcggcggccatcgccggtgacatggcggcgcagctgtatgggctgagcaagctggccgagaagatcgaagaccgcccggtcaattccacgcgctttctgatcatcggtagccaggaagtgccgccgaccggcgacgacaagacctcgatcatcgtctccatgcgcaacaagccgggtgccctgcatgagctgctgatgccgttccactccaacggcatcgacctgacccgcatcgaaacgcgcccgtcgcgcagcggcaagtggacctatgtgttcttcatcgactgcatggggcaccaccaggacccgctgatcaagaacgtgctggagaagatcggccacgaagccgtggcgttgaaggtgctggggtcgtacccgaaagccgtgctgtaa

SEQ ID NO: 30939 - protein, 365 aa, Pseudomonas stutzeri
MSEADQLKALRVRIDSLDERILDLISERARCAQEVARVKTASWPKAEEAVFYRPEREAWVLKHIMELNKGPLDNEEMARLFREIMSSCLALEQPLRVAYLGPEGTFSQAAALKHFGHSVISKPMAAIDEVFREVVAGAVNFGVVPVENSTEGAVNHTLDSFLEHDIVICGEVELRIHHHLLVGETTKTDRITRIYSHAQSLAQCRKWLDAHYPNVERVAVSSNADAAKRVKSEWNSAAIAGDMAAQLYGLSKLAEKIEDRPVNSTRFLIIGSQEVPPTGDDKTSIIVSMRNKPGALHELLMPFHSNGIDLTRIETRPSRSGKWTYVFFIDCMGHHQDPLIKNVLEKIGHEAVALKVLGSYPKAVL

SEQ ID NO: 30940 - DNA, 24 bp, Primer
atgacatcggaaaacccgttactg

SEQ ID NO: 30941 - DNA, 25 bp, Primer
ttaggttggatcaacaggcactacg

SEQ ID NO: 30942 - protein, 391 aa, consensus
  MISC_FEATURE (1)..(391): consensus for the disclosure of xaa see table XV
LXXXRXXIXXXDXXXXXLXXXRXXXXXXXXXXKXXXXXXXXXXXXXXXXXXXXXXXXXXXXXXXXXXXXXLXXXXXXXXXXXIXXXXXXXXXXXXXXXXXXXXXXXXXXXXAXLGPXGXXXXXAXXXXXXXXXXXXXXXXXXXXXXXFXXVXXXXXXXXVXPXENXXXGXXXXXXDXXXXXXXXIXGEXXXXXXHXXXXXXXXXXXXXXXXXXHXQXXXQCXXXXXXXXXXXXXXXXXXXXSXAXXXXXXXXXXXXXXAAXXXXXXXXXYXLXXXXXXXXXXXXXNXTRFXXXXXXXXXXXXXXXXXXXTXXXXXXXXXXGXXXXXLXXXXXXXXXXXXXESRPXXXXXXXWXXXFXXDXXXXXXXXXXXXXXXXXXXXXXXXXKXLGXYP

SEQ ID NO: 30943 - protein, 33 aa, consensus
  MISC_FEATURE (1)..(33): consensus for the disclosure of xaa see table XV
XXXXRXXXXXXDXXXXXXXXXRXXXXXXXXXXK

SEQ ID NO: 30944 - protein, 14 aa, consensus
  MISC_FEATURE (1)..(14): consensus for the disclosure of xaa see table XV
XXXLGXXXXXXXXX

SEQ ID NO: 30945 - protein, 42 aa, consensus
  MISC_FEATURE (1)..(42): consensus for the disclosure of xaa see table XV
XXXXXXXXXXXXXXXPXENXXXGXXXXXXDXXXXXXXXXXXX

SEQ ID NO: 30946 - protein, 36 aa, consensus
  MISC_FEATURE (1)..(36): consensus for the disclosure of xaa see table XV
XXXXXXXXXXXXXXXXXXXXXXXXXXXXNXXXFXXX

SEQ ID NO: 30947 - protein, 56 aa, consensus
  MISC_FEATURE (1)..(56): consensus for the disclosure of xaa see table XV
XXXXXXXXXXXXXXXXXXXXXFXXXXXXXXXXXXXXXXXXXXXXXXXXXXXXXGXX

SEQ ID NO: 30948 - DNA, 681 bp, Escherichia coli K12
  CDS (1)..(681)
atgatcaggagtcacaccatgaccattacgtctctggatggctatcgctggctgaagaacgatattattcgcggtaattttcaaccggatgaaaaattacgaatgagtttgctgacatcgcgttatgcacttggcgttgggccgttacgggaagctctttcgcaactggtggcggaacggctggtcacggtggtgaatcaaaaagggtatcgggtggcgtctatgtcagagcaggagctgctcgatattttcgacgcccgcgccaatatggaagcgatgttagtgagtctggcgattgcccgcggtggcgatgagtgggaggcagacgttctcgcaaaagcgcatctgctgagtaagcttgaggcctgtgacgccagcgagaaaatgcttgatgagtgggatctgcgtcatcaggcgtttcatactgcaattgtggcgggctgtggttctcactatttgctgcaaatgcgtgaacggttgtttgatctggcggcgcgttatcgatttatctggctgcggcgaacggtgctttcggtggaaatgctggaggataaacacgatcagcaccagaccctgactgcggcggtactggcgcgagataccgcgcgcgccagtgagttaatgcgccagcatttactgacgccaattcccattatccagcaggcgatggctggcaattaa

SEQ ID NO: 30949 - protein, 226 aa, Escherichia coli K12
MIRSHTMTITSLDGYRWLKNDIIRGNFQPDEKLRMSLLTSRYALGVGPLREALSQLVAERLVTVVNQKGYRVASMSEQELLDIFDARANMEAMLVSLAIARGGDEWEADVLAKAHLLSKLEACDASEKMLDEWDLRHQAFHTAIVAGCGSHYLLQMRERLFDLAARYRFIWLRRTVLSVEMLEDKHDQHQTLTAAVLARDTARASELMRQHLLTPIPIIQQAMAGN

SEQ ID NO: 30950 - DNA, 738 bp, Pseudomonas sp
  CDS (1)..(738)
atgaatgcgagaactccaaacagcctcaccatgggaggcgacaagtcatttgcggatgcgtcgccggtgcccatcgcgaacgtgcgcagcctgattgaggcgacgtttcagcggttgcgggcggacatcgtggaggggcgactcgctgctggctccagactcgccattgaagatctcaagtcgcgctatgaggttagcggcgggaccgtgcgggaggcgctttccctgctggtggccaataacctggtgcagacacaggcccagcgtggatttcatgtgacccccatgtctctggatgacatgcgtgatctggccgccacgcggatcgcgcttgagtgcgaagcgctgcgccaaagtgtgctgaatggcgacgccgaatgggaggcgcgggttgtcagttcgtatcaccggctctcgctcctcgacgagcgcacgatgcgcgatccggttcacttgttcaatcagtgggagcaagccaaccgcgactttcacgaagccctgatctcagcctgttcatccgcctggacccagcggttcctgtctatcctgtatttgcaaatggagcgctaccgccgattgacggcgatgcacaaccggcctgccagaaacgtgcacgaggagcatctggcgcttcgtgacagcgcgctcgcgcgtgatgccgagcgctgtactgagttgttgcggatgcatattgagtcatcaatttcggtggttcggcaattcggtttgttgcggtga

SEQ ID NO: 30951 - protein, 245 aa, Pseudomonas sp
MNARTPNSLTMGGDKSFADASPVPIANVRSLIEATFQRLRADIVEGRLAAGSRLAIEDLKSRYEVSGGTVREALSLLVANNLVQTQAQRGFHVTPMSLDDMRDLAATRIALECEALRQSVLNGDAEWEARVVSSYHRLSLLDERTMRDPVHLFNQWEQANRDFHEALISACSSAWTQRFLSILYLQMERYRRLTAMHNRPARNVHEEHLALRDSALARDAERCTELLRMHIESSISVVRQFGLLR

SEQ ID NO: 30952 - DNA, 678 bp, Salmonella enterica subsp. enterica serovar Typhi
  CDS (1)..(678)
atgaccgccctttcccaaccgacggccatagatggctatcgctggcttaaaaatgacattattcgcggcacttatcagccggatgagaaactgcggatgagtttattaaccgcccgctatgcgctcggcgtagggccgctgcgtgaggcgctgtcgcaactggtggcggaacggctggtcaccgtggtgaatcaaaaaggctatcgcgtggcatccatgtcagaggcggaactcctcgatatttttgacgcgcgcgccaatatggaagcgatgctggtacgcctggcgattgaacgcggcgatgatgcgtgggaggcggagatcctggcgcgagcgcatatgctcagcaaactggaagccagcgatgccagtgaacatatgctcgatgaatgggatcagcgccaccaggcgttccattccgccattgtcgccgggtgcggctcccactatctgctacagatgcgcgaacgcttatttgacctggcggcccgctaccgctttatttggttacgtgaaaccgttctgtccgtcgagatgctggaagataaacatatccagcatcacacgctaaccgaagcgatactggcgcgcgaggcggcacgcgccagcgaattaatgcgtcagcatttgctgacgccgattcccattattcgccaggcgatggcagggaaaatgtag

SEQ ID NO: 30953 - protein, 225 aa, Salmonella enterica subsp. enterica serovar Typhi
MTALSQPTAIDGYRWLKNDIIRGTYQPDEKLRMSLLTARYALGVGPLREALSQLVAERLVTVVNQKGYRVASMSEAELLDIFDARANMEAMLVRLAIERGDDAWEAEILARAHMLSKLEASDASEHMLDEWDQRHQAFHSAIVAGCGSHYLLQMRERLFDLAARYRFIWLRETVLSVEMLEDKHIQHHTLTEAILAREAARASELMRQHLLTPIPIIRQAMAGKM

SEQ ID NO: 30954 - DNA, 675 bp, Sinorhizobium meliloti
  CDS (1)..(675)
atgagcgaaaacattttctacaagctgcgggacgatatcgagaacggcatcgtaacgggcgagttcgagccgggtgaacgcctggacgagacgcaactcgccatgcgcttcggcgtatcccgcaccccgatccgcgaagccttgatgcaattgagcgcgatcgggcttgtcgagatcagaccgcggcgcggcgcagtcgtcgtggacccggcacctcagcgcgtctacgaaatgttcgaggtgatggctgaactggaaggcatggcgggtgctcttgccgctcgccggcataccgaggaagacagtgcggctctgttggctgcccacgagaaatgccgggaggcggtcctcagcgaggagaccgatcgctactattatgaaaacgagatattccatcgtgcgatatacacggcgagccatagcggctttctcgaggagcaatgcacgaccttgcatcgccgccttcgcccctatcgtcgcctgcagctcagagttcgtaaccgcatgaaggtctcgttcagggaacatggagagatcgtcgaagccattctttccggcaatacggatggcgcgcgggagggtttgcgcagccatgtggcggtccaaggagaccgcttcggtgaccttgtagcaaacctctcgaaccgtgagcggcgcagcggccgcctcggatag

SEQ ID NO: 30955 - protein, 224 aa, Sinorhizobium meliloti
MSENIFYKLRDDIENGIVTGEFEPGERLDETQLAMRFGVSRTPIREALMQLSAIGLVEIRPRRGAVVVDPAPQRVYEMFEVMAELEGMAGALAARRHTEEDSAALLAAHEKCREAVLSEETDRYYYENEIFHRAIYTASHSGFLEEQCTTLHRRLRPYRRLQLRVRNRMKVSFREHGEIVEAILSGNTDGAREGLRSHVAVQGDRFGDLVANLSNRERRSGRLG

SEQ ID NO: 30956 - DNA, 923 bp, Pseudomonas pseudoalcaligenes
  CDS (95)..(832)
atcgattatcgacatttttgaagccgctttcctccccggatcctgattccgaaagtgctgaaaatttttctttaacgagcatgtgtgaaatgcaatgaatacgagaactccaagcggcgttgcgatggcaggcgaaaagtcattttcggatgcatcgacggtgcctcgcgcgaagatgcgcagcctgattgaggtgacgtttcagcgtttgcgagcagacatcgtggaggggcgactcgctgcgggctccagactcggcgttgaagatctcaagtcgcgctatgaggtcagcggcggaaccatgcgggaggcgctttctctgctagtagccgaaaacctggtgcagacacaggcccagcgtgggtttcatgtgaccccaatgtccctgggtgacatgcgtgatttggcggccacccggatcgcgctcgagagcgaagcgttacgccaaagcgtgctgaatggtgacgctgaatgggaggcgcggatcgtcagttcgtttcaccgactgtcattgattgaagagcccacgatgcgggatccggctcgctggtttaatgagtgggagccagtcaaccgcggttttcacgaagctcttatctctgcctgttcgtccgtctggatccggcggttcctgtccatcctgtatgtgcatatggagcgctaccgccgattgactgctatgcacaacccgcctaccagaaacgtacatgaggagcatctagcacttcgcgacagcgcgctcgcgcgagatgccgagcgctgtgctgcgttgatggcggagcacatcgaatcatcaatttcggtggttcgggaattcggtttgttgaggtgacgccaacatcccacgtgtttgttttcgtcgtgatggatgcggtcggcattttttcgccctactaagggcatttcaaaggagacgttgaatc

SEQ ID NO: 30957 - protein, 245 aa, Pseudomonas pseudoalcaligenes
MNTRTPSGVAMAGEKSFSDASTVPRAKMRSLIEVTFQRLRADIVEGRLAAGSRLGVEDLKSRYEVSGGTMREALSLLVAENLVQTQAQRGFHVTPMSLGDMRDLAATRIALESEALRQSVLNGDAEWEARIVSSFHRLSLIEEPTMRDPARWFNEWEPVNRGFHEALISACSSVWIRRFLSILYVHMERYRRLTAMHNPPTRNVHEEHLALRDSALARDAERCAALMAEHIESSISVVREFGLLR

SEQ ID NO: 30958 - DNA, 681 bp, Bacillus licheniformis DSM 13
  CDS (1)..(681)
atgaagttttcgatccaacgtgcagtctcttatcatgatcaagtccatcattatttaaaagatatgattattaaaggaggatatcagcccggcgaacggatctatgaatccaaaatcgccaaggagctgcaagtgagccgcagccccgtcagagaggcgattcggacacttgaacaagaaggcctgttattgatagatgataaatcaaaaattacagtttatgaaccgacaatcaaagatcttgaagaaatataccaatgccgtcaggcgctcgaatccctggccgtttctttggcgactcgccttgcctctaatgaaacactggagctcatttccgaaacgctctctgaggcgcataagcaccagaaaagccaaggtccggagtcggctaatgctctgcttcgcctaaatacgcaatttcatgatgccatcatcgaagcgagcgaaaacgaacgcctgcaaaaacagctgcttgatttacggtcgctgacctttttctaccggagcaaaaaccttgaaaaaccggagcgcactcttgaaatcatcaatcagcacgaggagattctgcgtcacatgcaggacagaaatgacgcaaaagcagccgaatcaatgaggaagcatatagaggcagacctttgctacttaaaagaggtgttgttcagaagcagtgccgcacgctaa

SEQ ID NO: 30959 - protein, 226 aa, Bacillus licheniformis DSM 13
MKFSIQRAVSYHDQVHHYLKDMIIKGGYQPGERIYESKIAKELQVSRSPVREAIRTLEQEGLLLIDDKSKITVYEPTIKDLEEIYQCRQALESLAVSLATRLASNETLELISETLSEAHKHQKSQGPESANALLRLNTQFHDAIIEASENERLQKQLLDLRSLTFFYRSKNLEKPERTLEIINQHEEILRHMQDRNDAKAAESMRKHIEADLCYLKEVLFRSSAAR

SEQ ID NO: 30960 - DNA, 654 bp, Photobacterium profundum
  CDS (1)..(654)
atgtctagccctactttgactaataaaattatggaagttatacgacaagatattctgcttggagagctttctccgggccaaaagcttgtcgttgccgacttaaaagcacgctataacgtcggagcctcacccattcgcgaagcgctggttcaattatcatggaaaaaatacgtcaaattcgcccctcaaaaaggctgctgggttgcccccatttcggtagatgaacttgaagatctgtttgagactaatctgattttatctcgcgtattattagaacgagcaatcatcaatggcgacgaggcatgggaactcaatattctcactacctatcacaagttaagcaaaataaaccctgcggcttcagacgttgattttacggaatgggaagatcggcacagtgaattccacctcgctttacttgcgggcagccaatcaccagtaatgctggaactataccgtgaagtttatgagcaaattgaacgttaccgtcacgtctgggtaagccgcaatcgccactatgaagaacgttatcatgataatggtgaacatgacgcgatgatgaaagctgtgctagggcgagatacacaacgggcactcgatttacttaataatcactttaagcgagcagtcgaaatcattaaagcatacatctaa

SEQ ID NO: 30961 - protein, 217 aa, Photobacterium profundum
MSSPTLTNKIMEVIRQDILLGELSPGQKLVVADLKARYNVGASPIREALVQLSWKKYVKFAPQKGCWVAPISVDELEDLFETNLILSRVLLERAIINGDEAWELNILTTYHKLSKINPAASDVDFTEWEDRHSEFHLALLAGSQSPVMLELYREVYEQIERYRHVWVSRNRHYEERYHDNGEHDAMMKAVLGRDTQRALDLLNNHFKRAVEIIKAYI

SEQ ID NO: 30962 - DNA, 732 bp, Rhodopseudomonas palustris
  CDS (1)..(732)
atgagcagcgtaagcccgatcctgcactatgcgttggatggcgacggcccgcggagcctgacttccgcggtacaggagcggatacgcgcggacattctggcgacccgtctgctacccggacaaaagcttcacatcgcaggccttgccaagcagttctcggtcagtctcgcggccgtccgcgaggcgctgtcccgcctcgtcgccgacgggctggtgcaggccgccgaccagcgcggcttccgcgtcagcccggtgtcactgcaggatctcgccgacgtcacccgatcgcgtatcgagatcgaaggcttgatgctgcggcgatcgatcgaactcggtgacgaggcctggttgaacgcggtcgaagccgcctggagcgccctgaaggcgtttccgcaccgttttccgggcgacgatcccctgcagtacgacgaatgggccaagcgccataacgcctttcatctcgtgctggtgagcggctgtgactcgccctggctactgcgcttccgcaaacttctgcacgaacaaagcgaacgctaccgacggctgtcgatccggcgcgactccgggcgcgatccggccgatgtcgaggttgagcacgcggccatcgtcgaggcggtgatcaggcgcgacgccgaggcggcgatcgcggctttggccaaacatttcacggcgaccaaggacagcgtcgcgatctcttccggcggaattctcgaggtcgatcgggcggtttga

SEQ ID NO: 30963 - protein, 243 aa, Rhodopseudomonas palustris
MSSVSPILHYALDGDGPRSLTSAVQERIRADILATRLLPGQKLHIAGLAKQFSVSLAAVREALSRLVADGLVQAADQRGFRVSPVSLQDLADVTRSRIEIEGLMLRRSIELGDEAWLNAVEAAWSALKAFPHRFPGDDPLQYDEWAKRHNAFHLVLVSGCDSPWLLRFRKLLHEQSERYRRLSIRRDSGRDPADVEVEHAAIVEAVIRRDAEAAIAALAKHFTATKDSVAISSGGILEVDRAV

SEQ ID NO: 30964 - DNA, 711 bp, Rhodopseudomonas palustris
  CDS (1)..(711)
atgatgaaactcgccgctgccccagacccggagatcgccaccagcgacacgctcagcgagcgcgcggccaacctgctcgagcgcgatatcgtctcgggcgagctgccgccgggatcgaagctcggcatcgtcgagctggcgcgccgctacgagatcggcgccacgccgctgcgcgaggggctgtcgcggctgacgtcgcgcgggctgatcgtcgcgatcgggcagcgcggcttccgcgtcgccgaagtcagccgcgacgatctgctcgacatcacgcggatgcggacggtgatcgaacgcgaggcgctacggctcgcgatcgacaatggcggcgacgcctgggaggccgggatcgtcgcggcgttgcaccagatgcagcgctacgtggagcgcaacgccaacgatttccgagaaggcgcgccggagttcgatcggctgcacaaggcgtttcacaccagcctgcttgcagcctgcggctctcctcgcctgctggcagcgcattcggacctgtacgatcaggcctatcgctatcggcgggtgatgatgcgcagcattgaaagcggccggtacttcatcgccgcgcatcgcgaattggccgacctcgtgctcgcacgcgacgccgaggccgcagagaccaagctcgaccagcatctgcgcgcgacgctgactaccgtctatccgccgggcaagagccagccgccatcccgctga

SEQ ID NO: 30965 - protein, 236 aa, Rhodopseudomonas palustris
MMKLAAAPDPEIATSDTLSERAANLLERDIVSGELPPGSKLGIVELARRYEIGATPLREGLSRLTSRGLIVAIGQRGFRVAEVSRDDLLDITRMRTVIEREALRLAIDNGGDAWEAGIVAALHQMQRYVERNANDFREGAPEFDRLHKAFHTSLLAACGSPRLLAAHSDLYDQAYRYRRVMMRSIESGRYFIAAHRELADLVLARDAEAAETKLDQHLRATLTTVYPPGKSQPPSR

SEQ ID NO: 30966 - DNA, 666 bp, Rhodopseudomonas palustris
  CDS (1)..(666)
atggtgcgggccgccccttctccgatcaagatcacccgcgccgaggagctgcggcgccagcttgccgacgagatcgttcgcggcacgctacgccccggcgcagcactcgacgaaaccgatatcgcacagcgtttcaaggtctcgcgcacgccggtgcgcgaggcgctacgacagctcgtcgccagcggcctcgtcgagtcgcggccgcatcacggggcggtggtggcgcagccgtcgttcgaacggctgaccggcatgttcgaagcgatgtccgaactcgaagcactgtgtgcgagcttcgcggccgagcggatgacgccgctggagcgccggacgctggagacgatccatgaggagctacggatgctcagctcgcagggcaatccggaacgcttccacgaagtcaacgaacacttccacaacgcgatctatgcgggggcacacaatgactacatcgccgagatcacgctagcgacgcgggtgcgggtgcagccgttccgccgtgcccagttccgcaatctcggacggctggcaaagtcgcacgcagagcacgaccgcgtggtgatcgcgatcctgcgcggcgaccgcgacggtgctgccaaggccatgcgccatcacatcgatctggtgcgcgacgaatacgaaatttacgcggtgtcggtatga

SEQ ID NO: 30967 - protein, 221 aa, Rhodopseudomonas palustris
MVRAAPSPIKITRAEELRRQLADEIVRGTLRPGAALDETDIAQRFKVSRTPVREALRQLVASGLVESRPHHGAVVAQPSFERLTGMFEAMSELEALCASFAAERMTPLERRTLETIHEELRMLSSQGNPERFHEVNEHFHNAIYAGAHNDYIAEITLATRVRVQPFRRAQFRNLGRLAKSHAEHDRVVIAILRGDRDGAAKAMRHHIDLVRDEYEIYAVSV

SEQ ID NO: 30968 - DNA, 738 bp, Rhizobium sp
  CDS (1)..(738)
atggtaccgcatgacgacggcgcatttgctccgacgacagaagatgctccatcgtcttctggctttcttgacgacggcaaaatcaccatcggaagccagcttgcatcccgtcttcgcgaagcgatcatctccggcgagcttcaggccggcagcaagatcaatctcgacaaggcgcgcaagacgttcaacgtgagcctcagtccgctgcgggaagcgttggcacggctgatatcggacggtttagtcgagttcgaggacaatcgcggctaccgcgtttcctcaatttccttggccaatctggaagagatcaccaccctgcgcgaagagtttgaagtctttgcgcttcgcgagtccatgcggctcggcgatgtgaagtgggagggcaacgtcatgcgcgcgctgcatcgccttaaccgcaccgagcgcgacgcggctcggtcggagacactggagcgctgggaagagctccaccgcgaatttcatctgacgctcatctctggttgcgggaagccgatcctgctccatttctgcaggttgcttcttaatctcaacgaccgctatcgccgggtgtttctgacccgcacgtcgggcgaccgcaacgtcagccaggagcacagtgagattgctcagggagccgtcgcgcgggatctggactattcgtgcgacatgttgcgtcagcatatccaccgcacggggaccaatctgcgcaatcacctcgcgacaaagggaatcttgtga

SEQ ID NO: 30969 - protein, 245 aa, Rhizobium sp
MVPHDDGAFAPTTEDAPSSSGFLDDGKITIGSQLASRLREAIISGELQAGSKINLDKARKTFNVSLSPLREALARLISDGLVEFEDNRGYRVSSISLANLEEITTLREEFEVFALRESMRLGDVKWEGNVMRALHRLNRTERDAARSETLERWEELHREFHLTLISGCGKPILLHFCRLLLNLNDRYRRVFLTRTSGDRNVSQEHSEIAQGAVARDLDYSCDMLRQHIHRTGTNLRNHLATKGIL

SEQ ID NO: 30970 - DNA, 720 bp, Rhizobium sp
  CDS (1)..(720)
atggaccatcagaagcaaaataacgcggctctggttcgccgcacgttgagacaacggattcttcgctgcgagctgcagccaggcgaacggatcgtcattaacgatgtctgcgaggagttcggcgttagccttggcgctgtccgcgaagctctttcaggtctggaaggtgaagggttgctgcatgcatacgccaagcgtggatttcaggtaacgggcgtatctctagaggatatgttcgacctcacgcaggcgcggatcgaagtcgaatgcgcctgtcttcgcctctccatcgcgcagggcgatctcgcctgggaaagtcaagtcgtggcagcgctttaccgactgaacggaacgccgcgggagcagcgtggatccgacgacgaaatgtcggcggcatggagtgaagcccatgcgaacttccacgtcgcgctggtcgccgggtgccgaaaccagaccctgctcggtatccggcagaccttattcgaccgcgctgagcgttatcgcaggctgtccataccggtcgatgcggatcaccgcgacgttgcggcggaacatgacgctctggcgcaggccgcccttcagagagatccggaaaatgcatgccggctgatggaaacgcatctgtcacgcaccgcgatgctcatcagcgaggccgccggccggcggctggatggcggcggcgaggaacctatcaagatggttccgagtgacgcttcctga

SEQ ID NO: 30971 - protein, 239 aa, Rhizobium sp
MDHQKQNNAALVRRTLRQRILRCELQPGERIVINDVCEEFGVSLGAVREALSGLEGEGLLHAYAKRGFQVTGVSLEDMFDLTQARIEVECACLRLSIAQGDLAWESQVVAALYRLNGTPREQRGSDDEMSAAWSEAHANFHVALVAGCRNQTLLGIRQTLFDRAERYRRLSIPVDADHRDVAAEHDALAQAALQRDPENACRLMETHLSRTAMLISEAAGRRLDGGGEEPIKMVPSDAS

SEQ ID NO: 30972 - DNA, 675 bp, Chromobacterium violaceum
  CDS (1)..(675)
atgaccaccctgcagccgatcaagcgccagacgcttaccagtgccgtcaccgagtccctgcgccgtcgcatcctgtccggcgagttcgccgacggccaacaactgcgccaagaggcgctgtccaatgaatacggcgtcagccgggtgccagtgcgggaagcgctgcggcagctggaagccgagggcctgatccagatcatcgaccacaagggcgccctggtgtccaagctgtcgctggaagacatcctggaattgctggaagtgcgggcgatgctggaatgctcgctgctgaaggcggccattccctgtcagagctcggccgaccacgaagccgcccagcagacgctgcgggaattcgaggtcgcgctcaacaacaacgacgtgcgccactggggcgagatcaactcccgcttccacctggcgctgtaccgcgccgcccgccggccaaacacgctggcgctgatcgagcagctgcacaacaagaccgaccgctacacccggatgcagatcctgttcacccgcaccatggagcgcgcccacgaggagcacacccggctgctggagctgtgccgccagggcaaggcggacgaagcggcggaattcctgcgcttccacatcctgtcggccggccacgcgctggaaagctacctgaagggccagcaggccaatcactga

SEQ ID NO: 30973 - protein, 224 aa, Chromobacterium violaceum
MTTLQPIKRQTLTSAVTESLRRRILSGEFADGQQLRQEALSNEYGVSRVPVREALRQLEAEGLIQIIDHKGALVSKLSLEDILELLEVRAMLECSLLKAAIPCQSSADHEAAQQTLREFEVALNNNDVRHWGEINSRFHLALYRAARRPNTLALIEQLHNKTDRYTRMQILFTRTMERAHEEHTRLLELCRQGKADEAAEFLRFHILSAGHALESYLKGQQANH

SEQ ID NO: 30974 - DNA, 663 bp, Bordetella parapertussis
  CDS (1)..(663)
atgaaggtcagcgaccgcatccggcaggcgctcgaagccgatatccgcaacggcgtcctgctgccgggcgatgccatcgacgaacaggaactggccgcccgccaccaggtttcgcgcaccccggtgcgcgaagcgctgctgcagctcaaggtccagggcatcctcgacagccagccgcgcggcggcgcggtggtggcgcgcatggacgtgcaggaactgttggcgatctgggagctgatggcggagatggaaggcgtgtgcacccgcatggcgtgccagcgcatgacggccgaggagcggtccgagctggcccgcgtgcatcgcgaggccgcgccggtggcgcaggccgacgacgcgcaggcctggcgcgaggccaaccaccgcttccatgaagtgctgtaccacggctgccgcaacccttacctgcgcgagcaattgctggcgctgcgcgcgcgcaccggcgcctatctgcgccacgccttcatcgcggtcggccgggtgcgcgcctcgtacgagcagcacggcgagctggtccaagccatcctcgaccacgaccccgagcgcgcgcaccggatgatgatgcgccacatcagcctggcgcaaggcgccaagggcctggccgacttcctcatcaacctgccccgctcgatggtcaagccctag

SEQ ID NO: 30975 - protein, 220 aa, Bordetella parapertussis
MKVSDRIRQALEADIRNGVLLPGDAIDEQELAARHQVSRTPVREALLQLKVQGILDSQPRGGAVVARMDVQELLAIWELMAEMEGVCTRMACQRMTAEERSELARVHREAAPVAQADDAQAWREANHRFHEVLYHGCRNPYLREQLLALRARTGAYLRHAFIAVGRVRASYEQHGELVQAILDHDPERAHRMMMRHISLAQGAKGLADFLINLPRSMVKP

SEQ ID NO: 30976 - DNA, 711 bp, Bordetella parapertussis
  CDS (1)..(711)
atgagcctcgaagtcagcctgccgccctcggccagcgcctgcgccgaaggcgccgcgggcggcggcaccctgcccgccaccgtggccgcccgcctgcgcgaacgcatcatccagggtgatttcccgcccggcgcgcggctcaacgaacgcgcgctgtgcgaccagctcggcgtatcgcgcacgccgctgcgcgaggcgctgcgcgcgctggccgccgagggcctggtgcgcatcgaaccgaaacgcggcgcccaagtggtggccctgtccgccgccgatatccgcgaagccttcgaagtcatcggcgggctggaggagatgtcgtgccgcctggcctgcgcgcgcgccaccgaccaggagatcgccgagatccgcgcgctgacctacgagatgatggccagccacgcgcggcgcgacctgccgtcgtacttccgcgccaaccgcgccatccacgagcgcatcggcctggccgcgcgcaacgccctgctcaagcagctgtacgacgcgcagaacgcgcgcatccagaacctgcgctacgtttccaacgaagaccgccacaaatgggaccaggcgatgcgcgagcacatggcgatggccgacgccctgcaggcgcgcgacgccgaacggctggccgacctcatgcgcggccacctgcggcgcaagtgcgaggcggcgctgcgcagcctggcggcggcgtccgggatccgttga

SEQ ID NO: 30977 - protein, 236 aa, Bordetella parapertussis
MSLEVSLPPSASACAEGAAGGGTLPATVAARLRERIIQGDFPPGARLNERALCDQLGVSRTPLREALRALAAEGLVRIEPKRGAQVVALSAADIREAFEVIGGLEEMSCRLACARATDQEIAEIRALTYEMMASHARRDLPSYFRANRAIHERIGLAARNALLKQLYDAQNARIQNLRYVSNEDRHKWDQAMREHMAMADALQARDAERLADLMRGHLRRKCEAALRSLAAASGIR

SEQ ID NO: 30978 - DNA, 741 bp, Bordetella parapertussis
  CDS (1)..(741)
atgggtgccgcgtgtgctaccattgccgcactattggtcagccacatcatgaaaaacgcgaagaacgggcgcacactcaatgccgaggtctacgcgcaattgcgcgcgcagatccttaccggacaattcatgccgcgccagcggctcaaggtttcccagctatccgagcagcacggcgtcagcctgaatgtcgtgcgcgaggccctcaatcgcctggccggcgagcaactggtcgagctgcagccccaattcgggttcgcggtgcgcgggctgtcggccgaggatctggtggatctgttcgagcagcgcggcgtggtcgagagcctggcgctgcgccagtcgatcgcgcgcggcgacctcaactggcagtcggacgtggtggccgcgcaccatcgtctgggcggcaccgccgtggtctcgcccgacgacccgcagaagctgaacccggaatggctggcgcgccacgaggagttcaacctcgtcatgatgcgcgcctgcggcagcccccggctgctgcagatcgtgcgccagctggccgaggcctcggccatctaccagcgcgcgctgttgcccctggcggccgtggcggcggagctcgagaccgagcacgacgacctgctgcagcgcatcctggacggcgacgccgatggcgcggtgcgcgtgctgctcaagcacatggaacagacccgcgacgccatgctgcctttcctggtccagcaggaagtcgccgagcaggcctga

SEQ ID NO: 30979 - protein, 246 aa, Bordetella parapertussis
MGAACATIAALLVSHIMKNAKNGRTLNAEVYAQLRAQILTGQFMPRQRLKVSQLSEQHGVSLNVVREALNRLAGEQLVELQPQFGFAVRGLSAEDLVDLFEQRGVVESLALRQSIARGDLNWQSDVVAAHHRLGGTAVVSPDDPQKLNPEWLARHEEFNLVMMRACGSPRLLQIVRQLAEASAIYQRALLPLAAVAAELETEHDDLLQRILDGDADGAVRVLLKHMEQTRDAMLPFLVQQEVAEQA

SEQ ID NO: 30980 - DNA, 657 bp, Bordetella bronchiseptica
  CDS (1)..(657)
atgctgcaattccagaagacagcagtcagcgccgaggaagaggcctaccagtacctgcagcaggaaatccgcctgggccgctacgcgcccggccaacgcctggtgcccgaagccatcgccggcgagatcggcaccagccgcatgccggtgcgcggcgcgctgcgccgcctggcctccgaaggcctggtcgaaatccgcgccaaccgcggcgccgtggtgcgcggcctgaatcgccaggaaatgctggaagtcttcgagatgcgctcggtccttgaaggcctggccgtgcgcaacgccctggccaacctgggcgacgagcacatccggcggctctccagcatgctggaccagatggaggccggctcgggcgactacctggactggaccactgcccaccgcgaattccacgaatacctgtgcagcttctgccgccagccgcgcctgctgcgccagatctccgagctgcactcggtcgtcgaaccctacatgcggctgtgggccgcgcagcccggccgcagcctgcgcgcgcgcgaatcccaccaggaactgatcgacgcgctcaagacccgcgacgcggcccgcgccgaagccgccgcgcgccagcacgtgctcaataccgtgccggtgctgcaggatttcctcgcccaggcgggctga

SEQ ID NO: 30981 - protein, 218 aa, Bordetella bronchiseptica
MLQFQKTAVSAEEEAYQYLQQEIRLGRYAPGQRLVPEAIAGEIGTSRMPVRGALRRLASEGLVEIRANRGAVVRGLNRQEMLEVFEMRSVLEGLAVRNALANLGDEHIRRLSSMLDQMEAGSGDYLDWTTAHREFHEYLCSFCRQPRLLRQISELHSVVEPYMRLWAAQPGRSLRARESHQELIDALKTRDAARAEAAARQHVLNTVPVLQDFLAQAG

SEQ ID NO: 30982 - DNA, 945 bp, Wautersia oxalatica
  CDS (1)..(945)
atgacacagcaagatcaagcatttctgacgcgattggttgcgtcaaagggttggccgaagggccactggcagaacccgatgtcgggccgaaagagaagaaggccgcaactgccatcgagtccaccctacgcaacgctccgtgactgcatcttgaggggaagccacccccaaggctcaaggctccacctcgaaacactcaagtcatcactgggtgtcagcggcagcactctgcgggaagcattgacgcgcctggttggagaccgtctggtcgtcgccgaagggcagaaagggttcaaggtggccccgatgtcgctttgcgatctcgatgatctgacgagcgcgcgcatcaccttggaaaccaccgccatcgtcgagagcatcaacctcggtgggggcgactgggaagaccaactcgtcatcagcttccgtcgactggcgagagcgcaggagcgagttgaagccaatcctgcagaggccttcgatgcatgggaagcgaggaatcaggaattccacaacgcactcatggccgcctctccgtccaaatggctcgcgaacttcagagaaatcctgtttcacaactccgagcgctaccgcaggttgtccggcacgcaaggcccaatttccgttgaggtgcacgaggagcacaagacaatcttcgaggcggcgataccgcgaatgcaaatcaggcggtttcggtcctttcgcagcacattcggcgctccgcaatgtgattcgagccaatgggttgctgagagaggcctgacctcgacccgtttccccaaggactggaacctaatgggcttcgacttcaccgcctcaactgattgctggtccgcgtgtacgcccaatctcccaagacaccccgccaccgtgcacagtggccgcgagttgctgccccagccactgttcgatgacgggtttccaaggaacgagcgtgaaacctaa

SEQ ID NO: 30983 - protein, 314 aa, Wautersia oxalatica
MTQQDQAFLTRLVASKGWPKGHWQNPMSGRKRRRPQLPSSPPYATLRDCILRGSHPQGSRLHLETLKSSLGVSGSTLREALTRLVGDRLVVAEGQKGFKVAPMSLCDLDDLTSARITLETTAIVESINLGGGDWEDQLVISFRRLARAQERVEANPAEAFDAWEARNQEFHNALMAASPSKWLANFREILFHNSERYRRLSGTQGPISVEVHEEHKTIFEAAIPRMQIRRFRSFRSTFGAPQCDSSQWVAERGLTSTRFPKDWNLMGFDFTASTDCWSACTPNLPRHPATVHSGRELLPQPLFDDGFPRNERET

SEQ ID NO: 30984 - DNA, 699 bp, Ralstonia sp
  CDS (1)..(699)
atgacagccgccaaacgccgcagcgcccgcgacagcgtgccagacgaccctcggcctcccgagcccttcgcgccgcgcaccctgtgcgagcgcgcctatcttcaattgcggcaggacatcgtgcagggacgcatcagccccggcgagcgcctgcgggtcgaacacctcaaggatcgctatcaagtgggtgccggcacgctgcgagaatccctggcgctgcttgtgtccgatgcccttgtgaccgttgaaggccagcggggataccgggtcacggcgatctcgctggacgacctgcaggatctcactgacacgcgggtgcggttggaaactgaagcgcttcgtctttccattcgctacggcgacatgcaatgggaagcgcagttgcgggcgtcgttcgacaacctcagagcctcggaggcccgtggccgtcggcggacccggcccggctgggagcaggccaaccggcgctttcatgaagccctgatcgccgcgcaccgctcgccgtggagtcaatatctgctgaagctcctttaccgtcacggggaacgctaccggcacgttgccatccgcctcgggacgaaccaatcagtctcccggaaagtgcatgaggaacatgcgctcatcttcgaggccgccgtggcgcggccaggaagcgcgcgctgcgctcgcactggaggcacatattcgccttacctatga

SEQ ID NO: 30985 - protein, 232 aa, Ralstonia sp
MTAAKRRSARDSVPDDPRPPEPFAPRTLCERAYLQLRQDIVQGRISPGERLRVEHLKDRYQVGAGTLRESLALLVSDALVTVEGQRGYRVTAISLDDLQDLTDTRVRLETEALRLSIRYGDMQWEAQLRASFDNLRASEARGRRRTRPGWEQANRRFHEALIAAHRSPWSQYLLKLLYRHGERYRHVAIRLGTNQSVSRKVHEEHALIFEAAVARPGSARCARTGGTYSPYL

SEQ ID NO: 30986 - DNA, 675 bp, Vibrio parahaemolyticus
  CDS (1)..(675)
atgtcacaaaagcctgtttttaagacgcgtactcagctcgttgaagaagcaattcgaactcagatcctgaagggcgagttaaaaactggtcagcctttacgtcaggatgcgttagcaaaagagttcaatgtcagccgaattcctgtgcgtgaagcactagtacaattggaagcgcagggtttagtcagtttcgagccacataaaggcgcgacagtgactgaactgtctccagataaaatcgatgagctatttgaactgcgtgcggttgtggaatgccacattctggaacgtgcgattcaaaacatgacggatgaagatctagaacgcgctcgtgaagttcgtgaacgtttcgaagcggtggtaaatagtggcgacgaagtggaagaatggagtaactataactacgaattccacaaagcgttatacgcacctgccaacatgccagaaaccatggatgtgatttacaacttaaataccaaatgcgatcgctacattcgtatgcagttgttattcaccacaggcattaaaaaagcggaacaagaacatttgaccttgtttgaaatgtgccagaacagagatattgatggcgcaaaatatctgttgaaaaaacacattctagaagcaggtacagctattcgtaacttgctgttagaaagacagagcccaaataactaa

SEQ ID NO: 30987 - protein, 224 aa, Vibrio parahaemolyticus
MSQKPVFKTRTQLVEEAIRTQILKGELKTGQPLRQDALAKEFNVSRIPVREALVQLEAQGLVSFEPHKGATVTELSPDKIDELFELRAVVECHILERAIQNMTDEDLERAREVRERFEAVVNSGDEVEEWSNYNYEFHKALYAPANMPETMDVIYNLNTKCDRYIRMQLLFTTGIKKAEQEHLTLFEMCQNRDIDGAKYLLKKHILEAGTAIRNLLLERQSPNN

SEQ ID NO: 30988 - DNA, 669 bp, Vibrio parahaemolyticus
  CDS (1)..(669)
atgtatgtgtccagtcccactcttaccgacaaagtatcaaaaatgatctgtcaggatatcctgactggtgagctaaaacctggtcaaaaacttgtggttgcagagctaaaagagaaatacaacgtaggtgcctcccctattcgcgaagcattggttcagctatcgtggagcaaatacgtcaaactcgcgccgcaaaaaggctgctgggttgcaccagtgtgtaagcatgagttgaatgacttgtatgaaagcctacggatgacggcttcatttctattgaaaaaggcgatcatgacaggtgatgagaactgggaactggacgtcctaacttcataccacaaactatctcgagtaaatctcgaccaaggcttttgctggagagaatgggaagaacgccactatcactttcttgaagcgttgcttgagggggcgaactcgcacaatttatttaccttcttccgagatatattaaaccagatcaagcgttaccattactttgctatgcaagtgctaggaacgaacaatcaaggtcactgcaatatcgatgaacaagagatgatcatgaagttatcgctgtctaaaaatagtgacgatgcggtgcagtttctggatcgttatttgttgaagtcgttgcaatgtgtcgaaaccgccatcgacaatccgctataa

SEQ ID NO: 30989 - protein, 222 aa, Vibrio parahaemolyticus
MYVSSPTLTDKVSKMICQDILTGELKPGQKLVVAELKEKYNVGASPIREALVQLSWSKYVKLAPQKGCWVAPVCKHELNDLYESLRMTASFLLKKAIMTGDENWELDVLTSYHKLSRVNLDQGFCWREWEERHYHFLEALLEGANSHNLFTFFRDILNQIKRYHYFAMQVLGTNNQGHCNIDEQEMIMKLSLSKNSDDAVQFLDRYLLKSLQCVETAIDNPL

SEQ ID NO: 30990 - DNA, 729 bp, Pseudomonas syringae
  CDS (31)..(729)
gtgtcgacaatgtcggtcggagcagaaaggatgctgacaacggaagacgacccggaaaccctttccgagaacgttttccgacgcattcagtcggccattgtcaaaggcgaaatcgcccccggcagcaagatttccgagccggagctggcgcgcacctatggcatcagtcgcggcccgttgcgtgaagcgatccatcggcttgaaggccagcggctggtggtgcgtgtgccgcatgtgggcgcccgtgtggtcgcgctcagccacgccgaattgatcgagctgtatgaaattcgtgaatccctggaaggcatggcctgccgcttggccgccgaacgcatgagccaggccgagattgatgagttgcgcagcgtgctcgacacccatgaacgcgatgcggcgttccaggcgggcatcggttactaccagcaggaaggtgatttcgactttcattaccggatcatccagggcagcggcaaccgcaccctcagtcagatgctctgcggtgagctttatcaactggtgcgcatgtaccgcatccagttctccaccacgcccaaccggccccggcaggcctttgccgaacaccaccggattctcgacgccatcgccgagcgcgacggcgagctggccgaattgttgatgcgccgtcacatcggcgcgtccagacgcaacatcgagcgccattatcaggcggcttcccaggcaacttccgaccgaggtcaaccatag

SEQ ID NO: 30991 - protein, 232 aa, Pseudomonas syringae
MLTTEDDPETLSENVFRRIQSAIVKGEIAPGSKISEPELARTYGISRGPLREAIHRLEGQRLVVRVPHVGARVVALSHAELIELYEIRESLEGMACRLAAERMSQAEIDELRSVLDTHERDAAFQAGIGYYQQEGDFDFHYRIIQGSGNRTLSQMLCGELYQLVRMYRIQFSTTPNRPRQAFAEHHRILDAIAERDGELAELLMRRHIGASRRNIERHYQAASQATSDRGQP

SEQ ID NO: 30992 - DNA, 696 bp, Pseudomonas putida
  CDS (1)..(696)
atggaagcgctcgccccccgacaaaactcagcattcagcgggtatgagaggctcaagaaggacatcatccgcggggtgttcaagcccggtgaaaagctgttgatgagcaccctcaaggaacgctacgacctgggtgtgggcccgctgcgcgaagcactgtcgcaactggtggccgagcacctggtcaacgcgatcagccagaaaggctaccgggtagcgcccatgtcgctggatgagatgaacgacatctacgacgcccgcgccaacctggaagcgatgatcattgccttggccatcgagcgcggcgatgacgcctgggaggcatcggtgctggcccactcgcatacattggccaaggtggtggaagtaaaaacccgcgagcagcggctggatgtgtgggacgagcggcacaaggcgttccatactgccattgcctcgggctgcggctccaagcacctgctgcaggcacgcacctacctgttcgaccaggccgagcgctaccgccacctgtggctgacgcagacggtgttttccgaagaggcgctggcgctcaagcgccaggagcatgcggcactggtcgaggtgatcctcgcccgggatgccaaaaccgccagcgccatgatgcgctcgcacctgatgacaccggtaccgatcattgcgcagatcatgcacgccgaaggcatcggtgcccgctag

SEQ ID NO: 30993 - protein, 231 aa, Pseudomonas putida
MEALAPRQNSAFSGYERLKKDIIRGVFKPGEKLLMSTLKERYDLGVGPLREALSQLVAEHLVNAISQKGYRVAPMSLDEMNDIYDARANLEAMIIALAIERGDDAWEASVLAHSHTLAKVVEVKTREQRLDVWDERHKAFHTAIASGCGSKHLLQARTYLFDQAERYRHLWLTQTVFSEEALALKRQEHAALVEVILARDAKTASAMMRSHLMTPVPIIAQIMHAEGIGAR

SEQ ID NO: 30994 - DNA, 717 bp, Pseudomonas putida
  CDS (1)..(717)
atgcaggacctttccacccccggcccggtgctgacagacgaaacggaaaccctctccgaaaacgtcttccgacgcatccaggcggccattgtcaagggtgatatcgcccccggcagcaagatttccgaaccggagttggcgcgcacctatggcatcagccgcgggccgctacgcgaggctatccaccgccttgaaggccagcgcctgctggtgcgcgtgccgcatgtgggcgcgcgggtggtatcgctcaaccacgccgagctgatcgagctgtacgaaatccgcgagtcgctggaaggcatggcctgccgcctggccgccgaacgcatgagccaggccgacatcgacgaactgcgccgggtgctcgacacccatgagcgcgatgccgcgttccaggccggcctgggctactaccagcaggaaggcgactacgacttccattaccggattattcagggtagcggcaaccagaccctggtcaagatgctctgcggcgagctgtaccagctggtgcgcatgtaccgtatccagttctctgccacgcctaaccggccacgccaggcctttgccgaacaccatcgcattcttgatgccatcgccgaccgtgacggcgaactggccgaactcctgatgcgccgccacatcggcgcgtccaagcgcaatatcgagcgtcactacctggacgcccacaacaacagcacacgaggtgagaaatga

SEQ ID NO: 30995 - protein, 238 aa, Pseudomonas putida
MQDLSTPGPVLTDETETLSENVFRRIQAAIVKGDIAPGSKISEPELARTYGISRGPLREAIHRLEGQRLLVRVPHVGARVVSLNHAELIELYEIRESLEGMACRLAAERMSQADIDELRRVLDTHERDAAFQAGLGYYQQEGDYDFHYRIIQGSGNQTLVKMLCGELYQLVRMYRIQFSATPNRPRQAFAEHHRILDAIADRDGELAELLMRRHIGASKRNIERHYLDAHNNSTRGEK

SEQ ID NO: 30996 - DNA, 774 bp, Bradyrhizobium japonicum
  CDS (1)..(774)
atgatactgactggcagcagagggatggcaggacggcgtcggatgcgtgagagggtcaagccagcaggtgaaacacgcgcggctgacgtgctccaccggatgcgcgcagacatcatcagttgcacgctcaagcccggcgccaagctgcggttcgaggcgctacgggacatctacgcggtgagcttttcgacgctgagggaggcgctgtcgcgcctcgtggccgaagggctcgtcatcgcggaggatcagcgcggcttcgtcgtcgcgccggtttcgatcgacgatctcaacgacctcacctatgtccgcgtgctcatcgagcgcgaatgcgttgcgctcgcgatcaagaacggcgacgacgcctgggaggcggacatcatcggcgcattccaccggatggatcgcctgcagaaccggctcggctccaattattatctctcggaagaatggggcaagctccacggcgattttcatttttcgcttgttgccgcgtgcggctcgcccaacctcctggagatccgccagaagctgttcgaacgcgcgcaccgctaccgccgcatgtcctcgcaattccggaccaaatggcgcgccaaggatgtcgagcacaagatgatcatggattcggtcgtcgcgcgcgatgccgcgaaggccgaggagctgatcgagcgccatatccgcgagacgaccgacaacgtgatcaagcacgcaggccacctcttcgtcacatccgacgaggaacgcccccgccgcacaagccgggtcgccgctgaatag

SEQ ID NO: 30997 - protein, 257 aa, Bradyrhizobium japonicum
MILTGSRGMAGRRRMRERVKPAGETRAADVLHRMRADIISCTLKPGAKLRFEALRDIYAVSFSTLREALSRLVAEGLVIAEDQRGFVVAPVSIDDLNDLTYVRVLIERECVALAIKNGDDAWEADIIGAFHRMDRLQNRLGSNYYLSEEWGKLHGDFHFSLVAACGSPNLLEIRQKLFERAHRYRRMSSQFRTKWRAKDVEHKMIMDSVVARDAAKAEELIERHIRETTDNVIKHAGHLFVTSDEERPRRTSRVAAE

SEQ ID NO: 30998 - DNA, 693 bp, Bradyrhizobium japonicum
  CDS (1)..(693)
atgtcagttatgcccaccgcctccctcgaccgcgaccgcgcctatgccctgctccgcgacctcgtcgtgtcaggcgagtttgcgcctgacgaacccctctccgaacgcagcctgtcgagccgcctggcgctgggccgcaccccgatccgcgaggcgctgaaggcgctcgccaaggacggcctgctcaccatccatccgatgcgcggcaccttcctgcgccagatgtcctttgacgatctgcgcgagattcatgaattgcggctcgcgctcgaaggcatggccgcctatctcgccgcgacgcgcgggccgacggagccgctgcgccaatgcgccggggagctgcgcagcattcagtcgcgcgaaaacatcgatgtcgaggaggcgcagcaggtcggctgggccttccacgacgaactctttcgcgcgaccggcaatggccggctggcgcagtcctacgacaatctgcgcgcgcagagcggcctcgccctccagaagatgcggcaatacagcgtcgagcgcacgcgccaggccgtcagcgagcatctcgacatctacgcggccatcgaagcgcacgatcctgacgccgcgcagcagcgcatgtggcggcatctgtcgtccgcattcgaggcccgcctcaccgcgctgggcgcgatccgcacgcaatatccgggacaaggagaccaccacgcatga

SEQ ID NO: 30999 - protein, 230 aa, Bradyrhizobium japonicum
MSVMPTASLDRDRAYALLRDLVVSGEFAPDEPLSERSLSSRLALGRTPIREALKALAKDGLLTIHPMRGTFLRQMSFDDLREIHELRLALEGMAAYLAATRGPTEPLRQCAGELRSIQSRENIDVEEAQQVGWAFHDELFRATGNGRLAQSYDNLRAQSGLALQKMRQYSVERTRQAVSEHLDIYAAIEAHDPDAAQQRMWRHLSSAFEARLTALGAIRTQYPGQGDHHA

SEQ ID NO: 31000 - DNA, 924 bp, Bradyrhizobium japonicum
  CDS (1)..(924)
atggcggcggccattcgcatacgaaagcggaccgcgtcgaaatctcttagcaactcgtgtgccagtgcgatttcgcggcaaatcaggcataagatttgcgagttggcaggtggatatcccggagatgcacgcgtctccgccagaaaatcggccggctcactggaaggttggtgccattttgtatacgtatatcgatatcggagaaacatgatggcggatattggtgcacatgccggaggcaggcgcgtgaaaaatgggcacgaaaccctggcggcgggccccggcatgacgctcgccgagagcctgcgccagaagctcgaaggggcgatcgcggcggggcatctcgagccgggcagccggctcgacgagcaggagatcgcccagcgcttcggcgtctcgcgcacgccggtgcgggaggcattccgtctgatggccgccaacaatctggtcgaactgcgcggccggcaaggggcgacggtccgcagcatcaaggcgcaggcgctgatcgagatgttccaggtcatggcggagctggaagggctctgcgcgcggctcgccgcgcggcgcgtctcccaggcctgggggactgaaattggcgagattcaccagcggcttgtggcggcaggtgaaaccggcgacatcgatgtcttctacgacatcaaccaggaatttcacgaggcgatctatgaggcctcgcgcaacgccttcctggccgagcagacccgcaagctgcgcaaccaggtggcggcgtatcgccgccgggtgacgcgcatgccgaaccggattgccgacaccgttcgcgagcatgaggcgatcatgcaggcgatcctggcccacgatcccgagcgggcgcacagcgccatgcgggaccacgtcaacctgctcggcgacaaccttctggacttcctcgccgccttcgaatga

SEQ ID NO: 31001 - protein, 307 aa, Bradyrhizobium japonicum
MAAAIRIRKRTASKSLSNSCASAISRQIRHKICELAGGYPGDARVSARKSAGSLEGWCHFVYVYRYRRNMMADIGAHAGGRRVKNGHETLAAGPGMTLAESLRQKLEGAIAAGHLEPGSRLDEQEIAQRFGVSRTPVREAFRLMAANNLVELRGRQGATVRSIKAQALIEMFQVMAELEGLCARLAARRVSQAWGTEIGEIHQRLVAAGETGDIDVFYDINQEFHEAIYEASRNAFLAEQTRKLRNQVAAYRRRVTRMPNRIADTVREHEAIMQAILAHDPERAHSAMRDHVNLLGDNLLDFLAAFE

SEQ ID NO: 31002 - DNA, 720 bp, Bradyrhizobium japonicum
  CDS (1)..(720)
atggcaggattgttgaaagtcgcagccgacgccgaggacgatggcgggctgctctccgatcgcattcgcaacgcgctcaccgacgagatcgcctcgggtgcgctcgtcgccggttccgccctggaagagcagctgttggccgatcgcttcggagcctcccgcacgccggtgcgggaggcgcttcgccagctcgtggtcagcggcctggtcgaagtgcgggggcggcgcggcctcgtcgtggcgcggatgacgcccgagcgcatcatggacatgttcgagaccagtgccgaggtggaggcgatgtgcgtcaggctcgcgacctatcgcatgaccccgctcgagcgcagccatttgatcgagctgcatgacgcctcgctgaagatggtcgaggccaatgacgtcgatacctatgacgcgttcaaccgggaattccacgaatgcatctaccgggcaacgcacaactcgtttctggcagagcaggcgcaggatgtccgctcgcgtctcagcgcttttcgccgcacgcaattgcggcatggcgatcgcattcgcaagtcccgcgacgagcatgacgtcatcatgcaggcgatcgccgaaggcgatggcgagaccgcatcgcgcaggatgcgggcgcatatgttgaacgcggccgcggcgcttcggcgctacatcgatgatcgcctcggcggacaggccgatgggcctggacctgacaacgcctga

SEQ ID NO: 31003 - protein, 239 aa, Bradyrhizobium japonicum
MAGLLKVAADAEDDGGLLSDRIRNALTDEIASGALVAGSALEEQLLADRFGASRTPVREALRQLVVSGLVEVRGRRGLVVARMTPERIMDMFETSAEVEAMCVRLATYRMTPLERSHLIELHDASLKMVEANDVDTYDAFNREFHECIYRATHNSFLAEQAQDVRSRLSAFRRTQLRHGDRIRKSRDEHDVIMQAIAEGDGETASRRMRAHMLNAAAALRRYIDDRLGGQADGPGPDNA

SEQ ID NO: 31004 - DNA, 627 bp, Vibrio vulnificus
  CDS (1)..(627)
atgatctgccaggatattcttcatggcgagctgaaaccaggacaaaaattagtcgttgcggatctaaaagacaagtacaacgttggggcatcaccaatccgcgaagcactcgtgcagctctcttggagcaaatacgtcaagcttgaaccacaaaaaggctgttgggttgccccagtctgcgaaaacgaactgcgcgatctttatgaaagcctacgcgtcgtggctcctgttttgctgaaaaaagcaatcgcttgcggaaatgaaaactgggaacttgaagtactaacggcttatcacaaactttctcgtgctcagaatttagacaccacaccagattgggcagaatgggaagagcgccacaaccatttccacaccacgttacttgcaggcgctgaagcaagaaacatgtttgatttctttagagatctcgccaatcagattaaacgctaccgctattttgctctctctcaacatcaaggtaataagcactctctgtttgatattgaagagcatgagatgatcatgaaacttgctttggcaaaaaattccgaagaagcggcacgccttttagacagccatcttgatagttcgatgaaaatgattgaatccgctatccaagccgcttaa

SEQ ID NO: 31005 - protein, 208 aa, Vibrio vulnificus
MICQDILHGELKPGQKLVVADLKDKYNVGASPIREALVQLSWSKYVKLEPQKGCWVAPVCENELRDLYESLRVVAPVLLKKAIACGNENWELEVLTAYHKLSRAQNLDTTPDWAEWEERHNHFHTTLLAGAEARNMFDFFRDLANQIKRYRYFALSQHQGNKHSLFDIEEHEMIMKLALAKNSEEAARLLDSHLDSSMKMIESAIQAA

SEQ ID NO: 31006 - DNA, 672 bp, Shewanella oneidensis
  CDS (1)..(672)
atgagtcgaactacgcctatagtccataaaacccgcacccaattagttgtagaagtgctcagagagaaaattctttcgggtgagatagccgcaggagaaccactcagacaaactgctttagccgaagccttgcatgttagccgtattccagtaagggaggccttgctgcaacttgaagctgaagggctggtaaaattcgaacctcacaaaggggctacggcaactgaattatccgttgcacaagtcaccgagctgtttgaattacgtgcaatgatcgaaaccgatctgctcgctaaagccataccacaacttcaagcagaagatttaataaaagctgaacgcgtattggaacaattggaatcagcctttaaacacgaagatgccgttgccagttggagcgagctaaatacacagtttcatacctgtttgtaccaagcagctaatcgcccacatacgctcgaggttgttcatggcctcaataccaactgcgatagatatattcgtttgcaattgctgctcgcaggagggatacccgcagcagaacacgagcaccgtgagctgctcaactattgtaagcaaagagaaactgagaaagccacggcgttgctgcgacatcatattttgcatgccgcaacgacaattcgggatcttgtcgccaaacaggtggtatag

SEQ ID NO: 31007 - protein, 223 aa, Shewanella oneidensis
MSRTTPIVHKTRTQLVVEVLREKILSGEIAAGEPLRQTALAEALHVSRIPVREALLQLEAEGLVKFEPHKGATATELSVAQVTELFELRAMIETDLLAKAIPQLQAEDLIKAERVLEQLESAFKHEDAVASWSELNTQFHTCLYQAANRPHTLEVVHGLNTNCDRYIRLQLLLAGGIPAAEHEHRELLNYCKQRETEKATALLRHHILHAATTIRDLVAKQVV

SEQ ID NO: 31008 - DNA, 675 bp, Xanthomonas campestris
  CDS (1)..(675)
atggagcccatggcgaacaaccaccgattgcaagcggtccagcagctacgcgaactgatcctgtgcggcacctttgcgccaggcgagcgcatcaccgaggccgccctggccgagcgcctggcgatttcccgcacccccatccgtcaggcgctgcctgcgctttgccaggagggtttgctggtgcaggcgggcaaccgcggctacgcagtgcgccgcttcagccagcaggagagcctggacgcgctggcggtccgggccctgatggaaggtatggctgcgcgcgcggtggccgaacaaggcgcctccgccaccctgctcgccgcactgcatggctgcctggacgagggtgaccgcatcctggccaagcgcaccctggatgccagcgacgaactggcctacggcgatatgaacgcgcggttccaccggatgatcgtgatggcggccgacaaaccgatcctgaccgagacagtggaccgctgcacgctggtgccgtttgtcagccccaccaacgtggtgttcgggcaacgctcgccgacgctcgcctacgacgatctgttctacggccaccgccagcacggcgcgatcgtcaccgccatcgagcaacgcgatggcgcgcgcgccgaactattgttccgcgagcatgccaacacgcaacgccacagcatggggatgtaa

SEQ ID NO: 31009 - protein, 224 aa, Xanthomonas campestris
MEPMANNHRLQAVQQLRELILCGTFAPGERITEAALAERLAISRTPIRQALPALCQEGLLVQAGNRGYAVRRFSQQESLDALAVRALMEGMAARAVAEQGASATLLAALHGCLDEGDRILAKRTLDASDELAYGDMNARFHRMIVMAADKPILTETVDRCTLVPFVSPTNVVFGQRSPTLAYDDLFYGHRQHGAIVTAIEQRDGARAELLFREHANTQRHSMGM

SEQ ID NO: 31010 - DNA, 675 bp, Xanthomonas axonopodis
  CDS (1)..(675)
atggagccaatggcgaacaaccaccgattgcaagcgattcagcagctacgcgaattgatcctgtgcggcaccttcgcgcccggcgagcgcgtcaccgaggcggcactggccgagcgcctggcgatttcgcgcacgccgatccgtcaggccctgccggcgttatgccaggaaggcctgctggtgcaggcgggcagccgtggttacgccgtgcggcgcttcagccagcaggaaagcctggatgccctggcggtgcgcgcaatgatggaaggcatggccgcacgcaccgtcgccgaacagggcgccccggccgagctgctcgccacgttgcatgcctgtctgggcgaaggcgaccgcatcctggccagccgcaacctctgcgccgacgatgagcaggcgtatggcgcaatgaacgcccgtttccaccgcgccatcgtggaggcggccaacaagccgatcctgaccgaaaccgtggaacgctgcacattggtgccgttcgtcagcccggtcaacgtcgtgttcggccaacgcactgccgcgcttgcctacgacgatctgttttacggacacaggcaacacggcgcgatcgtttcggccatcgaacaacgcgatggcgcacgcgcggaattactgttccgcgaacacgccaacacgcaacggcacagcatgggaatctga

SEQ ID NO: 31011 - protein, 224 aa, Xanthomonas axonopodis
MEPMANNHRLQAIQQLRELILCGTFAPGERVTEAALAERLAISRTPIRQALPALCQEGLLVQAGSRGYAVRRFSQQESLDALAVRAMMEGMAARTVAEQGAPAELLATLHACLGEGDRILASRNLCADDEQAYGAMNARFHRAIVEAANKPILTETVERCTLVPFVSPVNVVFGQRTAALAYDDLFYGHRQHGAIVSAIEQRDGARAELLFREHANTQRHSMGI

SEQ ID NO: 31012 - DNA, 765 bp, Pseudomonas sp
  CDS (1)..(765)
atgacaaagcaagatcaagcagttctgcctcgattgattgagtcagcaagactgcccgaaggggcactggcagaattcaatgtcgggccgaaagagaagaaagccgtaaccgccatcgaatccacctatgcaaccctccgtgacgcaatcttgaggggaagctacccacagagctctaggctccacctcgagacgctcaagtcatcgctgggcgtcagcggcagcactctgcgggaagcattgacgcgcctgattggagaccgtctggtcgtcgctgaaggacagaaggggttcagggtggccccaatgtcgctttgcgatcttgatgacctgacgagtgcgcgcatcatgttggaaagcgccgccctcgtcgaaagcatcaacctcggtggggacggctgggaagaccaactcgtcaccagtttccgtcgactgacgagggcgcaggaacgagtcgaggccaatccggcagaggccttcgacgcgtgggaagcgaggaacttggagttccacaacgcactcatggccgcctctccgtccaaatggctcgcgaacttcagagaaatcctgcttcgaaactctgagcgctaccgcaggttgtccggcacgcaaggcccacttcctgccgaagtgcacgaggagcacaagacaatcttcgacgcggcgatggcccgtgatgtagatcgggcggtttcggccctctcgcagcatattcgccgctccgcgaatgtgattcgagcaaatggattgctgaggaaggtctga

SEQ ID NO: 31013 - protein, 254 aa, Pseudomonas sp
MTKQDQAVLPRLIESARLPEGALAEFNVGPKEKKAVTAIESTYATLRDAILRGSYPQSSRLHLETLKSSLGVSGSTLREALTRLIGDRLVVAEGQKGFRVAPMSLCDLDDLTSARIMLESAALVESINLGGDGWEDQLVTSFRRLTRAQERVEANPAEAFDAWEARNLEFHNALMAASPSKWLANFREILLRNSERYRRLSGTQGPLPAEVHEEHKTIFDAAMARDVDRAVSALSQHIRRSANVIRANGLLRKV

SEQ ID NO: 31014 - DNA, 762 bp, Rhizobium loti
  CDS (1)..(762)
atgcagttcgtacacgaggatactcatgtccagttcggcggttttccgctacgctggagtccgcgtgactgggagcatcgattgcgtgaatttgcggaaggcctgatcgagaggccgcagacggttgccgagcaggtcgccaacgtgctgcgcgaggccattgctagcggaacgctgaaggccggcacggcgctacgccaggacgaccttgccgagcagttcggcttcagccgcatgcctattcgtgacgcgcttcgccaattggaggcggagggcattgtctccattcaccccaccaagggcgcgcatgtcgcacggatggacggcgccgagatcagcgaaatctacgcggtgcgcgaattgctcgaatgcgaagcgcttcgcctctccattccggctttgttggacggcaagctcgatgaggccgaacaggtgctcgaccagatcgacgcggagcgcaatgtcggccgctggggggcgctgaaccggacctttcacctgtcgctctacgctgcctgcggcaaccagcgtctgctcggtctgatcgaggcgcaccacaacgccgccgatcgctatgtccgcatcctcttgtcgaacctcgactatcgcacccgctcacaggcggaacatcgcgacctgctggctgcctgccgccagcgcgacggcaagaaggccgtgagcgttctgcgccagcaccttcgcgaaggcagcggcacgctcgtcaatgcgatagagggcggcggcctgtcgcgaaaatcctag

SEQ ID NO: 31015 - protein, 253 aa, Rhizobium loti
MQFVHEDTHVQFGGFPLRWSPRDWEHRLREFAEGLIERPQTVAEQVANVLREAIASGTLKAGTALRQDDLAEQFGFSRMPIRDALRQLEAEGIVSIHPTKGAHVARMDGAEISEIYAVRELLECEALRLSIPALLDGKLDEAEQVLDQIDAERNVGRWGALNRTFHLSLYAACGNQRLLGLIEAHHNAADRYVRILLSNLDYRTRSQAEHRDLLAACRQRDGKKAVSVLRQHLREGSGTLVNAIEGGGLSRKS

SEQ ID NO: 31016 - DNA, 663 bp, Rhizobium loti
  CDS (1)..(663)
atgccgacgaactttccagagatgtccgccactgcggaagtagaggcgtacaatcacgttcagagagcccttcgcctcggccgctacaaaccgggcgacaggctcattcccgaggaaattgccgccgagatcggcatgagccgcatgccggtgcgggaagcctttcggcgcctggcctccgacgggctggtggtccttcgtcctaatcggggatgcgtggtcgcgggcctcactgtcgatgagcttttcgagattttcgagattcgctcggttctggagggactcgccgtcaggctggcggtgccccggatcgacgacgaggagttcgaggagctcgaccgcctgctcgagcgcatggagcgtgcgggccagagcggcggcggcgactgggtcgtccgccaccaggaattccatggccgcatctgtgcgttgagccagaggcccaagctgatccaccagatatcggcgctgcatgtggtcatcgagccttacatgcgcatctggttcgacgattgtaacaaaccgctttccgcgcgcgaggagcatgccgccgtaatcgctgccttgcgctcgggcgacgcacatcacgcggaacaggtgatgcaggaacatgttctcggcacggcgccgctgctggccgagttcgtgagtcccagccggtga

SEQ ID NO: 31017 - protein, 220 aa, Rhizobium loti
MPTNFPEMSATAEVEAYNHVQRALRLGRYKPGDRLIPEEIAAEIGMSRMPVREAFRRLASDGLVVLRPNRGCVVAGLTVDELFEIFEIRSVLEGLAVRLAVPRIDDEEFEELDRLLERMERAGQSGGGDWVVRHQEFHGRICALSQRPKLIHQISALHVVIEPYMRIWFDDCNKPLSAREEHAAVIAALRSGDAHHAEQVMQEHVLGTAPLLAEFVSPSR

SEQ ID NO: 31018 - DNA, 744 bp, Rhizobium loti
  CDS (1)..(744)
atgacatatggagctgccaacctgaacgacgacggcacaggatccaagagcacactcgccagcacggtctatcaccaattgcgggatgatcttctcggcggcgctcttgaaaccgaaagcaaactgcgggtcgagtgggttgtttccaaatatggcgccggcgcttcgccggttcgtgaagctcttaatcgccttgcctccgaaggacttcttggtcgccacgaccagcgtggctttttcatcatgccggtcagtgcggcggagctcgaggagctgacgcggacccgctgctggctcgaggagcgggcgcttcgcgaatccatcgcccaccgcaccgccgaatgggaagaacagctggtgctggcgctgcatcgcctgggccgcgcctcgcgtctttcgccgcaaaatgccacgtcgctcgatccggactgggagaaattgcaccgcacctttcatcgggtgctgatctcggcctgccggtcgcactggctggtgggtttctgcgatcagctttccgatcacgcctatcgctaccggcaaatggccaatgacggcgaaagcatcccgcgcgacgatttcgccgaacaccggcagatcgccgaatacgcgctggacggcaatgccgacgaggccgtcaaggccttgatcgatcactaccagctgaccgcttccatatgcatggaacgtttcaagcaaggcgaagtcgcaaaggtcgccgcctcggccgaacgcgcccggcggtaa

SEQ ID NO: 31019 - protein, 247 aa, Rhizobium loti
MTYGAANLNDDGTGSKSTLASTVYHQLRDDLLGGALETESKLRVEWVVSKYGAGASPVREALNRLASEGLLGRHDQRGFFIMPVSAAELEELTRTRCWLEERALRESIAHRTAEWEEQLVLALHRLGRASRLSPQNATSLDPDWEKLHRTFHRVLISACRSHWLVGFCDQLSDHAYRYRQMANDGESIPRDDFAEHRQIAEYALDGNADEAVKALIDHYQLTASICMERFKQGEVAKVAASAERARR

SEQ ID NO: 31020 - DNA, 780 bp, Rhizobium loti
  CDS (1)..(780)
atggcgatgcaggatcagaacaattccacgaagaccgaggcggcctatcagctgctgcggcgcgatatcctgaccacccgcctcatgccgggcgcgccgctcaagctgagcgcgctgcgcggcacatacggcgtcggctggacgccgctgcgtgaagccttgtcccgacttgaagccgaacgcctggtcaccgccatcagcaatcgcggctttgccgtcgctcccgtgtcgcgcgccgagctcgaggacctggcgcgcgcaaggatggttgtcgaaatgccgctgttcctggaatcgatcgcgaacggcggcagggaatgggaggacgcggtcgtcaccgctcattaccggctctcccgctgcaagaccgcggtcgaagacccttccgatgcggccgtcgacaaatgggacgagagccacgaggccttccatgcggcgttgctgagcgcggcgacgtcgaactggctgttgcgcttccgctcgacgatcgccgatcagctgcggcggcatcaccgttttctcggcctggcgcccacattacgagcggcggccggcctcaaggacggctatggcgaggcaatggacgctttgcgcgaggcgatcgccatcgagcatcacaccgagatcatggaagcggcgctcgatcgcgacgtcgagcgggcaaaggcgctgatgacggcgcatatcggctacacgctgcacgtctatgtgcacagcgaagacaattgcgccaatccctacaccgcgcgcgccggcagtctgaaagcggtttccggatga

SEQ ID NO: 31021 - protein, 259 aa, Rhizobium loti
MAMQDQNNSTKTEAAYQLLRRDILTTRLMPGAPLKLSALRGTYGVGWTPLREALSRLEAERLVTAISNRGFAVAPVSRAELEDLARARMVVEMPLFLESIANGGREWEDAVVTAHYRLSRCKTAVEDPSDAAVDKWDESHEAFHAALLSAATSNWLLRFRSTIADQLRRHHRFLGLAPTLRAAAGLKDGYGEAMDALREAIAIEHHTEIMEAALDRDVERAKALMTAHIGYTLHVYVHSEDNCANPYTARAGSLKAVSG

SEQ ID NO: 31022 - DNA, 693 bp, Streptomyces coelicolor
  CDS (1)..(693)
atgactcagaccgcccccacgtcgccccagtcgcccccgccggcgggcaagcggatgctctccgagcaggtctacgcacatctgcgggacgcgatcatgcgcggcgaccacacccccggtgccgccctcaagccgcaggacctcgccaaggagcagggcgtgagcctggccgtggtgcgcgaggccctcgtgcgggtggtcggggacgggctcgccgaccggctgcccaaccgcggcttcgccgtcccggcctactccgaccggcgctggcaggagatcgcggaggcccgccgcaccatcgaaccggtcctgctgcgcatgtccgtcgagcgcggcgacgtcgactgggaggcccgggtgcgcgccgcccaccaccggctgtcccgcacgcccccgtacacgccggaggagggcgagtactacagcgaggcgtggtccgaggcgcaccggctcttccaccgcgccctgatggagggctgcggcaaccccgtgctgctggagaccttcgaccggctgtggacggcgagcgaactggcccgccgctggtcgacgcaccgcaatcccggccgggacggcgtcgaggaacaccgccggctggaggaggcggcgctggcccgcgacgccgacaccgccgccgaggtgctggtccggcacctcaccctcacggccgagggcctgaccgcggagggctga

SEQ ID NO: 31023 - protein, 230 aa, Streptomyces coelicolor
MTQTAPTSPQSPPPAGKRMLSEQVYAHLRDAIMRGDHTPGAALKPQDLAKEQGVSLAVVREALVRVVGDGLADRLPNRGFAVPAYSDRRWQEIAEARRTIEPVLLRMSVERGDVDWEARVRAAHHRLSRTPPYTPEEGEYYSEAWSEAHRLFHRALMEGCGNPVLLETFDRLWTASELARRWSTHRNPGRDGVEEHRRLEEAALARDADTAAEVLVRHLTLTAEGLTAEG

SEQ ID NO: 31024 - DNA, 732 bp, Alcaligenes eutrophus
  CDS (1)..(732)
atgacacagcaagatcaagcatttctgacgcgattggttgcgtcaaagggttggccgaagggccactggcagaacccgatgtcgggccgaaagagaagaaggccgcaactgccatcgagtccaccctacgcaacgctccgtgactgcatcttgaggggaagccacccccaaggctcaaggctccacctcgaaacactcaagtcatcactgggtgtcagcggcagcactctgcgggaagcattgacgcgcctggttggagaccgtctggtcgtcgccgaagggcagaaagggttcaaggtggccccgatgtcgctttgcgatctcgatgatctgacgagcgcgcgcatcaccttggaaaccaccgccatcgtcgagagcatcaacctcggtgggggcgactgggaagaccaactcgtcatcagcttccgtcgactggcgagagcgcaggagcgagttgaagccaatcctgcagaggccttcgatgcatgggaagcgaggaatcaggaattccacaacgcactcatggccgcctctccgtccaaatggctcgcgaacttcagagaaatcctgtttcacaactccgagcgctaccgcaggttgtccggcacgcaaggcccaatttccgttgaggtgcacgaggagcacaagacaatcttcgaggcggcgatagcccgcgatgcaaatcaggcggtttcggtcctttcgcagcacattcggcgctccgcaatgtga

SEQ ID NO: 31025 - protein, 243 aa, Alcaligenes eutrophus
MTQQDQAFLTRLVASKGWPKGHWQNPMSGRKRRRPQLPSSPPYATLRDCILRGSHPQGSRLHLETLKSSLGVSGSTLREALTRLVGDRLVVAEGQKGFKVAPMSLCDLDDLTSARITLETTAIVESINLGGGDWEDQLVISFRRLARAQERVEANPAEAFDAWEARNQEFHNALMAASPSKWLANFREILFHNSERYRRLSGTQGPISVEVHEEHKTIFEAAIARDANQAVSVLSQHIRRSAM

SEQ ID NO: 31026 - DNA, 741 bp, Rhodococcus sp
  CDS (1)..(741)
atgaccaccaccgacaccggccccaagccgggcagtgaggccgccgccctgctcgccaatgtccgcacctcgggggcgcggctgtcctccgcgttgtacgacattctgaagaaccggctgctcgaagggcgctatgcggcaggcgagaagatcgtcgtcgagtcgatccggcaagagttcggggtgagcaagcagcccgtcatggacgctctgcgccgcctgtccagcgacaagctggtccacatcgttccccaggtcggttgcgaggtcgtctcctacgccccgcgcgaagtggaagacttctacaccctgttcggcggtttcgaagggaccatcgccgcggtagcggcctcccggcggaccgaggcccagttgctggagctggacctgatctcggcgcgggtcgacgccctgatcacctcccacgacccggtggtccgcgcccgcgggtaccgcgtgcacaaccgggagttccatgcggccatccacgcgatggcgcactcgcggatcatggaggagaccagccagcgaatgtgggatctgtcggacttcttgatcaacaccaccggcatcaccaacccgctctcgagcgcactgcccgaccggcagcatgaccaccacgaaatcaccgaggccatccgcaaccgtgacgcagctgccgcccgcgaggccatggaacgccacatcgtcggcaccatcgcagtaatccgcgacgaatccaacgcccagctgccgagctag

SEQ ID NO: 31027 - protein, 246 aa, Rhodococcus sp
MTTTDTGPKPGSEAAALLANVRTSGARLSSALYDILKNRLLEGRYAAGEKIVVESIRQEFGVSKQPVMDALRRLSSDKLVHIVPQVGCEVVSYAPREVEDFYTLFGGFEGTIAAVAASRRTEAQLLELDLISARVDALITSHDPVVRARGYRVHNREFHAAIHAMAHSRIMEETSQRMWDLSDFLINTTGITNPLSSALPDRQHDHHEITEAIRNRDAAAAREAMERHIVGTIAVIRDESNAQLPS

SEQ ID NO: 31028 - DNA, 780 bp, Comamonas testosteroni
  CDS (25)..(744)
aaatcctttgtgcaatgcctggccatgcccgaggctgaatccagcggcggcgaggcatcacgcaccctgaccgagcaaacctatgcccggctgcgcaccgatattgtcgaaggccgcctgctgcctggcagcaagctgcgcatagagcatctgcgccaggcctacgaggtcggtgcaggcaccttgcgggaggcgttgacgcgcctggtcagtgatgcactggtcacaaccgaaggccagcgcggctttcgcgtctccaccatcgccatggacgacctgcaggacatcacccgcctgcgggtacatatcgaaacccatgcactgcgtgaatccatacgccatggcgacgcagcctggcgggcccagttgcaggccagctatgacgagctctcggcagccgagcaaccgctgtccagcgacaaccgccgccagtgggaggcattgaatgtgcgctttcacgagtccctgctctccggctatgcatccccttggacattgaaggtgctgcgtctgctggcgcgccatagcgagcgctaccgctgctacgccatggagcagcccgcgctcacccgcgatgtgcatgccgagcaccaggagatcttcgagctcgccatggctggccacgaggcccgcgcggccctggccctggaagcccatatttgcaccaccccccatctactgctgcaggcaatgcgcgaaggcaagctggtgttgcctggcacccggccggaaggggaggtatgaactgcagcacagctttatcattttggtagctgtctg

SEQ ID NO: 31029 - protein, 239 aa, Comamonas testosteroni
MPEAESSGGEASRTLTEQTYARLRTDIVEGRLLPGSKLRIEHLRQAYEVGAGTLREALTRLVSDALVTTEGQRGFRVSTIAMDDLQDITRLRVHIETHALRESIRHGDAAWRAQLQASYDELSAAEQPLSSDNRRQWEALNVRFHESLLSGYASPWTLKVLRLLARHSERYRCYAMEQPALTRDVHAEHQEIFELAMAGHEARAALALEAHICTTPHLLLQAMREGKLVLPGTRPEGEV

SEQ ID NO: 31030 - DNA, 666 bp, Photobacterium leiognathi
  CDS (1)..(666)
atgaggactcacgtgtctagcccgactttaacaaatcaggttatggaagtaattcgacaggacatcttgctcggtaaactcactcctggacaaaaattggttgtagctgatctaaaagagcgctacaacgttggtgcatctccaatccgtgaagcattagtgcaattatcatggaaaaaatacattaaattcgcaccgcaaaaaggctgctgggtagcccctgtctctattgaagagcttcaggatcttttcagtgccaataaagtaatttcacgtgaactattaacgcgtgcaattactcatggtgatgaagcatgggaattaaatatccttacggcttaccataaactcagccgaatagatcctacatcagatgagaccgatttatcagaatgggaacaacgccactgcgatttccataccgcgatcctaaccagtgagcattctcctgtgatgcttgatatctaccacgatatctatgatcaaattaagcgctatcgccatatttgggtcagtaaaatgcgtcaagtcgaagatcgctacactgatgagggtgaacatgaagcattgatgaaggccgtccttgctcgtgatcttgagcaagcgcaaaagatcatgcatacccactttgaacgtgcggtagaagatatcaaaaattatctttaa

SEQ ID NO: 31031 - protein, 221 aa, Photobacterium leiognathi
MRTHVSSPTLTNQVMEVIRQDILLGKLTPGQKLVVADLKERYNVGASPIREALVQLSWKKYIKFAPQKGCWVAPVSIEELQDLFSANKVISRELLTRAITHGDEAWELNILTAYHKLSRIDPTSDETDLSEWEQRHCDFHTAILTSEHSPVMLDIYHDIYDQIKRYRHIWVSKMRQVEDRYTDEGEHEALMKAVLARDLEQAQKIMHTHFERAVEDIKNYL

SEQ ID NO: 31032 - DNA, 22 bp, Primer
atgatcaggagtcacaccatga

SEQ ID NO: 31033 - DNA, 21 bp, Primer
ttaattgccagccatcgcctg

SEQ ID NO: 31034 - protein, 178 aa, consensus
  MISC_FEATURE (1)..(178): consensus for the disclosure of xaa see table XV
REALXXLXXXXLXXXXXXXGXXVXXXXXXXXXXXXXXXXXXEXXXXXXXXXXXXXXXXXXXXXXXXXXXXXXXXXXXXXXXXXXXXXXXXXXFHXXXXXXXXXXXXXXXXXXXXXXXXXXXXXXXXXXXXXXXXXXXXXXXXXXXXXXXXXXXXXHXXXXXXXXXXXXXXAXXXXXXH

SEQ ID NO: 31035 - protein, 81 aa, consensus
  MISC_FEATURE (1)..(81): consensus for the disclosure of xaa see table XV
XXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 31036 - protein, 12 aa, consensus
  MISC_FEATURE (1)..(12): consensus for the disclosure of xaa see table XV
XXXXXXXXXXXX

SEQ ID NO: 31037 - DNA, 1062 bp, Escherichia coli K12; identical to SEQ ID NO: 2732
  CDS (1)..(1062)

SEQ ID NO: 31038 - protein, 353 aa, Escherichia coli K12; identical to SEQ ID NO: 2733

SEQ ID NO: 31039 - DNA, 1444 bp, Pseudomonas fluorescens; identical to SEQ ID NO: 2734
  CDS (156)..(1214)

SEQ ID NO: 31040 - protein, 352 aa, Pseudomonas fluorescens; identical to SEQ ID NO: 2735

SEQ ID NO: 31041 - DNA, 1484 bp, Haemophilus influenzae; identical to SEQ ID NO: 2736
  CDS (278)..(1342)

SEQ ID NO: 31042 - protein, 354 aa, Haemophilus influenzae; identical to SEQ ID NO: 2737

SEQ ID NO: 31043 - DNA, 1131 bp, Thermus aquaticus; identical to SEQ ID NO: 2738
  CDS (62)..(1084)

SEQ ID NO: 31044 - protein, 340 aa, Thermus aquaticus; identical to SEQ ID NO: 2739

SEQ ID NO: 31045 - DNA, 1196 bp, Aquifex pyrophilus; identical to SEQ ID NO: 2740
  CDS (51)..(1097)

SEQ ID NO: 31046 - protein, 348 aa, Aquifex pyrophilus; identical to SEQ ID NO: 2741

SEQ ID NO: 31047 - DNA, 1023 bp, Rickettsia prowazekii; identical to SEQ ID NO: 2742
  CDS (1)..(1023)

SEQ ID NO: 31048 - protein, 340 aa, Rickettsia prowazekii; identical to SEQ ID NO: 2743

SEQ ID NO: 31049 - DNA, 1329 bp, Myxococcus xanthus; identical to SEQ ID NO: 2744
  CDS (201)..(1229)

SEQ ID NO: 31050 - protein, 342 aa, Myxococcus xanthus; identical to SEQ ID NO: 2745

SEQ ID NO: 31051 - DNA, 1394 bp, Legionella pneumophila; identical to SEQ ID NO: 2746
  CDS (166)..(1212)

SEQ ID NO: 31052 - protein, 348 aa, Legionella pneumophila; identical to SEQ ID NO: 2747

SEQ ID NO: 31053 - DNA, 1224 bp, Treponema pallidum subsp. pallidum (syphilis spirochete); identical to SEQ ID NO: 2748
  CDS (1)..(1224): k means g or t/u

SEQ ID NO: 31054 - protein, 407 aa, Treponema pallidum subsp. pallidum (syphilis spirochete); identical to SEQ ID NO: 2749
  misc_feature (375)..(375): Xaa can be Cys or Phe

SEQ ID NO: 31055 - DNA, 1050 bp, Clostridium acetobutylicum; identical to SEQ ID NO: 2750
  CDS (1)..(1050)

SEQ ID NO: 31056 - protein, 349 aa, Clostridium acetobutylicum; identical to SEQ ID NO: 2751

SEQ ID NO: 31057 - DNA, 1047 bp, Listeria innocua; identical to SEQ ID NO: 2752
  CDS (1)..(1047)

SEQ ID NO: 31058 - protein, 348 aa, Listeria innocua; identical to SEQ ID NO: 2753

SEQ ID NO: 31059 - DNA, 1137 bp, Brucella melitensis; identical to SEQ ID NO: 2754
  CDS (1)..(1137)

SEQ ID NO: 31060 - protein, 378 aa, Brucella melitensis; identical to SEQ ID NO: 2755

SEQ ID NO: 31061 - DNA, 1062 bp, Salmonella enterica subsp. enterica serovar Typhi; identical to SEQ ID NO: 2756
  CDS (1)..(1062)

SEQ ID NO: 31062 - protein, 353 aa, Salmonella enterica subsp. enterica serovar Typhi; identical to SEQ ID NO: 2757

SEQ ID NO: 31063 - DNA, 1074 bp, Nostoc sp. PCC 7120; identical to SEQ ID NO: 2758
  CDS (1)..(1074)

SEQ ID NO: 31064 - protein, 357 aa, Nostoc sp. PCC 7120; identical to SEQ ID NO: 2759

SEQ ID NO: 31065 - DNA, 1044 bp, Xylella fastidiosa; identical to SEQ ID NO: 2760
  CDS (1)..(1044)

SEQ ID NO: 31066 - protein, 347 aa, Xylella fastidiosa; identical to SEQ ID NO: 2761

SEQ ID NO: 31067 - DNA, 1164 bp, Lactococcus lactis subsp. lactis; identical to SEQ ID NO: 2762
  CDS (1)..(1164)

SEQ ID NO: 31068 - protein, 387 aa, Lactococcus lactis subsp. lactis; identical to SEQ ID NO: 2763

SEQ ID NO: 31069 - DNA, 2025 bp, Borrelia burgdorferi (Lyme disease spirochete); identical to SEQ ID NO: 2764
  CDS (25)..(1122)

SEQ ID NO: 31070 - protein, 365 aa, Borrelia burgdorferi (Lyme disease spirochete); identical to SEQ ID NO: 2765

SEQ ID NO: 31071 - DNA, 1728 bp, Deinococcus radiodurans; identical to SEQ ID NO: 2766
  CDS (399)..(1490)

SEQ ID NO: 31072 - protein, 363 aa, Deinococcus radiodurans; identical to SEQ ID NO: 2767

SEQ ID NO: 31073 - DNA, 1071 bp, Caulobacter crescentus; identical to SEQ ID NO: 2768
  CDS (1)..(1071)

SEQ ID NO: 31074 - protein, 356 aa, Caulobacter crescentus; identical to SEQ ID NO: 2769

SEQ ID NO: 31075 - DNA, 1199 bp, Thermotoga maritima; identical to SEQ ID NO: 2770
  CDS (67)..(1137)

SEQ ID NO: 31076 - protein, 356 aa, Thermotoga maritima; identical to SEQ ID NO: 2771

SEQ ID NO: 31077 - DNA, 1662 bp, Arabidopsis thaliana (mouse-ear cress); identical to SEQ ID NO: 2772
  CDS (368)..(1498)

SEQ ID NO: 31078 - protein, 376 aa, Arabidopsis thaliana (mouse-ear cress); identical to SEQ ID NO: 2773

SEQ ID NO: 31079 - DNA, 1038 bp, Aquifex aeolicus; identical to SEQ ID NO: 2774
  CDS (1)..(1038)

SEQ ID NO: 31080 - protein, 345 aa, Aquifex aeolicus; identical to SEQ ID NO: 2775

SEQ ID NO: 31081 - DNA, 1062 bp, Chlamydophila pneumoniae, Chlamydia pneumoniae; identical to SEQ ID NO: 2776
  CDS (1)..(1062)

SEQ ID NO: 31082 - protein, 353 aa, Chlamydophila pneumoniae, Chlamydia pneumoniae; identical to SEQ ID NO: 2777

SEQ ID NO: 31083 - DNA, 1047 bp, Neisseria meningitidis; identical to SEQ ID NO: 2778
  CDS (1)..(1047)

SEQ ID NO: 31084 - protein, 348 aa, Neisseria meningitidis; identical to SEQ ID NO: 2779

SEQ ID NO: 31085 - DNA, 1032 bp, Campylobacter jejuni; identical to SEQ ID NO: 2780
  CDS (1)..(1032)

SEQ ID NO: 31086 - protein, 343 aa, Campylobacter jejuni; identical to SEQ ID NO: 2781

SEQ ID NO: 31087 - DNA, 1065 bp, Chlamydia muridarum, Chlamydia trachomatis MoPn; identical to SEQ ID NO: 2782
  CDS (1)..(1065)

SEQ ID NO: 31088 - protein, 354 aa, Chlamydia muridarum, Chlamydia trachomatis MoPn; identical to SEQ ID NO: 2783

SEQ ID NO: 31089 - DNA, 1050 bp, Bacillus halodurans; identical to SEQ ID NO: 2784
  CDS (1)..(1050)

SEQ ID NO: 31090 - protein, 349 aa, Bacillus halodurans; identical to SEQ ID NO: 2785

SEQ ID NO: 31091 - DNA, 1229 bp, Streptococcus pneumoniae; identical to SEQ ID NO: 2786
  CDS (26)..(1192)

SEQ ID NO: 31092 - protein, 388 aa, Streptococcus pneumoniae; identical to SEQ ID NO: 2787

SEQ ID NO: 31093 - DNA, 1251 bp, Agrobacterium tumefaciens; identical to SEQ ID NO: 2788
  CDS (1)..(1251)

SEQ ID NO: 31094 - protein, 416 aa, Agrobacterium tumefaciens; identical to SEQ ID NO: 2789

SEQ ID NO: 31095 - DNA, 1044 bp, Staphylococcus aureus; identical to SEQ ID NO: 2790
  CDS (1)..(1044)

SEQ ID NO: 31096 - protein, 347 aa, Staphylococcus aureus; identical to SEQ ID NO: 2791

SEQ ID NO: 31097 - DNA, 1506 bp, Acinetobacter calcoaceticus; identical to SEQ ID NO: 2792
  CDS (403)..(1452)

SEQ ID NO: 31098 - protein, 349 aa, Acinetobacter calcoaceticus; identical to SEQ ID NO: 2793

SEQ ID NO: 31099 - DNA, 1479 bp, Brucella abortus; identical to SEQ ID NO: 2794
  CDS (316)..(1398)

SEQ ID NO: 31100 - protein, 360 aa, Brucella abortus; identical to SEQ ID NO: 2795

SEQ ID NO: 31101 - DNA, 981 bp, Streptococcus pyogenes; identical to SEQ ID NO: 2796
  CDS (1)..(981)

SEQ ID NO: 31102 - protein, 326 aa, Streptococcus pyogenes; identical to SEQ ID NO: 2797

SEQ ID NO: 31103 - DNA, 1349 bp, Leptospira biflexa; identical to SEQ ID NO: 2798
  CDS (107)..(1270)

SEQ ID NO: 31104 - protein, 387 aa, Leptospira biflexa; identical to SEQ ID NO: 2799

SEQ ID NO: 31105 - DNA, 1762 bp, Xanthomonas campestris pv. campestris; identical to SEQ ID NO: 2800
  CDS (159)..(1190)

SEQ ID NO: 31106 - protein, 343 aa, Xanthomonas campestris pv. campestris; identical to SEQ ID NO: 2801

SEQ ID NO: 31107 - DNA, 1212 bp, Aeromonas salmonicida; identical to SEQ ID NO: 2802
  CDS (151)..(1212)

SEQ ID NO: 31108 - protein, 353 aa, Aeromonas salmonicida; identical to SEQ ID NO: 2803

SEQ ID NO: 31109 - DNA, 1433 bp, Azotobacter vinelandii; identical to SEQ ID NO: 2804
  CDS (311)..(1360)

SEQ ID NO: 31110 - protein, 349 aa, Azotobacter vinelandii; identical to SEQ ID NO: 2805

SEQ ID NO: 31111 - DNA, 1108 bp, Acetobacter polyoxogenes; identical to SEQ ID NO: 2806
  CDS (35)..(1081)

SEQ ID NO: 31112 - protein, 348 aa, Acetobacter polyoxogenes; identical to SEQ ID NO: 2807

SEQ ID NO: 31113 - DNA, 1230 bp, Neisseria gonorrhoeae; identical to SEQ ID NO: 2808
  CDS (133)..(1179)

SEQ ID NO: 31114 - protein, 348 aa, Neisseria gonorrhoeae; identical to SEQ ID NO: 2809

SEQ ID NO: 31115 - DNA, 1649 bp, Bacteroides fragilis; identical to SEQ ID NO: 2810
  CDS (351)..(1307)

SEQ ID NO: 31116 - protein, 318 aa, Bacteroides fragilis; identical to SEQ ID NO: 2811

SEQ ID NO: 31117 - DNA, 1349 bp, Methylobacillus sp; identical to SEQ ID NO: 2812
  CDS (293)..(1327)

SEQ ID NO: 31118 - protein, 344 aa, Methylobacillus sp; identical to SEQ ID NO: 2813

SEQ ID NO: 31119 - DNA, 1320 bp, Vibrio anguillarum; identical to SEQ ID NO: 2814
  CDS (166)..(1212)

SEQ ID NO: 31120 - protein, 348 aa, Vibrio anguillarum; identical to SEQ ID NO: 2815

SEQ ID NO: 31121 - DNA, 1394 bp, Anabaena variabilis; identical to SEQ ID NO: 2816
  CDS (125)..(1201)

SEQ ID NO: 31122 - protein, 358 aa, Anabaena variabilis; identical to SEQ ID NO: 2817

SEQ ID NO: 31123 - DNA, 1334 bp, Bacillus subtilis; identical to SEQ ID NO: 2818
  CDS (215)..(1258)

SEQ ID NO: 31124 - protein, 347 aa, Bacillus subtilis; identical to SEQ ID NO: 2819

SEQ ID NO: 31125 - DNA, 1348 bp, Proteus mirabilis; identical to SEQ ID NO: 2820
  CDS (151)..(1218)

SEQ ID NO: 31126 - protein, 355 aa, Proteus mirabilis; identical to SEQ ID NO: 2821

SEQ ID NO: 31127 - DNA, 1384 bp, Pseudomonas aeruginosa; identical to SEQ ID NO: 2822
  CDS (145)..(1185)

SEQ ID NO: 31128 - protein, 346 aa, Pseudomonas aeruginosa; identical to SEQ ID NO: 2823

SEQ ID NO: 31129 - DNA, 1352 bp, Pseudomonas cepacia; identical to SEQ ID NO: 2824
  CDS (223)..(1266)

SEQ ID NO: 31130 - protein, 347 aa, Pseudomonas cepacia; identical to SEQ ID NO: 2825

SEQ ID NO: 31131 - DNA, 1047 bp, Synechococcus sp; identical to SEQ ID NO: 2826
  CDS (1)..(1047)

SEQ ID NO: 31132 - protein, 348 aa, Synechococcus sp; identical to SEQ ID NO: 2827

SEQ ID NO: 31133 - DNA, 1190 bp, Aquaspirillum magnetotacticum; identical to SEQ ID NO: 2828
  CDS (112)..(1146)

SEQ ID NO: 31134 - protein, 344 aa, Aquaspirillum magnetotacticum; identical to SEQ ID NO: 2829

SEQ ID NO: 31135 - DNA, 1841 bp, Rhizobium leguminosarum bv. viciae; identical to SEQ ID NO: 2830
  CDS (32)..(1087)

SEQ ID NO: 31136 - protein, 351 aa, Rhizobium leguminosarum bv. viciae; identical to SEQ ID NO: 2831

SEQ ID NO: 31137 - DNA, 1047 bp, Rhizobium meliloti; identical to SEQ ID NO: 2832
  CDS (1)..(1047)

SEQ ID NO: 31138 - protein, 348 aa, Rhizobium meliloti; identical to SEQ ID NO: 2833

SEQ ID NO: 31139 - DNA, 2762 bp, Mycobacterium tuberculosis; identical to SEQ ID NO: 2834
  CDS (311)..(2683)

SEQ ID NO: 31140 - protein, 790 aa, Mycobacterium tuberculosis; identical to SEQ ID NO: 2835

SEQ ID NO: 31141 - DNA, 1249 bp, Methylomonas clara; identical to SEQ ID NO: 2836
  CDS (123)..(1151)

SEQ ID NO: 31142 - protein, 342 aa, Methylomonas clara; identical to SEQ ID NO: 2837

SEQ ID NO: 31143 - DNA, 1065 bp, Enterobacter agglomerans; identical to SEQ ID NO: 2838
  CDS (1)..(1065)

SEQ ID NO: 31144 - protein, 354 aa, Enterobacter agglomerans; identical to SEQ ID NO: 2839

SEQ ID NO: 31145 - DNA, 1125 bp, Streptomyces lividans; identical to SEQ ID NO: 2840
  CDS (1)..(1125)

SEQ ID NO: 31146 - protein, 374 aa, Streptomyces lividans; identical to SEQ ID NO: 2841

SEQ ID NO: 31147 - DNA, 1347 bp, Rhodobacter sphaeroides; identical to SEQ ID NO: 2842
  CDS (220)..(1251)

SEQ ID NO: 31148 - protein, 343 aa, Rhodobacter sphaeroides; identical to SEQ ID NO: 2843

SEQ ID NO: 31149 - DNA, 1065 bp, Vibrio cholerae; identical to SEQ ID NO: 2844
  CDS (1)..(1065)

SEQ ID NO: 31150 - protein, 354 aa, Vibrio cholerae; identical to SEQ ID NO: 2845

SEQ ID NO: 31151 - DNA, 1068 bp, Rhodobacter capsulatus; identical to SEQ ID NO: 2846
  CDS (1)..(1068)

SEQ ID NO: 31152 - protein, 355 aa, Rhodobacter capsulatus; identical to SEQ ID NO: 2847

SEQ ID NO: 31153 - DNA, 1533 bp, Helicobacter pylori; identical to SEQ ID NO: 2848
  CDS (275)..(1318)

SEQ ID NO: 31154 - protein, 347 aa, Helicobacter pylori; identical to SEQ ID NO: 2849

SEQ ID NO: 31155 - DNA, 1065 bp, Synechocystis sp; identical to SEQ ID NO: 2850
  CDS (1)..(1065)

SEQ ID NO: 31156 - protein, 354 aa, Synechocystis sp; identical to SEQ ID NO: 2851

SEQ ID NO: 31157 - DNA, 1351 bp, Arabidopsis thaliana (mouse-ear cress); identical to SEQ ID NO: 2852
  CDS (1)..(1320)

SEQ ID NO: 31158 - protein, 439 aa, Arabidopsis thaliana (mouse-ear cress); identical to SEQ ID NO: 2853

SEQ ID NO: 31159 - DNA, 1392 bp, Pseudomonas putida; identical to SEQ ID NO: 2854
  CDS (111)..(1178)

SEQ ID NO: 31160 - protein, 355 aa, Pseudomonas putida; identical to SEQ ID NO: 2855

SEQ ID NO: 31161 - DNA, 1053 bp, Mycobacterium tuberculosis; identical to SEQ ID NO: 2856
  CDS (1)..(1053)

SEQ ID NO: 31162 - protein, 350 aa, Mycobacterium tuberculosis; identical to SEQ ID NO: 2857

SEQ ID NO: 31163 - DNA, 1053 bp, Wolinella succinogenes; identical to SEQ ID NO: 2858
  CDS (1)..(1053)

SEQ ID NO: 31164 - protein, 350 aa, Wolinella succinogenes; identical to SEQ ID NO: 2859

SEQ ID NO: 31165 - DNA, 1110 bp, Vibrio vulnificus; identical to SEQ ID NO: 2860
  CDS (1)..(1110)

SEQ ID NO: 31166 - protein, 369 aa, Vibrio vulnificus; identical to SEQ ID NO: 2861

SEQ ID NO: 31167 - DNA, 1068 bp, Photorhabdus luminescens; identical to SEQ ID NO: 2862
  CDS (1)..(1068)

SEQ ID NO: 31168 - protein, 355 aa, Photorhabdus luminescens; identical to SEQ ID NO: 2863

SEQ ID NO: 31169 - DNA, 1110 bp, Gloeobacter violaceus; identical to SEQ ID NO: 2864
  CDS (1)..(1110)

SEQ ID NO: 31170 - protein, 369 aa, Gloeobacter violaceus; identical to SEQ ID NO: 2865

SEQ ID NO: 31171 - DNA, 1053 bp, Chromobacterium violaceum; identical to SEQ ID NO: 2866
  CDS (1)..(1053)

SEQ ID NO: 31172 - protein, 350 aa, Chromobacterium violaceum; identical to SEQ ID NO: 2867

SEQ ID NO: 31173 - DNA, 1128 bp, Synechococcus sp; identical to SEQ ID NO: 2868
  CDS (1)..(1128)

SEQ ID NO: 31174 - protein, 375 aa, Synechococcus sp; identical to SEQ ID NO: 2869

SEQ ID NO: 31175 - DNA, 1128 bp, Rhodopirellula baltica; identical to SEQ ID NO: 2870
  CDS (1)..(1128)

SEQ ID NO: 31176 - protein, 375 aa, Rhodopirellula baltica; identical to SEQ ID NO: 2871

SEQ ID NO: 31177 - DNA, 1113 bp, Prochlorococcus marinus subsp; identical to SEQ ID NO: 2872
  CDS (1)..(1113)

SEQ ID NO: 31178 - protein, 370 aa, Prochlorococcus marinus subsp; identical to SEQ ID NO: 2873

SEQ ID NO: 31179 - DNA, 1140 bp, Prochlorococcus marinus; identical to SEQ ID NO: 2874
  CDS (1)..(1140)

SEQ ID NO: 31180 - protein, 379 aa, Prochlorococcus marinus; identical to SEQ ID NO: 2875

SEQ ID NO: 31181 - DNA, 1140 bp, Prochlorococcus marinus; identical to SEQ ID NO: 2876
  CDS (1)..(1140)

SEQ ID NO: 31182 - protein, 379 aa, Prochlorococcus marinus; identical to SEQ ID NO: 2877

SEQ ID NO: 31183 - DNA, 1038 bp, Helicobacter hepaticus; identical to SEQ ID NO: 2878
  CDS (1)..(1038)

SEQ ID NO: 31184 - protein, 345 aa, Helicobacter hepaticus; identical to SEQ ID NO: 2879

SEQ ID NO: 31185 - DNA, 1119 bp, Haemophilus ducreyi; identical to SEQ ID NO: 2880
  CDS (1)..(1119)

SEQ ID NO: 31186 - protein, 372 aa, Haemophilus ducreyi; identical to SEQ ID NO: 2881

SEQ ID NO: 31187 - DNA, 1048 bp, Campylobacter lari; identical to SEQ ID NO: 2882
  CDS (9)..(1043)

SEQ ID NO: 31188 - protein, 344 aa, Campylobacter lari; identical to SEQ ID NO: 2883

SEQ ID NO: 31189 - DNA, 1077 bp, Burkholderia fungorum; identical to SEQ ID NO: 2884
  CDS (1)..(1077)

SEQ ID NO: 31190 - protein, 358 aa, Burkholderia fungorum; identical to SEQ ID NO: 2885

SEQ ID NO: 31191 - DNA, 963 bp, Mycobacteriophage CJW1; identical to SEQ ID NO: 2886
  CDS (1)..(963)

SEQ ID NO: 31192 - protein, 320 aa, Mycobacteriophage CJW1; identical to SEQ ID NO: 2887

SEQ ID NO: 31193 - DNA, 1563 bp, Zymomonas mobilis; identical to SEQ ID NO: 2888
  CDS (231)..(1250)

SEQ ID NO: 31194 - protein, 339 aa, Zymomonas mobilis; identical to SEQ ID NO: 2889

SEQ ID NO: 31195 - DNA, 1038 bp, Bacillus megaterium; identical to SEQ ID NO: 2890
  CDS (1)..(1038)

SEQ ID NO: 31196 - protein, 345 aa, Bacillus megaterium; identical to SEQ ID NO: 2891

SEQ ID NO: 31197 - DNA, 1038 bp, Bacillus megaterium; identical to SEQ ID NO: 2892
  CDS (1)..(1038)

SEQ ID NO: 31198 - protein, 345 aa, Bacillus megaterium; identical to SEQ ID NO: 2893

SEQ ID NO: 31199 - DNA, 1044 bp, Bacillus amyloliquefaciens; identical to SEQ ID NO: 2894
  CDS (1)..(1044)

SEQ ID NO: 31200 - protein, 347 aa, Bacillus amyloliquefaciens; identical to SEQ ID NO: 2895

SEQ ID NO: 31201 - DNA, 1047 bp, Listeria monocytogenes; identical to SEQ ID NO: 2896
  CDS (1)..(1047): m means a or c

SEQ ID NO: 31202 - protein, 348 aa, Listeria monocytogenes; identical to SEQ ID NO: 2897
  misc_feature (228)..(228): Xaa can be Pro or Gln

SEQ ID NO: 31203 - DNA, 1035 bp, Oryza sativa; identical to SEQ ID NO: 2898
  CDS (1)..(1035)

SEQ ID NO: 31204 - protein, 344 aa, Oryza sativa; identical to SEQ ID NO: 2899

SEQ ID NO: 31205 - DNA, 1035 bp, Campylobacter lari; identical to SEQ ID NO: 2900
  CDS (1)..(1035)

SEQ ID NO: 31206 - protein, 344 aa, Campylobacter lari; identical to SEQ ID NO: 2901

SEQ ID NO: 31207 - DNA, 2035 bp, Borrelia hermsii; identical to SEQ ID NO: 2902
  CDS (256)..(1326)

SEQ ID NO: 31208 - protein, 356 aa, Borrelia hermsii; identical to SEQ ID NO: 2903

SEQ ID NO: 31209 - DNA, 1487 bp, Chlamydomonas reinhardtii; identical to SEQ ID NO: 2904
  CDS (121)..(1365)

SEQ ID NO: 31210 - protein, 414 aa, Chlamydomonas reinhardtii; identical to SEQ ID NO: 2905

SEQ ID NO: 31211 - DNA, 1669 bp, Streptococcus suis; identical to SEQ ID NO: 2906
  CDS (469)..(1500)

SEQ ID NO: 31212 - protein, 343 aa, Streptococcus suis; identical to SEQ ID NO: 2907

SEQ ID NO: 31213 - DNA, 1439 bp, Peanut witches; identical to SEQ ID NO: 2908
  CDS (218)..(1228)

SEQ ID NO: 31214 - protein, 336 aa, Peanut witches; identical to SEQ ID NO: 2909

SEQ ID NO: 31215 - DNA, 1377 bp, Myxococcus xanthus; identical to SEQ ID NO: 2910
  CDS (201)..(1277)

SEQ ID NO: 31216 - protein, 358 aa, Myxococcus xanthus; identical to SEQ ID NO: 2911

SEQ ID NO: 31217 - DNA, 1404 bp, Acidiphilium facilis; identical to SEQ ID NO: 2912
  CDS (187)..(1251)

SEQ ID NO: 31218 - protein, 354 aa, Acidiphilium facilis; identical to SEQ ID NO: 2913

SEQ ID NO: 31219 - DNA, 1059 bp, Actinobacillus actinomycetemcomitans; identical to SEQ ID NO: 2914
  CDS (1)..(1059)

SEQ ID NO: 31220 - protein, 352 aa, Actinobacillus actinomycetemcomitans; identical to SEQ ID NO: 2915

SEQ ID NO: 31221 - DNA, 1565 bp, Alcaligenes eutrophus; identical to SEQ ID NO: 2916
  CDS (194)..(1255)

SEQ ID NO: 31222 - protein, 353 aa, Alcaligenes eutrophus; identical to SEQ ID NO: 2917

SEQ ID NO: 31223 - DNA, 1047 bp, Amycolatopsis mediterranei; identical to SEQ ID NO: 2918
  CDS (1)..(1047)

SEQ ID NO: 31224 - protein, 348 aa, Amycolatopsis mediterranei; identical to SEQ ID NO: 2919

SEQ ID NO: 31225 - DNA, 1035 bp, Bacteroides thetaiotaomicron; identical to SEQ ID NO: 2920
  CDS (1)..(1035)

SEQ ID NO: 31226 - protein, 344 aa, Bacteroides thetaiotaomicron; identical to SEQ ID NO: 2921

SEQ ID NO: 31227 - DNA, 1194 bp, Bifidobacterium longum; identical to SEQ ID NO: 2922
  CDS (1)..(1194)

SEQ ID NO: 31228 - protein, 397 aa, Bifidobacterium longum; identical to SEQ ID NO: 2923

SEQ ID NO: 31229 - DNA, 1062 bp, Bordetella pertussis; identical to SEQ ID NO: 2924
  CDS (1)..(1062)

SEQ ID NO: 31230 - protein, 353 aa, Bordetella pertussis; identical to SEQ ID NO: 2925

SEQ ID NO: 31231 - DNA, 1089 bp, Bradyrhizobium japonicum; identical to SEQ ID NO: 2926
  CDS (1)..(1089)

SEQ ID NO: 31232 - protein, 362 aa, Bradyrhizobium japonicum; identical to SEQ ID NO: 2927

SEQ ID NO: 31233 - DNA, 2058 bp, Campylobacter fetus; identical to SEQ ID NO: 2928
  CDS (401)..(1438)

SEQ ID NO: 31234 - protein, 345 aa, Campylobacter fetus; identical to SEQ ID NO: 2929

SEQ ID NO: 31235 - DNA, 1458 bp, Chloroflexus aurantiacus; identical to SEQ ID NO: 2930
  CDS (116)..(1171)

SEQ ID NO: 31236 - protein, 351 aa, Chloroflexus aurantiacus; identical to SEQ ID NO: 2931

SEQ ID NO: 31237 - DNA, 1053 bp, Chlamydophila caviae; identical to SEQ ID NO: 2932
  CDS (1)..(1053)

SEQ ID NO: 31238 - protein, 350 aa, Chlamydophila caviae; identical to SEQ ID NO: 2933

SEQ ID NO: 31239 - DNA, 1087 bp, Chromatium vinosum; identical to SEQ ID NO: 2934
  CDS (1)..(1044)

SEQ ID NO: 31240 - protein, 347 aa, Chromatium vinosum; identical to SEQ ID NO: 2935

SEQ ID NO: 31241 - DNA, 1346 bp, Clostridium perfringens; identical to SEQ ID NO: 2936
  CDS (172)..(1230)

SEQ ID NO: 31242 - protein, 352 aa, Clostridium perfringens; identical to SEQ ID NO: 2937

SEQ ID NO: 31243 - DNA, 1053 bp, Clostridium tetani; identical to SEQ ID NO: 2938
  CDS (1)..(1053)

SEQ ID NO: 31244 - protein, 350 aa, Clostridium tetani; identical to SEQ ID NO: 2939

SEQ ID NO: 31245 - DNA, 1161 bp, Corynebacterium efficiens; identical to SEQ ID NO: 2940
  CDS (1)..(1161)

SEQ ID NO: 31246 - protein, 386 aa, Corynebacterium efficiens; identical to SEQ ID NO: 2941

SEQ ID NO: 31247 - DNA, 1402 bp, Corynebacterium glutamicum; identical to SEQ ID NO: 2942
  CDS (133)..(1263)

SEQ ID NO: 31248 - protein, 376 aa, Corynebacterium glutamicum; identical to SEQ ID NO: 2943

SEQ ID NO: 31249 - DNA, 1409 bp, Corynebacterium pseudotuberculosis; identical to SEQ ID NO: 2944
  CDS (223)..(1332)

SEQ ID NO: 31250 - protein, 369 aa, Corynebacterium pseudotuberculosis; identical to SEQ ID NO: 2945

SEQ ID NO: 31251 - DNA, 1032 bp, Coxiella burnetii; identical to SEQ ID NO: 2946
  CDS (1)..(1032)

SEQ ID NO: 31252 - protein, 343 aa, Coxiella burnetii; identical to SEQ ID NO: 2947

SEQ ID NO: 31253 - DNA, 1047 bp, Enterococcus faecalis; identical to SEQ ID NO: 2948
  CDS (1)..(1047)

SEQ ID NO: 31254 - protein, 348 aa, Enterococcus faecalis; identical to SEQ ID NO: 2949

SEQ ID NO: 31255 - DNA, 1072 bp, Erwinia carotovora; identical to SEQ ID NO: 2950
  CDS (1)..(1029)

SEQ ID NO: 31256 - protein, 342 aa, Erwinia carotovora; identical to SEQ ID NO: 2951

SEQ ID NO: 31257 - DNA, 1137 bp, Fusobacterium nucleatum; identical to SEQ ID NO: 2952
  CDS (1)..(1137)

SEQ ID NO: 31258 - protein, 378 aa, Fusobacterium nucleatum; identical to SEQ ID NO: 2953

SEQ ID NO: 31259 - DNA, 1613 bp, Herbaspirillum seropedicae; identical to SEQ ID NO: 2954
  CDS (199)..(1254)

SEQ ID NO: 31260 - protein, 351 aa, Herbaspirillum seropedicae; identical to SEQ ID NO: 2955

SEQ ID NO: 31261 - DNA, 1143 bp, Lactobacillus plantarum; identical to SEQ ID NO: 2956
  CDS (1)..(1143)

SEQ ID NO: 31262 - protein, 380 aa, Lactobacillus plantarum; identical to SEQ ID NO: 2957

SEQ ID NO: 31263 - DNA, 1101 bp, Leptospira interrogans; identical to SEQ ID NO: 2958
  CDS (1)..(1101)

SEQ ID NO: 31264 - protein, 366 aa, Leptospira interrogans; identical to SEQ ID NO: 2959

SEQ ID NO: 31265 - DNA, 1126 bp, Mycoplasma mycoides; identical to SEQ ID NO: 2960
  CDS (79)..(1116)

SEQ ID NO: 31266 - protein, 345 aa, Mycoplasma mycoides; identical to SEQ ID NO: 2961

SEQ ID NO: 31267 - DNA, 1050 bp, Mycobacterium smegmatis; identical to SEQ ID NO: 2962
  CDS (1)..(1050)

SEQ ID NO: 31268 - protein, 349 aa, Mycobacterium smegmatis; identical to SEQ ID NO: 2963

SEQ ID NO: 31269 - DNA, 1044 bp, Oceanobacillus iheyensis; identical to SEQ ID NO: 2964
  CDS (1)..(1044)

SEQ ID NO: 31270 - protein, 347 aa, Oceanobacillus iheyensis; identical to SEQ ID NO: 2965

SEQ ID NO: 31271 - DNA, 1071 bp, Paracoccus denitrificans; identical to SEQ ID NO: 2966
  CDS (1)..(1071)

SEQ ID NO: 31272 - protein, 356 aa, Paracoccus denitrificans; identical to SEQ ID NO: 2967

SEQ ID NO: 31273 - DNA, 1320 bp, Pasteurella haemolytica; identical to SEQ ID NO: 2968
  CDS (157)..(1263)

SEQ ID NO: 31274 - protein, 368 aa, Pasteurella haemolytica; identical to SEQ ID NO: 2969

SEQ ID NO: 31275 - DNA, 1500 bp, Pasteurella multocida; identical to SEQ ID NO: 2970
  CDS (175)..(1239)

SEQ ID NO: 31276 - protein, 354 aa, Pasteurella multocida; identical to SEQ ID NO: 2971

SEQ ID NO: 31277 - DNA, 1023 bp, Porphyromonas gingivalis; identical to SEQ ID NO: 2972
  CDS (1)..(1023)

SEQ ID NO: 31278 - protein, 340 aa, Porphyromonas gingivalis; identical to SEQ ID NO: 2973

SEQ ID NO: 31279 - DNA, 1824 bp, Prevotella ruminicola; identical to SEQ ID NO: 2974
  CDS (501)..(1523)

SEQ ID NO: 31280 - protein, 340 aa, Prevotella ruminicola; identical to SEQ ID NO: 2975

SEQ ID NO: 31281 - DNA, 978 bp, Proteus vulgaris; identical to SEQ ID NO: 2976
  CDS (1)..(978)

SEQ ID NO: 31282 - protein, 325 aa, Proteus vulgaris; identical to SEQ ID NO: 2977

SEQ ID NO: 31283 - DNA, 1047 bp, Pseudomonas oleovorans; identical to SEQ ID NO: 2978
  CDS (1)..(1047)

SEQ ID NO: 31284 - protein, 348 aa, Pseudomonas oleovorans; identical to SEQ ID NO: 2979

SEQ ID NO: 31285 - DNA, 1068 bp, Pseudomonas putida; identical to SEQ ID NO: 2980
  CDS (1)..(1068)

SEQ ID NO: 31286 - protein, 355 aa, Pseudomonas putida; identical to SEQ ID NO: 2981

SEQ ID NO: 31287 - DNA, 1110 bp, Pseudomonas syringae; identical to SEQ ID NO: 2982
  CDS (46)..(1110)

SEQ ID NO: 31288 - protein, 354 aa, Pseudomonas syringae; identical to SEQ ID NO: 2983

SEQ ID NO: 31289 - DNA, 1980 bp, Pseudomonas tolaasii; identical to SEQ ID NO: 2984
  CDS (414)..(1472)

SEQ ID NO: 31290 - protein, 352 aa, Pseudomonas tolaasii; identical to SEQ ID NO: 2985

SEQ ID NO: 31291 - DNA, 1501 bp, Rhizobium etli; identical to SEQ ID NO: 2986
  CDS (242)..(1327)

SEQ ID NO: 31292 - protein, 361 aa, Rhizobium etli; identical to SEQ ID NO: 2987

SEQ ID NO: 31293 - DNA, 1098 bp, Rhizobium loti; identical to SEQ ID NO: 2988
  CDS (1)..(1098)

SEQ ID NO: 31294 - protein, 365 aa, Rhizobium loti; identical to SEQ ID NO: 2989

SEQ ID NO: 31295 - DNA, 1092 bp, Rhodopseudomonas palustris; identical to SEQ ID NO: 2990
  CDS (1)..(1092)

SEQ ID NO: 31296 - protein, 363 aa, Rhodopseudomonas palustris; identical to SEQ ID NO: 2991

SEQ ID NO: 31297 - DNA, 1047 bp, Rhodopseudomonas viridis; identical to SEQ ID NO: 2992
  CDS (1)..(1047)

SEQ ID NO: 31298 - protein, 348 aa, Rhodopseudomonas viridis; identical to SEQ ID NO: 2993

SEQ ID NO: 31299 - DNA, 1074 bp, Shewanella oneidensis; identical to SEQ ID NO: 2994
  CDS (1)..(1074)

SEQ ID NO: 31300 - protein, 357 aa, Shewanella oneidensis; identical to SEQ ID NO: 2995

SEQ ID NO: 31301 - DNA, 1235 bp, Spirulina platensis; identical to SEQ ID NO: 2996
  CDS (54)..(1151)

SEQ ID NO: 31302 - protein, 365 aa, Spirulina platensis; identical to SEQ ID NO: 2997

SEQ ID NO: 31303 - DNA, 1074 bp, Staphylococcus epidermidis; identical to SEQ ID NO: 2998
  CDS (25)..(1074)

SEQ ID NO: 31304 - protein, 349 aa, Staphylococcus epidermidis; identical to SEQ ID NO: 2999

SEQ ID NO: 31305 - DNA, 1140 bp, Streptococcus agalactiae; identical to SEQ ID NO: 3000
  CDS (1)..(1140)

SEQ ID NO: 31306 - protein, 379 aa, Streptococcus agalactiae; identical to SEQ ID NO: 3001

SEQ ID NO: 31307 - DNA, 1119 bp, Streptomyces ambofaciens; identical to SEQ ID NO: 3002
  CDS (1)..(1119)

SEQ ID NO: 31308 - protein, 372 aa, Streptomyces ambofaciens; identical to SEQ ID NO: 3003

SEQ ID NO: 31309 - DNA, 1134 bp, Streptomyces avermitilis; identical to SEQ ID NO: 3004
  CDS (1)..(1134)

SEQ ID NO: 31310 - protein, 377 aa, Streptomyces avermitilis; identical to SEQ ID NO: 3005

SEQ ID NO: 31311 - DNA, 1152 bp, Streptococcus mutans; identical to SEQ ID NO: 3006
  CDS (1)..(1152)

SEQ ID NO: 31312 - protein, 383 aa, Streptococcus mutans; identical to SEQ ID NO: 3007

SEQ ID NO: 31313 - DNA, 1137 bp, Streptococcus pyogenes; identical to SEQ ID NO: 3008
  CDS (1)..(1137)

SEQ ID NO: 31314 - protein, 378 aa, Streptococcus pyogenes; identical to SEQ ID NO: 3009

SEQ ID NO: 31315 - DNA, 1356 bp, Streptococcus parasanguis; identical to SEQ ID NO: 3010
  CDS (118)..(1263)

SEQ ID NO: 31316 - protein, 381 aa, Streptococcus parasanguis; identical to SEQ ID NO: 3011

SEQ ID NO: 31317 - DNA, 1416 bp, Streptomyces rimosus; identical to SEQ ID NO: 3012
  CDS (229)..(1359)

SEQ ID NO: 31318 - protein, 376 aa, Streptomyces rimosus; identical to SEQ ID NO: 3013

SEQ ID NO: 31319 - DNA, 1916 bp, Streptococcus thermophilus; identical to SEQ ID NO: 3014
  CDS (555)..(1694)

SEQ ID NO: 31320 - protein, 379 aa, Streptococcus thermophilus; identical to SEQ ID NO: 3015

SEQ ID NO: 31321 - DNA, 1271 bp, Streptomyces violaceus; identical to SEQ ID NO: 3016
  CDS (75)..(1208)

SEQ ID NO: 31322 - protein, 377 aa, Streptomyces violaceus; identical to SEQ ID NO: 3017

SEQ ID NO: 31323 - DNA, 1068 bp, Synechococcus elongatus; identical to SEQ ID NO: 3018
  CDS (1)..(1068)

SEQ ID NO: 31324 - protein, 355 aa, Synechococcus elongatus; identical to SEQ ID NO: 3019

SEQ ID NO: 31325 - DNA, 1023 bp, Thermus thermophilus; identical to SEQ ID NO: 3020
  CDS (1)..(1023)

SEQ ID NO: 31326 - protein, 340 aa, Thermus thermophilus; identical to SEQ ID NO: 3021

SEQ ID NO: 31327 - DNA, 1405 bp, Thiobacillus ferrooxidans; identical to SEQ ID NO: 3022
  CDS (196)..(1236)

SEQ ID NO: 31328 - protein, 346 aa, Thiobacillus ferrooxidans; identical to SEQ ID NO: 3023

SEQ ID NO: 31329 - DNA, 1314 bp, Tropheryma whipplei; identical to SEQ ID NO: 3024
  CDS (1)..(1314)

SEQ ID NO: 31330 - protein, 437 aa, Tropheryma whipplei; identical to SEQ ID NO: 3025

SEQ ID NO: 31331 - DNA, 1411 bp, Vibrio cholerae; identical to SEQ ID NO: 3026
  CDS (183)..(1247)

SEQ ID NO: 31332 - protein, 354 aa, Vibrio cholerae; identical to SEQ ID NO: 3027

SEQ ID NO: 31333 - DNA, 1044 bp, Vibrio parahaemolyticus; identical to SEQ ID NO: 3028
  CDS (1)..(1044)

SEQ ID NO: 31334 - protein, 347 aa, Vibrio parahaemolyticus; identical to SEQ ID NO: 3029

SEQ ID NO: 31335 - DNA, 996 bp, Wigglesworthia glossinidia brevipalpis; identical to SEQ ID NO: 3030
  CDS (1)..(996)

SEQ ID NO: 31336 - protein, 331 aa, Wigglesworthia glossinidia brevipalpis; identical to SEQ ID NO: 3031

SEQ ID NO: 31337 - DNA, 1035 bp, Xanthomonas axonopodis; identical to SEQ ID NO: 3032
  CDS (1)..(1035)

SEQ ID NO: 31338 - protein, 344 aa, Xanthomonas axonopodis; identical to SEQ ID NO: 3033

SEQ ID NO: 31339 - DNA, 1594 bp, Xenorhabdus nematophilus; identical to SEQ ID NO: 3034
  CDS (142)..(1218)

SEQ ID NO: 31340 - protein, 358 aa, Xenorhabdus nematophilus; identical to SEQ ID NO: 3035

SEQ ID NO: 31341 - DNA, 1044 bp, Xylella fastidiosa; identical to SEQ ID NO: 3036
  CDS (1)..(1044)

SEQ ID NO: 31342 - protein, 347 aa, Xylella fastidiosa; identical to SEQ ID NO: 3037

SEQ ID NO: 31343 - DNA, 1020 bp, Zymomonas mobilis; identical to SEQ ID NO: 3038
  CDS (1)..(1020)

SEQ ID NO: 31344 - protein, 339 aa, Zymomonas mobilis; identical to SEQ ID NO: 3039

SEQ ID NO: 31345 - DNA, 1660 bp, primary endosymbiont of Sitophilus oryzae; identical to SEQ ID NO: 3040
  CDS (11)..(1078)

SEQ ID NO: 31346 - protein, 355 aa, primary endosymbiont of Sitophilus oryzae; identical to SEQ ID NO: 3041

SEQ ID NO: 31347 - DNA, 1110 bp, Azospirillum lipoferum; identical to SEQ ID NO: 3042
  CDS (1)..(1110)

SEQ ID NO: 31348 - protein, 369 aa, Azospirillum lipoferum; identical to SEQ ID NO: 3043

SEQ ID NO: 31349 - DNA, 1017 bp, Geobacter sulfurreducens; identical to SEQ ID NO: 3044
  CDS (1)..(1017)

SEQ ID NO: 31350 - protein, 338 aa, Geobacter sulfurreducens; identical to SEQ ID NO: 3045

SEQ ID NO: 31351 - DNA, 1230 bp, Mycobacterium paratuberculosis; identical to SEQ ID NO: 3046
  CDS (1)..(1230)

SEQ ID NO: 31352 - protein, 409 aa, Mycobacterium paratuberculosis; identical to SEQ ID NO: 3047

SEQ ID NO: 31353 - DNA, 1083 bp, Lactobacillus johnsonii; identical to SEQ ID NO: 3048
  CDS (1)..(1083)

SEQ ID NO: 31354 - protein, 360 aa, Lactobacillus johnsonii; identical to SEQ ID NO: 3049

SEQ ID NO: 31355 - DNA, 1245 bp, Treponema denticola; identical to SEQ ID NO: 3050
  CDS (1)..(1245)

SEQ ID NO: 31356 - protein, 414 aa, Treponema denticola; identical to SEQ ID NO: 3051

SEQ ID NO: 31357 - DNA, 1068 bp, Wolbachia pipientis wMel; identical to SEQ ID NO: 3052
  CDS (1)..(1068)

SEQ ID NO: 31358 - protein, 355 aa, Wolbachia pipientis wMel; identical to SEQ ID NO: 3053

SEQ ID NO: 31359 - DNA, 1074 bp, Desulfovibrio vulgaris; identical to SEQ ID NO: 3054
  CDS (1)..(1074)

SEQ ID NO: 31360 - protein, 357 aa, Desulfovibrio vulgaris; identical to SEQ ID NO: 3055

SEQ ID NO: 31361 - DNA, 1557 bp, Bacillus licheniformis; identical to SEQ ID NO: 3056
  CDS (369)..(1415)

SEQ ID NO: 31362 - protein, 348 aa, Bacillus licheniformis; identical to SEQ ID NO: 3057

SEQ ID NO: 31363 - DNA, 1119 bp, Corynebacterium diphtheriae; identical to SEQ ID NO: 3058
  CDS (1)..(1119)

SEQ ID NO: 31364 - protein, 372 aa, Corynebacterium diphtheriae; identical to SEQ ID NO: 3059

SEQ ID NO: 31365 - DNA, 1038 bp, Mycoplasma mycoides; identical to SEQ ID NO: 3060
  CDS (1)..(1038)

SEQ ID NO: 31366 - protein, 345 aa, Mycoplasma mycoides; identical to SEQ ID NO: 3061

SEQ ID NO: 31367 - DNA, 1134 bp, Bdellovibrio bacteriovorus; identical to SEQ ID NO: 3062
  CDS (1)..(1134)

SEQ ID NO: 31368 - protein, 377 aa, Bdellovibrio bacteriovorus; identical to SEQ ID NO: 3063

SEQ ID NO: 31369 - DNA, 1086 bp, Parachlamydia sp; identical to SEQ ID NO: 3064
  CDS (1)..(1086)

SEQ ID NO: 31370 - protein, 361 aa, Parachlamydia sp; identical to SEQ ID NO: 3065

SEQ ID NO: 31371 - DNA, 1071 bp, Photobacterium profundum; identical to SEQ ID NO: 3066
  CDS (1)..(1071)

SEQ ID NO: 31372 - protein, 356 aa, Photobacterium profundum; identical to SEQ ID NO: 3067

SEQ ID NO: 31373 - DNA, 24 bp, Primer
atggctatcgacgaaaacaaacag

SEQ ID NO: 31374 - DNA, 27 bp, Primer
ttaaaaatcttcgttagtttctgctac

SEQ ID NO: 31375 - protein, 323 aa, consensus; identical to SEQ ID NO: 5813
  MISC_FEATURE (1)..(323): consensus for the disclosure of xaa see table XV

SEQ ID NO: 31376 - protein, 33 aa, consensus; identical to SEQ ID NO: 4356
  MISC_FEATURE (1)..(33): consensus for the disclosure of xaa see table XV

SEQ ID NO: 31377 - protein, 36 aa, consensus; identical to SEQ ID NO: 4357
  MISC_FEATURE (1)..(36): consensus for the disclosure of xaa see table XV

SEQ ID NO: 31378 - protein, 39 aa, consensus; identical to SEQ ID NO: 4358
  MISC_FEATURE (1)..(39): consensus for the disclosure of xaa see table XV

SEQ ID NO: 31379 - DNA, 1344 bp, Escherichia coli K12; identical to SEQ ID NO: 25117
  CDS (1)..(1344)

SEQ ID NO: 31380 - protein, 447 aa, Escherichia coli K12; identical to SEQ ID NO: 25118

SEQ ID NO: 31381 - DNA, 1215 bp, Vibrio cholerae; identical to SEQ ID NO: 25119
  CDS (1)..(1215)

SEQ ID NO: 31382 - protein, 404 aa, Vibrio cholerae; identical to SEQ ID NO: 25120

SEQ ID NO: 31383 - DNA, 1215 bp, Listeria monocytogenes; identical to SEQ ID NO: 25121
  CDS (1)..(1215)

SEQ ID NO: 31384 - protein, 404 aa, Listeria monocytogenes; identical to SEQ ID NO: 25122

SEQ ID NO: 31385 - DNA, 1224 bp, Agrobacterium tumefaciens; identical to SEQ ID NO: 25123
  CDS (1)..(1224)

SEQ ID NO: 31386 - protein, 407 aa, Agrobacterium tumefaciens; identical to SEQ ID NO: 25124

SEQ ID NO: 31387 - DNA, 1410 bp, Salmonella enterica subsp. enterica serovar Typhi; identical to SEQ ID NO: 25125
  CDS (1)..(1410)

SEQ ID NO: 31388 - protein, 469 aa, Salmonella enterica subsp. enterica serovar Typhi; identical to SEQ ID NO: 25126

SEQ ID NO: 31389 - DNA, 1368 bp, Yersinia pestis; identical to SEQ ID NO: 25127
  CDS (1)..(1368)

SEQ ID NO: 31390 - protein, 455 aa, Yersinia pestis; identical to SEQ ID NO: 25128

SEQ ID NO: 31391 - DNA, 1203 bp, Nostoc sp. PCC 7120; identical to SEQ ID NO: 25129
  CDS (1)..(1203)

SEQ ID NO: 31392 - protein, 400 aa, Nostoc sp. PCC 7120; identical to SEQ ID NO: 25130

SEQ ID NO: 31393 - DNA, 1215 bp, Listeria innocua; identical to SEQ ID NO: 25131
  CDS (1)..(1215)

SEQ ID NO: 31394 - protein, 404 aa, Listeria innocua; identical to SEQ ID NO: 25132

SEQ ID NO: 31395 - DNA, 2317 bp, Saccharomyces cerevisiae; identical to SEQ ID NO: 25133
  CDS (762)..(2024)

SEQ ID NO: 31396 - protein, 420 aa, Saccharomyces cerevisiae; identical to SEQ ID NO: 25134

SEQ ID NO: 31397 - DNA, 1239 bp, Mus musculus (house mouse); identical to SEQ ID NO: 25135
  CDS (1)..(1239)

SEQ ID NO: 31398 - protein, 412 aa, Mus musculus (house mouse); identical to SEQ ID NO: 25136

SEQ ID NO: 31399 - DNA, 2098 bp, Methanococcus vannielii; identical to SEQ ID NO: 25137
  CDS (798)..(1991)

SEQ ID NO: 31400 - protein, 397 aa, Methanococcus vannielii; identical to SEQ ID NO: 25138

SEQ ID NO: 31401 - DNA, 2171 bp, Streptomyces coelicolor; identical to SEQ ID NO: 25139
  CDS (317)..(1780)

SEQ ID NO: 31402 - protein, 487 aa, Streptomyces coelicolor; identical to SEQ ID NO: 25140

SEQ ID NO: 31403 - DNA, 1212 bp, Bacillus subtilis; identical to SEQ ID NO: 25141
  CDS (1)..(1212)

SEQ ID NO: 31404 - protein, 403 aa, Bacillus subtilis; identical to SEQ ID NO: 25142

SEQ ID NO: 31405 - DNA, 1206 bp, Aquifex aeolicus; identical to SEQ ID NO: 25143
  CDS (1)..(1206)

SEQ ID NO: 31406 - protein, 401 aa, Aquifex aeolicus; identical to SEQ ID NO: 25144

SEQ ID NO: 31407 - DNA, 1206 bp, Staphylococcus aureus; identical to SEQ ID NO: 25145
  CDS (1)..(1206)

SEQ ID NO: 31408 - protein, 401 aa, Staphylococcus aureus; identical to SEQ ID NO: 25146

SEQ ID NO: 31409 - DNA, 1203 bp, Clostridium acetobutylicum; identical to SEQ ID NO: 25147
  CDS (1)..(1203)

SEQ ID NO: 31410 - protein, 400 aa, Clostridium acetobutylicum; identical to SEQ ID NO: 25148

SEQ ID NO: 31411 - DNA, 1221 bp, Campylobacter jejuni; identical to SEQ ID NO: 25149
  CDS (1)..(1221)

SEQ ID NO: 31412 - protein, 406 aa, Campylobacter jejuni; identical to SEQ ID NO: 25150

SEQ ID NO: 31413 - DNA, 1239 bp, Pseudomonas aeruginosa; identical to SEQ ID NO: 25151
  CDS (22)..(1239)

SEQ ID NO: 31414 - protein, 405 aa, Pseudomonas aeruginosa; identical to SEQ ID NO: 25152

SEQ ID NO: 31415 - DNA, 1230 bp, Bacillus halodurans; identical to SEQ ID NO: 25153
  CDS (1)..(1230)

SEQ ID NO: 31416 - protein, 409 aa, Bacillus halodurans; identical to SEQ ID NO: 25154

SEQ ID NO: 31417 - DNA, 1191 bp, Halobacterium sp. NRC-1; identical to SEQ ID NO: 25155
  CDS (1)..(1191)

SEQ ID NO: 31418 - protein, 396 aa, Halobacterium sp. NRC-1; identical to SEQ ID NO: 25156

SEQ ID NO: 31419 - DNA, 1221 bp, Sulfolobus solfataricus; identical to SEQ ID NO: 25157
  CDS (1)..(1221)

SEQ ID NO: 31420 - protein, 406 aa, Sulfolobus solfataricus; identical to SEQ ID NO: 25158

SEQ ID NO: 31421 - DNA, 1173 bp, Archaeoglobus fulgidus; identical to SEQ ID NO: 25159
  CDS (1)..(1173)

SEQ ID NO: 31422 - protein, 390 aa, Archaeoglobus fulgidus; identical to SEQ ID NO: 25160

SEQ ID NO: 31423 - DNA, 1209 bp, Deinococcus radiodurans; identical to SEQ ID NO: 25161
  CDS (1)..(1209)

SEQ ID NO: 31424 - protein, 402 aa, Deinococcus radiodurans; identical to SEQ ID NO: 25162

SEQ ID NO: 31425 - DNA, 1197 bp, Lactococcus lactis subsp. lactis; identical to SEQ ID NO: 25163
  CDS (1)..(1197)

SEQ ID NO: 31426 - protein, 398 aa, Lactococcus lactis subsp. lactis; identical to SEQ ID NO: 25164

SEQ ID NO: 31427 - DNA, 1188 bp, Methanococcus jannaschii; identical to SEQ ID NO: 25165
  CDS (1)..(1188)

SEQ ID NO: 31428 - protein, 395 aa, Methanococcus jannaschii; identical to SEQ ID NO: 25166

SEQ ID NO: 31429 - DNA, 1197 bp, Mycobacterium tuberculosis; identical to SEQ ID NO: 25167
  CDS (1)..(1197)

SEQ ID NO: 31430 - protein, 398 aa, Mycobacterium tuberculosis; identical to SEQ ID NO: 25168

SEQ ID NO: 31431 - DNA, 1335 bp, Haemophilus influenzae; identical to SEQ ID NO: 25169
  CDS (1)..(1335)

SEQ ID NO: 31432 - protein, 444 aa, Haemophilus influenzae; identical to SEQ ID NO: 25170

SEQ ID NO: 31433 - DNA, 1200 bp, Methanobacterium thermoautotrophicum; identical to SEQ ID NO: 25171
  CDS (1)..(1200)

SEQ ID NO: 31434 - protein, 399 aa, Methanobacterium thermoautotrophicum; identical to SEQ ID NO: 25172

SEQ ID NO: 31435 - DNA, 1344 bp, Neisseria meningitidis; identical to SEQ ID NO: 25173
  CDS (1)..(1344)

SEQ ID NO: 31436 - protein, 447 aa, Neisseria meningitidis; identical to SEQ ID NO: 25174

SEQ ID NO: 31437 - DNA, 1200 bp, Mycobacterium leprae; identical to SEQ ID NO: 25175
  CDS (1)..(1200)

SEQ ID NO: 31438 - protein, 399 aa, Mycobacterium leprae; identical to SEQ ID NO: 25176

SEQ ID NO: 31439 - DNA, 1248 bp, Streptococcus pneumoniae; identical to SEQ ID NO: 25177
  CDS (1)..(1248)

SEQ ID NO: 31440 - protein, 415 aa, Streptococcus pneumoniae; identical to SEQ ID NO: 25178

SEQ ID NO: 31441 - DNA, 1206 bp, Xylella fastidiosa; identical to SEQ ID NO: 25179
  CDS (1)..(1206)

SEQ ID NO: 31442 - protein, 401 aa, Xylella fastidiosa; identical to SEQ ID NO: 25180

SEQ ID NO: 31443 - DNA, 1230 bp, Thermotoga maritima; identical to SEQ ID NO: 25181
  CDS (1)..(1230)

SEQ ID NO: 31444 - protein, 409 aa, Thermotoga maritima; identical to SEQ ID NO: 25182

SEQ ID NO: 31445 - DNA, 1227 bp, Caulobacter crescentus; identical to SEQ ID NO: 25183
  CDS (1)..(1227)

SEQ ID NO: 31446 - protein, 408 aa, Caulobacter crescentus; identical to SEQ ID NO: 25184

SEQ ID NO: 31447 - DNA, 1194 bp, Streptomyces clavuligerus; identical to SEQ ID NO: 25185
  CDS (1)..(1194)

SEQ ID NO: 31448 - protein, 397 aa, Streptomyces clavuligerus; identical to SEQ ID NO: 25186

SEQ ID NO: 31449 - DNA, 2449 bp, Streptomyces lavendulae; identical to SEQ ID NO: 25187
  CDS (535)..(1983)

SEQ ID NO: 31450 - protein, 482 aa, Streptomyces lavendulae; identical to SEQ ID NO: 25188

SEQ ID NO: 31451 - DNA, 1203 bp, Synechocystis sp; identical to SEQ ID NO: 25189
  CDS (1)..(1203)

SEQ ID NO: 31452 - protein, 400 aa, Synechocystis sp; identical to SEQ ID NO: 25190

SEQ ID NO: 31453 - DNA, 1233 bp, Schizosaccharomyces pombe; identical to SEQ ID NO: 25191
  CDS (1)..(1233)

SEQ ID NO: 31454 - protein, 410 aa, Schizosaccharomyces pombe; identical to SEQ ID NO: 25192

SEQ ID NO: 31455 - DNA, 1245 bp, Ashbya gossypii; identical to SEQ ID NO: 25193
  CDS (1)..(1245)

SEQ ID NO: 31456 - protein, 414 aa, Ashbya gossypii; identical to SEQ ID NO: 25194

SEQ ID NO: 31457 - DNA, 1245 bp, Brachydanio rerio; identical to SEQ ID NO: 25195
  CDS (1)..(1245)

SEQ ID NO: 31458 - protein, 414 aa, Brachydanio rerio; identical to SEQ ID NO: 25196

SEQ ID NO: 31459 - DNA, 1206 bp, Symbiobacterium thermophilum; identical to SEQ ID NO: 25197
  CDS (1)..(1206)

SEQ ID NO: 31460 - protein, 401 aa, Symbiobacterium thermophilum; identical to SEQ ID NO: 25198

SEQ ID NO: 31461 - DNA, 1425 bp, Propionibacterium acnes; identical to SEQ ID NO: 25199
  CDS (1)..(1425)

SEQ ID NO: 31462 - protein, 474 aa, Propionibacterium acnes; identical to SEQ ID NO: 25200

SEQ ID NO: 31463 - DNA, 1437 bp, Leifsonia xyli; identical to SEQ ID NO: 25201
  CDS (1)..(1437)

SEQ ID NO: 31464 - protein, 478 aa, Leifsonia xyli; identical to SEQ ID NO: 25202

SEQ ID NO: 31465 - DNA, 1197 bp, Desulfotalea psychrophila; identical to SEQ ID NO: 25203
  CDS (1)..(1197)

SEQ ID NO: 31466 - protein, 398 aa, Desulfotalea psychrophila; identical to SEQ ID NO: 25204

SEQ ID NO: 31467 - DNA, 1251 bp, Debaryomyces hansenii CBS767; identical to SEQ ID NO: 25205
  CDS (1)..(1251)

SEQ ID NO: 31468 - protein, 416 aa, Debaryomyces hansenii CBS767; identical to SEQ ID NO: 25206

SEQ ID NO: 31469 - DNA, 1263 bp, Kluyveromyces lactis NRRL Y; identical to SEQ ID NO: 25207
  CDS (1)..(1263)

SEQ ID NO: 31470 - protein, 420 aa, Kluyveromyces lactis NRRL Y; identical to SEQ ID NO: 25208

SEQ ID NO: 31471 - DNA, 1347 bp, Erwinia carotovora; identical to SEQ ID NO: 25209
  CDS (1)..(1347)

SEQ ID NO: 31472 - protein, 448 aa, Erwinia carotovora; identical to SEQ ID NO: 25210

SEQ ID NO: 31473 - DNA, 1341 bp, Acinetobacter sp; identical to SEQ ID NO: 25211
  CDS (1)..(1341)

SEQ ID NO: 31474 - protein, 446 aa, Acinetobacter sp; identical to SEQ ID NO: 25212

SEQ ID NO: 31475 - DNA, 1263 bp, Candida glabrata CBS138; identical to SEQ ID NO: 25213
  CDS (1)..(1263)

SEQ ID NO: 31476 - protein, 420 aa, Candida glabrata CBS138; identical to SEQ ID NO: 25214

SEQ ID NO: 31477 - DNA, 1206 bp, Bacillus thuringiensis; identical to SEQ ID NO: 25215
  CDS (1)..(1206)

SEQ ID NO: 31478 - protein, 401 aa, Bacillus thuringiensis; identical to SEQ ID NO: 25216

SEQ ID NO: 31479 - DNA, 1188 bp, Picrophilus torridus; identical to SEQ ID NO: 25217
  CDS (1)..(1188)

SEQ ID NO: 31480 - protein, 395 aa, Picrophilus torridus; identical to SEQ ID NO: 25218

SEQ ID NO: 31481 - DNA, 1215 bp, Photobacterium profundum; identical to SEQ ID NO: 25219
  CDS (1)..(1215)

SEQ ID NO: 31482 - protein, 404 aa, Photobacterium profundum; identical to SEQ ID NO: 25220

SEQ ID NO: 31483 - DNA, 1338 bp, Rhodopseudomonas palustris; identical to SEQ ID NO: 25221
  CDS (1)..(1338)

SEQ ID NO: 31484 - protein, 445 aa, Rhodopseudomonas palustris; identical to SEQ ID NO: 25222

SEQ ID NO: 31485 - DNA, 1191 bp, Photorhabdus luminescens; identical to SEQ ID NO: 25223
  CDS (1)..(1191)

SEQ ID NO: 31486 - protein, 396 aa, Photorhabdus luminescens; identical to SEQ ID NO: 25224

SEQ ID NO: 31487 - DNA, 1227 bp, Neurospora crassa; identical to SEQ ID NO: 25225
  CDS (1)..(1227)

SEQ ID NO: 31488 - protein, 408 aa, Neurospora crassa; identical to SEQ ID NO: 25226

SEQ ID NO: 31489 - DNA, 1332 bp, Haemophilus ducreyi; identical to SEQ ID NO: 25227
  CDS (1)..(1332)

SEQ ID NO: 31490 - protein, 443 aa, Haemophilus ducreyi; identical to SEQ ID NO: 25228

SEQ ID NO: 31491 - DNA, 1733 bp, Xenopus laevis; identical to SEQ ID NO: 25229
  CDS (81)..(1316)

SEQ ID NO: 31492 - protein, 411 aa, Xenopus laevis; identical to SEQ ID NO: 25230

SEQ ID NO: 31493 - DNA, 1455 bp, Streptomyces avermitilis; identical to SEQ ID NO: 25231
  CDS (1)..(1455)

SEQ ID NO: 31494 - protein, 484 aa, Streptomyces avermitilis; identical to SEQ ID NO: 25232

SEQ ID NO: 31495 - DNA, 1209 bp, Bacteroides thetaiotaomicron; identical to SEQ ID NO: 25233
  CDS (1)..(1209)

SEQ ID NO: 31496 - protein, 402 aa, Bacteroides thetaiotaomicron; identical to SEQ ID NO: 25234

SEQ ID NO: 31497 - DNA, 1215 bp, Vibrio vulnificus; identical to SEQ ID NO: 25235
  CDS (1)..(1215)

SEQ ID NO: 31498 - protein, 404 aa, Vibrio vulnificus; identical to SEQ ID NO: 25236

SEQ ID NO: 31499 - DNA, 1516 bp, Arabidopsis thaliana; identical to SEQ ID NO: 25237
  CDS (1)..(1485)

SEQ ID NO: 31500 - protein, 494 aa, Arabidopsis thaliana; identical to SEQ ID NO: 25238

SEQ ID NO: 31501 - DNA, 1206 bp, Bacillus cereus; identical to SEQ ID NO: 25239
  CDS (1)..(1206)

SEQ ID NO: 31502 - protein, 401 aa, Bacillus cereus; identical to SEQ ID NO: 25240

SEQ ID NO: 31503 - DNA, 1239 bp, Bifidobacterium longum; identical to SEQ ID NO: 25241
  CDS (1)..(1239)

SEQ ID NO: 31504 - protein, 412 aa, Bifidobacterium longum; identical to SEQ ID NO: 25242

SEQ ID NO: 31505 - DNA, 1338 bp, Bordetella bronchiseptica; identical to SEQ ID NO: 25243
  CDS (1)..(1338)

SEQ ID NO: 31506 - protein, 445 aa, Bordetella bronchiseptica; identical to SEQ ID NO: 25244

SEQ ID NO: 31507 - DNA, 1338 bp, Bradyrhizobium japonicum; identical to SEQ ID NO: 25245
  CDS (1)..(1338)

SEQ ID NO: 31508 - protein, 445 aa, Bradyrhizobium japonicum; identical to SEQ ID NO: 25246

SEQ ID NO: 31509 - DNA, 1221 bp, Brucella suis; identical to SEQ ID NO: 25247
  CDS (1)..(1221)

SEQ ID NO: 31510 - protein, 406 aa, Brucella suis; identical to SEQ ID NO: 25248

SEQ ID NO: 31511 - DNA, 1206 bp, Buchnera aphidicola; identical to SEQ ID NO: 25249
  CDS (1)..(1206)

SEQ ID NO: 31512 - protein, 401 aa, Buchnera aphidicola; identical to SEQ ID NO: 25250

SEQ ID NO: 31513 - DNA, 1230 bp, Buchnera aphidicola; identical to SEQ ID NO: 25251
  CDS (1)..(1230)

SEQ ID NO: 31514 - protein, 409 aa, Buchnera aphidicola; identical to SEQ ID NO: 25252

SEQ ID NO: 31515 - DNA, 1338 bp, Burkholderia multivorans; identical to SEQ ID NO: 25253
  CDS (1)..(1338)

SEQ ID NO: 31516 - protein, 445 aa, Burkholderia multivorans; identical to SEQ ID NO: 25254

SEQ ID NO: 31517 - DNA, 1206 bp, Chlorobium tepidum; identical to SEQ ID NO: 25255
  CDS (1)..(1206)

SEQ ID NO: 31518 - protein, 401 aa, Chlorobium tepidum; identical to SEQ ID NO: 25256

SEQ ID NO: 31519 - DNA, 1227 bp, Chromobacterium violaceum; identical to SEQ ID NO: 25257
  CDS (1)..(1227)

SEQ ID NO: 31520 - protein, 408 aa, Chromobacterium violaceum; identical to SEQ ID NO: 25258

SEQ ID NO: 31521 - DNA, 1218 bp, Clostridium perfringens; identical to SEQ ID NO: 25259
  CDS (1)..(1218)

SEQ ID NO: 31522 - protein, 405 aa, Clostridium perfringens; identical to SEQ ID NO: 25260

SEQ ID NO: 31523 - DNA, 1197 bp, Clostridium tetani; identical to SEQ ID NO: 25261
  CDS (1)..(1197)

SEQ ID NO: 31524 - protein, 398 aa, Clostridium tetani; identical to SEQ ID NO: 25262

SEQ ID NO: 31525 - DNA, 1200 bp, Corynebacterium diphtheriae; identical to SEQ ID NO: 25263
  CDS (1)..(1200)

SEQ ID NO: 31526 - protein, 399 aa, Corynebacterium diphtheriae; identical to SEQ ID NO: 25264

SEQ ID NO: 31527 - DNA, 1206 bp, Corynebacterium efficiens; identical to SEQ ID NO: 25265
  CDS (1)..(1206)

SEQ ID NO: 31528 - protein, 401 aa, Corynebacterium efficiens; identical to SEQ ID NO: 25266

SEQ ID NO: 31529 - DNA, 1206 bp, Corynebacterium glutamicum; identical to SEQ ID NO: 25267
  CDS (1)..(1206)

SEQ ID NO: 31530 - protein, 401 aa, Corynebacterium glutamicum; identical to SEQ ID NO: 25268

SEQ ID NO: 31531 - DNA, 1191 bp, Desulfovibrio vulgaris; identical to SEQ ID NO: 25269
  CDS (1)..(1191)

SEQ ID NO: 31532 - protein, 396 aa, Desulfovibrio vulgaris; identical to SEQ ID NO: 25270

SEQ ID NO: 31533 - DNA, 1274 bp, Drosophila melanogaster; identical to SEQ ID NO: 25271
  CDS (15)..(1274)

SEQ ID NO: 31534 - protein, 419 aa, Drosophila melanogaster; identical to SEQ ID NO: 25272

SEQ ID NO: 31535 - DNA, 1221 bp, Geobacter sulfurreducens; identical to SEQ ID NO: 25273
  CDS (1)..(1221)

SEQ ID NO: 31536 - protein, 406 aa, Geobacter sulfurreducens; identical to SEQ ID NO: 25274

SEQ ID NO: 31537 - DNA, 1197 bp, Gloeobacter violaceus; identical to SEQ ID NO: 25275
  CDS (1)..(1197)

SEQ ID NO: 31538 - protein, 398 aa, Gloeobacter violaceus; identical to SEQ ID NO: 25276

SEQ ID NO: 31539 - DNA, 1215 bp, Helicobacter hepaticus; identical to SEQ ID NO: 25277
  CDS (1)..(1215)

SEQ ID NO: 31540 - protein, 404 aa, Helicobacter hepaticus; identical to SEQ ID NO: 25278

SEQ ID NO: 31541 - DNA, 1236 bp, Lactobacillus plantarum; identical to SEQ ID NO: 25279
  CDS (1)..(1236)

SEQ ID NO: 31542 - protein, 411 aa, Lactobacillus plantarum; identical to SEQ ID NO: 25280

SEQ ID NO: 31543 - DNA, 1212 bp, Leptospira interrogans; identical to SEQ ID NO: 25281
  CDS (1)..(1212)

SEQ ID NO: 31544 - protein, 403 aa, Leptospira interrogans; identical to SEQ ID NO: 25282

SEQ ID NO: 31545 - DNA, 1185 bp, Methanopyrus kandleri; identical to SEQ ID NO: 25283
  CDS (1)..(1185)

SEQ ID NO: 31546 - protein, 394 aa, Methanopyrus kandleri; identical to SEQ ID NO: 25284

SEQ ID NO: 31547 - DNA, 1185 bp, Methanosarcina mazei; identical to SEQ ID NO: 25285
  CDS (1)..(1185)

SEQ ID NO: 31548 - protein, 394 aa, Methanosarcina mazei; identical to SEQ ID NO: 25286

SEQ ID NO: 31549 - DNA, 1194 bp, Methanococcus maripaludis; identical to SEQ ID NO: 25287
  CDS (1)..(1194)

SEQ ID NO: 31550 - protein, 397 aa, Methanococcus maripaludis; identical to SEQ ID NO: 25288

SEQ ID NO: 31551 - DNA, 1215 bp, Moritella abyssi; identical to SEQ ID NO: 25289
  CDS (1)..(1215)

SEQ ID NO: 31552 - protein, 404 aa, Moritella abyssi; identical to SEQ ID NO: 25290

SEQ ID NO: 31553 - DNA, 1215 bp, Moritella profunda; identical to SEQ ID NO: 25291
  CDS (1)..(1215)

SEQ ID NO: 31554 - protein, 404 aa, Moritella profunda; identical to SEQ ID NO: 25292

SEQ ID NO: 31555 - DNA, 1197 bp, Mycobacterium paratuberculosis; identical to SEQ ID NO: 25293
  CDS (1)..(1197)

SEQ ID NO: 31556 - protein, 398 aa, Mycobacterium paratuberculosis; identical to SEQ ID NO: 25294

SEQ ID NO: 31557 - DNA, 1215 bp, Nitrosomonas europaea; identical to SEQ ID NO: 25295
  CDS (1)..(1215)

SEQ ID NO: 31558 - protein, 404 aa, Nitrosomonas europaea; identical to SEQ ID NO: 25296

SEQ ID NO: 31559 - DNA, 1254 bp, Oceanobacillus iheyensis; identical to SEQ ID NO: 25297
  CDS (1)..(1254)

SEQ ID NO: 31560 - protein, 417 aa, Oceanobacillus iheyensis; identical to SEQ ID NO: 25298

SEQ ID NO: 31561 - DNA, 1338 bp, Pasteurella multocida; identical to SEQ ID NO: 25299
  CDS (1)..(1338)

SEQ ID NO: 31562 - protein, 445 aa, Pasteurella multocida; identical to SEQ ID NO: 25300

SEQ ID NO: 31563 - DNA, 1215 bp, Photorhabdus luminescens; identical to SEQ ID NO: 25301
  CDS (1)..(1215)

SEQ ID NO: 31564 - protein, 404 aa, Photorhabdus luminescens; identical to SEQ ID NO: 25302

SEQ ID NO: 31565 - DNA, 1209 bp, Prochlorococcus marinus; identical to SEQ ID NO: 25303
  CDS (1)..(1209)

SEQ ID NO: 31566 - protein, 402 aa, Prochlorococcus marinus; identical to SEQ ID NO: 25304

SEQ ID NO: 31567 - DNA, 1206 bp, Prochlorococcus marinus; identical to SEQ ID NO: 25305
  CDS (1)..(1206)

SEQ ID NO: 31568 - protein, 401 aa, Prochlorococcus marinus; identical to SEQ ID NO: 25306

SEQ ID NO: 31569 - DNA, 1215 bp, Prochlorococcus marinus subsp; identical to SEQ ID NO: 25307
  CDS (1)..(1215)

SEQ ID NO: 31570 - protein, 404 aa, Prochlorococcus marinus subsp; identical to SEQ ID NO: 25308

SEQ ID NO: 31571 - DNA, 1218 bp, Pseudomonas putida; identical to SEQ ID NO: 25309
  CDS (1)..(1218)

SEQ ID NO: 31572 - protein, 405 aa, Pseudomonas putida; identical to SEQ ID NO: 25310

SEQ ID NO: 31573 - DNA, 1218 bp, Pseudomonas syringae; identical to SEQ ID NO: 25311
  CDS (1)..(1218)

SEQ ID NO: 31574 - protein, 405 aa, Pseudomonas syringae; identical to SEQ ID NO: 25312

SEQ ID NO: 31575 - DNA, 1233 bp, Pyrococcus furiosus; identical to SEQ ID NO: 25313
  CDS (1)..(1233)

SEQ ID NO: 31576 - protein, 410 aa, Pyrococcus furiosus; identical to SEQ ID NO: 25314

SEQ ID NO: 31577 - DNA, 1338 bp, Ralstonia solanacearum; identical to SEQ ID NO: 25315
  CDS (1)..(1338)

SEQ ID NO: 31578 - protein, 445 aa, Ralstonia solanacearum; identical to SEQ ID NO: 25316

SEQ ID NO: 31579 - DNA, 1224 bp, Rhizobium loti; identical to SEQ ID NO: 25317
  CDS (1)..(1224)

SEQ ID NO: 31580 - protein, 407 aa, Rhizobium loti; identical to SEQ ID NO: 25318

SEQ ID NO: 31581 - DNA, 1218 bp, Rhizobium meliloti; identical to SEQ ID NO: 25319
  CDS (1)..(1218)

SEQ ID NO: 31582 - protein, 405 aa, Rhizobium meliloti; identical to SEQ ID NO: 25320

SEQ ID NO: 31583 - DNA, 1215 bp, Rhodopirellula baltica; identical to SEQ ID NO: 25321
  CDS (1)..(1215)

SEQ ID NO: 31584 - protein, 404 aa, Rhodopirellula baltica; identical to SEQ ID NO: 25322

SEQ ID NO: 31585 - DNA, 1188 bp, Rhodococcus fascians; identical to SEQ ID NO: 25323
  CDS (1)..(1188)

SEQ ID NO: 31586 - protein, 395 aa, Rhodococcus fascians; identical to SEQ ID NO: 25324

SEQ ID NO: 31587 - DNA, 1224 bp, Shewanella oneidensis; identical to SEQ ID NO: 25325
  CDS (1)..(1224)

SEQ ID NO: 31588 - protein, 407 aa, Shewanella oneidensis; identical to SEQ ID NO: 25326

SEQ ID NO: 31589 - DNA, 1215 bp, Staphylococcus epidermidis; identical to SEQ ID NO: 25327
  CDS (10)..(1215)

SEQ ID NO: 31590 - protein, 401 aa, Staphylococcus epidermidis; identical to SEQ ID NO: 25328

SEQ ID NO: 31591 - DNA, 1215 bp, Streptomyces avermitilis; identical to SEQ ID NO: 25329
  CDS (1)..(1215)

SEQ ID NO: 31592 - protein, 404 aa, Streptomyces avermitilis; identical to SEQ ID NO: 25330

SEQ ID NO: 31593 - DNA, 1446 bp, Streptomyces coelicolor; identical to SEQ ID NO: 25331
  CDS (1)..(1446)

SEQ ID NO: 31594 - protein, 481 aa, Streptomyces coelicolor; identical to SEQ ID NO: 25332

SEQ ID NO: 31595 - DNA, 1191 bp, Streptococcus mutans; identical to SEQ ID NO: 25333
  CDS (1)..(1191)

SEQ ID NO: 31596 - protein, 396 aa, Streptococcus mutans; identical to SEQ ID NO: 25334

SEQ ID NO: 31597 - DNA, 1173 bp, Sulfolobus tokodaii; identical to SEQ ID NO: 25335
  CDS (1)..(1173)

SEQ ID NO: 31598 - protein, 390 aa, Sulfolobus tokodaii; identical to SEQ ID NO: 25336

SEQ ID NO: 31599 - DNA, 1206 bp, Synechococcus elongatus; identical to SEQ ID NO: 25337
  CDS (1)..(1206)

SEQ ID NO: 31600 - protein, 401 aa, Synechococcus elongatus; identical to SEQ ID NO: 25338

SEQ ID NO: 31601 - DNA, 1212 bp, Synechococcus sp; identical to SEQ ID NO: 25339
  CDS (1)..(1212)

SEQ ID NO: 31602 - protein, 403 aa, Synechococcus sp; identical to SEQ ID NO: 25340

SEQ ID NO: 31603 - DNA, 1218 bp, Thermoplasma acidophilum; identical to SEQ ID NO: 25341
  CDS (1)..(1218)

SEQ ID NO: 31604 - protein, 405 aa, Thermoplasma acidophilum; identical to SEQ ID NO: 25342

SEQ ID NO: 31605 - DNA, 1203 bp, Thermus thermophilus; identical to SEQ ID NO: 25343
  CDS (1)..(1203)

SEQ ID NO: 31606 - protein, 400 aa, Thermus thermophilus; identical to SEQ ID NO: 25344

SEQ ID NO: 31607 - DNA, 1233 bp, Thermoanaerobacter tengcongensis; identical to SEQ ID NO: 25345
  CDS (1)..(1233)

SEQ ID NO: 31608 - protein, 410 aa, Thermoanaerobacter tengcongensis; identical to SEQ ID NO: 25346

SEQ ID NO: 31609 - DNA, 1212 bp, Vibrio vulnificus; identical to SEQ ID NO: 25347
  CDS (1)..(1212)

SEQ ID NO: 31610 - protein, 403 aa, Vibrio vulnificus; identical to SEQ ID NO: 25348

SEQ ID NO: 31611 - DNA, 1215 bp, Wolinella succinogenes; identical to SEQ ID NO: 25349
  CDS (1)..(1215)

SEQ ID NO: 31612 - protein, 404 aa, Wolinella succinogenes; identical to SEQ ID NO: 25350

SEQ ID NO: 31613 - DNA, 1194 bp, Xanthomonas campestris; identical to SEQ ID NO: 25351
  CDS (1)..(1194)

SEQ ID NO: 31614 - protein, 397 aa, Xanthomonas campestris; identical to SEQ ID NO: 25352

SEQ ID NO: 31615 - DNA, 1206 bp, Xylella fastidiosa; identical to SEQ ID NO: 25353
  CDS (1)..(1206)

SEQ ID NO: 31616 - protein, 401 aa, Xylella fastidiosa; identical to SEQ ID NO: 25354

SEQ ID NO: 31617 - DNA, 24 bp, Primer
atgacgacgattctcaagcatctc

SEQ ID NO: 31618 - DNA, 25 bp, Primer
ttactggcctttgttttccagattc

SEQ ID NO: 31619 - protein, 409 aa, consensus; identical to SEQ ID NO: 25521
  MISC_FEATURE (1)..(409): consensus for the disclosure of xaa see table XV

SEQ ID NO: 31620 - protein, 36 aa, consensus; identical to SEQ ID NO: 25515
  MISC_FEATURE (1)..(36): consensus for the disclosure of xaa see table XV

SEQ ID NO: 31621 - protein, 42 aa, consensus; identical to SEQ ID NO: 25516
  MISC_FEATURE (1)..(42): consensus for the disclosure of xaa see table XV

SEQ ID NO: 31622 - protein, 18 aa, consensus
  MISC_FEATURE (1)..(18): consensus for the disclosure of xaa see table XV
XXXXXNXXXXXXXXXXXX

SEQ ID NO: 31623 - protein, 13 aa, consensus
  MISC_FEATURE (1)..(13): consensus for the disclosure of xaa see table XV
XXXXXXXGXXXXX

SEQ ID NO: 31624 - protein, 36 aa, consensus; identical to SEQ ID NO: 25519
  MISC_FEATURE (1)..(36): consensus for the disclosure of xaa see table XV

SEQ ID NO: 31625 - protein, 37 aa, consensus; identical to SEQ ID NO: 25520
  MISC_FEATURE (1)..(37): consensus for the disclosure of xaa see table XV

SEQ ID NO: 31626 - DNA, 725 bp, Escherichia coli K12
  CDS (4)..(432)
ttaatgaaaacttttacagctaaaccagaaaccgtaaaacgcgactggtatgttgttgacgcgaccggtaaaactctgggccgtctggctactgaactggctcgtcgcctgcgcggtaagcacaaagcggaatacactccgcacgtagataccggtgattacatcatcgttctgaacgctgacaaagttgctgtaaccggcaacaagcgtactgacaaagtgtactatcaccacaccggccacatcggtggtatcaaacaagcgacctttgaagagatgattgctcgccgtcctgagcgtgtgattgaaatcgcggttaaaggcatgttgccaaaaggcccgctgggtcgtgctatgttccgtaaactgaaagtttacgcgggtaacgagcacaaccacgcggcacagcaaccgcaagttcttgacatctaatcgggattataggcaatggctgaaaatcaatactacggcactggtcgccgcaaaagttccgcagctcgcgttttcatcaaaccgggcaacggtaaaatcgtaatcaaccaacgttctctggaacagtacttcggtcgtgaaactgcccgcatggtagttcgtcagccgctggaactggtcgacatggttgagaaactggacctgtacatcaccgttaaaggtggtggtatctctggtcaggctggtgcgatccgtcacggtatcacccgcgctctgatggaatacgacgagtc

SEQ ID NO: 31627 - protein, 142 aa, Escherichia coli K12 [sequence omitted]

SEQ ID NO: 31628 - DNA, 982 bp, Spinacia oleracea (spinach)
  CDS (40)..(792)
ctctctttctctctctctacagagctacaacatacaacaatggcgacaatggcctgcgcttcttccctaacgtttccttcagcgcagacccagaaatccttcttcggcaccaatgtaaaacaaactcctgttttgagctttcctcgcccaacagtggcggcagcagtagcagtgagcgccagaaaatcaacatcagcatctaccaaatgtaccgaggaatggcgtcaactcaaagaggccgtgaagaaagagtttgccattcctcatgttcccttagaccagcgctggatgtttactcttgaagaagctactggccctgatatttggaacacaacatggtatcctaaatctgctgaccatgttcctactgacaagaagtggtatgttgttgatgccacggatctgattcttgggaggatggcttcaactatagcaatacatattcgcgggaagaacttggcctcctatactccaagtgttgacatgggagcctttgtaatcgtggttaatgctgataaagttgctgtatcgggtaaaaagaggacacagaagttatacaggcgccattcaggaaggccagggggtctgaaggaggaaacctttgaccaacttcagaaaagaattccggaaaggattattgagcatgctgtccgtggcatgcttcctaaaggaagactcgggcggtatttgttcaatcacctcaaagtgtacaaaggcgcagagcatcctcaccaagctcagcaaccgattgatcttccactcagagacaagagaattcgcgttgagaaatgagtgttgtatctatcaagcaaacaactttataatgccaatgttttaacagaattaagcatccctctgttttgtagattgaaaattaagttgtgtaggtagataatttgaccattttgtaattcaggtattaaaacaaactcatatttgtttacacaagatgagaatctctgtatctttcagctcatattgc

SEQ ID NO: 31629 - protein, 250 aa, Spinacia oleracea (spinach)
MATMACASSLTFPSAQTQKSFFGTNVKQTPVLSFPRPTVAAAVAVSARKSTSASTKCTEEWRQLKEAVKKEFAIPHVPLDQRWMFTLEEATGPDIWNTTWYPKSADHVPTDKKWYVVDATDLILGRMASTIAIHIRGKNLASYTPSVDMGAFVIVVNADKVAVSGKKRTQKLYRRHSGRPGGLKEETFDQLQKRIPERIIEHAVRGMLPKGRLGRYLFNHLKVYKGAEHPHQAQQPIDLPLRDKRIRVEK

SEQ ID NO: 31630 - DNA, 444 bp, Mycobacterium tuberculosis
  CDS (1)..(444)
atgcccacgtacgcgcccaaggcgggtgacaccacgcgatcgtggtacgtcatcgacgccacggacgtggtgcttggccgccttgccgtcgcggcggccaacctgctgcgcggcaagcacaagccgacgttcgcccccaatgtcgatggcggtgacttcgtcatcgtgatcaacgccgacaaggtcgccatcagcggcgacaaactgcagcacaagatggtttaccggcactcggggtatcccggcggcctgcacaagcgcaccatcggtgagctaatgcaacgccaccccgaccgcgtggtggaaaaggcgatcctcggcatgttgcccaagaacaggctcagccgccagatccagcgcaagcttcgcgtctacgccggcccggagcatccgcacagcgctcagcagccggttccgtacgagctcaagcaggtggcgcaatga

SEQ ID NO: 31631 - protein, 147 aa, Mycobacterium tuberculosis
MPTYAPKAGDTTRSWYVIDATDVVLGRLAVAAANLLRGKHKPTFAPNVDGGDFVIVINADKVAISGDKLQHKMVYRHSGYPGGLHKRTIGELMQRHPDRVVEKAILGMLPKNRLSRQIQRKLRVYAGPEHPHSAQQPVPYELKQVAQ

SEQ ID NO: 31632 - DNA, 453 bp, Chlamydia trachomatis
  CDS (1)..(453)
atggaaaaaagaaaagatacgaaaacgaccctagctaaggcttcggacgatcgaaacaaagcctggtatgtagttaatgctgaagggaagaccttagggagattatcttcagaagttgcgaagatcctgagaggtaagcataaggtgacttttactcctcacgtagcgatgggagatggtgtcattgtgatcaatgctgagaaagtgcgtttgactggcgcaaaaagagctcagaaagtgtatcactattacacaggctttatttctgggatgcgagaagttccttttgaaaacatgattgcgcgaaagcctgcttatgttatcgagcatgctgttaaaggaatgttgcctaaaacaaaacttggaagacgtcaaatgaaatctttaagagttttgaaaggtagttcttacgcacagtatgaagctatcaaaccaattgttttagacgcgtaa

SEQ ID NO: 31633 - protein, 150 aa, Chlamydia trachomatis
MEKRKDTKTTLAKASDDRNKAWYVVNAEGKTLGRLSSEVAKILRGKHKVTFTPHVAMGDGVIVINAEKVRLTGAKRAQKVYHYYTGFISGMREVPFENMIARKPAYVIEHAVKGMLPKTKLGRRQMKSLRVLKGSSYAQYEAIKPIVLDA

SEQ ID NO: 31634 - DNA, 429 bp, Pseudomonas aeruginosa
  CDS (1)..(429)
atgaaaacctataccgcgaaaccggaaactgtacagcgcgactggttcgtcgtcgacgctgccggccagaccctgggtcgtctggcgaccgaaattgcccgccgcctgcgtggcaagcacaagcctgagtacactccgcacgttgacaccggcgactacatcgtcgtcatcaacgccgagcaggtgcgtgtgaccggtgccaagaccaccgacaagatgtactaccaccactccggcttcccgggcggcatcaagtcgatcaacttcgagaagctgatcgccaaggcccctgagcgcgtcatcgagaccgctgtaaaaggcatgctgccgaagaaccctctgggtcgcgatatgtatcgcaagctgaaggtgtacaagggtgccagccacccgcacaccgctcagcagccccaagaactgaagatttaa

SEQ ID NO: 31635 - protein, 142 aa, Pseudomonas aeruginosa
MKTYTAKPETVQRDWFVVDAAGQTLGRLATEIARRLRGKHKPEYTPHVDTGDYIVVINAEQVRVTGAKTTDKMYYHHSGFPGGIKSINFEKLIAKAPERVIETAVKGMLPKNPLGRDMYRKLKVYKGASHPHTAQQPQELKI

SEQ ID NO: 31636 - DNA, 474 bp, Caulobacter crescentus
  CDS (1)..(474)
atgcagaagatcacggcttccttgaagccagccgaggtcgagaagaagtggatcgtggtcgacgctgagaacgccgttgtcggccgtctggcttcgttcatcgccatgcgtcttcgcggcaagcatcgtcctgactacaccccgcacgtcgattgcggcgacttcgtcgtcgtcatcaacgccgacaaggtgaagttcaccggcaagaagctggacgacaaggtctactaccgtcacaccggtcacccgggcggcatcaaggaaaccaccccgcgcaaggtgctgggcggtcgtttccccgagcgcgtcctcgagaaggccgttgagcgcatgctgcccaaggagagcccgctggctcgcaagcagctgacccacctgctcatctacaacaacggtgagcacccgcaccaagcgcaaaaccccgaagtcgtcgacttcgcgggccgcaacgccaagaacatccggagcctctaa

SEQ ID NO: 31637 - protein, 157 aa, Caulobacter crescentus
MQKITASLKPAEVEKKWIVVDAENAVVGRLASFIAMRLRGKHRPDYTPHVDCGDFVVVINADKVKFTGKKLDDKVYYRHTGHPGGIKETTPRKVLGGRFPERVLEKAVERMLPKESPLARKQLTHLLIYNNGEHPHQAQNPEVVDFAGRNAKNIRSL

SEQ ID NO: 31638 - DNA, 757 bp, Arabidopsis thaliana (mouse-ear cress)
  CDS (1)..(726)
atggcggttctttgctcgtcttcgacggtgatactctcttcttcttccgtgaaatcctccggaagtgagagaaagtctccgtttttagggttctctttaacggctatctcgaagccgtcggtacgagtcggcatttatgcgaattcgaaaagaggattgcaagtgaagtgtgaagctgagccgacgacgacgacttctcttgttccggcgaatcaacgatggatgttcgacgaagaagaagctaatggccctgacatctggaacacgacatggtatccaaaagcttcagaccatgtgaacacggacaagccctggtttgtggttgatgcaactgacaaaattcttggtagattggcatcgacaattgctaatcacatccgtgggaagaatcttgcctcttacactcctagtgtcgacatgggagcttttgtgattgtggtgaatgctgagaaagttgctgtatctggaaagaagcgtaaccaaaagctgtacaggaggcattcaggacgacctggtggtatgacagtagagacatttgatcaattgcagcagagaattcctgaaagaatcgttgagcatgctgttcgtggaatgcttccaaagggacggcttgggagagctctgttcaatcacctgaaggtgtacaaaggccctgaccatcctcacgaggcccagaaaccgcttgatctgcctatcagggacaagagaatacagctgcaaaaatagaagctccaccactgttccattatcgccaagc

SEQ ID NO: 31639 - protein, 241 aa, Arabidopsis thaliana (mouse-ear cress)
MAVLCSSSTVILSSSSVKSSGSERKSPFLGFSLTAISKPSVRVGIYANSKRGLQVKCEAEPTTTTSLVPANQRWMFDEEEANGPDIWNTTWYPKASDHVNTDKPWFVVDATDKILGRLASTIANHIRGKNLASYTPSVDMGAFVIVVNAEKVAVSGKKRNQKLYRRHSGRPGGMTVETFDQLQQRIPERIVEHAVRGMLPKGRLGRALFNHLKVYKGPDHPHEAQKPLDLPIRDKRIQLQK

SEQ ID NO: 31640 - DNA, 465 bp, Agrobacterium tumefaciens
  CDS (1)..(465)
atgtctactttcgttcagaagcccgctgaggtggagaagaagtggatcatcatcgacgccgaaggcctcgttgttggtcgcctcgccaccatcgttgcaacccgcctgcgcggcaagcacaaggctacctttaccccccacgttgatgatggcgacaacgtcatcgttatcaatgcggaaaaggttgccttcaccggcaagaagtattccgacaagaagtactactggcacaccggtcacccgggtggcatcaaggagcgcaccgctcgccagatcatcgaaggccgcttcccggagcgcgtcgttgaaaaggctatcgagcgcatgatcccgcgcggcccgctcggccgtcgccagatgaagaacctgcgcgtttacgccggctctaaccacccgcacgaagcacagcagcccaccgttctcgacgtggccgcgcttaacaagaagaacgtaaggagcgcctga

SEQ ID NO: 31641 - protein, 154 aa, Agrobacterium tumefaciens
MSTFVQKPAEVEKKWIIIDAEGLVVGRLATIVATRLRGKHKATFTPHVDDGDNVIVINAEKVAFTGKKYSDKKYYWHTGHPGGIKERTARQIIEGRFPERVVEKAIERMIPRGPLGRRQMKNLRVYAGSNHPHEAQQPTVLDVAALNKKNVRSA

SEQ ID NO: 31642 - DNA, 465 bp, Brucella melitensis
  CDS (1)..(465)
atggcaactttctcccagaagccggctgaagtggttaagaagtgggtgctgatcgacgccgaaggtctcgtcgtcggccgtctcgcatcgctcgtcgccaatcgcctgcgtggcaagcacaaggcaaccttcaccccgcatgttgacgatggcgacaatgtcatcatcatcaatgccgacaaggttgttctgaccggcaagaaatataccgacaagaaatactactggcacaccggccatccgggcggcatcaaggagcgtaccgctcgccagattctcgaaggccgtttcccggaacgcgttcttgagaaggctattgagcgtatgatcccgcgtggtccgctcggccgtcgccagatgaagaacctgcgcgttaatgcaggcccgaaccatcagcacgaagctcagcagcctgaagtcctcgacgtcgcagcgctgaaccgcaagaacaaagggaatgcataa

SEQ ID NO: 31643 - protein, 154 aa, Brucella melitensis
MATFSQKPAEVVKKWVLIDAEGLVVGRLASLVANRLRGKHKATFTPHVDDGDNVIIINADKVVLTGKKYTDKKYYWHTGHPGGIKERTARQILEGRFPERVLEKAIERMIPRGPLGRRQMKNLRVNAGPNHQHEAQQPEVLDVAALNRKNKGNA

SEQ ID NO: 31644 - DNA, 438 bp, Listeria monocytogenes
  CDS (1)..(438)
atgcgtacaacttatatggcgaaacccggcgaagtagaacgtaaatggtacgttatcgacgctactggtgtttctttaggacgtttatccagtgaagttgcttcaattcttcgcggaaaaaacaaaccacaatttactccacatatcgacactggagactttgtaatcatcatcaacgctggtaagattggtcttactggtaaaaaagctactgacaaaatttactaccgtcactctcaatatccaggcggtttgaaatctcgtactgcaggcgaaatgcgtacaaacaatcctgagaaattattagaactatctatcaaaggtatgcttccaaaaaattctcttgggcgtcaattattcaaaaaattacacgtatatggtggatctgagcacgaacacgcagctcaacaaccagaagtatacgaattacgcggttaa

SEQ ID NO: 31645 - protein, 145 aa, Listeria monocytogenes
MRTTYMAKPGEVERKWYVIDATGVSLGRLSSEVASILRGKNKPQFTPHIDTGDFVIIINAGKIGLTGKKATDKIYYRHSQYPGGLKSRTAGEMRTNNPEKLLELSIKGMLPKNSLGRQLFKKLHVYGGSEHEHAAQQPEVYELRG

SEQ ID NO: 31646 - DNA, 456 bp, Nostoc sp. PCC 7120
  CDS (1)..(456)
atgagtaaaacctatcttcctcctcaagaatcccttgagcgtgattggtatgtagtagatgctacggacaaacgcctgggtcgccttgccagtgaaattgccatgattttaagaggcaaaaataaggcacactataccccacacctagatacaggtgacttcgtgattgttgtaaatgctaaaaaagtagcagttacaggcaagaaacgtactcagaaactttatcgtcgtcactctggtcgtcctggtgggatgaagacagaaacctttgccaaactgcaacagcgtttaccagaaagaatcgtggaacacgctgtcaaaggtatgctacccaaaaatagcctgggtaagcagttattcactaaactgaaagtttacgctgggccgactcatccccacgatgcccaaaaacctaaagaactcaacattcatacaatccctggagcagaaagttaa

SEQ ID NO: 31647 - protein, 151 aa, Nostoc sp. PCC 7120
MSKTYLPPQESLERDWYVVDATDKRLGRLASEIAMILRGKNKAHYTPHLDTGDFVIVVNAKKVAVTGKKRTQKLYRRHSGRPGGMKTETFAKLQQRLPERIVEHAVKGMLPKNSLGKQLFTKLKVYAGPTHPHDAQKPKELNIHTIPGAES

SEQ ID NO: 31648 - DNA, 438 bp, Haloarcula marismortui
  CDS (1)..(438)
atgagcgtcgcagaattcgacgcggatgtcatcgttgacgcccgcgactgtatcatgggccgcgtcgcatcacaggtcgccgaacaggctctcgatggcgagacggtcgccgtcgtcaacgccgaacgcgccgtgattaccggccgagaggagcagatcgtagagaagtacgagaaacgtgtcgacatcggtaacgacaacgggtacttctaccccaagcgaccggacggcatcttcaaacgcaccatccgcggcatgctgccccacaagaagcagcgtggccgcgaagcgttcgagagcgtccgtgtctacctcggcaacccgtacgacgaggacggcgaggttctagacggcacgtcgcttgaccgactgtcgaacatcaagttcgtcacgctgggcgagatcagcgaaacgcttggagcgaacaagacatggtaa

SEQ ID NO: 31649 - protein, 145 aa, Haloarcula marismortui
MSVAEFDADVIVDARDCIMGRVASQVAEQALDGETVAVVNAERAVITGREEQIVEKYEKRVDIGNDNGYFYPKRPDGIFKRTIRGMLPHKKQRGREAFESVRVYLGNPYDEDGEVLDGTSLDRLSNIKFVTLGEISETLGANKTW

SEQ ID NO: 31650 - DNA, 441 bp, Mycoplasma genitalium
  CDS (1)..(441)
atgcaaaaaacatcgatgcttacaaaggaagaagccattaaaaacaggaagtggtatcttgttgacgctagtggtttggttttaggcaaattagcagttaaagctgcaaatttaattagaggaaaaaataaagctaattttactcctaatcaagattgtggagatcatctaataattattaacagtgatcaagtggttttaactggaaataaaaaagacaatgagttttgatatcatcactctcaatacatgggtggaattaaaaaaactagtggaagggatatgataaacaaaaattcagataaacttgttttcaatgctgttaagggaatgttacctgataatcgtttaagcagaagattaataactaaagtacatgtttttaagaatgataagcacaacatggaagcacaaaaaccaacattacttaattgaagttaa

SEQ ID NO: 31651 - protein, 146 aa, Mycoplasma genitalium
MQKTSMLTKEEAIKNRKWYLVDASGLVLGKLAVKAANLIRGKNKANFTPNQDCGDHLIIINSDQVVLTGNKKDNEFWYHHSQYMGGIKKTSGRDMINKNSDKLVFNAVKGMLPDNRLSRRLITKVHVFKNDKHNMEAQKPTLLNWS

SEQ ID NO: 31652 - DNA, 441 bp, Borrelia burgdorferi (Lyme disease spirochete)
  CDS (1)..(441)
atgaataaaataaccaataatgatacgatttggatcaagccaaagactgttgagaaaaaatggtatgtaattgatgcagcagatagaattttaggtaaagttgctgtggatgttgttaaaattttaagaggcaaacataaagcttattatactccccatcaagatttaggtgacaatgttatcattattaatgcttctaaagttaagctgacggggaaaaaatatcaacaaaaactttattataggcattcaagatatcctggaggtctttattctgacacttttagaacattgtcagagagaaagccttgtgctcctcttgaaattgctattaagggtatgttgccaaaaggccctttggggcgtaatctttttagaaatttaaaagtcttttctggttcagagcatactcttaaagctcaaaatcctataaagctgtaa

SEQ ID NO: 31653 - protein, 146 aa, Borrelia burgdorferi (Lyme disease spirochete)
MNKITNNDTIWIKPKTVEKKWYVIDAADRILGKVAVDVVKILRGKHKAYYTPHQDLGDNVIIINASKVKLTGKKYQQKLYYRHSRYPGGLYSDTFRTLSERKPCAPLEIAIKGMLPKGPLGRNLFRNLKVFSGSEHTLKAQNPIKL

SEQ ID NO: 31654 - DNA, 429 bp, Pyrococcus horikoshii
  CDS (1)..(429)
atgaggattattaatgctgatggactcatacttgggaggcttgcttcaagagttgcaaagatgcttcttgaaggtgaggaagtcgtaatagtaaatgctgaaaaggcagtaattacagggaatagggaggttatattcagcaaatataagcaaagaactggacttagaacgctaactaatcccaggagaggtccattttatcccaagagaagtgacgaaatagttagaagaaccatcagagggatgcttccttggaagacagatcgcggaaggaaggccttcaggagactgaaggtttacgttggcattcctaaagagtttcaagataagcaacttgaaacaattgtagaggctcacgtttcaaggttatcgagacctaagtatgtaaccgttggtgaggttgctaagttcttaggagggaagttctga

SEQ ID NO: 31655 - protein, 142 aa, Pyrococcus horikoshii
MRIINADGLILGRLASRVAKMLLEGEEVVIVNAEKAVITGNREVIFSKYKQRTGLRTLTNPRRGPFYPKRSDEIVRRTIRGMLPWKTDRGRKAFRRLKVYVGIPKEFQDKQLETIVEAHVSRLSRPKYVTVGEVAKFLGGKF

SEQ ID NO: 31656 - DNA, 432 bp, Neisseria meningitidis
  CDS (1)..(432)
atgaaaaccttttcagcgaaaccccacgaggtgaagcgcgaatggttcgtcatcgatgcccaagacaaagtcttgggtcgcgttgcggccgaagtcgccagccgtctgcgtggcaaacacaaacctgaatacaccccccacgtcgataccggcgattacatcattgttatcaatgcggacaaactgcgtgtaaccggtgccaaattcgaagataaaaaatacttccgccattccggtttcccaggcggtatctacgaacgcaccttccgcgaaatgcaagagcaattcccgggccgcgctttggaacaagctgtaaaaggtatgctgcccaaaggtcctctgggttacgccatgattaaaaaactgaaagtgtatgcgggtgcggaacacgcccatgctgcgcaacaacccaaagttttggaactgaaataa

SEQ ID NO: 31657 - protein, 143 aa, Neisseria meningitidis
MKTFSAKPHEVKREWFVIDAQDKVLGRVAAEVASRLRGKHKPEYTPHVDTGDYIIVINADKLRVTGAKFEDKKYFRHSGFPGGIYERTFREMQEQFPGRALEQAVKGMLPKGPLGYAMIKKLKVYAGAEHAHAAQQPKVLELK

SEQ ID NO: 31658 - DNA, 429 bp, Vibrio cholerae
  CDS (1)..(429)
atgaaaactttcgttgctaaaccagaaactgtaaaacgcgactggtacgttgtagacgctgaaggtaaaactcttggccgtctagcaagtgaaattgcatctcgcctacgtggcaaacacaaagctgaatacactccacacgttgacactggtgattacatcatcgttgttaatgcggagaaagttactgttacaggtaacaaggctaagaacaagatgtaccaccgtcactctgagttcccaggtggcctgaagtcattcagcttcgagaagctgattgagcgtaagccagaaatggtacttgagttagcggttaaaggtatgttgccaaaaggtcctctaggccgtgctatgtaccgtaagctgaaagtttacgctggcgctgagcacaaccatgctgctcaacaaccaaaagtactggacatctaa

SEQ ID NO: 31659 - protein, 142 aa, Vibrio cholerae
MKTFVAKPETVKRDWYVVDAEGKTLGRLASEIASRLRGKHKAEYTPHVDTGDYIIVVNAEKVTVTGNKAKNKMYHRHSEFPGGLKSFSFEKLIERKPEMVLELAVKGMLPKGPLGRAMYRKLKVYAGAEHNHAAQQPKVLDI

SEQ ID NO: 31660 - DNA, 423 bp, Methanococcus jannaschii
  CDS (1)..(423)
atgatagttatgacagtaatagatgctgaaggagcgatattgggaagattggcttcagaagtagcaaaaagagttttgagaggagaagaaattgttattgtaaatgctgagatggtagttattacaggtaacaaggactggattataaaaacctaccaagaggaaagagagaagaaaaacgttgctaacccaagaagatttgggccgaaattcccaagaagaccagatgatatattaagaagaacaattagaaagatgcttccatacaaaaaaccaaaaggaagagaggcatttaagagagttaaagtttatgttggaaatcctaaaaacttaacagttgatgaaaaaataagccacaaattaaacaccaccaaatatataacattagctgagttaagcaaacacttaggagcgaagttctga

SEQ ID NO: 31661 - protein, 140 aa, Methanococcus jannaschii
MIVMTVIDAEGAILGRLASEVAKRVLRGEEIVIVNAEMVVITGNKDWIIKTYQEEREKKNVANPRRFGPKFPRRPDDILRRTIRKMLPYKKPKGREAFKRVKVYVGNPKNLTVDEKISHKLNTTKYITLAELSKHLGAKF

SEQ ID NO: 31662 - DNA, 435 bp, Clostridium acetobutylicum
  CDS (1)..(435)
atgaaatcgtacttagcgaaaccacaggaaatcgaaagaaaatggtatgttattgatgttgcaggtaagccacttggaagagctgcaagtcaaatagcttcaattttaagaggaaaaaataagccaatatacactccaaatgttgatactggagattacgtaatagttttaaatgcagaaaaagttcttttaacaggaaaaaaagcagatcaaaaaatgtttagacaccatactttatatccaggtggattaaaggaaatgtcatataaagatgcaattgctaagaaagctgacttcgtattctatgaagcagttagaagaatgcttccaagcggtgtattaggaagaaaaatgattaagaaattaaaagtatataaaggcgaagagcataataatgaagctcaaaaacctgaagttttagagttgaaatattaa

SEQ ID NO: 31663 - protein, 144 aa, Clostridium acetobutylicum
MKSYLAKPQEIERKWYVIDVAGKPLGRAASQIASILRGKNKPIYTPNVDTGDYVIVLNAEKVLLTGKKADQKMFRHHTLYPGGLKEMSYKDAIAKKADFVFYEAVRRMLPSGVLGRKMIKKLKVYKGEEHNNEAQKPEVLELKY

SEQ ID NO: 31664 - DNA, 483 bp, Helicobacter pylori
  CDS (19)..(444)
ttttatcaaaggattcttatgacaaagaccgctaaagtcaatgacatcgttcgtgattgggtcgttttagacgccaaagacaaggtttttggccgcttgatcactgaaatcgctgtgcttttaagagggaaacaccgccctttttacacccctaatgtggattgtggggattttgtggtggttatcaacgctaataaggttaaattttcaggcatgaaattagaggataaagagtattttacccattcaggctattttggcagcactaagagcaagactctccaagaaatgctagaaaaagcccctgaaaagctctaccacttagccgttaggggcatgctccctaaaacgaaattagggaaagcgatgattaaaaaactcaaagtttatcgtgatgataagcaccctcacaccgcacaaactagcaaaaaggacgctaaatgagaaaaatctatgctaccggtaaaagaaaaaccgctatcg

SEQ ID NO: 31665 - protein, 141 aa, Helicobacter pylori
MTKTAKVNDIVRDWVVLDAKDKVFGRLITEIAVLLRGKHRPFYTPNVDCGDFVVVINANKVKFSGMKLEDKEYFTHSGYFGSTKSKTLQEMLEKAPEKLYHLAVRGMLPKTKLGKAMIKKLKVYRDDKHPHTAQTSKKDAK

SEQ ID NO: 31666 - DNA, 429 bp, Treponema pallidum subsp. pallidum (syphilis spirochete)
  CDS (1)..(429)
atgaggacaatctttgttaatgagcgcgaggctgttcgcgcttggcacctgattgacgcagcggggcgccccttggggcgtgttgccgcgcgcgttgcgtgtctcctgcgtggtaagcataaagcatcgtacacgccaaaccaggaaatgggtgattacgttgtggtaatcaacgctgagaaggtgttcctgagtgggactaaaccgaaggacaagatgtactaccgccactcaggctatcctggggggctcaagagcgtgtcgtttagcgcgttggtcaagcgccggcctgtcgaaccgttgcgtcacgcggttaagggtatgctacccaaggggcctttgggacgcaagcttatcaagaatgtgaagatatacgcgggatctgtgcatccgcacgagtcgcagaatcccgtgccgctgtcgtgttaa

SEQ ID NO: 31667 - protein, 142 aa, Treponema pallidum subsp. pallidum (syphilis spirochete)
MRTIFVNEREAVRAWHLIDAAGRPLGRVAARVACLLRGKHKASYTPNQEMGDYVVVINAEKVFLSGTKPKDKMYYRHSGYPGGLKSVSFSALVKRRPVEPLRHAVKGMLPKGPLGRKLIKNVKIYAGSVHPHESQNPVPLSC

SEQ ID NO: 31668 - DNA, 849 bp, Methanobacterium thermoautotrophicum
  CDS (1)..(849)
atgttgctcatgatcatcaacggagaaggacatatccttggaagactggcaagtgtcgtcagcaagaagctccttgagggggaggaagtgatcgtcttaaatgccgagaagatcctgatcacaggttctaaggaatgggcatacggcaagtacaagcagaggattgacagggccagcatatccaaccccagaaggatgggtcccaagtaccccagaaggcccgacgacatattcagaaggaccgtgaggggcatgctaccctacaagaaatcaaagggaagagaagccttcaagggcctcaaggcatatgtgggtattccacgtgaattcaaggatgaagaaatggttgaaatacccgatgcaaaggcaggcagcataaaaaagggaatggaactcggagagatctcagaacttctgggtgctagattacagatagggagtgtaatcatgaagaaggttattcacacaagcggcaaaaggaaaaccgccattgcaagggggaccatcagggaaggtaagggtagagtgaggatcaacaaggtcccggttgaactctacacacctgaacttgcaaggctcaagatcatggaaccactgaaacttgccggcgacgttataaatgacgttgacataaacgtcagggtcgttggtgggggtatagttggacaggccgaggctgcaaggatggtcatcgccaggggactcgtggactggaccagtgacatggacctcaaggagaagttcgtacagtacgacaggacaatgctggtgggagaccccagacgttcagagcccaagaagtacgggggccgaggcgcccgtgcaaggagacagaagagttacaggtag

SEQ ID NO: 31669 - protein, 282 aa, Methanobacterium thermoautotrophicum
MLLMIINGEGHILGRLASVVSKKLLEGEEVIVLNAEKILITGSKEWAYGKYKQRIDRASISNPRRMGPKYPRRPDDIFRRTVRGMLPYKKSKGREAFKGLKAYVGIPREFKDEEMVEIPDAKAGSIKKGMELGEISELLGARLQIGSVIMKKVIHTSGKRKTAIARGTIREGKGRVRINKVPVELYTPELARLKIMEPLKLAGDVINDVDINVRVVGGGIVGQAEAARMVIARGLVDWTSDMDLKEKFVQYDRTMLVGDPRRSEPKKYGGRGARARRQKSYR

SEQ ID NO: 31670 - DNA, 525 bp, Deinococcus radiodurans
  CDS (1)..(525)
atggctttcccggacacggacgtttctccccccagaggcgggccgtcgtcgccagccaaatccccccttttacggagtttcaaggtgaaaacctacatccccaaaaacgacgagcagaactgggtcgtggtggacgcctcgggcgtgcccctcggccgcctcgccaccctgatcgcttcgcgcatccgtggcaagcaccgccccgacttcacccccaacatgatccagggtgacttcgtggtggtcatcaacgccgcgcaggtggccctgaccggcaagaagttggacgacaaggtctatacccgctacaccggctaccagggtggcctcaagaccgaaaccgcccgcgaagcgctcagcaagcaccccgagcgcgtgatcgagcacgccgtgttcggcatgctgcccaagggccgtcagggccgtgcgatgcacacccgcctgaaggtctacgcgggtgaaacccacccccacagcgcccagaagccgcaagttcttaagacgcagccgcttgaggtcaaataa

SEQ ID NO: 31671 - protein, 174 aa, Deinococcus radiodurans
MAFPDTDVSPPRGGPSSPAKSPLLRSFKVKTYIPKNDEQNWVVVDASGVPLGRLATLIASRIRGKHRPDFTPNMIQGDFVVVINAAQVALTGKKLDDKVYTRYTGYQGGLKTETAREALSKHPERVIEHAVFGMLPKGRQGRAMHTRLKVYAGETHPHSAQKPQVLKTQPLEVK

SEQ ID NO: 31672 - DNA, 426 bp, Campylobacter jejuni
  CDS (1)..(426)
atgacaaagataacaaagccaaacgaagtaaaacgagaatggattgttttagacgcagaaggcaaacgctttggtcgtcttttaactgaagtagcaacaattttgagaggtaaaaacaaaccttgctttactccaaatgttgattgtggtgattatgtaattatcatcaatgcttcaaaagctgtatttacaggtgctaataaagcagaagataagctttatcatagacattcaggatattttggaagtgtaaaaagcgaaaaatttggtgatttacttgaaaaaaatcctgcaaaattatataaattagcagttagaggtatgcttcctaaaacaaatttgggcagagctatgcttaaaaaattaaaaatctatgcgggtagtgagcacccacacactgcacaaattgctaaagaaggaaaataa

SEQ ID NO: 31673 - protein, 141 aa, Campylobacter jejuni
MTKITKPNEVKREWIVLDAEGKRFGRLLTEVATILRGKNKPCFTPNVDCGDYVIIINASKAVFTGANKAEDKLYHRHSGYFGSVKSEKFGDLLEKNPAKLYKLAVRGMLPKTNLGRAMLKKLKIYAGSEHPHTAQIAKEGK

SEQ ID NO: 31674 - DNA, 447 bp, Ureaplasma urealyticum
  CDS (1)..(447)
atgcaaaagtcttcaatgcttaagaaagaagtcgctattgcgcgtcgacaatgatatttagttgatgcaacagatttagttttaggtcgtttatctgttaaagtagcagatattttaagaggaaagaataaagttgattatacaccaaacgttgatgcaggtgattatgtggtagttatcaattcagataaagttgttttaactggtcaaaaagcattacgtgaaaattgatataatcattcacactatattggtggtttaagaacacgtagtggggaagaaatgattagcaaatattcagatgaacttattcgtcgttcagttaaaggaatgcttccaaaaaataaattagcaaaacaaattctaaacaaattattcatttataaaaatgataaacatccccatgaagcacaacaaccaactattttggaattaaaattaaaatag

SEQ ID NO: 31675 - protein, 148 aa, Ureaplasma urealyticum
MQKSSMLKKEVAIARRQWYLVDATDLVLGRLSVKVADILRGKNKVDYTPNVDAGDYVVVINSDKVVLTGQKALRENWYNHSHYIGGLRTRSGEEMISKYSDELIRRSVKGMLPKNKLAKQILNKLFIYKNDKHPHEAQQPTILELKLK

SEQ ID NO: 31676 - DNA, 438 bp, Staphylococcus aureus
  CDS (1)..(438)
atgcgtcaaacatttatggcaaatgaatcaaacattgagcgcaaatggtatgttatcgatgctgaaggccaaacattaggtcgtttatcatcagaagtagcatctatcttacgcggtaaaaataaagtaacttacacaccacacgttgatactggtgattatgtaatcgttattaatgcatcaaaaatcgaatttactggtaacaaagaaactgacaaagtttactaccgtcactcaaatcacccaggtggtatcaaatcaatcactgctggtgaattaagaagaactaacccagaacgtttaattgaaaactcaattaaaggtatgttaccaagcactcgtttaggcgaaaaacaaggtaaaaaattatttgtatatggtggcgctgaacatccacacgctgcacaacaaccagaaaactacgaattacgtggttaa

SEQ ID NO: 31677 - protein, 145 aa, Staphylococcus aureus
MRQTFMANESNIERKWYVIDAEGQTLGRLSSEVASILRGKNKVTYTPHVDTGDYVIVINASKIEFTGNKETDKVYYRHSNHPGGIKSITAGELRRTNPERLIENSIKGMLPSTRLGEKQGKKLFVYGGAEHPHAAQQPENYELRG

SEQ ID NO: 31678 - DNA, 522 bp, Plasmodium falciparum
  CDS (1)..(522)
atgcccaaggttgatattttttcagaagaacatatttcaaagtgtgctttaagcgtttttgataaagagaaaggtaactggtttgtaatagacgctacaaataaaagtgtaggaagtttagctgcatgcattagtaaattattacaaggaaaatatagagttgattacaatcctaataaagttaatagtagtagtgttattgttgtaaatgctatacatgtgaagttttatggacatacatgggataccaaaatttataaattcccaagaaaaagtcattcaaaaagtcataaaattttatcatgtaaaacagtctttgctagaaacccatccatgattttaaatctagctgttaagagaatgctacccaataacagacttaggcaaatcttttatagaaaattatatgtatatccaggagccctacatccacattggggtataccacaagttgtagtacccaaaaaaaatgtagtcaaaaaggaagagcagcaagatataaagacctttaccattttgtaa

SEQ ID NO: 31679 - protein, 173 aa, Plasmodium falciparum
MPKVDIFSEEHISKCALSVFDKEKGNWFVIDATNKSVGSLAACISKLLQGKYRVDYNPNKVNSSSVIVVNAIHVKFYGHTWDTKIYKFPRKSHSKSHKILSCKTVFARNPSMILNLAVKRMLPNNRLRQIFYRKLYVYPGALHPHWGIPQVVVPKKNVVKKEEQQDIKTFTIL

SEQ ID NO: 31680 - DNA, 468 bp, Rickettsia prowazekii
  CDS (1)..(468)
atgaaaacttactcagcaaagccatcggaaattgaaaagaaatggtgggtcattgatgcaaaaaatgttgtactaggacgccttgctagcagggttgctattatgttacgaggtaaacataagcctagttttacacctcatttagattgtggtgataatataattataataaatgcagaacatataaaattaacaggtaaaaaactgaatcctaaagatggaaaagtatattatcgacataccggatttccaggtgggatcaaagatactacagcaggtaaaatcttaagtggtaaatatcctgagagagttattaaaatggctgtaaaaagaatgattacaagaaatgttttgggtgcgaagcaaatgagtaatttatatgtttatgcaaattgtgaacatccacatatggcacagcagcctactatttatgattttgcaagcgaaaatccaaaaaataaaaagtaa

SEQ ID NO: 31681 - protein, 155 aa, Rickettsia prowazekii
MKTYSAKPSEIEKKWWVIDAKNVVLGRLASRVAIMLRGKHKPSFTPHLDCGDNIIIINAEHIKLTGKKLNPKDGKVYYRHTGFPGGIKDTTAGKILSGKYPERVIKMAVKRMITRNVLGAKQMSNLYVYANCEHPHMAQQPTIYDFASENPKNKK

SEQ ID NO: 31682 - DNA, 429 bp, Xylella fastidiosa
  CDS (1)..(429)
atgactacgttcactgcaaaaaacgagaccgtccagcgcgactggtatcttgttgacgccgaaggcaaaaccctcggccgccttgccacagagttggcgcgacgcctactcggcaaaacgaaacctgtctacactacccatgttgatacaggcgattatcttgtcgtgattaatgccgagaaggtcgttgttacaggcaaaaaactcactgataagtattaccaccgcttcaccggatatgtaggcaatcttaagagtgagagcctcggacaagcgctgcaacgccatccggagcgagtacttgagatcgcagtcaaaggcatgcttccgaaagggccgctaggccgcgctatgtaccgcaagcttaaagtctacacgggctccaagcatccacacgccgcgcagcagccacaagttctggacatataa

SEQ ID NO: 31683 - protein, 142 aa, Xylella fastidiosa
MTTFTAKNETVQRDWYLVDAEGKTLGRLATELARRLLGKTKPVYTTHVDTGDYLVVINAEKVVVTGKKLTDKYYHRFTGYVGNLKSESLGQALQRHPERVLEIAVKGMLPKGPLGRAMYRKLKVYTGSKHPHAAQQPQVLDI

SEQ ID NO: 31684 - DNA, 438 bp, Halobacterium sp. NRC-1
  CDS (1)..(438)
atgagtctcgcagaattcgacgccgacgtcgtcgtggacgcgcgcgactgcatcatgggtcgcgtcgcgagcaacgtcgccgagcgcgcgctcgccggcgaccgggttgccgtcgtgaacgccgagcaggcggtcatcacgggaacggaggacgacgtgttctccacgtaccgcacgcgcgccaacctggggtccgaccgcggaccgtactacccgaagcgccccgacggcatcttcaagcgtgccatccgcggcatgctgccgtacaagcaggacgacggtcgggaggcgctcgacagcgtccgcgtgtacgtcgggaacccgatggacgaggacggcgacgtgcttgacggcacgtcgctggaccgactgtcaacaatccgcttcgtcaccctcagcgaagtgtccgaggaactgggggcgaacgtcacatggtaa

SEQ ID NO: 31685 - protein, 145 aa, Halobacterium sp. NRC-1
MSLAEFDADVVVDARDCIMGRVASNVAERALAGDRVAVVNAEQAVITGTEDDVFSTYRTRANLGSDRGPYYPKRPDGIFKRAIRGMLPYKQDDGREALDSVRVYVGNPMDEDGDVLDGTSLDRLSTIRFVTLSEVSEELGANVTW

SEQ ID NO: 31686 - DNA, 429 bp, Buchnera sp
  CDS (1)..(429)
atgaaaactttttcaattaaatcaagtaatattaaaagacattggtattatgtagatgccacaaataaaatattaggccgattagcaagtgcattatcgtttcatcttagagggaaacataagacagaatatactccgcatcttgatactggtgattatatcatcgttataaatgcttctaaaatattagtcacaggaaataaaaggattaataaaatttattatcatcatacaggttacgtaggtggtataaaacaatctagatttgaagaaatgatttctagtcatccagaaagagttattgaaattgctgtaaaaggtatgcttccaaaaggtgctctaggacgttctatgtttaaaaagttaaaagttttttctaatgaaaatcatgaacatatagctcagtgtcctcaattattaaatatttga

SEQ ID NO: 31687 - protein, 142 aa, Buchnera sp
MKTFSIKSSNIKRHWYYVDATNKILGRLASALSFHLRGKHKTEYTPHLDTGDYIIVINASKILVTGNKRINKIYYHHTGYVGGIKQSRFEEMISSHPERVIEIAVKGMLPKGALGRSMFKKLKVFSNENHEHIAQCPQLLNI

SEQ ID NO: 31688 - DNA, 447 bp, Lactococcus lactis subsp. lactis
  CDS (1)..(447)
atgatgaaaactacattcatggctaacgctcaaaacgttgaccgtaaatggtacgtcgtcgatgcaactgatgttcctcttggacgtctttctgcagttgtcgcaagcgtacttcgtggaaaaaacaaaccaacatacacaccacatactgatacaggtgatttcgtaatcgttgttaacgctgaaaaaatcaaattgactggtaaaaaagcaactgataaagtatattactcacactcacttcacccaggtggattgaaatcagttactgctggtgaactccgtgaaaaaaatgctgtacgtttgattgaaaaatcagtaaaaggtatgctcccacacaacacacttggacgtgctcaaggcatgaaacttaaagtgtttgttggcgcagaacacacacatacagctcaaaaacctgaagtccttgacatcacaggtttgatttaa

SEQ ID NO: 31689 - protein, 148 aa, Lactococcus lactis subsp. lactis
MMKTTFMANAQNVDRKWYVVDATDVPLGRLSAVVASVLRGKNKPTYTPHTDTGDFVIVVNAEKIKLTGKKATDKVYYSHSLHPGGLKSVTAGELREKNAVRLIEKSVKGMLPHNTLGRAQGMKLKVFVGAEHTHTAQKPEVLDITGLI

SEQ ID NO: 31690 - DNA, 429 bp, Haemophilus influenzae
  CDS (1)..(429)
atgaaaacttttgtagcaaaaccagaaacggttaaacgcgactggtacgtagtagatgcgacaggtaaaactttaggtcgtttagcgactgaattagcacgtcgtcttcgtggtaaacacaaggctgagtacactccacacgtagatactggtgattacatcatcgttatcaacgcagacaaagtggcagtaactggtcgtaaagaaacagataaactttactactggcacactggctatgtaggtggtattaaacaagcgactttcaaagaaatgatcgctcgccgtcctgaagcagtgattgaaattgcggttaaaggtatgttgccaaaaggtccattaggccgtgcaatgttccgtaaattaaaagtgtatgcaggtggagaacaccaacacgcagcacaacaaccacaagtattagatatttaa

SEQ ID NO: 31691 - protein, 142 aa, Haemophilus influenzae
MKTFVAKPETVKRDWYVVDATGKTLGRLATELARRLRGKHKAEYTPHVDTGDYIIVINADKVAVTGRKETDKLYYWHTGYVGGIKQATFKEMIARRPEAVIEIAVKGMLPKGPLGRAMFRKLKVYAGGEHQHAAQQPQVLDI

SEQ ID NO: 31692 - DNA, 471 bp, Archaeoglobus fulgidus
  CDS (1)..(471)
atggcggtaaacgttagcagggttatcaagactcttggagacgacttcacagttattgatgcttcaggccacattctcggaaggctgtcaagcaaaattgcaaagagactgctcaacggcgagagaatcgttgttgttaacgcagagaaggcggtgattacgggggacaagtacatggtcttcgagaggtacaaggagaagtacgacaggggaagcaaggagaaggggccttacttcccgaggcatcccgagagaatattcaagagaaccgtcaggggaatgctcccatggaagagctcaaggggaagagatgcctacagaaggctcagagttttcatgggcgttccggaggagcttcagggcagggagtttgagaaaatcgaggacgcacttctggagaaagtttcaaaaacagacaagtacgttactcttgcagaggtaagcaggtatctcggtttcagaggtgtctga

SEQ ID NO: 31693 - protein, 156 aa, Archaeoglobus fulgidus
MAVNVSRVIKTLGDDFTVIDASGHILGRLSSKIAKRLLNGERIVVVNAEKAVITGDKYMVFERYKEKYDRGSKEKGPYFPRHPERIFKRTVRGMLPWKSSRGRDAYRRLRVFMGVPEELQGREFEKIEDALLEKVSKTDKYVTLAEVSRYLGFRGV

SEQ ID NO: 31694 - DNA, 438 bp, Bacillus subtilis
  CDS (1)..(438)
atgcgtacaacacctatggctaacgcaagtactattgaacgcaagtgcttagttgttgatgctgctggcaagactttaggtcgtctttcttcagaagttgcagctatccttcgcggaaaacacaaaccaacttacacaccacacgttgatactggagatcatgtgatcatcatcaacgccgaaaaaatcgagttaactggtaaaaagttaactgacaaaatctactaccgtcacactcaacatccaggcggattaaaatcaagaactgctcttgaaatgcgtacaaactaccctgagaaaatgcttgagcttgctatcaaaggcatgcttccaaaaggttctctaggtcgtcaaatgttcaaaaaattgaacgtataccgtggttctgagcatccacacgaagcacaaaaacctgaagtttacgaacttcgcggttaa

SEQ ID NO: 31695 - protein, 145 aa, Bacillus subtilis
MRTTPMANASTIERKCLVVDAAGKTLGRLSSEVAAILRGKHKPTYTPHVDTGDHVIIINAEKIELTGKKLTDKIYYRHTQHPGGLKSRTALEMRTNYPEKMLELAIKGMLPKGSLGRQMFKKLNVYRGSEHPHEAQKPEVYELRG

SEQ ID NO: 31696 - DNA, 450 bp, Thermotoga maritima
  CDS (1)..(450)
atggctaggtactttcctgttcagaagacaactatgataaaacccgaagaggttgaaagaaaatggtacgtggtagatgcttccggaaaggttctcggaagactcgcgacgcgcatagcgaagatattgatggggaaacacaagcccaattacactccgcacgttgacacgggagattacgtcatcgttgtgaacgctgacaaggtggttcttaccggaaagaagctcgatcagaaggtttattactggcattctggttatcccggaggtctgaagtctctgacagcaagacagatgctggaaaagcatcccgaaagactcatatggctcgctgtcaaaaggatgctcccgaagaacagaaagggcagaaaaatgctcaaaagactcaaagtttatgcgtcacccgaacatccacatcaggcacagaaacctgagcctattgaactgtga

SEQ ID NO: 31697 - protein, 149 aa, Thermotoga maritima
MARYFPVQKTTMIKPEEVERKWYVVDASGKVLGRLATRIAKILMGKHKPNYTPHVDTGDYVIVVNADKVVLTGKKLDQKVYYWHSGYPGGLKSLTARQMLEKHPERLIWLAVKRMLPKNRKGRKMLKRLKVYASPEHPHQAQKPEPIEL

SEQ ID NO: 31698 - DNA, 468 bp, Aeropyrum pernix
  CDS (1)..(468)
atgctgttggccggcggagaggctagggagattgttgtagacgggtccggcatgataatgggccgcctggccagcgttgtagccaaactcctgctggccgggtggcgtgtgaatgtggtgaacgccgagaagatcgtgttgagcggggatcctaggatggttgtcgagagttataggacgacagtacttggcgtgaagagccacttcagccataagtggaggcccaagaggcctagaacgcctcagaggctctttaaacacgccgtaagaggcatgctgccgaagaacaaggcgagggggaggagggctctcgcgaggctcagggtttatgtcggggtgcccgacgagcttaaaggcagggagttcgtgaggttccccgaggccgatgcctccaggctaagctctcactacatagagcttggtgccgttgcgaggcagctcgggtggaaggggggtgttgagaagtga

SEQ ID NO: 31699 - protein, 155 aa, Aeropyrum pernix
MLLAGGEAREIVVDGSGMIMGRLASVVAKLLLAGWRVNVVNAEKIVLSGDPRMVVESYRTTVLGVKSHFSHKWRPKRPRTPQRLFKHAVRGMLPKNKARGRRALARLRVYVGVPDELKGREFVRFPEADASRLSSHYIELGAVARQLGWKGGVEK

SEQ ID NO: 31700 - DNA, 450 bp, Chlamydophila pneumoniae, Chlamydia pneumoniae
  CDS (1)..(450)
atggaaaaaagaaaagacacaaaaacaactatagtaaagtccagtgaaactacgaagtcatggtatgttgttgatgctgctgggaaaaccttaggaaggctttcttcagaagtggcaaaaattttaagaggcaagcataaagtcacctatactcctcatgtggctatgggagacggtgttattgttattaatgcagagaaggttcgcctaactggagctaagaaaggccaaaaaatctatcgctactacacaggatatatctctggaatgcgagaaattccttttgaaaatatgatggcgagaaaacctaattacattattgagcatgcgatcaagggaatgatgcccagaactcgcttaggaaagaaacaattgaagtccttaaggattgtaaaaggggattcatacgaaacttttgaatctcaaaagccaattttattagatatttaa

SEQ ID NO: 31701 - protein, 149 aa, Chlamydophila pneumoniae, Chlamydia pneumoniae
MEKRKDTKTTIVKSSETTKSWYVVDAAGKTLGRLSSEVAKILRGKHKVTYTPHVAMGDGVIVINAEKVRLTGAKKGQKIYRYYTGYISGMREIPFENMMARKPNYIIEHAIKGMMPRTRLGKKQLKSLRIVKGDSYETFESQKPILLDI

SEQ ID NO: 31702 - DNA, 435 bp, Mycoplasma pulmonis
  CDS (1)..(435)
atgagacaaactactattgttaaacataaagaagttaacaaaaaatgattccttattgatgcagatggtgtagttttgggaaagttagctactttaacagcatcaattttaagaggaaaaaataagcctgattttacacccaacgttgatatgggagacaacattgtaataattaatgccgaaaaagttgtattaacagctaataaagaagaggataaaaaatactactctcactctggatatcctggagggctaaaagtaattaatgcagctaagctaagagctaaaaaaccaattgcaattgttgaaaaagcggttaaaggaatgcttccacatacaaaattaggtagacaacaatttagaaacttgtatgtctatgctggaagtgtacataagcaagaggcacaacagccagtaagaattgaggttaaataa

SEQ ID NO: 31703 - protein, 144 aa, Mycoplasma pulmonis
MRQTTIVKHKEVNKKWFLIDADGVVLGKLATLTASILRGKNKPDFTPNVDMGDNIVIINAEKVVLTANKEEDKKYYSHSGYPGGLKVINAAKLRAKKPIAIVEKAVKGMLPHTKLGRQQFRNLYVYAGSVHKQEAQQPVRIEVK

SEQ ID NO: 31704 - DNA, 447 bp, Streptococcus pneumoniae
  CDS (1)..(447)
atgaacaaaacaacatttatggctaaaccaggccaagttgaacgtaaatggtacgtagttgacgcaactgatgtaccacttggacgtctttctgcagtagttgctagcgtacttcgcggaaaaaacaaaccaacatttacaccacacactgatacaggtgacttcgtgattgttatcaatgctgaaaaagttaaattgactggtaaaaaagcaactgataaaatctactacactcactcaaaccacccaggtggattgaaacaaatctctgcaggtgaacttcgttctaaaaatgcagtacgtttgattgagaaatcagttaaaggtatgcttccacacaatacacttggacgcgctcaaggtatgaagttgaaagtatttgttggagctgagcacactcatgctgcacaacaaccagaagttcttgacatttcaggacttatctaa

SEQ ID NO: 31705 - protein, 148 aa, Streptococcus pneumoniae
MNKTTFMAKPGQVERKWYVVDATDVPLGRLSAVVASVLRGKNKPTFTPHTDTGDFVIVINAEKVKLTGKKATDKIYYTHSNHPGGLKQISAGELRSKNAVRLIEKSVKGMLPHNTLGRAQGMKLKVFVGAEHTHAAQQPEVLDISGLI

SEQ ID NO: 31706 - DNA, 435 bp, Aquifex aeolicus
  CDS (1)..(435)
atgaagacatacaggattaagcccgaagaagtggaaagaaagtggtgggtagtggacgcaacgggaaagactctgggaagacttgcaagcgaaatagctaaaattttgaggggaaagcacaaaccttactatcagccggacgttgattgcggtgatttcgtaatagttataaacgcggagaagataagagttacgggtaagaaactcgagcagaagaagtattactggcacagcagataccccggaggattgaaggagagaaccctcaagtggatgctcgaaaacaaacccgaagaggttataagactcgcggtaaagaggatgcttcccaaaaacagactcggacacagaatgcttaagaagttaaaagtttacaggggacctgagcatccccaccaagctcaaaaaccccagcctctggaggttaaagcatga

SEQ ID NO: 31707 - protein, 144 aa, Aquifex aeolicus
MKTYRIKPEEVERKWWVVDATGKTLGRLASEIAKILRGKHKPYYQPDVDCGDFVIVINAEKIRVTGKKLEQKKYYWHSRYPGGLKERTLKWMLENKPEEVIRLAVKRMLPKNRLGHRMLKKLKVYRGPEHPHQAQKPQPLEVKA

SEQ ID NO: 31708 - DNA, 438 bp, Bacillus halodurans
  CDS (1)..(438)
atgcgtacaacatatatggcaaagccaaacgaagttgagcgtaagtggtacgtggttgacgcagaaggtcaaacgcttggtcgtttagcttctgaagtggcttccatcttacgtggaaagcacaagccaacttacactccacatgtagatacaggtgaccatgtcatcattatcaatgcggagaaaattcatttaactggaaacaagcttcaagacaagatctactatcgtcacagcggtcatccaggcggtcttaaagaaacgcgcgcggcagatatgcgtgcaaacaagcctgaaaaaatgcttgagcttgccatcaaaggcatgcttccaaagaacacgcttggacgtaagcaaggcatgaaacttcatgtttatgcaggtagcgaacataagcaccaagcacaaaaaccagaagtgtacgaacttcgcggataa

SEQ ID NO: 31709 - protein, 145 aa, Bacillus halodurans
MRTTYMAKPNEVERKWYVVDAEGQTLGRLASEVASILRGKHKPTYTPHVDTGDHVIIINAEKIHLTGNKLQDKIYYRHSGHPGGLKETRAADMRANKPEKMLELAIKGMLPKNTLGRKQGMKLHVYAGSEHKHQAQKPEVYELRG

SEQ ID NO: 31710 - DNA, 438 bp, Staphylococcus carnosus
  CDS (1)..(438)
atgcgtcaaacatttatggctaatgaatcaaacattgagcgcaaatggtatgttatcgatgcagcaggccaaactttaggtcgcttatcatcagaagtagcatctattttacgcggaaaacataaagcaacttatactccacacgttgacagtggtgactacgtaatcatcatcaacgctggacaaatcgaaatgacaggtaaaaaagcttcagacaaagtttactaccgtcactctaactacccaggtggaattaaatcaatcacagctggtgaattaagagagaaaaacccagaacgtttacttgaaatttcaatcaaaggcatgttaccaagcagccgtttaggtgaaaaacaaggtaaaaaattatttgtatatggtggcgctgaacatccacacgctgcacaacaaccagaaaactacgagttacgtggttaa

SEQ ID NO: 31711 - protein, 145 aa, Staphylococcus carnosus
MRQTFMANESNIERKWYVIDAAGQTLGRLSSEVASILRGKHKATYTPHVDSGDYVIIINAGQIEMTGKKASDKVYYRHSNYPGGIKSITAGELREKNPERLLEISIKGMLPSSRLGEKQGKKLFVYGGAEHPHAAQQPENYELRG

SEQ ID NO: 31712 - DNA, 438 bp, Sulfolobus acidocaldarius
  CDS (1)..(438)
atgagtagtcaggaagagatagttattgtagacgcaacaaaccaaatattaggaagaatgtcaacccacatagctaagttattgaagtcaggtaagaaggtctatgtggtgaatgctgaaaaagcgataataagtggtcctagatctagggttctagagggctactcccttctatttactgtaaagactatgcaaaatccttacaggcaaggaattagaagacccagaaatccaataaacatagtgaagagaacagtgagagggatgcttcctaaaaataaattaggaaagcaaatttacaggaatctcaaagcatatatcggaattctggaaggtaaatctatgattagatttgacgatgctgatgttagtaggttaaaaggtaaatatataactgttgcagagttatcaagattattaggtgggttaaagcaatga

SEQ ID NO: 31713 - protein, 145 aa, Sulfolobus acidocaldarius
MSSQEEIVIVDATNQILGRMSTHIAKLLKSGKKVYVVNAEKAIISGPRSRVLEGYSLLFTVKTMQNPYRQGIRRPRNPINIVKRTVRGMLPKNKLGKQIYRNLKAYIGILEGKSMIRFDDADVSRLKGKYITVAELSRLLGGLKQ

SEQ ID NO: 31714 - DNA, 492 bp, Saccharomyces cerevisiae
  CDS (1)..(492)
atgtcgcagaagattggacacagtggcttggcttttgcgcgcctttggcaccatgtcgacgttgcccgtgataagaggacattgggtagattggcttcagcaattgcaattaccttaattggtagacataagccggtctatcatccgtcacaagactgtggagactacgtagtagtgactaattgccaaaaaatccgtgtaacaggtaagaaatttgagcagaagacttactggtctcattcaggtagacctggtcagctaaagttacagacaatgaacaaggttgttgccgataaaggatttggagaaattttgaaaaaagcagttagcggtatgttgcctaaaaataaattgagaaagcaacggttagaccgcttaaaagttttcgatggaagtgaaaacccttataaacaaaatattactgcctttgcccatgagcaatcatcaataccagagcctcttaaagaatcaatttttaaccaattgaaatag

SEQ ID NO: 31715 - protein, 163 aa, Saccharomyces cerevisiae
MSQKIGHSGLAFARLWHHVDVARDKRTLGRLASAIAITLIGRHKPVYHPSQDCGDYVVVTNCQKIRVTGKKFEQKTYWSHSGRPGQLKLQTMNKVVADKGFGEILKKAVSGMLPKNKLRKQRLDRLKVFDGSENPYKQNITAFAHEQSSIPEPLKESIFNQLK

SEQ ID NO: 31716 - DNA, 444 bp, Mycobacterium leprae
  CDS (1)..(444)
atgcctacatacgcgcccaaggcgggtgacaccacgtgttcgtggtacgtcatcgacgccacggacgtggtgcttggccgccttgccgctgtagcggccactctgttgcgcggcaagcacaagcccacgttcgctcctaatgttgatggcggtgactttgtcatcgtgatcaacgccgacaaggtcgccatcagcggcgataaagtacagcataagatggtttaccgccactcggggtatcccggcggcttgcgcaaacgcaccattggcgagctgatgcaaaagcaccccgaccgcgtcgtagagaaagccatcgttggcatgctgcccaaaaacaagcttagccgccagatccagcgcaagcttcgtgtctacgccggaccagatcatccacattccgctcagcaaccggttccattcgaaatcaagcaggtagcgcagtga

SEQ ID NO: 31717 - protein, 147 aa, Mycobacterium leprae
MPTYAPKAGDTTCSWYVIDATDVVLGRLAAVAATLLRGKHKPTFAPNVDGGDFVIVINADKVAISGDKVQHKMVYRHSGYPGGLRKRTIGELMQKHPDRVVEKAIVGMLPKNKLSRQIQRKLRVYAGPDHPHSAQQPVPFEIKQVAQ

SEQ ID NO: 31718 - DNA, 429 bp, chloroplast Porphyra purpurea
  CDS (1)..(429)
atgaataaaacacaagtcccatcactaattaccagccaaagctggtatgttatagatgctaaaaatcagaagcttggtcgtatgtccactcatatctctaatattttaagaggtaaaaataaaccttcatatactccttatttagatacaggagattacgtaattgttattaattcatctgaagtatctgttagcggaaataaaacaactcaaaaactgtatagaaggcattctggccaaccaggaggattaaaagttgaaacatttgaacaactgcaaacaagattacctaatcgaattgttgaaaaatcagtaaaaggtatgttgcccaaaggtccattaggccgaaaattatttacaaaactaaaagtctacccaggaccatctcatcctcatgctgcacagaaaccgcaagagtatatggtataa

SEQ ID NO: 31719 - protein, 142 aa, chloroplast Porphyra purpurea
MNKTQVPSLITSQSWYVIDAKNQKLGRMSTHISNILRGKNKPSYTPYLDTGDYVIVINSSEVSVSGNKTTQKLYRRHSGQPGGLKVETFEQLQTRLPNRIVEKSVKGMLPKGPLGRKLFTKLKVYPGPSHPHAAQKPQEYMV

SEQ ID NO: 31720 - DNA, 450 bp, Sulfolobus solfataricus
  CDS (1)..(450)
atgagcacgcaagttcaagagcaagtggtcataattaacgcagaaggtcagatcttaggtaggatggctagtaacgtagttaggcttttaaaggaaggcaaaaaggtaattatagtaaatggggagaaagcggtaataagtggagagaagaacagagttattgagtcttacaaattacttttaaccgtaaaaacgctttttaatccttatagaaatgggattagaaggcctagatcaccaataaatatagtgaaaaggactataagaggaatgctacctaaaagcagtaaaggacgtagaatgttaaagaacgttaagatatatgttggggtgccaaaagaattcgaggggagacaatttattaaattcccagactctgatgtgagtagacttaaaggtaagtatgttacagtagaagtggtttcaaaagagctagggtggagtggatga

SEQ ID NO: 31721 - protein, 149 aa, Sulfolobus solfataricus
MSTQVQEQVVIINAEGQILGRMASNVVRLLKEGKKVIIVNGEKAVISGEKNRVIESYKLLLTVKTLFNPYRNGIRRPRSPINIVKRTIRGMLPKSSKGRRMLKNVKIYVGVPKEFEGRQFIKFPDSDVSRLKGKYVTVEVVSKELGWSG

SEQ ID NO: 31722 - DNA, 456 bp, Synechocystis sp
  CDS (1)..(456)
atgaacaaaactgtattaccaaccatcgacaacctagaccacaaatggtacgtcattgatgccgaaggtcaacgcctcggccgtctggctaccgaagtggccaccattctgcggggcaaaaataagcctacctttactccccacatggacaccggtgattttgtcattatcattaatgcggaaaaaatagaagttaccggcagaaaacgggagcaaaaactgtatcgtcgccattctggccgtcccggtgggatgaaggaagagacctttgaaaaactccaagttcgtctaccggaaagaattgttgaaagtgctgtgcggggaatgttgcccaaaaatagcctcggtcgtaagttgttcaccaagctaaaagtctacgctggcccgagccatccccacgcggcccaacagccagaaacccttgttatcaataccattcctgcaggagctaactaa

SEQ ID NO: 31723 - protein, 151 aa, Synechocystis sp
MNKTVLPTIDNLDHKWYVIDAEGQRLGRLATEVATILRGKNKPTFTPHMDTGDFVIIINAEKIEVTGRKREQKLYRRHSGRPGGMKEETFEKLQVRLPERIVESAVRGMLPKNSLGRKLFTKLKVYAGPSHPHAAQQPETLVINTIPAGAN

SEQ ID NO: 31724 - DNA, 420 bp, chloroplast Odontella sinensis
  CDS (1)..(420)
atgaatgaaacatttatcccagcttctgattataaaaaaaaaaattggtgtttaattgattgtaaagatcaaaaattaggacgaattgctgttgtgattagtcgtcttttatctggtaaacaaaaattacattatcatccagcttttgatgttggtgattatgtagtagtaataaatgcacaagatatgattttcgatagtcaacaaccaagattttctgtaaatgtacctggccgacctggtcgtcttttaaaacaagtaattaatgctttaccatcacaattattaatgactgctatttacggtatgctgccagaaggatcagctaaaaaaagtcttccaaaacgactaaagatttataatggccctgatcacccacatgcagcacaaaatccaataaaattggatgaatttatataa

SEQ ID NO: 31725 - protein, 139 aa, chloroplast Odontella sinensis
MNETFIPASDYKKKNWCLIDCKDQKLGRIAVVISRLLSGKQKLHYHPAFDVGDYVVVINAQDMIFDSQQPRFSVNVPGRPGRLLKQVINALPSQLLMTAIYGMLPEGSAKKSLPKRLKIYNGPDHPHAAQNPIKLDEFI

SEQ ID NO: 31726 - DNA, 444 bp, Streptomyces coelicolor
  CDS (1)..(444)
atgcgtacgtacagccccaagcccggcgatgtgacgcgccagtggcacgtcatcgacgcccaggacgtcgtcctgggtcgtctggccaccactgcggcctccatcctgcgcggcaagcacaagccgatctacgcgccccacgtcgacaccggtgacttcgtcatcatcatcaacgccgacaaggtgcacctctccggcaacaagcggacccagaagatggcgtaccgccactccggctacccgggcggtctgcgctccgtgcgctacgacgagctcctggacaagaacccggagaaggccgtcgagaaggccatcaagggcatgctcccgaagaactccctgggccgtcagatgctctcgaagctgaaggtctacaagggtgaccagcacccgcacggcgcgcagcagccgcagccgttcgagatcacccaggtcgcgcagtag

SEQ ID NO: 31727 - protein, 147 aa, Streptomyces coelicolor
MRTYSPKPGDVTRQWHVIDAQDVVLGRLATTAASILRGKHKPIYAPHVDTGDFVIIINADKVHLSGNKRTQKMAYRHSGYPGGLRSVRYDELLDKNPEKAVEKAIKGMLPKNSLGRQMLSKLKVYKGDQHPHGAQQPQPFEITQVAQ

SEQ ID NO: 31728 - DNA, 474 bp, Schizosaccharomyces pombe
  CDS (1)..(474)
atgtcaacgttgaatggacaaacagcattggcttacgccaaagtttggcatcatgtttctgcaaaaaatgttcctctaggtaggctggcttcccaaattgcaactactcttatgggcaagcacaaacccatttatcaccctgcagcagactgtggagatgtcgtagtagtcactgactgttctgaaattgggatttctggtcgaaaactcgaaaatcataaatattattcacattcgggtcagcctggtcatcttaaagagtggacgatggaagaaatggctgcgaaacgggggcacaaggatttgttgagaagagcagttggtggaatgcttccaagaaataagctttgggataggagaatgaaacgtctttatatttacgatggagctgaacacccttataaggcaaacatatttcgttcctaccataatcctgtaagttcgcaaattgcgaaggaattattctcgaaataa

SEQ ID NO: 31729 - protein, 157 aa, Schizosaccharomyces pombe
MSTLNGQTALAYAKVWHHVSAKNVPLGRLASQIATTLMGKHKPIYHPAADCGDVVVVTDCSEIGISGRKLENHKYYSHSGQPGHLKEWTMEEMAAKRGHKDLLRRAVGGMLPRNKLWDRRMKRLYIYDGAEHPYKANIFRSYHNPVSSQIAKELFSK

SEQ ID NO: 31730 - DNA, 540 bp, Burkholderia mallei ATCC 23344
  CDS (112)..(540)
atgcccacggaaaaagaacagggagagcctgcatcgcgccacgaagcgcctgccaagagcagacaagcagggaagaacgtttgggcacaagcaatcaattttggatcgatcatgaagacgttttccgcaaaagcccatgaggtgacgcgcgaatggtacgtgattgacgcgacggataaggttctcggccgtgtcgccagcgaagtggcacgccgtctgcgcggcaagcacaagcccgagttcactccgcacgtcgacaccggtgatttcatcatcgtcatcaacgcgagcaagctgaaggtcacgggcaacaagacgctggacaagaagtactaccgtcactcgggctacccgggcggcatctatgaaacgacgttcggcaagatgcaggaacgcttcccgggccgcgcgctcgagaaggcggtcaagggcatgctgccgaagtgcccgctcggctacgcgatgatcaagaagctgaaggtctacgctgaagccacgcatccgcattcggctcaacagccgaaggcgcttgagatctag

SEQ ID NO: 31731 - protein, 142 aa, Burkholderia mallei ATCC 23344
MKTFSAKAHEVTREWYVIDATDKVLGRVASEVARRLRGKHKPEFTPHVDTGDFIIVINASKLKVTGNKTLDKKYYRHSGYPGGIYETTFGKMQERFPGRALEKAVKGMLPKCPLGYAMIKKLKVYAEATHPHSAQQPKALEI

SEQ ID NO: 31732 - DNA, 438 bp, Bacillus cereus ZK
  CDS (1)..(438)
atgcgtacgacttttatggcaaaagctaacgaagttgagcgtaaatggtatgtggttgatgctgaaggtcaaactttaggtcgccttgctagtgaagtagcatccattttacgtggtaaaaacaaacctacatttacaccacacgttgacacgggtgatcatgtaattattattaacgctgagaaaattcatttaacaggtaataaattgaacgataaaatgtactaccgtcacactaaccacccaggtggacttaaacaaagaacagctcttgtgctgcgtacaaactaccctgtacaaatgttagagcttgcaattaaaggcatgcttccaaaaggacgcttaggccgtcaagtttctaagaaactaaacgtgtatgctggagcagagcatccacaccaagcacaaaaaccagaagtttacgaacttcgcggataa

SEQ ID NO: 31733 - protein, 145 aa, Bacillus cereus ZK
MRTTFMAKANEVERKWYVVDAEGQTLGRLASEVASILRGKNKPTFTPHVDTGDHVIIINAEKIHLTGNKLNDKMYYRHTNHPGGLKQRTALVLRTNYPVQMLELAIKGMLPKGRLGRQVSKKLNVYAGAEHPHQAQKPEVYELRG

SEQ ID NO: 31734 - DNA, 462 bp, Bacteroides fragilis
  CDS (1)..(462)
atggatactttaagttacaagaccatttctgcaaacaaggcaactgtaaccaaagaatgggttatcgttgatgctacagaccaaactttaggtcgtctgggagcaaaagttgcgaaactgttgagaggaaagtataaaccaaactttactcctcatgtagactgcggtgataacgttattatcatcaatgcagacaaagttaaattaagtggtaacaaatggaatgacagagtttatttgtcttatactggctacccgggtggtcagagagaaatgactcctgctcgtttgatcgccaaacctaacggtgaagacagattactgagaaaagtagtgaagggcatgcttccgaagaacagactgggagctaagttgctgagcaatatgtatgtttacgcaggtagcgaacacaaacatgatgctcagaacccgaaagcaattgatataaactcacttaaataa

SEQ ID NO: 31735 - protein, 153 aa, Bacteroides fragilis
MDTLSYKTISANKATVTKEWVIVDATDQTLGRLGAKVAKLLRGKYKPNFTPHVDCGDNVIIINADKVKLSGNKWNDRVYLSYTGYPGGQREMTPARLIAKPNGEDRLLRKVVKGMLPKNRLGAKLLSNMYVYAGSEHKHDAQNPKAIDINSLK

SEQ ID NO: 31736 - DNA, 438 bp, Bacillus licheniformis DSM 13
  CDS (1)..(438)
atgcgtacaacacctatggctaacgcaagtaatattgaacgcaagtggttagttgttgatgctgctggcaagacgctaggacgtctttctactgaagttgcatctatccttcgcggaaaacataaaccaacttacacaccacacgttgacactggagatcatgtgatcatcatcaacgctgaaaaaatcgagttaactggtaaaaagttaacggacaaaatctactaccgtcacactcaacatccaggcggtttaaaatcaagaactgctcttgaaatgcgtacaaactaccctgagaaaatgcttgaacttgcgatcaaaggcatgcttccaaaaggttctctaggtcgtcaaatgttcaaaaaattgaatgtataccgtggttctgagcatccacaccaagcacaaaaacctgaagtttacgaacttcgcggttaa

SEQ ID NO: 31737 - protein, 145 aa, Bacillus licheniformis DSM 13
MRTTPMANASNIERKWLVVDAAGKTLGRLSTEVASILRGKHKPTYTPHVDTGDHVIIINAEKIELTGKKLTDKIYYRHTQHPGGLKSRTALEMRTNYPEKMLELAIKGMLPKGSLGRQMFKKLNVYRGSEHPHQAQKPEVYELRG

SEQ ID NO: 31738 - DNA, 444 bp, Mannheimia succiniciproducens MBEL55E
  CDS (1)..(444)
atggtaattaaattaatgaaaacttttgtagcaaaaccggaaacagttaaacgtgactggtatgtagtagatgcgacaggtaaaacgttaggtcgtttagcgaccgaattagcgagtcgccttcgtggtaaacataaagctgagtacactccgcacgtagatacaggtgattatatcatcgttatcaatgcggataaagtagcggtaacaggtcgtaaagaaaccgataaagtttactactggcacactggttatgtcggcggtattaaacaagcgacttttaaagaaatgattgctcgccgtccggaagcagtgattgagattgcggttaaaggtatgttgccaaaaggtccgttaggccgtgcaatgttccgtaaattaaaagtgtacgcaggttcacaacatgaacatgcagcacaacaaccacaagttttagatatctaa

SEQ ID NO: 31739 - protein, 147 aa, Mannheimia succiniciproducens MBEL55E
MVIKLMKTFVAKPETVKRDWYVVDATGKTLGRLATELASRLRGKHKAEYTPHVDTGDYIIVINADKVAVTGRKETDKVYYWHTGYVGGIKQATFKEMIARRPEAVIEIAVKGMLPKGPLGRAMFRKLKVYAGSQHEHAAQQPQVLDI

SEQ ID NO: 31740 - DNA, 465 bp, Borrelia garinii PBi
  CDS (1)..(465)
atgaagaaaataaccaataatgttacgatttggatcaagccaaagactgttgagaaaaaatggtatttaattgatgcagcagatagagttttaggtaaagttgctgtagatgttgttaggattttaagaggcaagcataaagcttattatactcctcatcaagatttaggtgataatgttattattattaatgcttctaaggttaggctgactggaaaaaaacatcaacaaaaactttattataggcactcaagatatccaggaggtctttattctgatacttttaaaacattgtcagagagaaagccttgtgcacctcttgagatcgctattaaaggtatgttgccaaaaggtcctttagggcgtgatctttttagaaatttaaaagtcttttctggttcagagcatactcttaaagctcaaaatcctataaagctggaagctaatttaagagaggtaaaatga

SEQ ID NO: 31741 - protein, 154 aa, Borrelia garinii PBi
MKKITNNVTIWIKPKTVEKKWYLIDAADRVLGKVAVDVVRILRGKHKAYYTPHQDLGDNVIIINASKVRLTGKKHQQKLYYRHSRYPGGLYSDTFKTLSERKPCAPLEIAIKGMLPKGPLGRDLFRNLKVFSGSEHTLKAQNPIKLEANLREVK

SEQ ID NO: 31742 - DNA, 432 bp, Symbiobacterium thermophilum
  CDS (1)..(432)
atgaacaagacttacatggccaatccgcagaatgtggagcggaagtggtatgtggtcgacgccgaaggcaagaccctcgggcggttggccagcaaggtggctgccattctgcgcggcaagcataagcccacgtttaccccgcacgttgattgcggtgattttgtcatcatcgtcaatgccgagaagatccaggtgaccggcaagaaggtcacggacaaggtctactaccgtcactccggttatccgggcggacagaaggccacgaccttcgagcagatgatcgcgaggcggcctgagcgcgtccttgagctcgccatcaaaggcatgcttccgcacaaccggctgggcaggcagatgtaccgcaagctgaaggtgtacgccggtcccgagcacccgcatgcggcgcagaagcccgagccgcttgaggtctaa

SEQ ID NO: 31743 - protein, 143 aa, Symbiobacterium thermophilum
MNKTYMANPQNVERKWYVVDAEGKTLGRLASKVAAILRGKHKPTFTPHVDCGDFVIIVNAEKIQVTGKKVTDKVYYRHSGYPGGQKATTFEQMIARRPERVLELAIKGMLPHNRLGRQMYRKLKVYAGPEHPHAAQKPEPLEV

SEQ ID NO: 31744 - DNA, 468 bp, Rickettsia typhi
  CDS (1)..(468)
atgaaaacttattcagcaaaaccatcggaaattgaaaagaaatggtgggtcattgatgcaaaaaatattgtactagggcgccttgctagcagagttgctattatgctacgaggcaaacataaacctagctttacacctcatttagattgtggtgataatataattataataaatgcagaacatataaaattaacaggtaaaaaactgaatcataaagatgggaaagtatattatcgacatacaggatttccaggtggaataaaagatactacagcaggtaaaatcttaagtggtaaatatcctgagagagttattaaaatggctgtaaaaagaatgattacaagaaatgttttaggtgcgaagcaaatgagtaatttatatgtttatgcaaattgtgaacatccacatatggcacagcagcccactgtttatgattttgctagcaaaaatccaaaaaataaaaagtaa

SEQ ID NO: 31745 - protein, 155 aa, Rickettsia typhi
MKTYSAKPSEIEKKWWVIDAKNIVLGRLASRVAIMLRGKHKPSFTPHLDCGDNIIIINAEHIKLTGKKLNHKDGKVYYRHTGFPGGIKDTTAGKILSGKYPERVIKMAVKRMITRNVLGAKQMSNLYVYANCEHPHMAQQPTVYDFASKNPKNKK

SEQ ID NO: 31746 - DNA, 444 bp, Propionibacterium acnes
  CDS (1)..(444)
atgaccacctacagccccaaggtcggcgaggtgcagcgtaattggtacgtcattgacgccgaggacatcgtcctgggccgtctggctaccactgctgccaacctcctgcgcggcaagcacaagccgcagtacgccccccacatcgacaccggtgactttgtcgtcgtcgtcaacgcctctaagattgcgctgaccggcaagaaggccaccgactcactgcgttacgaccactccggacgcccgggcggcctgcgcgtcaccagcatcggcgagatgcttgcgaagaacccgcgccgtgccgtggagcgcgcggtgtggggcatgatgcccaagaacaagctgtcgcgtcagcagctcaagaagctgaaggtgtatggcggccctgagcatccgcacgctgcgcagaacccgcagccttacgagatcacccagatcgcccagtga

SEQ ID NO: 31747 - protein, 147 aa, Propionibacterium acnes
MTTYSPKVGEVQRNWYVIDAEDIVLGRLATTAANLLRGKHKPQYAPHIDTGDFVVVVNASKIALTGKKATDSLRYDHSGRPGGLRVTSIGEMLAKNPRRAVERAVWGMMPKNKLSRQQLKKLKVYGGPEHPHAAQNPQPYEITQIAQ

SEQ ID NO: 31748 - DNA, 447 bp, Leifsonia xyli
  CDS (1)..(447)
atgacgcgcacttactccccgaaggcagacgagatccagcgcgactgggtcgtcatcgacgcgaccaatgtcgtgctcggccgtctcgccagccacaccgccgccctcctgcgcggcaagcacaaggcgaccttcgccccccacatggacacgggcgacttcgtcatcatcgtcaacgcggacaaggttgccttcaccggccagaaggtcgcgcagaagaaggcctaccgccactccggctacccgggtgggctcaaggccgtcacctacgccgagctcctcgagaagaatccggttcgcgccgtcgagaaggctgtgcgcgggatgctgccgaagaactccatcggccgggcccagttccgcaagctgaaagtctacaccggaagcgagcacccgcacgccgcccagcagcccaaggcctacgccctcggccaggtcgcccagtag

SEQ ID NO: 31749 - protein, 148 aa, Leifsonia xyli
MTRTYSPKADEIQRDWVVIDATNVVLGRLASHTAALLRGKHKATFAPHMDTGDFVIIVNADKVAFTGQKVAQKKAYRHSGYPGGLKAVTYAELLEKNPVRAVEKAVRGMLPKNSIGRAQFRKLKVYTGSEHPHAAQQPKAYALGQVAQ

SEQ ID NO: 31750 - DNA, 429 bp, Desulfotalea psychrophila
  CDS (1)..(429)
atgaaaacctatcttgctccagtcaacgagatcgagaaagagtggtatgttgtcgatgcagagaacaaggtactgggacgcttggcctctgagatcgcttctcgacttcgcggtaagcataaacctacattttcatcatttattgataacggtgatttcattgtagtgacaaatgctgagaaaatcgcgcttaccggtaagaagtgggacgacaagacatattatcgtcatactggatatattggtggcattaaagaaaccagtgctaaagaacttcttgaaaaacatccaaccgaccttatcactaaggcagttcgaggcatgctccctaagaacaaaatgggcagagcacaacttaagaagctcaaggtgtatgttggagcagctcatccacatgcagctcagcaacctactgttttagacatttaa

SEQ ID NO: 31751 - protein, 142 aa, Desulfotalea psychrophila
MKTYLAPVNEIEKEWYVVDAENKVLGRLASEIASRLRGKHKPTFSSFIDNGDFIVVTNAEKIALTGKKWDDKTYYRHTGYIGGIKETSAKELLEKHPTDLITKAVRGMLPKNKMGRAQLKKLKVYVGAAHPHAAQQPTVLDI

SEQ ID NO: 31752 - DNA, 432 bp, Gracilaria tenuistipitata var
  CDS (1)..(432)
atgaataagacatatttagctccaacaaagaattatagtacatggtatattattgatgctaaaaataaaaatttaggtaggcttagtagtaaaatagctaaattactaagaggtaaaaattcaatttcttttacaccatatgttaataataaaatatatataatattaataaattcacgatcaatcaatgttacaggtaaaaaatttgttcaaaaaacatataaacgacattctggttacccaggaggattaaaagtccaaaaatttaatgaaattttaaatcaaagaccaaatagaatcttggaaaaatccattaaaggcatgctgccaaaagggattttaggtagacaattatttagacagctaaaaatctatccagataacatacatcctcatgaatcacaacaaccaaaaataataacatttatttaa

SEQ ID NO: 31753 - protein, 143 aa, Gracilaria tenuistipitata var
MNKTYLAPTKNYSTWYIIDAKNKNLGRLSSKIAKLLRGKNSISFTPYVNNKIYIILINSRSINVTGKKFVQKTYKRHSGYPGGLKVQKFNEILNQRPNRILEKSIKGMLPKGILGRQLFRQLKIYPDNIHPHESQQPKIITFI

SEQ ID NO: 31754 - DNA, 525 bp, Debaryomyces hansenii CBS767
  CDS (1)..(525)
atgtctcagagaattggtaattcggctcttgctttatcaagggtatggcatcatgtcgatgttgctgctgatgaaagaactttaggtcgtatagcatcaagcatagcattaacgttacaagggaaacataagccaacgttctcgccaaatagagaccacggtgactacgttgtcgtcaccaactgtgcacatttgaaagtaaccggtaataaattacaagacagaacttactggtcgcatagcactcgtcctggttcattaaaattggtgcctatggagaggatgatcgctaacaaagggtacgcagaagtattgagaagagcagtaaaagggatgatcccaaagaataaattgagactcatcagaatggatagattgaaactttatgatggagatgaacatccttataagcaaaacttgattgcatacgctgacgagatgaaggagatgaagagtaaattagctgaattaaacagaaaagaaaaggcaatgcaagatcttcgtgcaaagtatttggaaagttag

SEQ ID NO: 31755 - protein, 174 aa, Debaryomyces hansenii CBS767
MSQRIGNSALALSRVWHHVDVAADERTLGRIASSIALTLQGKHKPTFSPNRDHGDYVVVTNCAHLKVTGNKLQDRTYWSHSTRPGSLKLVPMERMIANKGYAEVLRRAVKGMIPKNKLRLIRMDRLKLYDGDEHPYKQNLIAYADEMKEMKSKLAELNRKEKAMQDLRAKYLES

SEQ ID NO: 31756 - DNA, 468 bp, Kluyveromyces lactis NRRL Y
  CDS (1)..(468)
atgtctcaaaaggtaggacatactggtttggcatttgccaggatgtggcatcatgttgatatatccaaggacaagagaacgcttggtagggtggcatctcaggttgctctagcgttaatggggaagcacaagccagtgtatcatccatctgctgattgcggtgattatgttgtggtaacgaactgccaagctttgcgtgtgacggggaacaagatgacccaaaagacgtactggtcgcatacttctagaccaggttcattaaagttgactacaatggaagacatgatcagtaacaagggttacagtgaagttttgaagaaggctgtgtccggaatgcttcccaagaataaacttcgtaagatcagacttgctagattaaaaattttcgatggaagtgaacatccatacaagagtaatatcaccgcatttgctgatcagcaactagagctgcaacaccagaagaaatag

SEQ ID NO: 31757 - protein, 155 aa, Kluyveromyces lactis NRRL Y
MSQKVGHTGLAFARMWHHVDISKDKRTLGRVASQVALALMGKHKPVYHPSADCGDYVVVTNCQALRVTGNKMTQKTYWSHTSRPGSLKLTTMEDMISNKGYSEVLKKAVSGMLPKNKLRKIRLARLKIFDGSEHPYKSNITAFADQQLELQHQKK

SEQ ID NO: 31758 - DNA, 453 bp, Mesoplasma florum
  CDS (1)..(453)
atgaaacaaacaacattaattgctgcaaaagacatcaaaaaaaattgatatatcgttgatgcagcaggacaaaatgtggggagattatctacagaagtagctagaatcttaagaggtaaacataaagttgacttcacacctcacatgaacaatggtgatcacgttatcatcattaacgctgagaaagtattatttactggtaaaaaagaatcagataaaacatactaccaccactcaatgcacccaggtggactaagaagaagaactgtagcagttcaaagagaattagacgcaactaaaattttagaacgttcaattcgtttgatgttaccaaaaaatgtacaaggaagaaatcaatttagagcattacacgtatttgttggtgaaaaccacccttacgcagctcaaaaaccagaagttttaacatttgtaaaaaaaggagataacaaataa

SEQ ID NO: 31759 - protein, 150 aa, Mesoplasma florum
MKQTTLIAAKDIKKNWYIVDAAGQNVGRLSTEVARILRGKHKVDFTPHMNNGDHVIIINAEKVLFTGKKESDKTYYHHSMHPGGLRRRTVAVQRELDATKILERSIRLMLPKNVQGRNQFRALHVFVGENHPYAAQKPEVLTFVKKGDNK

SEQ ID NO: 31760 - DNA, 429 bp, Acinetobacter sp
  CDS (1)..(429)
atgaaaactctcagcgctaagccagctgaagttcaacatgactggtatgttgttgatgcttctggcaaaactttaggtcgccttgcgactgaaatcgctcgtcgtttacgcggtaagcataaaacttcttatactcctcacgttgacactggcgattacatcgttgtgattaatgctgaacaagttcaagtgactggtaaaaaatcacttgataagaaatattatcgccatactggtttccctggtggtatccgtgagactaacttcgagaagttaatcgctcacaaacctgaagctgttcttgaaaaagcagttaaaggcatgttacctaaaggtcctcttggttatgcaatgatcaaaaaaatgaaagtgtacgctggtactgagcatccgcatgctgctcaacagccacaagttttggacatctaa

SEQ ID NO: 31761 - protein, 142 aa, Acinetobacter sp
MKTLSAKPAEVQHDWYVVDASGKTLGRLATEIARRLRGKHKTSYTPHVDTGDYIVVINAEQVQVTGKKSLDKKYYRHTGFPGGIRETNFEKLIAHKPEAVLEKAVKGMLPKGPLGYAMIKKMKVYAGTEHPHAAQQPQVLDI

SEQ ID NO: 31762 - DNA, 504 bp, Candida glabrata CBS138
  CDS (1)..(504)
atgtctcagaaagttggacacacagggctagcgtttgccaggctatggcaccatgttgatttggctaaggataagagaacattaggtagggttgcctcttctatcgcggtgacacttataggtaagcacaagccagtatatcatccatctcaggattgtggtgattacgttgttgtgactaattgtcagaaagtgcgtataactggtaagaagtttgagcaaaagacttattggtcgcattcaactaaaccaggtaatttaaagttaacaacaatgaagaccatggctgagaataaaggctacggtgaacttttgaagaaagctgtatctggtatgttacccaaaaatagacttagaaaagtaagactagcaagactgaaagtatttgatggtgctgagcatccttacggtgacaattttactgcatatgccttgaaacagccaaaggtgcagaaattaatagaatctaggcaagagcgtacacaggtttcacaagaagcttga

SEQ ID NO: 31763 - protein, 167 aa, Candida glabrata CBS138
MSQKVGHTGLAFARLWHHVDLAKDKRTLGRVASSIAVTLIGKHKPVYHPSQDCGDYVVVTNCQKVRITGKKFEQKTYWSHSTKPGNLKLTTMKTMAENKGYGELLKKAVSGMLPKNRLRKVRLARLKVFDGAEHPYGDNFTAYALKQPKVQKLIESRQERTQVSQEA

SEQ ID NO: 31764 - DNA, 465 bp, Bartonella quintana
  CDS (1)..(465)
atggcaactttttcacaaaagccaactgaagtggtgaaaaaatgggttattattgatgcagagaaccttgttttaggtcgtcttgccgcattcgttgctaaccgcttacgtggcaaacataaagccacatttactccacatgttgatgatggtgacaatgttattgtaatcaatgcagataaaatagttcttactggcaagaaatatacagataaaaaatattattggcataccggctatattggtggaatcaaagaacgcaccgcacgtcagattcttgaaggacgttttcctgaacgcgttgttgaaaaagctgtagagcgtatgattcctcgtggaccgcttggtcgtcgccaattgaggaatctacatgtttatgctggaagtcaaaacccgcatgcggcgcaacagcccgaagctcttgacgttggtgctttaaaccgcaaaaacaaaaggattgcttga

SEQ ID NO: 31765 - protein, 154 aa, Bartonella quintana
MATFSQKPTEVVKKWVIIDAENLVLGRLAAFVANRLRGKHKATFTPHVDDGDNVIVINADKIVLTGKKYTDKKYYWHTGYIGGIKERTARQILEGRFPERVVEKAVERMIPRGPLGRRQLRNLHVYAGSQNPHAAQQPEALDVGALNRKNKRIA

SEQ ID NO: 31766 - DNA, 465 bp, Bartonella henselae
  CDS (1)..(465)
atggcaactttttcacaaaagccaactgaagtggtgaaaaaatgggttattattgacgcagagaacctcgttttaggtcgtcttgccgcatttgttgctaaccgcttacgtggcaaacataaagctacatttactccacatgttgatgatggtgacaatgttattgtgatcaatgcagacaaaatatctctcaccggaaagaaatatacagataaaaaatattattggcatacaggttatattggtggaattaagaagcgtacagcgcggcaaattcttgaaggacgttttcctgaacgtgttgttgaaaaggctgtggaacgtatgattcctcgtgggcctctcggtcgtcgccaattgaagaatctccgtgtttacgctggaagccagcacccgcatgcggcacaacaacccgaagctcttgacgttggtgctttaaatcgcaaaaacaaaaggattgcttga

SEQ ID NO: 31767 - protein, 154 aa, Bartonella henselae
MATFSQKPTEVVKKWVIIDAENLVLGRLAAFVANRLRGKHKATFTPHVDDGDNVIVINADKISLTGKKYTDKKYYWHTGYIGGIKKRTARQILEGRFPERVVEKAVERMIPRGPLGRRQLKNLRVYAGSQHPHAAQQPEALDVGALNRKNKRIA

SEQ ID NO: 31768 - DNA, 477 bp, Fremyella diplosiphon
  CDS (1)..(477)
atgacaaaggacaaattacaaatgactaaaacataccttcctcctcaagatgctcttgagcgtgagtggtacatagtagatgccacagatcaacgcctcggccgcctcgctagtgaaatcgctatggttttgcgaggcaaaaagaaagctgaatatactcctcacctagatacaggtgattttgtcattgttatcaatgctgagaaaatagcagttacaggtaaaaaacgtactcaaaagctctatcgtcgccattctggccgtcctggtggaatgaaaaccgaaacattcgcgaaactgcaacagcgtataccagaaagaattgtagaacacgctgttaaggggatgttacctaaaaatagcctgggtaagcagttgtttactaagctgaaagtctatgctgggccaactcacccccatgcagcgcaaaaacccaaagaacttaaagttaatacaattcctggagcagaaagttaa

SEQ ID NO: 31769 - protein, 158 aa, Fremyella diplosiphon
MTKDKLQMTKTYLPPQDALEREWYIVDATDQRLGRLASEIAMVLRGKKKAEYTPHLDTGDFVIVINAEKIAVTGKKRTQKLYRRHSGRPGGMKTETFAKLQQRIPERIVEHAVKGMLPKNSLGKQLFTKLKVYAGPTHPHAAQKPKELKVNTIPGAES

SEQ ID NO: 31770 - DNA, 435 bp, Mycoplasma mobile
  CDS (1)..(435)
atgagacaaacaacaattataagacataaagaaactgataaaaaatgatttgttgtagatgcagaaggtcaggtgctaggtcgtttagcatcggttgtagcatcttatttaagaggtaaaaataagcctacttttacaccaaatgttgatatgggtgataacattattgtaattaatgcagataaagttgtcctaacagcaaaaaaagaagatgacaaaatttattattcaagttctggttataatggtggtttaaaagcaattaatgcaagagatttaagagcaaaaaaaccatttgcgcttgttgaaaaagctgtaaaaggaatgattccgcatacaaaattaggtcgtaaacaattcgggaatttatatgtttatgcaggtagagagcacaatcatgaagctcaaaaaccagaagtattagaggttaaataa

SEQ ID NO: 31771 - protein, 144 aa, Mycoplasma mobile
MRQTTIIRHKETDKKWFVVDAEGQVLGRLASVVASYLRGKNKPTFTPNVDMGDNIIVINADKVVLTAKKEDDKIYYSSSGYNGGLKAINARDLRAKKPFALVEKAVKGMIPHTKLGRKQFGNLYVYAGREHNHEAQKPEVLEVK

SEQ ID NO: 31772 - DNA, 429 bp, Photobacterium profundum
  CDS (1)..(429)
atgaaaactttcgttgctaaaccagaaactgtaaaacgtgactggtatgttgttgacgctgaaggtaaaactcttggccgtctagcaactcaaatcgcatctcgtctacgtggtaagcataagccggagtacactccgcacgttgacactggtgactacattgtagttatcaacgctgaaaaagttgctgtaactggcgctaagagaactgacaagatgtaccaccaccacacaggtttcatcggtggtcttaagtcaatcagctttgaaaagcttatcgataagaagccagaaatggttatcgaaactgctgttaaaggcatgcttcctaagggtcctctaggccgtgcaatgtaccgtaaacttaaagtttatgcgggtactgagcacaaccatgctgcacagcagcctaaagtactagacatctaa

SEQ ID NO: 31773 - protein, 142 aa, Photobacterium profundum
MKTFVAKPETVKRDWYVVDAEGKTLGRLATQIASRLRGKHKPEYTPHVDTGDYIVVINAEKVAVTGAKRTDKMYHHHTGFIGGLKSISFEKLIDKKPEMVIETAVKGMLPKGPLGRAMYRKLKVYAGTEHNHAAQQPKVLDI

SEQ ID NO: 31774 - DNA, 432 bp, Parachlamydia sp
  CDS (1)..(432)
atgcaaaagacgtttactccgaataaaaatgaaataaaacttaagtggtttgttttagatgcaaccggaaagactttaggtcgcttgacatctgagattgcaaaaattcttcgtggaaagcataaacctacttacacaacttatatggattgtggagatggtgttattgtggtcaacgctgataaagtagaagtcacgggttctaaagaagctcaaaaaatttatcattattatacaggttctatgagcggtttgagagaaatcccttaccgtacaatgaaagctcgtaagcctgaatatatcattgagcatgccgttaaaggaatgatgcctaagacgcgcttggcaagacaacaaattaaaaaattgcgtgtatttgccggaaaagagcatgatttagctgctcaacaaccaatccacgttaacatttaa

SEQ ID NO: 31775 - protein, 143 aa, Parachlamydia sp
MQKTFTPNKNEIKLKWFVLDATGKTLGRLTSEIAKILRGKHKPTYTTYMDCGDGVIVVNADKVEVTGSKEAQKIYHYYTGSMSGLREIPYRTMKARKPEYIIEHAVKGMMPKTRLARQQIKKLRVFAGKEHDLAAQQPIHVNI

SEQ ID NO: 31776 - DNA, 441 bp, Bdellovibrio bacteriovorus
  CDS (1)..(441)
atgaagactttcaatgcaaaagcagaagaagttgaaagaaaatggtggatcgtcgatgctgctggccaaaaagttggtcgtgtagcaactcatgtagcgactatccttcgtggtaaaaacaaagctatctacactcctaacgttgatactggcgacttcgttgttgttatcaatacggacaagatggaactttctggaactaagtggcaggacaagaagtactactctcacactcgcttcttcggttctttgaaagagatgacagcagctcaagcgaaagagaaagattctactttcatcattcacgaagctgttcgcggtatgcttccaacaaacaagctatcccgtcacgttatcatgaaaatgaaggcttacactggtgctgagcatcctcatgctgctcaaaaaccggctcttttcacccttccatctaagaaataa

SEQ ID NO: 31777 - protein, 146 aa, Bdellovibrio bacteriovorus
MKTFNAKAEEVERKWWIVDAAGQKVGRVATHVATILRGKNKAIYTPNVDTGDFVVVINTDKMELSGTKWQDKKYYSHTRFFGSLKEMTAAQAKEKDSTFIIHEAVRGMLPTNKLSRHVIMKMKAYTGAEHPHAAQKPALFTLPSKK

SEQ ID NO: 31778 - DNA, 456 bp, Mycoplasma mycoides
  CDS (1)..(456)
atgaaacaaactacaatgatttctgcaaaagacactaataaaaaatgatatattgttgatgcagaaaataaaactgtggggagattagcaactcaagttgctcttgtattaagaggaaaacataaagttgattttactccacatattaataatggagatcacgttattataattaatgctgaaaaagcaattttttctggaaaaaaagaatctaataaattctactatcaccattcaatgcatcctggtggattgaaaaaaagaagtgttgaagttcaaagagaactagatgctactaagattttagaaagagctattagattaatgcttccaaaaaacgttcaaggttcaaaccaatacagagctttacatgtatttaaaggttcaaatcacccatttgctgcacaaaaacctgaagttttagaaatttcaactaaaaaaggagacgttaaataa

SEQ ID NO: 31779 - protein, 151 aa, Mycoplasma mycoides
MKQTTMISAKDTNKKWYIVDAENKTVGRLATQVALVLRGKHKVDFTPHINNGDHVIIINAEKAIFSGKKESNKFYYHHSMHPGGLKKRSVEVQRELDATKILERAIRLMLPKNVQGSNQYRALHVFKGSNHPFAAQKPEVLEISTKKGDVK

SEQ ID NO: 31780 - DNA, 444 bp, Corynebacterium diphtheriae
  CDS (1)..(444)
atgtctacttaccacccaaagagcggtgacatcacccgcaagtggtacgtcatcgacgccactgacgtggttctgggtcgtcttgctacccacgcagctgacttgttgcgcggcaagggcaagcctcagtttgcaccgaacgttgactgcggcgatcacgttatcgtgatcaacgctgacaaggttcacgtttcctccaacaagcgcgagcgtgagatgcgctaccgtcactctggctacccaggtggtctgaagaccatgaccttgggtcgttcccttgaggttcacccagagcgcgtggttgaggagtcgattcgtggcatgatgccacacaaccgtctttcccgcgcttctgtgaagaagctgcacgtgttcgcaggttctgagcacccatacgctgctcagaagccagagacctacgagttcaagcaggtggcccagtag

SEQ ID NO: 31781 - protein, 147 aa, Corynebacterium diphtheriae
MSTYHPKSGDITRKWYVIDATDVVLGRLATHAADLLRGKGKPQFAPNVDCGDHVIVINADKVHVSSNKREREMRYRHSGYPGGLKTMTLGRSLEVHPERVVEESIRGMMPHNRLSRASVKKLHVFAGSEHPYAAQKPETYEFKQVAQ

SEQ ID NO: 31782 - DNA, 459 bp, Onion yellows phytoplasma
  CDS (1)..(459)
atgacagaacaattgcaaccaaaaaacaatcaaaaaactttaatggctaataaaacaacagtaaaacctaaatggcacctagtagatgctaagggcaaaaccctaggcagattagctaccaaagtggcttccattttaaaaggaaaacacaaaacacattacacgccacacgtagacaatggcgattatgttattgttgtaaatgctgcctatattcatttaactggcaaaaaatggcaacaaaaaacttactacaaacattcaggttatccaggtggtttaactaaagttgtagcttcagaaatgatgcgtaaatttcctacaagaatggttgaaaaagcaattttaggaatggttcctcatactaaattaggttcacaaattggtaaaaaattatttgtttatgccgaacaaaaccacaatcaccaagcgcaacaaccagaaagtttagaggtttaa

SEQ ID NO: 31783 - protein, 152 aa, Onion yellows phytoplasma
MTEQLQPKNNQKTLMANKTTVKPKWHLVDAKGKTLGRLATKVASILKGKHKTHYTPHVDNGDYVIVVNAAYIHLTGKKWQQKTYYKHSGYPGGLTKVVASEMMRKFPTRMVEKAILGMVPHTKLGSQIGKKLFVYAEQNHNHQAQQPESLEV

SEQ ID NO: 31784 - DNA, 435 bp, Desulfovibrio vulgaris
  CDS (1)..(435)
atgaaaactttcagccctacgcccgagaacatcaaccgcgaatggtttgtggttgacgcagaagacaagattctcggccgtctcgccacccagattgcacatcgcctgcgtggcaagcacaagcctgaattcgctccgcacatggacaacggcgacttcatcgtcgtggtcaactgcgaaaagatcaaggtcaccggcaagaagctggaccagaagaaatactacaaccactccggttacgtgggcgggcttcgtgaaaccagcctcgagaagctgctcgccagcaagccggaagaagtactgctcaaggccgtgcgtggcatgctgccccgcaaccgccttggtcgtgccatgctcaccaagctcaaggtctaccgtggcaccgagcatccccatgccgcccagaagcccacgccccttgagctgacgtactaa

SEQ ID NO: 31785 - protein, 144 aa, Desulfovibrio vulgaris
MKTFSPTPENINREWFVVDAEDKILGRLATQIAHRLRGKHKPEFAPHMDNGDFIVVVNCEKIKVTGKKLDQKKYYNHSGYVGGLRETSLEKLLASKPEEVLLKAVRGMLPRNRLGRAMLTKLKVYRGTEHPHAAQKPTPLELTY

SEQ ID NO: 31786 - DNA, 492 bp, Thermus thermophilus
  CDS (1)..(492)
atggtaaagtcctctttggcgttcttgcggggtcccccgatcccccgtcaagaacaaaggagggccctggtgaagacgtacgtgccgaaacaagtggaaccccgctgggttctcattgacgcggagggcaagaccttggggcggcttgccacgaagatcgccaccctccttcggggcaagcaccgccccgactggacccccaacgtggccatgggggacttcgtggtggtggtcaacgccgacaagatccgcgtcaccgggaagaagctggagcagaagatctacacccgttacagcggctaccctggggggctcaagaagatccccttggagaagatgctggccacccaccccgagcgggtgctggagcacgcggtgaaggggatgctgcccaaggggcctttgggccgcaggctcttcaagcggctcaaggtctacgccggcccggaccatccccaccaggcccagaggccggagaagctggaggtctag

SEQ ID NO: 31787 - protein, 163 aa, Thermus thermophilus
MVKSSLAFLRGPPIPRQEQRRALVKTYVPKQVEPRWVLIDAEGKTLGRLATKIATLLRGKHRPDWTPNVAMGDFVVVVNADKIRVTGKKLEQKIYTRYSGYPGGLKKIPLEKMLATHPERVLEHAVKGMLPKGPLGRRLFKRLKVYAGPDHPHQAQRPEKLEV

SEQ ID NO: 31788 - DNA, 450 bp, Leptospira interrogans
  CDS (1)..(450)
atgtcagtattatcaaaagtacataaaactccttctcttacaaaagaaaacgccgtaaaaggttggtttgtagtagatgcggaaggaaaaactctaggaagactcgcttccggaattgccgcaagacttcgcggaaaacacaaagcaacttttacccccaaccaagattgtggggacaatatcatcgttatcaatgcttccaaagtaaaagtaactggtaataaagaaactcaaaagaaatattatcaccactctcgttatccgggcgggatgacggaaacagttttcaaggacttaattgcaaaacaacctgaaaaggtgatctacgaggccgtaaaaggaatgcttcctaagagtaaactcggagataaaatgctcacccattgtaaaatattttcgggtgctgaacacaatctgcaggctcaaaaacctgtgaaacttgacatttag

SEQ ID NO: 31789 - protein, 149 aa, Leptospira interrogans
MSVLSKVHKTPSLTKENAVKGWFVVDAEGKTLGRLASGIAARLRGKHKATFTPNQDCGDNIIVINASKVKVTGNKETQKKYYHHSRYPGGMTETVFKDLIAKQPEKVIYEAVKGMLPKSKLGDKMLTHCKIFSGAEHNLQAQKPVKLDI

SEQ ID NO: 31790 - DNA, 438 bp, Bacillus cereus
  CDS (1)..(438)
atgcgtacgacttttatggcaaaagctaacgaagttgagcgtaaatggtatgtggttgatgctgaaggtcaaactttaggtcgccttgctagtgaagtagcatccattttacgtggtaaaaacaaacctacatttacaccacacgttgacacgggtgatcatgtaattattattaacgctgagaaaattcatttaacaggtaataaattaaacgataaaatttactaccgtcacactaaccacccaggtggacttaaacaaagaacagctcttgaaatgcgtacaaactaccctgtacaaatgttagagcttgcaattaaaggcatgcttccaaaaggacgcttaggccgtcaagtttctaagaaactaaacgtgtatgctggagcagagcatccacaccaagcacaaaaaccagaagtttacgaacttcgcggataa

SEQ ID NO: 31791 - protein, 145 aa, Bacillus cereus
MRTTFMAKANEVERKWYVVDAEGQTLGRLASEVASILRGKNKPTFTPHVDTGDHVIIINAEKIHLTGNKLNDKIYYRHTNHPGGLKQRTALEMRTNYPVQMLELAIKGMLPKGRLGRQVSKKLNVYAGAEHPHQAQKPEVYELRG

SEQ ID NO: 31792 - DNA, 459 bp, Wolbachia pipientis wMel
  CDS (1)..(459)
atgaagacttttttcttaaaggagaaacaaatcaataaaaagtggtttgtcatagatgcagaaggattagtggtagggaggcttgcagcatttgtagcgacactattacgtggaaagcataaacctgagtatacacctcatatggattgtggcgataatgtaattattatcaacgcagaaagggtgcatttcaccggaaagaagcttaaagataaaatttactataagcatacaggttattctggtggtttgaagaaaactactccagataatattttaaatggcaaatttcctgagcgtgtaatagaaatggcagtgaaaaggatgcttgatgatgggcctatggcacgtagacgctttgaaaatttgtatgtttattctggttcagagcataagcatcaaggacagcaacctgaaaagatagattttgcctctttgaatcgtaaaaataaaaagtaa

SEQ ID NO: 31793 - protein, 152 aa, Wolbachia pipientis wMel
MKTFFLKEKQINKKWFVIDAEGLVVGRLAAFVATLLRGKHKPEYTPHMDCGDNVIIINAERVHFTGKKLKDKIYYKHTGYSGGLKKTTPDNILNGKFPERVIEMAVKRMLDDGPMARRRFENLYVYSGSEHKHQGQQPEKIDFASLNRKNKK

SEQ ID NO: 31794 - DNA, 429 bp, Treponema denticola
  CDS (1)..(429)
atgaaaactattttttttaaagaacatgaagcgccgcgctcttggtaccttattgatgccgccgggaagccgcttggccgcgttgctgctaaaactgcagctatgctgagaggaaaacacaaggtaagttttgcacctcatcaggaaatcggtgattatgtcgttattattaatgccgaaaaagtagccgtaacaggaaataaggctaaggataagatgtactatactcactccggttatgtaggcggtttaaagtctatcaactttaacggcttaatcgctaaaaaaccggctgaacccttgatgattgcaattaaaggtatgcttcctaagggaccccttggaagaaaacttttaacgaatgttaaggtctatgcaggccccgaacatcctcaccaagcacaaaaccccatagcggttgaagtataa

SEQ ID NO: 31795 - protein, 142 aa, Treponema denticola
MKTIFFKEHEAPRSWYLIDAAGKPLGRVAAKTAAMLRGKHKVSFAPHQEIGDYVVIINAEKVAVTGNKAKDKMYYTHSGYVGGLKSINFNGLIAKKPAEPLMIAIKGMLPKGPLGRKLLTNVKVYAGPEHPHQAQNPIAVEV

SEQ ID NO: 31796 - DNA, 444 bp, Mycobacterium paratuberculosis
  CDS (1)..(444)
atgcccacttacgcgccaaaggcgggtgacaccaccaggtcgtggtacgtcatcgacgccacggacgtggtgcttggccgccttgccgtcgcggcagccaacctgctgcgcggcaagcacaagccgacgttcgcccccaacgtcgacggcggtgacttcgtcatcgtcgtcaacgccgacaaggtcgccttcagcggccagaagctggacaagaagctggcttaccgccactcggggtaccccggcggtctgcgcagccgcaccatcggcgagctgatgcaaaagcacccggaccgggtcgtggcggacgcgatcgtcggcatgctgcccaagaacaagctgagccgccagatccagcgcaagctccgcgtctacgccggaccggagcacccgcacaccgcccagcagcccattccgtacgagatcaagcaggtggcccagtag

SEQ ID NO: 31797 - protein, 147 aa, Mycobacterium paratuberculosis
MPTYAPKAGDTTRSWYVIDATDVVLGRLAVAAANLLRGKHKPTFAPNVDGGDFVIVVNADKVAFSGQKLDKKLAYRHSGYPGGLRSRTIGELMQKHPDRVVADAIVGMLPKNKLSRQIQRKLRVYAGPEHPHTAQQPIPYEIKQVAQ

SEQ ID NO: 31798 - DNA, 432 bp, Geobacter sulfurreducens
  CDS (1)..(432)
atgaaaacgacgaaggttgcaaagaaagaagaagtgaccagggattggtacctggttgatgccgataacaaggtgcttggtcgcatggccaccgagatcgccaacatcctgcgcggcaagaaaaagccgatctacacgcctagcgtcgatacgggcgacttcgtcgtcgttgtcaacgccgcgaagcttcagcttaccggcaacaagctggcagataagatgtactatcatcacaccggcttccccggcggcatcaagtccatcactgccggcaagctcatcgagaagaagcccgaggacctgatccgcaaggcggtcaaggggatgctccccaagaacaagcttgcccgccacatgctcaagaaactcaaggtctatgccggccccgagcatccgcacgaggcccagcagcccaagaccctcgacatttaa

SEQ ID NO: 31799 - protein, 143 aa, Geobacter sulfurreducens
MKTTKVAKKEEVTRDWYLVDADNKVLGRMATEIANILRGKKKPIYTPSVDTGDFVVVVNAAKLQLTGNKLADKMYYHHTGFPGGIKSITAGKLIEKKPEDLIRKAVKGMLPKNKLARHMLKKLKVYAGPEHPHEAQQPKTLDI

SEQ ID NO: 31800 - DNA, 444 bp, Lactobacillus johnsonii
  CDS (1)..(444)
atgcgtactaccccattagctaaaactagtgatattaaacgtaagtggtatgttatcgatgcgactgatgtttcacttggtcgtttatcaactgctgtagcatcaattttaagaggtaagaataagcctcaatatacaccaaatgttgatactggtgattatgttattgttgttaacgcagctaaattgaagttgactggtaaaaaagcaactgataagatctactaccgccactcagattaccgtggtggcttaagagctactcctgccggtgaattattagctaagaacccagtaagattagttgaattatctgtaaaaggcatgttgccaaagaatactcttggtcaccaagaattcatgaagatgcatgtttacgctggtgaagaccacgaacacgcagcacaaaagcctgaaaagttagacatcaacgaattaatctag

SEQ ID NO: 31801 - protein, 147 aa, Lactobacillus johnsonii
MRTTPLAKTSDIKRKWYVIDATDVSLGRLSTAVASILRGKNKPQYTPNVDTGDYVIVVNAAKLKLTGKKATDKIYYRHSDYRGGLRATPAGELLAKNPVRLVELSVKGMLPKNTLGHQEFMKMHVYAGEDHEHAAQKPEKLDINELI

SEQ ID NO: 31802 - DNA, 489 bp, Nanoarchaeum equitans
  CDS (1)..(489)
atggaatttttgggcgaactaatttatgacgcagaaggcttagttttaggaaggttggcctctatagtagctagaaacctaaaaaggggctatagagtaaaaatagtaaatgccgagaaagctataattactggggatcccaatatggttaaaaaggaatggctacaaaaagtaaagaggggcgattattataaggggcctttctatccaaagagaccagataatatattaaaaagagttattaggggaatgttaccaaggaaaactgcaaggggcagagagttattaaaaaatgtaaaagtatacataggagtaccagaagaattaaaggataaaccaaaactaggattaaatttggaaaacgctaaaggctacccagaggcattaataaaagaggtgttaaaagcaaaacccaaatttgagaggggtaacataaaatatatagagttaggagaattatccaaatatttgggagcaaaatttacataa

SEQ ID NO: 31803 - protein, 162 aa, Nanoarchaeum equitans
MEFLGELIYDAEGLVLGRLASIVARNLKRGYRVKIVNAEKAIITGDPNMVKKEWLQKVKRGDYYKGPFYPKRPDNILKRVIRGMLPRKTARGRELLKNVKVYIGVPEELKDKPKLGLNLENAKGYPEALIKEVLKAKPKFERGNIKYIELGELSKYLGAKFT

SEQ ID NO: 31804 - DNA, 471 bp, Ashbya gossypii
  CDS (1)..(471)
atgtcacagaagatcggtcagagcgggttggcgtttgccaggctatggcaccacgtggacgtggctcgggagcagcggacgctgggtagactggcgtcgagcattgcgatcacgctgatgggaaagcacaaaccggtatatcaccccagcatggactgtggggactacgtggtggtgaccaacgcgcaggatctgcaggtgacgggtaagaagtgggagcagaagacgtactggtcccacagcgggaggccagggcacctgaagctgcggacgatggagaccatagcgacgaacaagggccacagcgagctgctgcgcaaggcggtgagcgggatgctgcccaagaaccggctgcgcaaggtgcggctggcgaggctgaaggtgttcgacggcagcgagcacccgtacaagcagaacatcgtggcgtttgcggacgagcaggcggagcagccggcgcggccgtcggcgtga

SEQ ID NO: 31805 - protein, 156 aa, Ashbya gossypii
MSQKIGQSGLAFARLWHHVDVAREQRTLGRLASSIAITLMGKHKPVYHPSMDCGDYVVVTNAQDLQVTGKKWEQKTYWSHSGRPGHLKLRTMETIATNKGHSELLRKAVSGMLPKNRLRKVRLARLKVFDGSEHPYKQNIVAFADEQAEQPARPSA

SEQ ID NO: 31806 - DNA, 690 bp, Oryza sativa
  CDS (1)..(690)
atggctgccgcgccgccggcgttcaccgggaacctcaagaaagcacttgcaggattgagaaggatcaatttagatgggttgagatggcgtgtatttgatgcaaagggtcaggtgcttggacggttggcatcccaaattgctgttgtgcttcaagggaaggacaagccaacttatgcaccacatgtggaaaacggggacatgtgtgtcgtacttaacgcgaaagatatcagtgtcacgggaaggaaaatgactgataagatttactactggcacacagggtatattggccatttgaaggaaagaagactcaaggaccagatggaaaaggacccaaccgaggtgattcgcaaagctgtgatgcgcatgcttccccgcaatagattgcgtgatgatagggatcgcaaactgaggatattttctggaagtgagcatcccttccatgatcgccctcttgaaccttttgcgatgccaccgcgtcaggtgcgcgagatgcgcccccaggcaagacgggcacttattagggcgcagaagaaagagcaggacagagcagcagcatcaaccaaagatgacaaagatgaggaggaggacaaaggaaagaagatgcttgaagttaaagggaaggcaaggaaaaaggccacacttggggacagaaaagaaagactgattttcaacaagcatggaatagcataa

SEQ ID NO: 31807 - protein, 229 aa, Oryza sativa
MAAAPPAFTGNLKKALAGLRRINLDGLRWRVFDAKGQVLGRLASQIAVVLQGKDKPTYAPHVENGDMCVVLNAKDISVTGRKMTDKIYYWHTGYIGHLKERRLKDQMEKDPTEVIRKAVMRMLPRNRLRDDRDRKLRIFSGSEHPFHDRPLEPFAMPPRQVREMRPQARRALIRAQKKEQDRAAASTKDDKDEEEDKGKKMLEVKGKARKKATLGDRKERLIFNKHGIA

SEQ ID NO: 31808 - DNA, 420 bp, Wolinella succinogenes
  CDS (1)..(420)
atgaacatgacaaaaatggcgaaagctaatgaaatcaagcgcgaatgggtcgtgctggatgccgaaggcaagactttcggtcgtctcatgactcaagtggctactcttcttagaggcaagcaccgacctgactatacccctcatgtggattgcggcgatttcgtcgttatcgtcaacgcatccaaggtggttttcagcggtttgaaactcgaagcgaaagagtacttcacgcactctggctatttcggtagcactaaatctcaaactcttcaagagcttttggagaagaatcctgagaagcttttccgactcgcggctagagggatgttgcccaagaccaagctaggtcgagcgatgctcaaaaagctcaaagtgtatgctggtgctgagcatccccataccgcacaagtaacgaagtaa

SEQ ID NO: 31809 - protein, 139 aa, Wolinella succinogenes
MNMTKMAKANEIKREWVVLDAEGKTFGRLMTQVATLLRGKHRPDYTPHVDCGDFVVIVNASKVVFSGLKLEAKEYFTHSGYFGSTKSQTLQELLEKNPEKLFRLAARGMLPKTKLGRAMLKKLKVYAGAEHPHTAQVTK

SEQ ID NO: 31810 - DNA, 429 bp, Vibrio vulnificus
  CDS (1)..(429)
atgaaaactttcgttgctaaaccagaaactgtaaaacgcgactggtacgttgtagacgctgaaggtaaaactcttggccgtctagcaagtgaaattgcatctcgcctacgtggcaaacacaaagctgagtacactccacacgttgacactggtgattacatcatcgttatcaacgcggagaaagttactgtaactggtaacaaagctgcagcaaaaacttactaccgtcacactgaattccctggtggtattaagtcaatcacttttgacaagctgattgttcgtaaaccagaaatggtcattgagctagcggttaaaggtatgctaccacgtggtcctctaggccgtgctatgtaccgtaagctaaaagtttacgctggcgctgagcacaaccatgttgctcaacaaccaaaagtactagacatctaa

SEQ ID NO: 31811 - protein, 142 aa, Vibrio vulnificus
MKTFVAKPETVKRDWYVVDAEGKTLGRLASEIASRLRGKHKAEYTPHVDTGDYIIVINAEKVTVTGNKAAAKTYYRHTEFPGGIKSITFDKLIVRKPEMVIELAVKGMLPRGPLGRAMYRKLKVYAGAEHNHVAQQPKVLDI

SEQ ID NO: 31812 - DNA, 456 bp, Porphyromonas gingivalis
  CDS (1)..(456)
atggatactttaagcttcaagaccatttctgcgaacaaagcaactgttacgaaggaatgggtcattgtagatgctgaaggacagacacttggccgtatgtgtgccaaggtggcaaagctcctgcgcggcaaatacaagcccaacttcaccccgcatgttgattgtggcgataacgtgatcgttatcaacgcagacaagatcgttctctccggtaataagtgggacggtcgtatttatctccgccatacgggctatcccggcggacaacgtcagttcacacctcgtgactttatgaacaaaggcccggaatacctcttccgcaaggtggtaaagggtatgctccccaagaatcgcttgggtgccaagatcattggcaatctatatgtatatgccggcacggagcacaagcatgaggctcagcaaccccggcaactggacattaattcactcaaataa

SEQ ID NO: 31813 - protein, 151 aa, Porphyromonas gingivalis
MDTLSFKTISANKATVTKEWVIVDAEGQTLGRMCAKVAKLLRGKYKPNFTPHVDCGDNVIVINADKIVLSGNKWDGRIYLRHTGYPGGQRQFTPRDFMNKGPEYLFRKVVKGMLPKNRLGAKIIGNLYVYAGTEHKHEAQQPRQLDINSLK

SEQ ID NO: 31814 - DNA, 429 bp, Photorhabdus luminescens
  CDS (1)..(429)
atgaaaacttttacagctaagccagaaaccgtaaaacgcgactggtatgttgttgacgcagatggcaaaactttaggccgtcttgcaactgaagtggctcgccgtctgcgcggcaagcataaagcggaatacactccgcatgttgataccggtgattacatcatcatcgttaatgcagaaaaagttgcagtcaccggcaacaagcgttctgataaaatctactatcaccacaccggtcatatcggtggtattaagcaagcgacctttgaagagatgattgcccgccgtcctgagcgtgtaattgaaatcgcggttaaaggcatgctgccaaaagggccactgggccgtgcaatgtaccgtaaactgaaagtttatgcaggtagcgagcacaaccatgcggcacagcaaccgcaagttctggacatttaa

SEQ ID NO: 31815 - protein, 142 aa, Photorhabdus luminescens
MKTFTAKPETVKRDWYVVDADGKTLGRLATEVARRLRGKHKAEYTPHVDTGDYIIIVNAEKVAVTGNKRSDKIYYHHTGHIGGIKQATFEEMIARRPERVIEIAVKGMLPKGPLGRAMYRKLKVYAGSEHNHAAQQPQVLDI

SEQ ID NO: 31816 - DNA, 459 bp, Gloeobacter violaceus
  CDS (1)..(459)
atgacagctaagacatttctccccgcagttgacgaaattgagcgtcgctggctggtggtagatgccgccgggcaacaccttgggcggctggcgagtgtcgtcgccaatctcattcggggcaagcatcgccccaacttcacgccccacctcgacaccggcgactttgtgatcgtcgtcaacgccgaaaaagtcgaagtaaccggcaaaaagtccagccagaagctttatcgccgcagttccggccgccccggcggcatgaaagtcgagaccttcagccatctgcaggcgcgcttgcccgagcgcatcgtcgagaaggccatctggggcatgcttccccacacccgcctcggccgccagcaatttaccaagttaaaagtctacaaggggccagcccatccccacgccgcccaaaaacccgaagtcttcgacctgagcacggtccttggaggtcactcgtga

SEQ ID NO: 31817 - protein, 152 aa, Gloeobacter violaceus
MTAKTFLPAVDEIERRWLVVDAAGQHLGRLASVVANLIRGKHRPNFTPHLDTGDFVIVVNAEKVEVTGKKSSQKLYRRSSGRPGGMKVETFSHLQARLPERIVEKAIWGMLPHTRLGRQQFTKLKVYKGPAHPHAAQKPEVFDLSTVLGGHS

SEQ ID NO: 31818 - DNA, 429 bp, Chromobacterium violaceum
  CDS (1)..(429)
atgaagaccttttctgccaaggcgcatgaggtaaagcgcgaatggtacgtggtcgacgctgccgataaggtgctgggtcgcctggctgccgaaatcgcccgccgcctgcgtggcaaacacaagccggaattcactccgcacgtcgataccggcgatttcatcgtcgtggtgaacgtcgagaagctgcgcgtgaccggtaccaaggctcaagacaagaagtactaccgtcactccggttacccgggcggtatctacgagcgcaccttcaccgaactgcaaaaccagttcccggaacgcgttctggaaaaggccgtgaaaggcatgctgccgaagggtccgctgggctacgccatgatcaagaagctcaaggtgtactccggctccgagcacccgcacgccgcccaacagcccaaagtgctggaaatctga

SEQ ID NO: 31819 - protein, 142 aa, Chromobacterium violaceum
MKTFSAKAHEVKREWYVVDAADKVLGRLAAEIARRLRGKHKPEFTPHVDTGDFIVVVNVEKLRVTGTKAQDKKYYRHSGYPGGIYERTFTELQNQFPERVLEKAVKGMLPKGPLGYAMIKKLKVYSGSEHPHAAQQPKVLEI

SEQ ID NO: 31820 - DNA, 552 bp, Neurospora crassa
  CDS (1)..(552)
atgtcgcaaacagtcggagctacccgactagcctactcccgtgtctggcaccacatctccgccgtcacccctcaccccaccctctcgaccatcaaggctccttccgaggccatcactcccccttctctcggtcgcctcgcctcgcgcattgccaccatcctgatgggcaagcacaagccgatctgggatccctccaccgactgcggcgactacgtcgtggtgaccaactgcgcgggtttgtacacgacgggccacaagaagtggcgcaagacgtactaccgccacaacacccggcccggttcgctacaggccatcaccatggatgcgctgatggagaagcacggcggcgccgaggtgctgcgcaaggccgtcagcggcatgcttcccaagaacaggctgcgcgacaagagactggcgaggctcaaggcgtttgagggtgatgcgcacccgtacaaggagaacttggtgcgatttggcggtaaggtggtgggcgctccaggttgggaggaggctgtcaaggctatccgggaggcggacatggagaggttatga

SEQ ID NO: 31821 - protein, 183 aa, Neurospora crassa
MSQTVGATRLAYSRVWHHISAVTPHPTLSTIKAPSEAITPPSLGRLASRIATILMGKHKPIWDPSTDCGDYVVVTNCAGLYTTGHKKWRKTYYRHNTRPGSLQAITMDALMEKHGGAEVLRKAVSGMLPKNRLRDKRLARLKAFEGDAHPYKENLVRFGGKVVGAPGWEEAVKAIREADMERL

SEQ ID NO: 31822 - DNA, 453 bp, Synechococcus sp
  CDS (1)..(453)
atgaacaagacctcccttcctcagattgattctctcgaacgccagtggtatctggtggacgctgagaacaagaccctcggtcgcctggccaccgaggttgccgccgttctgcgcggcaagaacaacccgagcttcactccccatttggacaccggcgatttcgtcgtggtagtgaatgccgagaagatccgggtgagtggcagcaagcccactcagaagctgtatcgccgtcactccgggcgtcccggcggcatgaagaccgaaaccttcgaggcgctgcaggaccgcattcccgagcgaatcgttgaaaaagcgatcaagggcatgcttccccacaacgccctgggccgtcagatgttccgcaagctcaaggtgtacaagggcagcgagcatccccatgccgcccagaagcctcagcctcttcagctcaacccctctgcatccgcccaatga

SEQ ID NO: 31823 - protein, 150 aa, Synechococcus sp
MNKTSLPQIDSLERQWYLVDAENKTLGRLATEVAAVLRGKNNPSFTPHLDTGDFVVVVNAEKIRVSGSKPTQKLYRRHSGRPGGMKTETFEALQDRIPERIVEKAIKGMLPHNALGRQMFRKLKVYKGSEHPHAAQKPQPLQLNPSASAQ

SEQ ID NO: 31824 - DNA, 456 bp, Rhodopirellula baltica
  CDS (1)..(456)
atggctgttcaacgaacctacatggccaaacccggccaaatcgaaaagcaatggcatgttgtggatgccagcgacgaagtcctcggtcgactcgccagcgatatcgctgtcgtgctgatgggaaaacatcgtcctgagtacacacctcacgttgattgcggtgatttcgtgatcgtcaccaacgccgacaagatcggcatgacgggcaacaagatgcgtgatcgccactacacttggtacaccggctacccaggcttgcgtctggaaagctaccaagatcgccatgatcgcaaaccggaatacttgctgtatcacgccgttcgccggatgctgccaaagaacaaacttgctcgccaaatgctgagcaagctgaaaatctacgctggccctgagcacccacacaccgctcagcaacccgttgaattggttcgcaccagcaaaaaagctagcgcttag

SEQ ID NO: 31825 - protein, 151 aa, Rhodopirellula baltica
MAVQRTYMAKPGQIEKQWHVVDASDEVLGRLASDIAVVLMGKHRPEYTPHVDCGDFVIVTNADKIGMTGNKMRDRHYTWYTGYPGLRLESYQDRHDRKPEYLLYHAVRRMLPKNKLARQMLSKLKIYAGPEHPHTAQQPVELVRTSKKASA

SEQ ID NO: 31826 - DNA, 432 bp, Prochlorococcus marinus subsp
  CDS (1)..(432)
atgaataaaactattactccctctatagaaactatcgaacgaaattggtttttagttgatgctaaagataagacacttggcaggctttctacagaaatagctgctgttttgagaggaaagaataaaccaacatttacccctcatttagacacaggtgattttgttatcgttgttaatgccgaaaaagtagaggtaacaggtaaaaaagcatcacagaaattatacagaagacattctggtagaccaggaggaatgaaagttgaaaaatttgaatcacttcaagaaaggattcctgagagaataattgagcaagctgttaaaggaatgcttcctcataattcattgggaaggcagcaattcaagaaattaaaagtttataaaggttcagatcatcctcatgctgcacaaaatcctgtattattaaatagttaa

SEQ ID NO: 31827 - protein, 143 aa, Prochlorococcus marinus subsp
MNKTITPSIETIERNWFLVDAKDKTLGRLSTEIAAVLRGKNKPTFTPHLDTGDFVIVVNAEKVEVTGKKASQKLYRRHSGRPGGMKVEKFESLQERIPERIIEQAVKGMLPHNSLGRQQFKKLKVYKGSDHPHAAQNPVLLNS

SEQ ID NO: 31828 - DNA, 453 bp, Prochlorococcus marinus
  CDS (1)..(453)
atgaacaagacctccgttccctcaattgattcgatcgaacgccagtggtttctggtggatgcagagaatcagacactcggcagacttgctactgaggtggcctccgtgctgcgcggcaagaacaagccaagcttcacccctcacctggatacaggtgactttgttgtggttgtcaatgcggacaaaatcagagtcagcggcaacaaggcaaatcaaaagctctaccgccgtcactctggtcgtcccggggggatgaaggttgaaaccttccaagcgttgcaggatcgtctacctgaacgcatcgtcgaaaaagccattaaagggatgcttcctcacaacgcccttggcagacagttgttccgcaaactcaaggtctaccgcggcccggaacatccccattccgcacagagaccccaaacccttcagctcaatcccgccgcttcatcgcaatga

SEQ ID NO: 31829 - protein, 150 aa, Prochlorococcus marinus
MNKTSVPSIDSIERQWFLVDAENQTLGRLATEVASVLRGKNKPSFTPHLDTGDFVVVVNADKIRVSGNKANQKLYRRHSGRPGGMKVETFQALQDRLPERIVEKAIKGMLPHNALGRQLFRKLKVYRGPEHPHSAQRPQTLQLNPAASSQ

SEQ ID NO: 31830 - DNA, 453 bp, Prochlorococcus marinus
  CDS (1)..(453)
atgaacaagactattactccctccatcgactcaatcaatcgtcagtggtatctcgtagatgccgaaaatcagacgcttggaagactggctactgaggtggcttctgttcttcgaggaaagaacaaacctagctttactcctcatttagatacaggggattttgtcatcattgtcaatgctgaaaaaattaaggttactggtaaaaagggaatgcaaaagctttatcgccggcattcaggacgtcctggaggaatgaaagtagaaacttttaattcacttcaagaaagaattcctgaaagaattgttgaaaaagctattaaaggaatgcttccacacaatgctcttggcagacaactttttagaaagttgaaggtttataagggctctgagcatcctcattcggctcaaaaccctcaggttcttagtattactaccaacgaattagttaaatga

SEQ ID NO: 31831 - protein, 150 aa, Prochlorococcus marinus
MNKTITPSIDSINRQWYLVDAENQTLGRLATEVASVLRGKNKPSFTPHLDTGDFVIIVNAEKIKVTGKKGMQKLYRRHSGRPGGMKVETFNSLQERIPERIVEKAIKGMLPHNALGRQLFRKLKVYKGSEHPHSAQNPQVLSITTNELVK

SEQ ID NO: 31832 - DNA, 429 bp, Helicobacter hepaticus
  CDS (1)..(429)
atggaattgacaaaaatagcaacacaaaatgacatcaatcgtcagtggattgtgcttgatgcaaaagataaagtctttggtcgccttatcacagaaatagctactcttttacgaggcaaacacaaaccttgtttcacacctcatattgattgtggcgattttgtagtcattattaatgccacagaagtaaaattcacaggtatgaaactcaaagacaaagaatacttcacgcattcaggttactttggcagcactaagagtaaaacacttcaagaaatgttagaaaaaactcccgaaaaactctatcatcttgcggtgcgaggtatgctccccaaaaacaaacttggacgagctatgcttaaaaaactcaaagtttatcgcggcagtgagcacccacacagcgctcaagtcgctaaaagctcaaaataa

SEQ ID NO: 31833 - protein, 142 aa, Helicobacter hepaticus
MELTKIATQNDINRQWIVLDAKDKVFGRLITEIATLLRGKHKPCFTPHIDCGDFVVIINATEVKFTGMKLKDKEYFTHSGYFGSTKSKTLQEMLEKTPEKLYHLAVRGMLPKNKLGRAMLKKLKVYRGSEHPHSAQVAKSSK

SEQ ID NO: 31834 - DNA, 423 bp, Haemophilus ducreyi
  CDS (1)..(423)
atgaaaacttttgtagcagaaacagtaaaacgtgactggtatgtagtagatgcggcaggtaaaactttaggtcgtttagctactgaattagcaagtcgcttacgcggtaagcataaagctgaatatactccacacgtagatacaggtgattacatcatcgttatcaatgcagagaaagtagtagtaacaggcaaaaaagaaactgataaaatctattactggcacactggctatgtaggtggtatcaaagatgcaaccttcaaagaaatgatttcgcgtcgtccagaagcagtgattgagatcgcagtaaaaggtatgttaccaaaaggtcctttaggtcgtgatatgttccgtaaattaaaagtttatgcaggtaacactcacaaccacgctgcacaacaaccacaagttttagacatctaa

SEQ ID NO: 31835 - protein, 140 aa, Haemophilus ducreyi
MKTFVAETVKRDWYVVDAAGKTLGRLATELASRLRGKHKAEYTPHVDTGDYIIVINAEKVVVTGKKETDKIYYWHTGYVGGIKDATFKEMISRRPEAVIEIAVKGMLPKGPLGRDMFRKLKVYAGNTHNHAAQQPQVLDI

SEQ ID NO: 31836 - DNA, 420 bp, Candidatus Blochmannia floridanus
  CDS (1)..(420)
atgagtcgattaagaataataaaaagattatggtatattgtagatgctaaaaataaagttcttggtcgattatctagtaatattgccaagtatttaattggaaaacataaagtagaatatgctccttatgttgatgtaggagattatattattgtgattaactcaaaagatgtctgtgtaactggacgtaaatataaagataaaatttattatagacatacgggttatgttggtgggattaaaaaattgacatttaaacagatgattatgtcttatcctaataaagtgattgaatcctcagttagaggaatgttgcctaaaaattcattaggtcgtatgatgtttaaacgattgaaagtatattcaggatctattcatagtcataatgcgcagtctcctaaagttttagaatatttatga

SEQ ID NO: 31837 - protein, 139 aa, Candidatus Blochmannia floridanus
MSRLRIIKRLWYIVDAKNKVLGRLSSNIAKYLIGKHKVEYAPYVDVGDYIIVINSKDVCVTGRKYKDKIYYRHTGYVGGIKKLTFKQMIMSYPNKVIESSVRGMLPKNSLGRMMFKRLKVYSGSIHSHNAQSPKVLEYL

SEQ ID NO: 31838 - DNA, 429 bp, Bordetella pertussis
  CDS (1)..(429)
atgaagacctttgtggccaagccgcatgaagtcaagcgtgactggtttgtgatcgacgccaagggcaaggtcctcggtcgtgtggccagcgaagtcgcacaccgtctgcgtggcaagcacaaacccgaattcacgccgcacgttgataccggcgattacatcgtcatcatcaacgctgccgatatcgttgtcacgggcaacaaggcgcaagacaagaagtacttccgccacaccacctaccccggtggcatccgtgaaacgaacttcgagaaaatgcagcagcgttttcccggccgcgctatccagaaggctgtcaagggcatgctgcccaaggggccgctgggctacgccatgatcaagaaactcaaggtgtacgccggtgccgagcacccgcacactgctcagcagcccaagccgctggaattctag

SEQ ID NO: 31839 - protein, 142 aa, Bordetella pertussis
MKTFVAKPHEVKRDWFVIDAKGKVLGRVASEVAHRLRGKHKPEFTPHVDTGDYIVIINAADIVVTGNKAQDKKYFRHTTYPGGIRETNFEKMQQRFPGRAIQKAVKGMLPKGPLGYAMIKKLKVYAGAEHPHTAQQPKPLEF

SEQ ID NO: 31840 - DNA, 618 bp, Arabidopsis thaliana
  CDS (1)..(618)
atggcgactcaggctgctgctgctgcctcattcaagggcaacttaaagaaagctgtggcaggtataaagcgtatcaatctcgacggtcttcgttggcgtgtttttgatgccagaggccaggttcttggtagactagcttcccagatatcaaccgtgcttcaagccaaagataagcctacttattgtcctaaccgcgacgatggcgatatttgtattgttctcaatgctaaggaaatcggcttcacaggaagaaagctcactgacaaattctaccgttggcatactgggtacatcggacacctgaaggaacggagtctgaaagatcagatggccaaagatcccacagaggtcattcgtaaggctgtctggcgcatgcttccaagtaacaatttgcgtgatgacagggatcggaagctgaggatatttgaaggcggtgagcatccttttggggacaagccacttgagccatttgtgatgccgcctcgtagagttagagagatgcgaccgcgcgcaaggcgagcaatgatccgtgcgcagaagaaggcagagcaggcagaaaatgagggaacagaggtaaagaaaggaaagaagaggaccctctctgaagtacctgcgtag

SEQ ID NO: 31841 - protein, 205 aa, Arabidopsis thaliana
MATQAAAAASFKGNLKKAVAGIKRINLDGLRWRVFDARGQVLGRLASQISTVLQAKDKPTYCPNRDDGDICIVLNAKEIGFTGRKLTDKFYRWHTGYIGHLKERSLKDQMAKDPTEVIRKAVWRMLPSNNLRDDRDRKLRIFEGGEHPFGDKPLEPFVMPPRRVREMRPRARRAMIRAQKKAEQAENEGTEVKKGKKRTLSEVPA

SEQ ID NO: 31842 - DNA, 1001 bp, Chlorarachnion sp
  CDS (48)..(869)
cggcacgagcgggctccttgcgccattcaccacccccctttcccctgatgcacgactacatcgagatccaaccggctccggcctcgggacacagaagacggcaaactctggggtttgtggcagttattgcgaccgttgcgattggttgcttcgcatacggccttagtaccggagagaagggtctcctcgagctctccccgtccagagccgcaacaaaaatgtcggtagtgaatatgcttccatcaaccatgggaattgatcggactttgaaatgcaattccgccaagaactttttgagaaagacaacgaaaacgctggagaaagtggatatgcctgcagacattgaaattgttggccctgatcctctccagagaaaatcttactacccgaagctagctgatactaaggcctcgaaggaaacctggatcgttctcgatgctcaggatcagattcttggacgtctcgcttcattagcagctacacttgtgatgggaaaatggcaccctctatatcacccagcaatgaatatgggagcacacgtcgtaattatcaacgcggataaggtacgcgttacaggccgaaagtacactgataaactgtacaagcgccatgtaactggacgcccgggctcgatgaaatccgaggctttccgtgatctccaagcaagaatccctgaacgtatcgttgaagtcgctatcaaaggaatgcttccaaaaactcgcctcggacgcgagcaattcaagcaactgcacatctatgctggagatgagaaccctcacacatcccaaaagcctgtcgacttaacgtataagattagcaaaggccagagagaaagcttcatgcaagatagggaactggttaaagaatagatactaaacttgtctagaggtacggttggcaagccaataccttgtagttgctgcgtatgtggtcacgtgactttgatgaaaaataaagtacttttgcatttgaattgtgtattcaaaaaaaaaaaaaaaaaa

SEQ ID NO: 31843 - protein, 273 aa, Chlorarachnion sp
MHDYIEIQPAPASGHRRRQTLGFVAVIATVAIGCFAYGLSTGEKGLLELSPSRAATKMSVVNMLPSTMGIDRTLKCNSAKNFLRKTTKTLEKVDMPADIEIVGPDPLQRKSYYPKLADTKASKETWIVLDAQDQILGRLASLAATLVMGKWHPLYHPAMNMGAHVVIINADKVRVTGRKYTDKLYKRHVTGRPGSMKSEAFRDLQARIPERIVEVAIKGMLPKTRLGREQFKQLHIYAGDENPHTSQKPVDLTYKISKGQRESFMQDRELVKE

SEQ ID NO: 31844 - DNA, 453 bp, Chlamydophila caviae
  CDS (1)..(453)
atggaaaaaagaaaagacacgaaaacaaccattgctaaagcatctgatgctcagaataagtcttggtatgttatcgatgctacaggcaaaaccttggggaggctttcttcagaggtggcaaaaatcttgcgaggcaagcataaagtaacttatacgcctcacatagctatgggtgatggtgttatcgttatcaatgcagagaaagtgcatttgacaggtgctaagaaaggtcaaaaaatataccgatactatacagggtatatttcaggaatgcgcgagattcctttcgaaaatatgttagctaaaaaaccatcttatattatcgagcacgcaattaaaggtatgatgcccaaaactcgcttgggtaaacgtcagttgaaatccttaagaatattaaaaggggattgctacaaaacgttcgaagctcagaagccgattttattagatgtttaa

SEQ ID NO: 31845 - protein, 150 aa, Chlamydophila caviae
MEKRKDTKTTIAKASDAQNKSWYVIDATGKTLGRLSSEVAKILRGKHKVTYTPHIAMGDGVIVINAEKVHLTGAKKGQKIYRYYTGYISGMREIPFENMLAKKPSYIIEHAIKGMMPKTRLGKRQLKSLRILKGDCYKTFEAQKPILLDV

SEQ ID NO: 31846 - DNA, 444 bp, Streptomyces avermitilis
  CDS (1)..(444)
atgcgtacgtacagccccaagcccggcgacattactcgccagtggtacgtcatcgacgcccaggatgtcgtcctgggccgtctggcgaccactgccgcgaacattctgcggggcaagcacaagccgatctatgcgccgcacgtcgacgctggtgacttcgtcatcatcatcaacgcggacaaggtccacctctccggcaacaagaagacccagaagctggcgtaccgccactccggttacccgggtggtctgcgctccgtccgttacgacgagctgctggcgaagaaccccgagaaggccgtcgagaaggccatcaagggcatgatccccaagaacaccctgggccgtcaggtgctctcgaagctgaaggtctactcgggcgaccagcacccgcacgctgcccagcagccggtgccgttcgagatcacccaggtcgcgcagtag

SEQ ID NO: 31847 - protein, 147 aa, Streptomyces avermitilis
MRTYSPKPGDITRQWYVIDAQDVVLGRLATTAANILRGKHKPIYAPHVDAGDFVIIINADKVHLSGNKKTQKLAYRHSGYPGGLRSVRYDELLAKNPEKAVEKAIKGMIPKNTLGRQVLSKLKVYSGDQHPHAAQQPVPFEITQVAQ

SEQ ID NO: 31848 - DNA, 435 bp, Nitrosomonas europaea
  CDS (1)..(435)
atgaagaccttttctgccaaaccacatgaagtaaggcatgagtggtttgtggttgatgcaaccgacaaagttctgggcagactggctgcagcaattgcccatcgcttgcgaggtaaacataagcctatttatacaccgcatgtcgacacgggtgattatatcgtggtcattaacgccgacaagctcagagtgaccggtaacaaggctgaagataagaaatattatcgccacagtggctaccctgggggtatttacgagaccactttcaagaaaatgcatgagcgttttcccaccaggccgcttgaaaaagctgtaaaaggtatgttgcccaagggtccgcttggttatgccatgataaaaaaactgaaaatctatgctggagatactcatcctcatgcggctcagcaaccgcaaccactggaaattaacgcttaa

SEQ ID NO: 31849 - protein, 144 aa, Nitrosomonas europaea
MKTFSAKPHEVRHEWFVVDATDKVLGRLAAAIAHRLRGKHKPIYTPHVDTGDYIVVINADKLRVTGNKAEDKKYYRHSGYPGGIYETTFKKMHERFPTRPLEKAVKGMLPKGPLGYAMIKKLKIYAGDTHPHAAQQPQPLEINA

SEQ ID NO: 31850 - DNA, 429 bp, Coxiella burnetii
  CDS (1)..(429)
atggcgacttacatggcgaatgcaaaaacggttagcccgcgctggttgttggttaatgcagaagggaaaacgctggggcgactggctagtcggatcgctgcgattttgcgaggcaaacataaagctgagtttacgcctcacgtcgacgcgggtgatttcgtcgtggtgattaatgtcgataaacttaaagtcacaggcaataaaactcaagataagcaatatcatcaccattctggctatccgggcggtttgaagacgattaacttcgctgacttgcaagccaaaaaaccacagcgtatcctggagttagctattaagggcatgctccctaaggggcctttaggtcgtcaactgtatcgtaaattgaaaatttatgcgggcgatcagcatccccaccaggctcagcaacctgaattgatcgacttatag

SEQ ID NO: 31851 - protein, 142 aa, Coxiella burnetii
MATYMANAKTVSPRWLLVNAEGKTLGRLASRIAAILRGKHKAEFTPHVDAGDFVVVINVDKLKVTGNKTQDKQYHHHSGYPGGLKTINFADLQAKKPQRILELAIKGMLPKGPLGRQLYRKLKIYAGDQHPHQAQQPELIDL

SEQ ID NO: 31852 - DNA, 426 bp, Tropheryma whipplei
  CDS (1)..(426)
atgtcttctaagcagtgggttttggttgacgccaaggatatggttttgggccgtcttgccacccaggttgcagttttgctgcggggcaaacacaggcccacttacgagcctcatcttgacacaggtgactgtgtcattgtagtgaatgccgctcttatccgcgtgacttcgaataagcatgctaaaaaagttttctacactcactccgggtatccgggtggactgaaaaaacgtggcttttctgatgtatttcaaaaaagcccggagagggttctggaaaaagctgttaaggggatgttgccaaaaaacaaacttggcagatcggtttttcgcaacctccgggtctatcccgggcaggatcatccgcatgccgcgcagaagccatctgtctatgcacctactagggttgcgcaggtgctcgtctga

SEQ ID NO: 31853 - protein, 141 aa, Tropheryma whipplei
MSSKQWVLVDAKDMVLGRLATQVAVLLRGKHRPTYEPHLDTGDCVIVVNAALIRVTSNKHAKKVFYTHSGYPGGLKKRGFSDVFQKSPERVLEKAVKGMLPKNKLGRSVFRNLRVYPGQDHPHAAQKPSVYAPTRVAQVLV

SEQ ID NO: 31854 - DNA, 603 bp, Dictyostelium discoideum
  CDS (1)..(603)
atgtcaagagcaatttttaaaaatccattaacatcatcacatttatggcatgttattgatgcatcaggacacagagttggtagattagcaacaaagatttcagaattattaagaggtaaacataaaccaatttatgatagatcagtaccattagagtgtggtgattatgtcgttgtattgaatgcacataaagttgaatttacaggtaaaaaatgggaccaaaaaatgtacagaaagcatagtggttatccaaggtggttaaaagaaccctcgcaaaagacatgtaaacttttaaagatttacgatggaattttcaatccacatcaaggtcaaatcacagccacaccatcatcaccaatagcattaaatatcggtccattcgttgaaaaacaaatcgaaccaactcaagaacaaatcgatgaatactatgctggttataaattacaaattaataatgattctcaatcttttgatctccttgaaactaaagttcgttcacataaagatcaacttaaacgtgaaagaagattattaagaaagaaaagagttaatgaattaaaaccattaagatcaccaccaaaaactgaagaaattgataattaa

SEQ ID NO: 31855 - protein, 200 aa, Dictyostelium discoideum
MSRAIFKNPLTSSHLWHVIDASGHRVGRLATKISELLRGKHKPIYDRSVPLECGDYVVVLNAHKVEFTGKKWDQKMYRKHSGYPRWLKEPSQKTCKLLKIYDGIFNPHQGQITATPSSPIALNIGPFVEKQIEPTQEQIDEYYAGYKLQINNDSQSFDLLETKVRSHKDQLKRERRLLRKKRVNELKPLRSPPKTEEIDN

SEQ ID NO: 31856 - DNA, 429 bp, Xylella fastidiosa
  CDS (1)..(429)
atgactacgttcactgcaaaaaacgagaccgtacagcgtgactggtatcttgttgacgccgaaggcaagaccctcggtcgccttgcaacagagttggcgcgccgcctactcggcaaaacgaaacctgtctacactccccatgttgatacaggcgattatcttgtcgtgattaatgccgagaaggtcgttgttacaggcaaaaaactcactgataagtactaccaccgcttcaccggatatgtaggcaatcttaagagtgagagcctcggacaagcgctgcaacgccatccggagcgagtgcttgagatcgcagtcaaaggcatgcttccgaaagggccactaggccgcgctatgtaccgcaagcttaaagtctacacgggctccaagcatccacacaccgcgcagcagccacaagttctggacatataa

SEQ ID NO: 31857 - protein, 142 aa, Xylella fastidiosa
MTTFTAKNETVQRDWYLVDAEGKTLGRLATELARRLLGKTKPVYTPHVDTGDYLVVINAEKVVVTGKKLTDKYYHRFTGYVGNLKSESLGQALQRHPERVLEIAVKGMLPKGPLGRAMYRKLKVYTGSKHPHTAQQPQVLDI

SEQ ID NO: 31858 - DNA, 429 bp, Vibrio parahaemolyticus
  CDS (1)..(429)
atgaaaactttcgttgctaaaccagaaactgtaaaacgcgactggtacgttgtagacgctgaaggtaaaactcttggccgtctagcaagtgaaattgcatctcgcctacgtggcaaacataaagctgaatacactcctcacgttgacgctggtgactacatcatcgttatcaacgctgagaaagttgctgtaactggtaacaaagctaaagacaaagtgtactaccgtcactctgagttcccaggtggtctaaaatctatcacttttgaaaagctgatcgatcgtaaacctgagatggttcttgagctagcagttaaaggcatgcttccacgtggtcctctaggccgtgctatgtaccgtaagcttaaagtttacgcaggcgctgagcacaaccatgttgctcaacaaccacaagtactagacatctaa

SEQ ID NO: 31859 - protein, 142 aa, Vibrio parahaemolyticus
MKTFVAKPETVKRDWYVVDAEGKTLGRLASEIASRLRGKHKAEYTPHVDAGDYIIVINAEKVAVTGNKAKDKVYYRHSEFPGGLKSITFEKLIDRKPEMVLELAVKGMLPRGPLGRAMYRKLKVYAGAEHNHVAQQPQVLDI

SEQ ID NO: 31860 - DNA, 429 bp, Pseudomonas syringae
  CDS (1)..(429)
atgaaaacttttactgctaaaccggaaacagttaagcgcgactggttcgtcgtcgacgctgctggtcagaccctgggtcgtctggccaccgaaatcgcgagccgtctgcgtggcaagcacaaaccggaatacactccgcacgttgacaccggcgactacatcgtcgtgatcaatgccgagcagatccgcgttactggtgccaagaccaccgacaagatctactactcacactccggttttccgggcggmatcaagtcgatcaacttcgaaaagctgatcgccaaagctcctgagcgcgtgatcgagaccgcggtcaaaggcatgctgcctaagaacccgctgggtcgcgacatgtatcgtaagctgaaagtctatgcgggcgctgtacaccctcatactgctcagcagcccctagaactgaagttttag

SEQ ID NO: 31861 - protein, 142 aa, Pseudomonas syringae
MKTFTAKPETVKRDWFVVDAAGQTLGRLATEIASRLRGKHKPEYTPHVDTGDYIVVINAEQIRVTGAKTTDKIYYSHSGFPGGIKSINFEKLIAKAPERVIETAVKGMLPKNPLGRDMYRKLKVYAGAVHPHTAQQPLELKF

SEQ ID NO: 31862 - DNA, 444 bp, Lactobacillus plantarum
  CDS (1)..(444)
atgcgtacaacatatatggctaaaccaggtgaaattgatcgtaaatggtatgtagttgatgcaaccgatgtacctttgggtcgtctttcaactgtcgtcgcatcaatcttgcgtggtaagaacaaacctacctttacccctaacgtggatactggtgataacgttatcgttattaatgcaagcaaggtcgctttaactgggaagaaagcagaacggaagatttattatcatcatactgcttatgctggtggtttaaaggaacggactgccggtgacttcttggcaaaggaacctactaaattgattgaaacttcagttaagggtatgcttcctcacaactctttaggccacaagatgggcttgaagttgcatgtttatgctggtgcagaacatacgcaacaagcacaaaagcctgaagttttggacatcactaacttaatctaa

SEQ ID NO: 31863 - protein, 147 aa, Lactobacillus plantarum
MRTTYMAKPGEIDRKWYVVDATDVPLGRLSTVVASILRGKNKPTFTPNVDTGDNVIVINASKVALTGKKAERKIYYHHTAYAGGLKERTAGDFLAKEPTKLIETSVKGMLPHNSLGHKMGLKLHVYAGAEHTQQAQKPEVLDITNLI

SEQ ID NO: 31864 - DNA, 435 bp, Clostridium tetani
  CDS (1)..(435)
atgaaatcatacatcgcgaaaccagaagaggttcaaagaaaatggtacgttgttgatgcagaaggaaaaccactaggaagagtggcaagtcaagttgctctaattttaagaggaaagaataagcctacatatacaccacatgtagacacaggagactacgttgttattataaatgctgaaaaagtagtattaacaggtaaaaaattagatcaaaagatgttaagacatcactcattatatccaggtggattaaaagaagtaccttataaggaagctttagctaaaaaaccagaatttgtttttgaagaagcggttagaagaatgcttccaaagggaccattaggaagaaaaatgcttaaaaagttaaaagtttacagaggttcagaacataataatgaagctcaaaacccagaagttttagaattaagatattaa

SEQ ID NO: 31865 - protein, 144 aa, Clostridium tetani
MKSYIAKPEEVQRKWYVVDAEGKPLGRVASQVALILRGKNKPTYTPHVDTGDYVVIINAEKVVLTGKKLDQKMLRHHSLYPGGLKEVPYKEALAKKPEFVFEEAVRRMLPKGPLGRKMLKKLKVYRGSEHNNEAQNPEVLELRY

SEQ ID NO: 31866 - DNA, 462 bp, Bacteroides thetaiotaomicron
  CDS (1)..(462)
atggatactttaagttacaagaccatttctgcaaacaaagcgaccgtaaccaaagaatgggttatcgttgacgctacagaccaaactttaggtcgtctgggagcaaaagttgcaaaattgctgagaggaaagtacaaaccaaactttactcctcacgtagactgcggtgataacgttattatcatcaatgcagacaaagtaaaactgactggtaacaaatggaatgacagagtatatttgtcatatacaggctaccctggtggtcagagagaaatgactcctgcccgtttgatcactaaaccgaacggcgaagagagattactgaaaaaagtagtgaaaggtatgcttcctaagaatatcttgggagctaaattgctgggtaacctgtatgtatacgctggtagcgaacacaaacatgaagctcagagcccgaaaatgattgatattaattcatataaataa

SEQ ID NO: 31867 - protein, 153 aa, Bacteroides thetaiotaomicron
MDTLSYKTISANKATVTKEWVIVDATDQTLGRLGAKVAKLLRGKYKPNFTPHVDCGDNVIIINADKVKLTGNKWNDRVYLSYTGYPGGQREMTPARLITKPNGEERLLKKVVKGMLPKNILGAKLLGNLYVYAGSEHKHEAQSPKMIDINSYK

SEQ ID NO: 31868 - DNA, 438 bp, Staphylococcus epidermidis
  CDS (1)..(438)
atgcgtcaaacatttatggcaaatgaatcaaacattgagcgcaaatggtatgttattgatgctgaaggccaaacattaggtcgtttatcatcagaagtagctgctatattacgcggtaaaaataaagtaacttatacaccacatgttgatactggtgattatgtaattatcattaatgcatctaaaattgaattcactggtaacaaagaacaagacaaaatgtatcaccgtcattcaaatcacccaggcggtttaaaatcaatctccgctggtgaattaaaaagaacaaatcctgaacgtttattagaaacttcaattaaaggtatgttaccaagtacacgcttaggtgaaaaacaaggtaaaaaattatttgtatatggtggcgctgaacatccacacgctgcacaacaaccagaaaactacgagttacgtggttaa

SEQ ID NO: 31869 - protein, 145 aa, Staphylococcus epidermidis
MRQTFMANESNIERKWYVIDAEGQTLGRLSSEVAAILRGKNKVTYTPHVDTGDYVIIINASKIEFTGNKEQDKMYHRHSNHPGGLKSISAGELKRTNPERLLETSIKGMLPSTRLGEKQGKKLFVYGGAEHPHAAQQPENYELRG

SEQ ID NO: 31870 - DNA, 444 bp, Yersinia pestis
  CDS (1)..(444)
atgggtaagcttttaatgaaaactttcacagctaaaccagaaactgtaaaacgcgactggtatgttgttgacgcgagcggtaagactttaggtcgcctcgctactgaactggctcgtcgcctgcgcggcaagcataaagcggaatacaccccgcacgttgatactggtgattacatcatcgttctgaacgcagaaaaagttgctgtaaccggcaacaagcgtacagacaagatttattaccatcacaccggtttcgtcggtggtatcaaacaagcgacctttgaagagatgattgcccgccgtcctgagcgtgtgattgaaatcgcggttaaaggcatgctgccgaagggcccgttgggtcgtgcaatgtaccgtaagcttaaagtttacgcgggtactgagcacaatcatgcggcacagcaaccgcaagttctggacatttaa

SEQ ID NO: 31871 - protein, 147 aa, Yersinia pestis
MGKLLMKTFTAKPETVKRDWYVVDASGKTLGRLATELARRLRGKHKAEYTPHVDTGDYIIVLNAEKVAVTGNKRTDKIYYHHTGFVGGIKQATFEEMIARRPERVIEIAVKGMLPKGPLGRAMYRKLKVYAGTEHNHAAQQPQVLDI

SEQ ID NO: 31872 - DNA, 429 bp, Wigglesworthia glossinidia brevipalpis
  CDS (1)..(429)
atgaaaacttttatgctaaaaaaaaatattgcaagacaaaattggcatatttttgatgcaaaaaataaaattttaggaagattctctacaaaattagcaagtatcttaaaaggaaagaacgatataacatatactcctcatgttgattctggaaattatgttatagtaattaattctaaaaaaataaaaatcactgggaaaaaattaaaaaataaattttattatcatcacacagggtatagcggaggaataaaaaaaataagcttagaaaatatgataaaaaataattcagaactagtgatatataaatctgtaaaaggtatgcttccaaaaggaagtttaggaagagttatgataaaaaaattaaaaattttttctggagaaagtcataaccatgaagctcaaaaaccaaaaaaacttttaacatga

SEQ ID NO: 31873 - protein, 142 aa, Wigglesworthia glossinidia brevipalpis
MKTFMLKKNIARQNWHIFDAKNKILGRFSTKLASILKGKNDITYTPHVDSGNYVIVINSKKIKITGKKLKNKFYYHHTGYSGGIKKISLENMIKNNSELVIYKSVKGMLPKGSLGRVMIKKLKIFSGESHNHEAQKPKKLLT

SEQ ID NO: 31874 - DNA, 459 bp, Synechococcus elongatus
  CDS (1)..(459)
atgaccagtaccgtaaagacaccactgcccgctgtggatgaccttgctccccagtggtatgtcattgatgccgctgatcaacggttgggtcggctagccgcagaaattgcccgcattctcaggggcaaaaacaaagccatttacaccccccacatggatacgggtgactttgtgattgtcatcaatgccgaaaaagtcaccgtcaccggcaaaaaacgctcccaaaaactctaccgtcgtcactccggccgtcccggcggcatgaaaattgaaacctttgatcaactccaagcccgtattccggagcggattattgagcacgctgttaaggggatgctgccaaaaaattccctgggccgcaaactctttaccaagctgaaagtttatgctggcccagagcatcctcaccaagcgcaaaaaccccagcctttgaccattaacacaattccgggagcctaa

SEQ ID NO: 31875 - protein, 152 aa, Synechococcus elongatus
MTSTVKTPLPAVDDLAPQWYVIDAADQRLGRLAAEIARILRGKNKAIYTPHMDTGDFVIVINAEKVTVTGKKRSQKLYRRHSGRPGGMKIETFDQLQARIPERIIEHAVKGMLPKNSLGRKLFTKLKVYAGPEHPHQAQKPQPLTINTIPGA

SEQ ID NO: 31876 - DNA, 447 bp, Streptococcus mutans
  CDS (1)..(447)
atgaacaaaacaacatacatggctaagccaggtgaagttgaacgtaaatggtacattgttgatgcgactgatgtccctcttggacgcctatcagcagttgttgccagcgtacttcgcggtaaaaacaaaccaacattcacacctcatacagacacaggtgactttgttattgttattaatgctgaaaaggttaaattaactggtaaaaaagcagctaataaaatctactacactcactcaatgtatccaggtggattaaagcaaatctctgctggtgaattgcgttctaaaaatgctgtgcgtttgattgaaaaatctgttaaagggatgcttccgcataacactcttggacgtgcacaaggtatgaaattgaaagtctttgttggttctgagcatacacatgctgcacaacaaccagaagtacttgatattacaggacttatctag

SEQ ID NO: 31877 - protein, 148 aa, Streptococcus mutans
MNKTTYMAKPGEVERKWYIVDATDVPLGRLSAVVASVLRGKNKPTFTPHTDTGDFVIVINAEKVKLTGKKAANKIYYTHSMYPGGLKQISAGELRSKNAVRLIEKSVKGMLPHNTLGRAQGMKLKVFVGSEHTHAAQQPEVLDITGLI

SEQ ID NO: 31878 - DNA, 447 bp, Streptococcus agalactiae
  CDS (1)..(447)
atgaacaaaacaactttcatggctaaaccaggccaagttgaacgcaaatggtacgttgttgacgcagcagatgtacctcttggacgtctttctgcagtagttgctagcgtacttcgcggaaaaaacaaaccaactttcacaccacacactgatacaggtgactttgtgattgttatcaatgctgaaaaagttaaattaactggtaaaaaagcgtcagataaaatctactacactcactcaatgtatccaggtggtttgaaacaaatctcagcaggtgaacttcgttctaaaaatgctgttcgtttgattgaaaaatcagttaaaggcatgcttccacataacactcttggacgtgcacaaggtatgaaattgaaagtatttgttggcggtgagcatacacatgctgcacaacaaccagaagtacttgatatctcaggacttatctag

SEQ ID NO: 31879 - protein, 148 aa, Streptococcus agalactiae
MNKTTFMAKPGQVERKWYVVDAADVPLGRLSAVVASVLRGKNKPTFTPHTDTGDFVIVINAEKVKLTGKKASDKIYYTHSMYPGGLKQISAGELRSKNAVRLIEKSVKGMLPHNTLGRAQGMKLKVFVGGEHTHAAQQPEVLDISGLI

SEQ ID NO: 31880 - DNA, 429 bp, Shewanella oneidensis
  CDS (1)..(429)
atgaagacttttactgctacaccagaaactgtaactcgtgactggttcgtcgttgatgcagacggcaaaactttaggtcgtatcgctaccgaaatcgctctgcgtttacgcggtaagcacaagcctgaatacactcctcacgttgacactggtgattacatcatcgttatcaacgctgagaaagttactgttactggtaacaaagcgcaaggcaagacgtactactcgcactcaggcttccctggtggcattaagcaaatcagctttgaaaagctgcaagctcataagccagaaatgatcatcgagaaagcagttaagggtatgttaccaaaaggtccactgggccgtgccatgttccgtaaactgaaagtttacgctggcgcagaacataaccacgctgcacaacaacctcaagttcttgatatctaa

SEQ ID NO: 31881 - protein, 142 aa, Shewanella oneidensis
MKTFTATPETVTRDWFVVDADGKTLGRIATEIALRLRGKHKPEYTPHVDTGDYIIVINAEKVTVTGNKAQGKTYYSHSGFPGGIKQISFEKLQAHKPEMIIEKAVKGMLPKGPLGRAMFRKLKVYAGAEHNHAAQQPQVLDI

SEQ ID NO: 31882 - DNA, 438 bp, Oceanobacillus iheyensis
  CDS (1)..(438)
atgcgcacaactttcatggcgaatgaagcgaatattgaacgcaaatggcttgttgtggatgctgaaggacaacgtcttggtcgtttagcaagtgaagtagcatctatccttcgtggaaagcataaagctacttacacaccacacgctgatacaggagataatgtcatcattattaatgctgacaaaatcgaattaactggtaacaaaatcaacgataaaatgtactatcgtcactctaaccacccaggtggattaaaagagcgtaacgcttacgaaatgcgtactaaatacccagagcaaatgcttgaaatcgcggttaaaggtatgcttccaaaaggacctctaggacgtaaaatgggcaagaaattgcacgtttacagaggagcagagcacaaccatcaagcgcaaaaaccagaagtttatgagcttcgcggataa

SEQ ID NO: 31883 - protein, 145 aa, Oceanobacillus iheyensis
MRTTFMANEANIERKWLVVDAEGQRLGRLASEVASILRGKHKATYTPHADTGDNVIIINADKIELTGNKINDKMYYRHSNHPGGLKERNAYEMRTKYPEQMLEIAVKGMLPKGPLGRKMGKKLHVYRGAEHNHQAQKPEVYELRG

SEQ ID NO: 31884 - DNA, 441 bp, Mycoplasma penetrans
  CDS (1)..(441)
atgcaaaaaacaacgtttgttaaaaatgaagctgctttagctaataagaaatgatatgttattgatgcttcaaatttaattttgggtaaattagcagttgaagctgctaacattttgcgtggaaaaaacaaagtagattttactcctaatgtagactgtggtgactatttgataattattaattcagataagattgttttatcttctgataaagcagatagagaaaaatgatacacacattcaggatatattggtgggttaaaagaaaaaagtggaagattaatgattgaaaaatattcagataaattaatctatggtgctattaaaggaatgctacctaaaaatacactatcaagatacttaattaagaaactttttatctacaaagatgctaatcacaagcaagcagctcaaaaaccaatggaaataaaattaaattaa

SEQ ID NO: 31885 - protein, 146 aa, Mycoplasma penetrans
MQKTTFVKNEAALANKKWYVIDASNLILGKLAVEAANILRGKNKVDFTPNVDCGDYLIIINSDKIVLSSDKADREKWYTHSGYIGGLKEKSGRLMIEKYSDKLIYGAIKGMLPKNTLSRYLIKKLFIYKDANHKQAAQKPMEIKLN

SEQ ID NO: 31886 - DNA, 444 bp, Corynebacterium efficiens
  CDS (1)..(444)
atgtctacttaccacccgaagagcggtgacatcacccgtaagtggtacgtcatcgacgccactgacgtggtcctgggtcgcctggccacccacgccgccgacctgcttcgcggcaagggcaagcccctgttcgcacccaacgttgactgcggtgaccatgtcatcatcatcaacgctgacaaggttgccatcacctccaacaagcgcgatcgcgagatgcgctaccgccactccggttacccgggtggtctgaagtccatgaccctgggccgttccctggaactgcacccggagcgtgtgctcgaggaatccatcaccggcatgatgccgcacaacaagctgaccgctgcatctgtgaagaagctgcacgtcttcgctggttctgagcacccatacgctgctcagaagccggagacctacgagatcaagaaggtggcccagtaa

SEQ ID NO: 31887 - protein, 147 aa, Corynebacterium efficiens
MSTYHPKSGDITRKWYVIDATDVVLGRLATHAADLLRGKGKPLFAPNVDCGDHVIIINADKVAITSNKRDREMRYRHSGYPGGLKSMTLGRSLELHPERVLEESITGMMPHNKLTAASVKKLHVFAGSEHPYAAQKPETYEIKKVAQ

SEQ ID NO: 31888 - DNA, 465 bp, Brucella suis
  CDS (1)..(465)
atggcaactttctcccagaagccggctgaagtggtgaagaagtgggtgctgatcgacgccgaaggtctcgtcgtcggccgtctcgcatcgctcgtcgccaatcgcctgcgtggcaagcacaaggcaaccttcaccccgcatgttgacgatggcgacaatgtcatcatcatcaatgccgacaaggttgttctgaccggcaagaaatataccgacaagaaatactactggcacaccggccatccgggcggcatcaaggagcgtaccgctcgccagattctcgaaggccgtttcccggaacgcgttcttgagaaggctattgagcgtatgatcccgcgtggtccgctcggccgtcgccagatgaagaacctgcgcgtttatgcaggcccgaaccatcagcacgaagctcagcagcctgaagtcctcgacgtcgcagcgctgaaccgcaagaacaaagggaatgcataa

SEQ ID NO: 31889 - protein, 154 aa, Brucella suis
MATFSQKPAEVVKKWVLIDAEGLVVGRLASLVANRLRGKHKATFTPHVDDGDNVIIINADKVVLTGKKYTDKKYYWHTGHPGGIKERTARQILEGRFPERVLEKAIERMIPRGPLGRRQMKNLRVYAGPNHQHEAQQPEVLDVAALNRKNKGNA

SEQ ID NO: 31890 - DNA, 450 bp, Bifidobacterium longum
  CDS (1)..(450)
atgaaaactttcactccgaagccagctgatctgactcatgactggtacgtcatcgacgccaccgacgtggtgctcggccgtctcgccacccaggctgcaatcctgctgcgcggcaagaacaagccgacctacgctccgcacgccgattccggcaaccacgtgatcatcatcaatgccgacaagattgctctgactggcaacaagatgggcaaggagctctactcgcactccggccgtcccggtggtctgcgtcgtgactcctacgccgagctgctcgagaagaaccccgagcgcatcatcaagaacgctgtcaagggcatgctgccgaagaaccgtctggccaaggtgcagctcgaccgcctgcgtatcttccgtggcgccgagcacccgcacaccccgcagaagccccaggtcttcgagatcgcccaggtctcgcagcaggccaagtga

SEQ ID NO: 31891 - protein, 149 aa, Bifidobacterium longum
MKTFTPKPADLTHDWYVIDATDVVLGRLATQAAILLRGKNKPTYAPHADSGNHVIIINADKIALTGNKMGKELYSHSGRPGGLRRDSYAELLEKNPERIIKNAVKGMLPKNRLAKVQLDRLRIFRGAEHPHTPQKPQVFEIAQVSQQAK

SEQ ID NO: 31892 - DNA, 447 bp, Streptococcus pyogenes
  CDS (1)..(447)
atgaacaaaacaactttcatggctaaaccaggccaagttgaacgcaaatggtacgttgttgacgcaactgatgtgccacttggacgtctttctgcagtagttgctagcgtacttcgcggaaaaaacaaaccaactttcacaccacatactgatacaggtgattttgttatcgttatcaacgctgaaaaagttaaattaactggtaaaaaagcgactgataaagtttactacactcactcaatgtacccaggtggtttgaaatcaatcactgctggtgaacttcgctctaaaaacgcagttcgcttgattgaaaaatcagttaaaggcatgcttccacataacactcttggacgtgcacaaggtatgaaattgaaagtcttcgttggcggtgagcacactcacgcagcacaacaaccagaagtacttgacatctcaggacttatctaa

SEQ ID NO: 31893 - protein, 148 aa, Streptococcus pyogenes
MNKTTFMAKPGQVERKWYVVDATDVPLGRLSAVVASVLRGKNKPTFTPHTDTGDFVIVINAEKVKLTGKKATDKVYYTHSMYPGGLKSITAGELRSKNAVRLIEKSVKGMLPHNTLGRAQGMKLKVFVGGEHTHAAQQPEVLDISGLI

SEQ ID NO: 31894 - DNA, 453 bp, Chlorobium tepidum
  CDS (1)..(453)
atgagcaaaacgttaagttttaaaacatactcagccaaaccgggcgaggtgaaaaggacatggcacatcattgatgcggagaaccaggtgctcggtagaatggctgcccagatcgccaatgttctgaggggaaagcacaagccgcagttcaccccccacatcgataccggtgatttcgtggtcgtgaccaacgccgccaaagttgcgctgagcggtaagaaacgcgacgacaaaacctacttctcgcactcccactatccgggtggcgtcaggatcgacagtgtaaaggaccttctccagaaaaagccggaaaaggtgatcgagcacgctgtgtggggtatgctgccgcacaacaaccttggccgccagctcttcaagaagctgaaggtctatgcaggcccggagcatccgcacgctgcccagatgccggtggaaatgaaaatcaatcaataa

SEQ ID NO: 31895 - protein, 150 aa, Chlorobium tepidum
MSKTLSFKTYSAKPGEVKRTWHIIDAENQVLGRMAAQIANVLRGKHKPQFTPHIDTGDFVVVTNAAKVALSGKKRDDKTYFSHSHYPGGVRIDSVKDLLQKKPEKVIEHAVWGMLPHNNLGRQLFKKLKVYAGPEHPHAAQMPVEMKINQ

SEQ ID NO: 31896 - DNA, 375 bp, Candidatus Tremblaya princeps
  CDS (1)..(375)
atgaaagacaacggtcagcatgtgctggacgcgcgcggaatggttctaggcaggctagctgtaaccgttgcagggctactgcgcggaaaatacaaggcaagctatgcacacaacgcagctccgcacaacgcagtgacagtattgaactgcgagcacgtaaggataagcggcagcaaggcagtaggcaaggtgtactataggcactcagggcatcccggtgggctaaggcgcacaaagctgcacgacctaatgctgagaagcccggcaacagtactaagagccgccgttcatggcatgctgccacggaacaggcttagggatagattcatgagtatgctaatggtgcatgctaatgagggggcagcacgccgatga

SEQ ID NO: 31897 - protein, 124 aa, Candidatus Tremblaya princeps
MKDNGQHVLDARGMVLGRLAVTVAGLLRGKYKASYAHNAAPHNAVTVLNCEHVRISGSKAVGKVYYRHSGHPGGLRRTKLHDLMLRSPATVLRAAVHGMLPRNRLRDRFMSMLMVHANEGAARR

SEQ ID NO: 31898 - DNA, 429 bp, Xanthomonas axonopodis
  CDS (1)..(429)
atgactacgttcaccgccaagtccgagaccgtccagcgcgactggtatctcgttgacgccgccggcaagacgctcggccgtctgtccaccgaactggcccgccgcctgcgcggcaagcacaagccggtttacacccctcacgtcgatactggcgattacctggtggtgatcaacgccgagaagatcgtcgtcacgggcaacaagctgaaagacaagaagtatcaccgcttcaccggctacatcggtaacttgaagaccgagagcctggagcaggcgctgcagcgccacccggagcgcgtgatcgaaatcgccgttaagggcatgctgccgaagggtccactgggccgcaccatgtaccgcaagctcaaggtctattcgggtgccgagcatccgcacgccgcccagcagccgcaagttctggatatctaa

SEQ ID NO: 31899 - protein, 142 aa, Xanthomonas axonopodis
MTTFTAKSETVQRDWYLVDAAGKTLGRLSTELARRLRGKHKPVYTPHVDTGDYLVVINAEKIVVTGNKLKDKKYHRFTGYIGNLKTESLEQALQRHPERVIEIAVKGMLPKGPLGRTMYRKLKVYSGAEHPHAAQQPQVLDI

SEQ ID NO: 31900 - DNA, 444 bp, Corynebacterium glutamicum
  CDS (1)..(444)
atgtctacttaccacccgaagagcggtgacatcacccgtaagtggtacgtcatcgacgccactgacgtggttctgggtcgcctggcaacccacgccgctgacctacttcgcggcaagggcaagcctttgtacgcacctaacgttgactgcggcgaccacgtaatcgtgatcaacgctgacaaggttgcagttacctccaacaagcgcgagcgcgaaatgcgttaccgccactccggttaccctggtggcctgaagtccatgaccctgggtcgttccctggatctgcacccagagcgcaccatcgaggattccatcgtcggcatgatgccacacaacaagctcactgctgcttccgcaaagaagctgcacgttttctccggctccgagcacccatacgctgctcagaagcctgaggcctacgagatcaagaaggtggcccagtag

SEQ ID NO: 31901 - protein, 147 aa, Corynebacterium glutamicum
MSTYHPKSGDITRKWYVIDATDVVLGRLATHAADLLRGKGKPLYAPNVDCGDHVIVINADKVAVTSNKREREMRYRHSGYPGGLKSMTLGRSLDLHPERTIEDSIVGMMPHNKLTAASAKKLHVFSGSEHPYAAQKPEAYEIKKVAQ

SEQ ID NO: 31902 - DNA, 429 bp, Streptococcus pyogenes
  CDS (1)..(429)
atggctaaaccaggccaagttgaacgcaaatggtacgttgttgacgcaactgatgtgccacttggacgtctttctgcagtagttgctagcgtacttcgcggaaaaaacaaaccaactttcacaccacacactgatacaggtgattttgttatcgttatcaacgctgaaaaaattaaattaactggtaaaaaagcgactgataaagtttactacactcactcaatgtacccaggtggtttgaaatcaatcactgctggtgaacttcgctctaaaaacgcagttcgcttgattgaaaaatcagttaaaggcatgcttccacataacactcttggacgtgcacaaggtatgaaattgaaagtcttcgttggcggtgagcacactcacgcagcacaacaaccagaagtacttgacatctcaggacttatctaa

SEQ ID NO: 31903 - protein, 142 aa, Streptococcus pyogenes
MAKPGQVERKWYVVDATDVPLGRLSAVVASVLRGKNKPTFTPHTDTGDFVIVINAEKIKLTGKKATDKVYYTHSMYPGGLKSITAGELRSKNAVRLIEKSVKGMLPHNTLGRAQGMKLKVFVGGEHTHAAQQPEVLDISGLI

SEQ ID NO: 31904 - DNA, 489 bp, Methanosarcina mazei
  CDS (1)..(489)
atgaagagatcatggaagcaaatccaaaagggtccggtatccggatattccgctgaggtgacgaagatgacggttatcgatgcaaaagggcttattctggggcgtcttgcaagttcagttgcaaaacagttgctttcaggagacgaaaaggtttatatcataaatgccgaaaaagccatcatttctggctcaagggcagccactctcagagaataccgggaaacccgggataggggtgcaacggaattcgggccttacttcccgaagcgtccggaccgcattctgaagaggactattcgtggcatgctgccctataagagagcaagaggcagagacgcaatgtccaggctcaaagtctatgtaggtgtcccctacgaacttaagggcgctgagacaaccaccatcgcagatgccgacatgaggcttctgagttctaacaagtacgtagagcttggtgaagtgagccagaaaatgggttcaaagttctaa

SEQ ID NO: 31905 - protein, 162 aa, Methanosarcina mazei
MKRSWKQIQKGPVSGYSAEVTKMTVIDAKGLILGRLASSVAKQLLSGDEKVYIINAEKAIISGSRAATLREYRETRDRGATEFGPYFPKRPDRILKRTIRGMLPYKRARGRDAMSRLKVYVGVPYELKGAETTTIADADMRLLSSNKYVELGEVSQKMGSKF

SEQ ID NO: 31906 - DNA, 432 bp, Thermoanaerobacter tengcongensis
  CDS (1)..(432)
atgaaatcctatatggctaaacccagtgacgtggaaagaaaatggtttgtcatagatgcagaaggaaaagtattgggaagattagcgagccagatcgctaaaatactgatgggaaaacacaaacccacatatactccccatgtggatacaggtgattttgttgtggttatcaatgccgataaagtagtattgacaggcaaaaaattggaagataaatattacaaatattatacaggttatccaggtggactaaaacagattcaatataaaaaattaatgcagacaaaacctgaatttgtcatatatcatgccgtaaaaggcatgttgcctaaaaataggttggggaggagaatgataaagaggctaaaagtatacagaggggctgagcacaagcatcaggctcaaaaacctgagaaattggatatagaatga

SEQ ID NO: 31907 - protein, 143 aa, Thermoanaerobacter tengcongensis
MKSYMAKPSDVERKWFVIDAEGKVLGRLASQIAKILMGKHKPTYTPHVDTGDFVVVINADKVVLTGKKLEDKYYKYYTGYPGGLKQIQYKKLMQTKPEFVIYHAVKGMLPKNRLGRRMIKRLKVYRGAEHKHQAQKPEKLDIE

SEQ ID NO: 31908 - DNA, 435 bp, Fusobacterium nucleatum
  CDS (1)..(435)
atgaaaaaatatacttttatgcaaagaaaagaagatgttgtcagagaatggcaccattatgatgctgaagggcaaattttaggaagattagcagtggaaattgctaaaaaattaatgggtaaagaaaaacttacatttacaccacatattgatggtggagattatgtagtggttacaaatgttgaaaaaatagttgtaactggaaaaaaattaactgataaagtttactacaatcactcaggatttcctggaggaataagagcaagaaaactaggagaaatcttagcaaagaaaccagaagaattattaatgctagctgttaaaagaatgcttccaaaaaataaattaggaagacaacaactaacaagacttagagtgtttgcaggagcagaacattctcatgttgcacaaaaaccaaataaggtagaattataa

SEQ ID NO: 31909 - protein, 144 aa, Fusobacterium nucleatum
MKKYTFMQRKEDVVREWHHYDAEGQILGRLAVEIAKKLMGKEKLTFTPHIDGGDYVVVTNVEKIVVTGKKLTDKVYYNHSGFPGGIRARKLGEILAKKPEELLMLAVKRMLPKNKLGRQQLTRLRVFAGAEHSHVAQKPNKVEL

SEQ ID NO: 31910 - DNA, 432 bp, Methanosarcina acetivorans
  CDS (1)..(432)
atgttgaagatgacggttatcgatgcaaaaggacttattctggggcgtcttgcaagttcagttgcaaaacagctgctttcaggagacgagaaggtttatatcataaatgccgagcaagccatcatttctggttcaagggcagccactctgagagagtaccgggaaacccgggaaagaggtgcaacggaattcgggccttacttcccgaagcgtccggaccgcattctgaagaggactattcgtggcatgttgccctataagagagcaagaggcagagacgcaatgtccaggctcaaagtctatgtaggtgtcccctatgaacttaagggcgctgaaacggtcaccattccggacgccgatatgaggcttctgagttccagcaggtatgtggagcttggtgaagtgagccagaaaatgggttcgaagttctaa

SEQ ID NO: 31911 - protein, 143 aa, Methanosarcina acetivorans
MLKMTVIDAKGLILGRLASSVAKQLLSGDEKVYIINAEQAIISGSRAATLREYRETRERGATEFGPYFPKRPDRILKRTIRGMLPYKRARGRDAMSRLKVYVGVPYELKGAETVTIPDADMRLLSSSRYVELGEVSQKMGSKF

SEQ ID NO: 31912 - DNA, 480 bp, Methanopyrus kandleri
  CDS (1)..(480)
atggtcgagtacgcccactcgaaacctgtcgacccggaagagtggaccgttatcgatgccgaaaacgccgtgctcggtcgcctagccagcgtggtggcgaagaggatcctcaaaggcgagaggatcgccgtcatcaacactgaaaaagccatcatcaccggcaagaagaacaccatcaaagaggagtggctgcagaaaatccagcgaggtgacccgaagaagggtccgttttacccgaggagacccgatctgatcttccgccgggtagtccgcggcatgctcccgtggaagaccaagcgcgggcgtgaagccttcaagcggcttcgcgcgtatatcggtacaccgagatgggtcgaggaggcgaacatcgagcccgagcgggttgccgaggctgacatgagtcggttgggacacctctggtacgtaactctcggcgagctctcggaggagctcggttaccagatgccggggggccagtaa

SEQ ID NO: 31913 - protein, 159 aa, Methanopyrus kandleri
MVEYAHSKPVDPEEWTVIDAENAVLGRLASVVAKRILKGERIAVINTEKAIITGKKNTIKEEWLQKIQRGDPKKGPFYPRRPDLIFRRVVRGMLPWKTKRGREAFKRLRAYIGTPRWVEEANIEPERVAEADMSRLGHLWYVTLGELSEELGYQMPGGQ

SEQ ID NO: 31914 - DNA, 429 bp, Pyrococcus furiosus
  CDS (1)..(429)
atgaggattattaacgctgaaggtttaatacttggaagattggcatcaaaggttgcaaagatgctccttgagggtgaagaagttgtcatagttaatgctgaaaaggctgtaatcactggaaacagagatgtaatctttaagaagtacaagcaaaggacagaattaaggacattaacaaaccccaggagaggaccattctatcccaagaggagcgacgaaattgtgagaagaacaataagaggcatgctcccatggaagaccgacaggggaaggaaggcctttaagaggcttaaggtttatgtgggaattcccaaggagttccaaggtaaggagcttgagactattattgaggctcatgtgtcaaggctttcaagaccaaagtatgttaccgttggtgaggttgcaaaattcctgggaggaaagttctga

SEQ ID NO: 31915 - protein, 142 aa, Pyrococcus furiosus
MRIINAEGLILGRLASKVAKMLLEGEEVVIVNAEKAVITGNRDVIFKKYKQRTELRTLTNPRRGPFYPKRSDEIVRRTIRGMLPWKTDRGRKAFKRLKVYVGIPKEFQGKELETIIEAHVSRLSRPKYVTVGEVAKFLGGKF

SEQ ID NO: 31916 - DNA, 435 bp, Clostridium perfringens
  CDS (1)..(435)
atgaaatcatacattgcaaaagcacaagaagttgaaagaaaatggtatgttgttgacgctgctggaaagccactaggaagagttgctagccaagttgcttcaatattaagaggaaagaacaagccaacatttacaccaaatgttgactgtggagatttcgttatcgttataaacgctgagaaagttgttttaactggtaagaaattagaccaaaaaatgttaagaaaacacagcttatacgctggtggattaaaagaaactccatacagagaagttttagaaaagaaacctgaatttgctttcgaagaagcagttagaagaatgcttccaacaggcgttttaggaagaaaaatgttaaagaaattaaacgtgtacagaggagctgagcacaaccacgctgctcaaaaaccagaagtacttgagttaagatactaa

SEQ ID NO: 31917 - protein, 144 aa, Clostridium perfringens
MKSYIAKAQEVERKWYVVDAAGKPLGRVASQVASILRGKNKPTFTPNVDCGDFVIVINAEKVVLTGKKLDQKMLRKHSLYAGGLKETPYREVLEKKPEFAFEEAVRRMLPTGVLGRKMLKKLNVYRGAEHNHAAQKPEVLELRY

SEQ ID NO: 31918 - DNA, 429 bp, Ralstonia solanacearum
  CDS (1)..(429)
atgaagaccttttccgcgaagccccatgaggtgaagcgcaattggttcgtgattgacgcgacggacaaggtcctcgggcgtgtcgccagcgaagtggcactccgactgcgcggcaagcacaaacccgaattcactccgcacgtcgacacgggcgatttcatcatcgtgatcaacgcagccaagctgcgtgtgacgggcgccaagacgaccgacaagaagtactatcgccactcgggctacccgggcggtatctacgaaacgacgttcggcaagatgcagcagcgtttcccgggccgcgccctggaaaaagccgtgaagggcatgctgccgaagggtccgctgggctacgcgatgatcaagaagctgaaggtgtacgccgaaggctcgcatccgcacgaagctcagcagccgcaagtgctggaaatctaa

SEQ ID NO: 31919 - protein, 142 aa, Ralstonia solanacearum
MKTFSAKPHEVKRNWFVIDATDKVLGRVASEVALRLRGKHKPEFTPHVDTGDFIIVINAAKLRVTGAKTTDKKYYRHSGYPGGIYETTFGKMQQRFPGRALEKAVKGMLPKGPLGYAMIKKLKVYAEGSHPHEAQQPQVLEI

SEQ ID NO: 31920 - DNA, 564 bp, Pyrobaculum aerophilum
  CDS (1)..(564)
atgaacgttgtaaagaggcctctagatatatctcaactgccagatgcaggtgaggtaatagttgatgcggaggggcacgtcgcggggagactagctacttatatcgctaaggcgttacttgagaggccgaatttaagaatagttgtagtaaacgccgaaaagctcgtgataactggagatgagaaaatggtgattgagtggtttaagagaaaaataagcgagtggcgtacgcattataacccagagaaggcgggccctaaggtgccgaggaggcccgatagagtatttaagagaattgtacgaggcatgttgcccaagaagagcgaaactggccgctctgcgttgaagagactgcgagtatatatgtcaattcccattgaaataatgcaaagaaagcggttagtgttatatgaagtgcccgaggcaaagctgaggttaaggccgttgcttcagtacacaactcttgaggaagtttggcgcagtattgaccctgaagcctgggagaagtggagaagagccgtggaggtgtggggcaaaaaattaaaacaagttgctagcggatag

SEQ ID NO: 31921 - protein, 187 aa, Pyrobaculum aerophilum
MNVVKRPLDISQLPDAGEVIVDAEGHVAGRLATYIAKALLERPNLRIVVVNAEKLVITGDEKMVIEWFKRKISEWRTHYNPEKAGPKVPRRPDRVFKRIVRGMLPKKSETGRSALKRLRVYMSIPIEIMQRKRLVLYEVPEAKLRLRPLLQYTTLEEVWRSIDPEAWEKWRRAVEVWGKKLKQVASG

SEQ ID NO: 31922 - DNA, 465 bp, Rhizobium meliloti
  CDS (1)..(465)
atggcaaccttcgttcagaagcctgcagaggtggagaagaagtggatcctcatcgacgccgaaggcctcgttgtcggtcgcctcgcttccctcatcgcaaaccgcctgcgcggcaagcataaagccacctacacgccgcatgtcgacgacggcgacaacgtcatcgtcatcaatgcagagaaggccgtcctcaccggcaagaagtacaccgacaagaagtactactggcacaccggttaccccggcggcatcaaggagcgcaccgcgcgccagatcatcgaaggccgcttcccggagcgcgtcatcgagaaggccgtcgagcgcatggttccgcgcggcccgctcggccgtcgccagatgaagaacctgcgtgtctacgccggctcgaaccacccgcacgaagcacagcagccggccgtcctcgacgtcgccaagctgaacagcaagaacacaaggagcgcctga

SEQ ID NO: 31923 - protein, 154 aa, Rhizobium meliloti
MATFVQKPAEVEKKWILIDAEGLVVGRLASLIANRLRGKHKATYTPHVDDGDNVIVINAEKAVLTGKKYTDKKYYWHTGYPGGIKERTARQIIEGRFPERVIEKAVERMVPRGPLGRRQMKNLRVYAGSNHPHEAQQPAVLDVAKLNSKNTRSA

SEQ ID NO: 31924 - DNA, 702 bp, Oryza sativa
  CDS (1)..(702)
atggctacggccatcgcagcctccgcgttcctctcctccgccttcgccagggacaggccgctcccccgccagcggcgcgcggcgaggcccgcgacccgccgcgccgccgcggggggcctgtcggtgcggtgcgagcagagcgagaagcagaagaggcagccgctctccgcgctcgtcccccgcgagcagcgattcatgttcgaaggcgacgagctctgcggccccgacatatggaacacaacatggtaccctaaggctgcagatcatgtaactactgagaagacatggtatgttgttgatgcaacagacaagattctaggtaggcttgcatccaccattgcagtacacatcagaggaaagaatgaggccacatacactccaagtgtggacatgggggcttttgttgttgtggttaatgcagagaaggttgctgtttctggcaaaaagcggtcacagaagctctacaggaggcactctggacggcctggtggaatgaaagaagaaacttttgatcagcttcagaaaaggattccggagagaattattgaacatgcagtgcgtggcatgcttcctaagggcagactgggaagaagactgtttacccacctcaaggtgtacaagggagcagaacatccccatgaggctcaaaaacctgttccactgcctatcaaggataaaagaatacagaagtctgagaagtag

SEQ ID NO: 31925 - protein, 233 aa, Oryza sativa
MATAIAASAFLSSAFARDRPLPRQRRAARPATRRAAAGGLSVRCEQSEKQKRQPLSALVPREQRFMFEGDELCGPDIWNTTWYPKAADHVTTEKTWYVVDATDKILGRLASTIAVHIRGKNEATYTPSVDMGAFVVVVNAEKVAVSGKKRSQKLYRRHSGRPGGMKEETFDQLQKRIPERIIEHAVRGMLPKGRLGRRLFTHLKVYKGAEHPHEAQKPVPLPIKDKRIQKSEK

SEQ ID NO: 31926 - DNA, 465 bp, Rhizobium loti
  CDS (1)..(465)
atgacaaccttttcgcagaagcctgcggatgtggtgaagaagtggatcctgatcgacgccgagggtctcgtcgtcggccgtctcgccactgtcatcgccaatcatcttcgcggcaagcacaagccgaccttcaccccgcatgtcgacgacggcgacaatgtcatcgtcatcaatgccgacaaggtggtgttcaccggcaagaagttcaccgacaaggtctattattggcacaccggccaccccggcggcatcaaggagcgcaccgcgcgccagctgctcgagggtcgtttcccggagcgtgtcgtcgagaaggccgttgagcgcatggtcccgcgtggcccgctcggccgtcgccagatgaagaacctgcgcgtctatgcaggcgccgagcatccgcatgtcgcccagcagccagaagtcctcgacgtggccaagctgaattccaagaacaagaaggtcgcataa

SEQ ID NO: 31927 - protein, 154 aa, Rhizobium loti
MTTFSQKPADVVKKWILIDAEGLVVGRLATVIANHLRGKHKPTFTPHVDDGDNVIVINADKVVFTGKKFTDKVYYWHTGHPGGIKERTARQLLEGRFPERVVEKAVERMVPRGPLGRRQMKNLRVYAGAEHPHVAQQPEVLDVAKLNSKNKKVA

SEQ ID NO: 31928 - DNA, 429 bp, Pasteurella multocida
  CDS (1)..(429)
atgaaaacttttgtagcaaagccagaaacggttaaacgcgactggtatgtagtagatgcgacaggtaaaactttaggtcgtttagcgactgaattagcacgtcgccttcgtggtaaacataaagcggaatacacgccacacgttgatacgggtgattacatcatcgtcattaacgcagagaaagttgctgtaaccggtaacaaagaaagcgataaactttaccactggcacactggctatgtaggtggcatcaaacaagcgactttcaaagaaatgatcgcacgccgtcctgaagcagtgattgaaattgcggtaaaaggtatgttgccaaaaggtccattaggtcgcgcaatgtatcgtaaattgaaagtgtatgcaggttctgaacataaccacgctgcacagcaaccacaagttttagatatttaa

SEQ ID NO: 31929 - protein, 142 aa, Pasteurella multocida
MKTFVAKPETVKRDWYVVDATGKTLGRLATELARRLRGKHKAEYTPHVDTGDYIIVINAEKVAVTGNKESDKLYHWHTGYVGGIKQATFKEMIARRPEAVIEIAVKGMLPKGPLGRAMYRKLKVYAGSEHNHAAQQPQVLDI

SEQ ID NO: 31930 - DNA, 846 bp, Ceratopteris richardii
  CDS (54)..(479): n means a or g or c or t/u
actcactatagggctcgagcggccgcccgggcaggtttagaaccctcctcgaaatggcggctgcgttcaagagggccatggctggtctcacgcctgagcgaatcgagggtcttaggtggagggtttttgatgccaaaggacagatcctcggaaggctggcatcccaaatatctgttgtacttcaagggaaagataaacccacttatgcaccacatcttgagaaaggagacatttgtgtggtgatcaatgccaaacatgtgtgttttacaggaaggaaacttactgacaaattctatcgatggcacacaggctatataggccatttgaaagaaagaagcttgaaagagcaaatgcnaaaggatccaactgaggttattcgcaaggctgtggttcgtatgcttccgaagaacaggctaagagatgaccgggcaagaaagttacgtatatttgtanatgatcagcacccattttgcggataagcctttacaaccttttgaaatgccacccgcgcantgtacgggaactcaggccacgttnanaagcgggcaactgaacnaactcgaaaaaaggctgaaaacaaaaccnncgaaattgggtcttttaaaaaangctaaccaaggaaggaaactaagggtgttaaaaaaggaaaatctctcattggcttggtttaaaatnggtgtttttgaaaaaaaatngctccaccttcccnttgaaaaaaaattttcccttgggtanggantnaaatttgaaatttccttgttccccccgggggtttggcctaaaaaaggaaaaacttttttcccnnaaaattcctnnccnttnatnncnttttttaaaaaaattccc

SEQ ID NO: 31931 - protein, 141 aa, Ceratopteris richardii
  misc_feature (101)..(101): Xaa can be Arg or Gln or Leu or Pro
  misc_feature (134)..(134): Xaa can be Asn or Asp or His or Tyr
MAAAFKRAMAGLTPERIEGLRWRVFDAKGQILGRLASQISVVLQGKDKPTYAPHLEKGDICVVINAKHVCFTGRKLTDKFYRWHTGYIGHLKERSLKEQMXKDPTEVIRKAVVRMLPKNRLRDDRARKLRIFVXDQHPFCG

SEQ ID NO: 31932 - DNA, 414 bp, Arabidopsis thaliana
  CDS (1)..(414)
atggcgactcaggctgctgctgctgcctcattcaagggcaacttaaagaaagctgtggcaggtataaagcgtatcaatctcgacggtcttcgttggcgtgtttttgatgccagaggccaggttcttggtagactagcttcccagatatcaaccgtgcttcaagccaaagataagcctacttattgtcctaaccgcgacgatggcgatatttgtattgttctcaatgctaaggaaatcggcttcacaggaagaaagctcactgacaaattctaccgttggcatactgggtacatcggacacctgaaggaacggagtctgaaagatcagatggccaaagatcccacagaggtcattcgtaaggctgtctggcgcatgcttccaagtaacaatttgcgtgatgtgagtacactataa

SEQ ID NO: 31933 - protein, 137 aa, Arabidopsis thaliana
MATQAAAAASFKGNLKKAVAGIKRINLDGLRWRVFDARGQVLGRLASQISTVLQAKDKPTYCPNRDDGDICIVLNAKEIGFTGRKLTDKFYRWHTGYIGHLKERSLKDQMAKDPTEVIRKAVWRMLPSNNLRDVSTL

SEQ ID NO: 31934 - DNA, 432 bp, Cyanidium caldarium
  CDS (1)..(432)
atgaaaaatccaatccggatgcaaaaagactacaaattacctgtttggtatcttattgatgctcaggaccagattcttggcaaaattgccacaaaagctgcgatcattttgatgggtaaaaacagatctacatattcttacaattccatgagtgcgaattttgttattataataaattcgagacaggtagctataacagggaataagaatactcaaaaagtatataagagatactcggccaaacctggcgctacaaaaacagaaagtttttatcatttaaaaaaaagaattcccaatcgcattttagaacaagctgtcaaaggaatgttgcctaaaagtgttcttggcaaaaaaatgtttagtcatttaaaggtttacgctggtgattcacacccccatttggcacaacagccaattcaactaagtatttaa

SEQ ID NO: 31935 - protein, 143 aa, Cyanidium caldarium
MKNPIRMQKDYKLPVWYLIDAQDQILGKIATKAAIILMGKNRSTYSYNSMSANFVIIINSRQVAITGNKNTQKVYKRYSAKPGATKTESFYHLKKRIPNRILEQAVKGMLPKSVLGKKMFSHLKVYAGDSHPHLAQQPIQLSI

SEQ ID NO: 31936 - DNA, 432 bp, Guillardia theta
  CDS (1)..(432)
atgaataaaacaattataagagaaggaaaaataaatttgggtaaatggtttattatagatgctacggataaaaatttgggtaggttagcgtcagaaaccgctaaaacgttagtaggtaaatatgatcctttatacgcaccaaatgttaatcccaaaaatatcattgtaataattaacgcggataaaataagagtaactggtaataaaaaatttgataaattttattatagacactctggtcaagtgggtggtttaactattgaaacattcaatgaattacaaagccggttaccaggtcgaattttagagaaagctgttaaaggtattctaccaaaaggtcctttaggtcgcgaattgtttaataatttgaaggtttacgctggttcttcacatccccatgaagctcaaaacccggttgcattagttatgtaa

SEQ ID NO: 31937 - protein, 143 aa, Guillardia theta
MNKTIIREGKINLGKWFIIDATDKNLGRLASETAKTLVGKYDPLYAPNVNPKNIIVIINADKIRVTGNKKFDKFYYRHSGQVGGLTIETFNELQSRLPGRILEKAVKGILPKGPLGRELFNNLKVYAGSSHPHEAQNPVALVM

SEQ ID NO: 31938 - DNA, 435 bp, Buchnera aphidicola
  CDS (1)..(435)
atgtatataaaaagtttttctgctaaatctaatgatttcaaaaaaatgtggtattgcattgatgctacagggaaaatattaggtcgattagcaacaaatattgcatctagattacgtggtaaacataaagttgaatataccccgcatgttgatattggtgattatttaatagtgattaacgctaaaaacattaaggttacgggaaaaaaatgtactgataaattttattatcatcatacaggatatgttggaggattaaaaaaaatagcatttaaggatatgttacatcgttatcctgagagaataattgaaattgcagttagagggatgcttccaaaaggaccgttaggtcgttctatgtttaaaaaattgaaagtatacgctaacgacaaccataatcattcagcgcaaaatccaaagattttgaatatttaa

SEQ ID NO: 31939 - protein, 144 aa, Buchnera aphidicola
MYIKSFSAKSNDFKKMWYCIDATGKILGRLATNIASRLRGKHKVEYTPHVDIGDYLIVINAKNIKVTGKKCTDKFYYHHTGYVGGLKKIAFKDMLHRYPERIIEIAVRGMLPKGPLGRSMFKKLKVYANDNHNHSAQNPKILNI

SEQ ID NO: 31940 - DNA, 618 bp, Drosophila melanogaster
  CDS (31)..(567)
tttaaattgtttaattaaaaatctcaaaaaatgtccattgcgaagcgtgtgcagcaatgggcaacgttcgcgcgcacttggcacatttacgattgcacctggcagaatccattcgagtcggcaaaactggttaaaacgcatttattgggcctccaaaagcccatttaccacccaatgaatgactgcggggatcatgtggtgctgatcaacacgcgggaaatcgctttgcccggtgacgagtgggtgaagagggtttacttccaccacaccggctatcctggtggcgcttcgtggaccctggcgtggcagctgcacgagaaggatcccacgatggtgatgaagaaggccgtgtacaactcgatgcgcggaaatctgcagcgcaggcacaccatgcaaagactgcacttgttcgccgacgatcaggtgcccgaggaaatcctgcaaaacgtcacgaatcaaatccgcacgccgcgctctattccccagcgtctggatcatatcgacaaagaaacgctggagaacttccccaacattatggattatcccaaggattatatcttgcgttgatatgctgataggaaatcattgtaattaagataaatacaaaatatggaaaaa

SEQ ID NO: 31941 - protein, 178 aa, Drosophila melanogaster
MSIAKRVQQWATFARTWHIYDCTWQNPFESAKLVKTHLLGLQKPIYHPMNDCGDHVVLINTREIALPGDEWVKRVYFHHTGYPGGASWTLAWQLHEKDPTMVMKKAVYNSMRGNLQRRHTMQRLHLFADDQVPEEILQNVTNQIRTPRSIPQRLDHIDKETLENFPNIMDYPKDYILR

SEQ ID NO: 31942 - DNA, 839 bp, Homo sapiens
  CDS (40)..(576)
tactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtatagtccttcaataggaaattgtaattaaaatataattttatagaaccatttttatgtaatctgatttgaatgttatagttgataataataaaatcacttacttggttgactaaaa

SEQ ID NO: 31943 - protein, 178 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDEYTQEEIDAFPRLWTPPEDYRL

SEQ ID NO: 31944 - DNA, 26 bp, Primer
atgaaaacttttacagctaaaccaga

SEQ ID NO: 31945 - DNA, 24 bp, Primer
ttagatgtcaagaacttgcggttg

SEQ ID NO: 31946 - protein, 162 aa, consensus
  MISC_FEATURE (1)..(162): consensus for the disclosure of xaa see table XV
WXXXDAXXXXXXLGRLXXXXAXXLXGKXXXXXXPXXXXXXGDXXXXXNAXXXXXXGXKXXXXXXKXXXXXXXXXXGXXXXXXXXXXXXXXXXXXXXXXXXXXXXXXPXXXXXXXXXGMLPXXXXLXXXXXXXLXVXXGXXHXXXXXXXXXXXXXXXXXXXXP

SEQ ID NO: 31947 - protein, 58 aa, consensus
  MISC_FEATURE (1)..(58): consensus for the disclosure of xaa see table XV
XXXXXXXXXXXXXGXXXXXXXXXXXXXXXXXXXXXXXXXXXXXXXXXNXXXXXXXXXX

SEQ ID NO: 31948 - protein, 26 aa, consensus
  MISC_FEATURE (1)..(26): consensus for the disclosure of xaa see table XV
XXXXXXXMXXXXXXXXXXXXXXXXXX

SEQ ID NO: 31949 - DNA, 1296 bp, Escherichia coli K12; identical to SEQ ID NO: 14372
  CDS (1)..(1296)

SEQ ID NO: 31950 - protein, 431 aa, Escherichia coli K12; identical to SEQ ID NO: 14373

SEQ ID NO: 31951 - DNA, 1664 bp, Oryza sativa (rice); identical to SEQ ID NO: 14374
  CDS (28)..(1479)

SEQ ID NO: 31952 - protein, 483 aa, Oryza sativa (rice); identical to SEQ ID NO: 14375

SEQ ID NO: 31953 - DNA, 2496 bp, Aquifex aeolicus; identical to SEQ ID NO: 14376
  CDS (1)..(2496)

SEQ ID NO: 31954 - protein, 831 aa, Aquifex aeolicus; identical to SEQ ID NO: 14377

SEQ ID NO: 31955 - DNA, 1080 bp, Mycobacterium tuberculosis; identical to SEQ ID NO: 14378
  CDS (1)..(1080)

SEQ ID NO: 31956 - protein, 359 aa, Mycobacterium tuberculosis; identical to SEQ ID NO: 14379

SEQ ID NO: 31957 - DNA, 1251 bp, Pyrococcus horikoshii; identical to SEQ ID NO: 14380
  CDS (1)..(1251)

SEQ ID NO: 31958 - protein, 416 aa, Pyrococcus horikoshii; identical to SEQ ID NO: 14381

SEQ ID NO: 31959 - DNA, 1326 bp, Chlamydophila pneumoniae, Chlamydia pneumoniae; identical to SEQ ID NO: 14382
  CDS (1)..(1326)

SEQ ID NO: 31960 - protein, 441 aa, Chlamydophila pneumoniae, Chlamydia pneumoniae; identical to SEQ ID NO: 14383

SEQ ID NO: 31961 - DNA, 1113 bp, Thermotoga maritima; identical to SEQ ID NO: 14384
  CDS (1)..(1113)

SEQ ID NO: 31962 - protein, 370 aa, Thermotoga maritima; identical to SEQ ID NO: 14385

SEQ ID NO: 31963 - DNA, 1994 bp, Arabidopsis thaliana (mouse-ear cress); identical to SEQ ID NO: 14386
  CDS (127)..(1698)

SEQ ID NO: 31964 - protein, 523 aa, Arabidopsis thaliana (mouse-ear cress); identical to SEQ ID NO: 14387

SEQ ID NO: 31965 - DNA, 1143 bp, Lactococcus lactis subsp. lactis; identical to SEQ ID NO: 14388
  CDS (1)..(1143)

SEQ ID NO: 31966 - protein, 380 aa, Lactococcus lactis subsp. lactis; identical to SEQ ID NO: 14389

SEQ ID NO: 31967 - DNA, 1140 bp, Streptococcus pneumoniae; identical to SEQ ID NO: 14390
  CDS (1)..(1140)

SEQ ID NO: 31968 - protein, 379 aa, Streptococcus pneumoniae; identical to SEQ ID NO: 14391

SEQ ID NO: 31969 - DNA, 2529 bp, Nostoc sp. PCC 7120; identical to SEQ ID NO: 14392
  CDS (1)..(2529)

SEQ ID NO: 31970 - protein, 842 aa, Nostoc sp. PCC 7120; identical to SEQ ID NO: 14393

SEQ ID NO: 31971 - DNA, 1699 bp, Nostoc sp. PCC 7120; identical to SEQ ID NO: 14394
  CDS (248)..(1537)

SEQ ID NO: 31972 - protein, 429 aa, Nostoc sp. PCC 7120; identical to SEQ ID NO: 14395

SEQ ID NO: 31973 - DNA, 1431 bp, Yersinia pestis; identical to SEQ ID NO: 14396
  CDS (1)..(1431)

SEQ ID NO: 31974 - protein, 476 aa, Yersinia pestis; identical to SEQ ID NO: 14397

SEQ ID NO: 31975 - DNA, 1263 bp, Agrobacterium tumefaciens; identical to SEQ ID NO: 14398
  CDS (1)..(1263)

SEQ ID NO: 31976 - protein, 420 aa, Agrobacterium tumefaciens; identical to SEQ ID NO: 14399

SEQ ID NO: 31977 - DNA, 1296 bp, Salmonella enterica subsp. enterica serovar Typhi; identical to SEQ ID NO: 14400
  CDS (1)..(1296)

SEQ ID NO: 31978 - protein, 431 aa, Salmonella enterica subsp. enterica serovar Typhi; identical to SEQ ID NO: 14401

SEQ ID NO: 31979 - DNA, 999 bp, Archaeoglobus fulgidus; identical to SEQ ID NO: 14402
  CDS (1)..(999)

SEQ ID NO: 31980 - protein, 332 aa, Archaeoglobus fulgidus; identical to SEQ ID NO: 14403

SEQ ID NO: 31981 - DNA, 984 bp, Pyrococcus horikoshii; identical to SEQ ID NO: 14404
  CDS (1)..(984)

SEQ ID NO: 31982 - protein, 327 aa, Pyrococcus horikoshii; identical to SEQ ID NO: 14405

SEQ ID NO: 31983 - DNA, 1272 bp, Thermotoga maritima; identical to SEQ ID NO: 14406
  CDS (1)..(1272)

SEQ ID NO: 31984 - protein, 423 aa, Thermotoga maritima; identical to SEQ ID NO: 14407

SEQ ID NO: 31985 - DNA, 999 bp, Pyrococcus abyssi; identical to SEQ ID NO: 14408
  CDS (1)..(999)

SEQ ID NO: 31986 - protein, 332 aa, Pyrococcus abyssi; identical to SEQ ID NO: 14409

SEQ ID NO: 31987 - DNA, 1335 bp, Deinococcus radiodurans; identical to SEQ ID NO: 14410
  CDS (1)..(1335)

SEQ ID NO: 31988 - protein, 444 aa, Deinococcus radiodurans; identical to SEQ ID NO: 14411

SEQ ID NO: 31989 - DNA, 1140 bp, Lactococcus lactis subsp. lactis; identical to SEQ ID NO: 14412
  CDS (1)..(1140)

SEQ ID NO: 31990 - protein, 379 aa, Lactococcus lactis subsp. lactis; identical to SEQ ID NO: 14413

SEQ ID NO: 31991 - DNA, 1395 bp, Aquifex aeolicus; identical to SEQ ID NO: 14414
  CDS (1)..(1395)

SEQ ID NO: 31992 - protein, 464 aa, Aquifex aeolicus; identical to SEQ ID NO: 14415

SEQ ID NO: 31993 - DNA, 1215 bp, Mycobacterium tuberculosis; identical to SEQ ID NO: 14416
  CDS (1)..(1215)

SEQ ID NO: 31994 - protein, 404 aa, Mycobacterium tuberculosis; identical to SEQ ID NO: 14417

SEQ ID NO: 31995 - DNA, 1227 bp, Methanococcus jannaschii; identical to SEQ ID NO: 14418
  CDS (1)..(1227)

SEQ ID NO: 31996 - protein, 408 aa, Methanococcus jannaschii; identical to SEQ ID NO: 14419

SEQ ID NO: 31997 - DNA, 1260 bp, Pyrococcus horikoshii; identical to SEQ ID NO: 14420
  CDS (1)..(1260)

SEQ ID NO: 31998 - protein, 419 aa, Pyrococcus horikoshii; identical to SEQ ID NO: 14421

SEQ ID NO: 31999 - DNA, 1107 bp, Bacillus halodurans; identical to SEQ ID NO: 14422
  CDS (1)..(1107)

SEQ ID NO: 32000 - protein, 368 aa, Bacillus halodurans; identical to SEQ ID NO: 14423

SEQ ID NO: 32001 - DNA, 1086 bp, Sulfolobus solfataricus; identical to SEQ ID NO: 14424
  CDS (1)..(1086)

SEQ ID NO: 32002 - protein, 361 aa, Sulfolobus solfataricus; identical to SEQ ID NO: 14425

SEQ ID NO: 32003 - DNA, 1158 bp, Methanobacterium thermoautotrophicum; identical to SEQ ID NO: 14426
  CDS (1)..(1158)

SEQ ID NO: 32004 - protein, 385 aa, Methanobacterium thermoautotrophicum; identical to SEQ ID NO: 14427

SEQ ID NO: 32005 - DNA, 1326 bp, Chlamydia trachomatis; identical to SEQ ID NO: 14428
  CDS (1)..(1326)

SEQ ID NO: 32006 - protein, 441 aa, Chlamydia trachomatis; identical to SEQ ID NO: 14429

SEQ ID NO: 32007 - DNA, 1260 bp, Pyrococcus abyssi; identical to SEQ ID NO: 14430
  CDS (1)..(1260)

SEQ ID NO: 32008 - protein, 419 aa, Pyrococcus abyssi; identical to SEQ ID NO: 14431

SEQ ID NO: 32009 - DNA, 1218 bp, Vibrio cholerae; identical to SEQ ID NO: 14432
  CDS (1)..(1218)

SEQ ID NO: 32010 - protein, 405 aa, Vibrio cholerae; identical to SEQ ID NO: 14433

SEQ ID NO: 32011 - DNA, 1152 bp, Bacillus halodurans; identical to SEQ ID NO: 14434
  CDS (1)..(1152)

SEQ ID NO: 32012 - protein, 383 aa, Bacillus halodurans; identical to SEQ ID NO: 14435

SEQ ID NO: 32013 - DNA, 1952 bp, Arabidopsis thaliana (mouse-ear cress); identical to SEQ ID NO: 14436
  CDS (295)..(1851)

SEQ ID NO: 32014 - protein, 518 aa, Arabidopsis thaliana (mouse-ear cress); identical to SEQ ID NO: 14437

SEQ ID NO: 32015 - DNA, 1143 bp, Clostridium acetobutylicum; identical to SEQ ID NO: 14438
  CDS (1)..(1143)

SEQ ID NO: 32016 - protein, 380 aa, Clostridium acetobutylicum; identical to SEQ ID NO: 14439

SEQ ID NO: 32017 - DNA, 2448 bp, Clostridium acetobutylicum; identical to SEQ ID NO: 14440
  CDS (1)..(2448)

SEQ ID NO: 32018 - protein, 815 aa, Clostridium acetobutylicum; identical to SEQ ID NO: 14441

SEQ ID NO: 32019 - DNA, 1242 bp, Pyrococcus abyssi; identical to SEQ ID NO: 14442
  CDS (1)..(1242)

SEQ ID NO: 32020 - protein, 413 aa, Pyrococcus abyssi; identical to SEQ ID NO: 14443

SEQ ID NO: 32021 - DNA, 1143 bp, Streptococcus pneumoniae; identical to SEQ ID NO: 14444
  CDS (1)..(1143)

SEQ ID NO: 32022 - protein, 380 aa, Streptococcus pneumoniae; identical to SEQ ID NO: 14445

SEQ ID NO: 32023 - DNA, 1119 bp, Clostridium acetobutylicum; identical to SEQ ID NO: 14446
  CDS (1)..(1119)

SEQ ID NO: 32024 - protein, 372 aa, Clostridium acetobutylicum; identical to SEQ ID NO: 14447

SEQ ID NO: 32025 - DNA, 1958 bp, Citrullus vulgaris S; identical to SEQ ID NO: 14448
  CDS (91)..(1671)

SEQ ID NO: 32026 - protein, 526 aa, Citrullus vulgaris S; identical to SEQ ID NO: 14449

SEQ ID NO: 32027 - DNA, 1693 bp, Citrullus vulgaris S; identical to SEQ ID NO: 14450
  CDS (1)..(1449)

SEQ ID NO: 32028 - protein, 482 aa, Citrullus vulgaris S; identical to SEQ ID NO: 14451

SEQ ID NO: 32029 - DNA, 1994 bp, Citrullus vulgaris S; identical to SEQ ID NO: 14452
  CDS (92)..(1672)

SEQ ID NO: 32030 - protein, 526 aa, Citrullus vulgaris S; identical to SEQ ID NO: 14453

SEQ ID NO: 32031 - DNA, 2037 bp, Hordeum vulgare (barley); identical to SEQ ID NO: 14454
  CDS (189)..(1772)

SEQ ID NO: 32032 - protein, 527 aa, Hordeum vulgare (barley); identical to SEQ ID NO: 14455

SEQ ID NO: 32033 - DNA, 1757 bp, Triticum aestivum (common wheat); identical to SEQ ID NO: 14456
  CDS (17)..(1438)

SEQ ID NO: 32034 - protein, 473 aa, Triticum aestivum (common wheat); identical to SEQ ID NO: 14457

SEQ ID NO: 32035 - DNA, 1143 bp, Bacillus subtilis; identical to SEQ ID NO: 14458
  CDS (1)..(1143)

SEQ ID NO: 32036 - protein, 380 aa, Bacillus subtilis; identical to SEQ ID NO: 14459

SEQ ID NO: 32037 - DNA, 1859 bp, Vicia faba (fava bean); identical to SEQ ID NO: 14460
  CDS (19)..(1557)

SEQ ID NO: 32038 - protein, 512 aa, Vicia faba (fava bean); identical to SEQ ID NO: 14461

SEQ ID NO: 32039 - DNA, 2040 bp, Vicia faba (fava bean); identical to SEQ ID NO: 14462
  CDS (90)..(1616)

SEQ ID NO: 32040 - protein, 508 aa, Vicia faba (fava bean); identical to SEQ ID NO: 14463

SEQ ID NO: 32041 - DNA, 2123 bp, Zea mays (maize); identical to SEQ ID NO: 14464
  CDS (189)..(1754)

SEQ ID NO: 32042 - protein, 521 aa, Zea mays (maize); identical to SEQ ID NO: 14465

SEQ ID NO: 32043 - DNA, 1926 bp, Beta vulgaris (beet); identical to SEQ ID NO: 14466
  CDS (205)..(1773)

SEQ ID NO: 32044 - protein, 522 aa, Beta vulgaris (beet); identical to SEQ ID NO: 14467

SEQ ID NO: 32045 - DNA, 2102 bp, Solanum tuberosum (potato); identical to SEQ ID NO: 14468
  CDS (130)..(1689)

SEQ ID NO: 32046 - protein, 519 aa, Solanum tuberosum (potato); identical to SEQ ID NO: 14469

SEQ ID NO: 32047 - DNA, 1708 bp, Solanum tuberosum (potato); identical to SEQ ID NO: 14470
  CDS (64)..(1515)

SEQ ID NO: 32048 - protein, 483 aa, Solanum tuberosum (potato); identical to SEQ ID NO: 14471

SEQ ID NO: 32049 - DNA, 1990 bp, Triticum aestivum (common wheat); identical to SEQ ID NO: 14472
  CDS (143)..(1711)

SEQ ID NO: 32050 - protein, 522 aa, Triticum aestivum (common wheat); identical to SEQ ID NO: 14473

SEQ ID NO: 32051 - DNA, 1822 bp, Hordeum vulgare (barley); identical to SEQ ID NO: 14474
  CDS (59)..(1477)

SEQ ID NO: 32052 - protein, 472 aa, Hordeum vulgare (barley); identical to SEQ ID NO: 14475

SEQ ID NO: 32053 - DNA, 1902 bp, Hordeum vulgare (barley); identical to SEQ ID NO: 14476
  CDS (17)..(1558)

SEQ ID NO: 32054 - protein, 513 aa, Hordeum vulgare (barley); identical to SEQ ID NO: 14477

SEQ ID NO: 32055 - DNA, 1182 bp, Synechocystis sp; identical to SEQ ID NO: 14478
  CDS (1)..(1182)

SEQ ID NO: 32056 - protein, 393 aa, Synechocystis sp; identical to SEQ ID NO: 14479

SEQ ID NO: 32057 - DNA, 2532 bp, Synechocystis sp; identical to SEQ ID NO: 14480
  CDS (1)..(2532)

SEQ ID NO: 32058 - protein, 843 aa, Synechocystis sp; identical to SEQ ID NO: 14481

SEQ ID NO: 32059 - DNA, 1320 bp, Synechocystis sp; identical to SEQ ID NO: 14482
  CDS (1)..(1320)

SEQ ID NO: 32060 - protein, 439 aa, Synechocystis sp; identical to SEQ ID NO: 14483

SEQ ID NO: 32061 - DNA, 1477 bp, Arabidopsis thaliana (mouse-ear cress); identical to SEQ ID NO: 14484
  CDS (151)..(1236)

SEQ ID NO: 32062 - protein, 361 aa, Arabidopsis thaliana (mouse-ear cress); identical to SEQ ID NO: 14485

SEQ ID NO: 32063 - DNA, 2065 bp, Oryza sativa (rice); identical to SEQ ID NO: 14486
  CDS (134)..(1693)

SEQ ID NO: 32064 - protein, 519 aa, Oryza sativa (rice); identical to SEQ ID NO: 14487

SEQ ID NO: 32065 - DNA, 1554 bp, Sorghum bicolor (sorghum); identical to SEQ ID NO: 14488
  CDS (1)..(1554)

SEQ ID NO: 32066 - protein, 517 aa, Sorghum bicolor (sorghum); identical to SEQ ID NO: 14489

SEQ ID NO: 32067 - DNA, 1855 bp, Oryza sativa (rice); identical to SEQ ID NO: 14490
  CDS (34)..(1578)

SEQ ID NO: 32068 - protein, 514 aa, Oryza sativa (rice); identical to SEQ ID NO: 14491

SEQ ID NO: 32069 - DNA, 1599 bp, Hordeum vulgare (barley); identical to SEQ ID NO: 14492
  CDS (41)..(1552)

SEQ ID NO: 32070 - protein, 503 aa, Hordeum vulgare (barley); identical to SEQ ID NO: 14493

SEQ ID NO: 32071 - DNA, 2032 bp, Pisum sativum (garden pea); identical to SEQ ID NO: 14494
  CDS (137)..(1669)

SEQ ID NO: 32072 - protein, 510 aa, Pisum sativum (garden pea); identical to SEQ ID NO: 14495

SEQ ID NO: 32073 - DNA, 2099 bp, Lycopersicon esculentum (tomato); identical to SEQ ID NO: 14496
  CDS (214)..(1764)

SEQ ID NO: 32074 - protein, 516 aa, Lycopersicon esculentum (tomato); identical to SEQ ID NO: 14497

SEQ ID NO: 32075 - DNA, 1850 bp, Lycopersicon esculentum (tomato); identical to SEQ ID NO: 14498
  CDS (47)..(1597)

SEQ ID NO: 32076 - protein, 516 aa, Lycopersicon esculentum (tomato); identical to SEQ ID NO: 14499

SEQ ID NO: 32077 - DNA, 2019 bp, Lycopersicon esculentum (tomato); identical to SEQ ID NO: 14500
  CDS (122)..(1696)

SEQ ID NO: 32078 - protein, 524 aa, Lycopersicon esculentum (tomato); identical to SEQ ID NO: 14501

SEQ ID NO: 32079 - DNA, 2009 bp, Cucumis melo var. markuwa Markino (Oriental melon); identical to SEQ ID NO: 14502
  CDS (154)..(1731)

SEQ ID NO: 32080 - protein, 525 aa, Cucumis melo var. markuwa Markino (Oriental melon); identical to SEQ ID NO: 14503

SEQ ID NO: 32081 - DNA, 2227 bp, Cucumis melo var. markuwa Markino (Oriental melon); identical to SEQ ID NO: 14504
  CDS (346)..(1902)

SEQ ID NO: 32082 - protein, 518 aa, Cucumis melo var. markuwa Markino (Oriental melon); identical to SEQ ID NO: 14505

SEQ ID NO: 32083 - DNA, 1961 bp, Arabidopsis thaliana (mouse-ear cress); identical to SEQ ID NO: 14506
  CDS (160)..(1725)

SEQ ID NO: 32084 - protein, 521 aa, Arabidopsis thaliana (mouse-ear cress); identical to SEQ ID NO: 14507

SEQ ID NO: 32085 - DNA, 1790 bp, Ipomoea batatas (sweet potato); identical to SEQ ID NO: 14508
  CDS (68)..(1636)

SEQ ID NO: 32086 - protein, 522 aa, Ipomoea batatas (sweet potato); identical to SEQ ID NO: 14509

SEQ ID NO: 32087 - DNA, 1823 bp, Ipomoea batatas (sweet potato); identical to SEQ ID NO: 14510
  CDS (40)..(1611)

SEQ ID NO: 32088 - protein, 523 aa, Ipomoea batatas (sweet potato); identical to SEQ ID NO: 14511

SEQ ID NO: 32089 - DNA, 1122 bp, Caenorhabditis elegans; identical to SEQ ID NO: 14512
  CDS (1)..(1122)

SEQ ID NO: 32090 - protein, 373 aa, Caenorhabditis elegans; identical to SEQ ID NO: 14513

SEQ ID NO: 32091 - DNA, 1092 bp, Schizosaccharomyces pombe; identical to SEQ ID NO: 14514
  CDS (1)..(1092)

SEQ ID NO: 32092 - protein, 363 aa, Schizosaccharomyces pombe; identical to SEQ ID NO: 14515

SEQ ID NO: 32093 - DNA, 1518 bp, Streptomyces coelicolor; identical to SEQ ID NO: 14516
  CDS (144)..(1337)

SEQ ID NO: 32094 - protein, 397 aa, Streptomyces coelicolor; identical to SEQ ID NO: 14517

SEQ ID NO: 32095 - DNA, 1260 bp, Mycobacterium leprae; identical to SEQ ID NO: 14518
  CDS (1)..(1260)

SEQ ID NO: 32096 - protein, 419 aa, Mycobacterium leprae; identical to SEQ ID NO: 14519

SEQ ID NO: 32097 - DNA, 1095 bp, Arabidopsis thaliana (mouse-ear cress); identical to SEQ ID NO: 14520
  CDS (1)..(1095)

SEQ ID NO: 32098 - protein, 364 aa, Arabidopsis thaliana (mouse-ear cress); identical to SEQ ID NO: 14521

SEQ ID NO: 32099 - DNA, 1731 bp, Arabidopsis thaliana (mouse-ear cress); identical to SEQ ID NO: 14522
  CDS (56)..(1624)

SEQ ID NO: 32100 - protein, 522 aa, Arabidopsis thaliana (mouse-ear cress); identical to SEQ ID NO: 14523

SEQ ID NO: 32101 - DNA, 2450 bp, Physcomitrella patens; identical to SEQ ID NO: 14524
  CDS (736)..(2058): n means a or g or c or t/u

SEQ ID NO: 32102 - protein, 440 aa, Physcomitrella patens; identical to SEQ ID NO: 14525

SEQ ID NO: 32103 - DNA, 1582 bp, Zea mays; identical to SEQ ID NO: 14526
  CDS (10)..(1566)

SEQ ID NO: 32104 - protein, 518 aa, Zea mays; identical to SEQ ID NO: 14527

SEQ ID NO: 32105 - DNA, 2027 bp, Cucumis melo; identical to SEQ ID NO: 14528
  CDS (99)..(1676)

SEQ ID NO: 32106 - protein, 525 aa, Cucumis melo; identical to SEQ ID NO: 14529

SEQ ID NO: 32107 - DNA, 2161 bp, Ipomoea batatas; identical to SEQ ID NO: 14530
  CDS (251)..(1804)

SEQ ID NO: 32108 - protein, 517 aa, Ipomoea batatas; identical to SEQ ID NO: 14531

SEQ ID NO: 32109 - DNA, 2105 bp, Lycopersicon esculentum; identical to SEQ ID NO: 14532
  CDS (154)..(1710)

SEQ ID NO: 32110 - protein, 518 aa, Lycopersicon esculentum; identical to SEQ ID NO: 14533

SEQ ID NO: 32111 - DNA, 1814 bp, Pisum sativum; identical to SEQ ID NO: 14534
  CDS (82)..(1605)

SEQ ID NO: 32112 - protein, 507 aa, Pisum sativum; identical to SEQ ID NO: 14535

SEQ ID NO: 32113 - DNA, 1035 bp, Bacillus thuringiensis serovar konkukian str; identical to SEQ ID NO: 14536
  CDS (1)..(1035)

SEQ ID NO: 32114 - protein, 344 aa, Bacillus thuringiensis serovar konkukian str; identical to SEQ ID NO: 14537

SEQ ID NO: 32115 - DNA, 1504 bp, Lycopersicon esculentum; identical to SEQ ID NO: 14538
  CDS (142)..(1227)

SEQ ID NO: 32116 - protein, 361 aa, Lycopersicon esculentum; identical to SEQ ID NO: 14539

SEQ ID NO: 32117 - DNA, 1146 bp, Mycoplasma mobile 163K; identical to SEQ ID NO: 14540
  CDS (1)..(1146)

SEQ ID NO: 32118 - protein, 381 aa, Mycoplasma mobile 163K; identical to SEQ ID NO: 14541

SEQ ID NO: 32119 - DNA, 1086 bp, Picrophilus torridus DSM 9790; identical to SEQ ID NO: 14542
  CDS (1)..(1086)

SEQ ID NO: 32120 - protein, 361 aa, Picrophilus torridus DSM 9790; identical to SEQ ID NO: 14543

SEQ ID NO: 32121 - DNA, 1218 bp, Photobacterium profundum; identical to SEQ ID NO: 14544
  CDS (1)..(1218)

SEQ ID NO: 32122 - protein, 405 aa, Photobacterium profundum; identical to SEQ ID NO: 14545

SEQ ID NO: 32123 - DNA, 1209 bp, Corynebacterium glutamicum; identical to SEQ ID NO: 14546
  CDS (101)..(1189)

SEQ ID NO: 32124 - protein, 362 aa, Corynebacterium glutamicum; identical to SEQ ID NO: 14547

SEQ ID NO: 32125 - DNA, 1419 bp, Parachlamydia sp; identical to SEQ ID NO: 14548
  CDS (1)..(1419)

SEQ ID NO: 32126 - protein, 472 aa, Parachlamydia sp; identical to SEQ ID NO: 14549

SEQ ID NO: 32127 - DNA, 1263 bp, Rhodopseudomonas palustris; identical to SEQ ID NO: 14550
  CDS (1)..(1263)

SEQ ID NO: 32128 - protein, 420 aa, Rhodopseudomonas palustris; identical to SEQ ID NO: 14551

SEQ ID NO: 32129 - DNA, 1284 bp, Corynebacterium diphtheriae; identical to SEQ ID NO: 14552
  CDS (1)..(1284)

SEQ ID NO: 32130 - protein, 427 aa, Corynebacterium diphtheriae; identical to SEQ ID NO: 14553

SEQ ID NO: 32131 - DNA, 1089 bp, Corynebacterium diphtheriae; identical to SEQ ID NO: 14554
  CDS (1)..(1089)

SEQ ID NO: 32132 - protein, 362 aa, Corynebacterium diphtheriae; identical to SEQ ID NO: 14555

SEQ ID NO: 32133 - DNA, 1563 bp, Ostreococcus tauri; identical to SEQ ID NO: 14556
  CDS (1)..(1563)

SEQ ID NO: 32134 - protein, 520 aa, Ostreococcus tauri; identical to SEQ ID NO: 14557

SEQ ID NO: 32135 - DNA, 2065 bp, Fragaria ananassa; identical to SEQ ID NO: 14558
  CDS (202)..(1725)

SEQ ID NO: 32136 - protein, 507 aa, Fragaria ananassa; identical to SEQ ID NO: 14559

SEQ ID NO: 32137 - DNA, 1872 bp, Fragaria ananassa; identical to SEQ ID NO: 14560
  CDS (34)..(1599)

SEQ ID NO: 32138 - protein, 521 aa, Fragaria ananassa; identical to SEQ ID NO: 14561

SEQ ID NO: 32139 - DNA, 1245 bp, Thermus thermophilus; identical to SEQ ID NO: 14562
  CDS (1)..(1245)

SEQ ID NO: 32140 - protein, 414 aa, Thermus thermophilus; identical to SEQ ID NO: 14563

SEQ ID NO: 32141 - DNA, 1047 bp, Thermus thermophilus; identical to SEQ ID NO: 14564
  CDS (1)..(1047)

SEQ ID NO: 32142 - protein, 348 aa, Thermus thermophilus; identical to SEQ ID NO: 14565

SEQ ID NO: 32143 - DNA, 1131 bp, Bacillus cereus; identical to SEQ ID NO: 14566
  CDS (1)..(1131)

SEQ ID NO: 32144 - protein, 376 aa, Bacillus cereus; identical to SEQ ID NO: 14567

SEQ ID NO: 32145 - DNA, 1035 bp, Bacillus cereus; identical to SEQ ID NO: 14568
  CDS (1)..(1035)

SEQ ID NO: 32146 - protein, 344 aa, Bacillus cereus; identical to SEQ ID NO: 14569

SEQ ID NO: 32147 - DNA, 1275 bp, Treponema denticola; identical to SEQ ID NO: 14570
  CDS (1)..(1275)

SEQ ID NO: 32148 - protein, 424 aa, Treponema denticola; identical to SEQ ID NO: 14571

SEQ ID NO: 32149 - DNA, 1077 bp, Mycobacterium paratuberculosis; identical to SEQ ID NO: 14572
  CDS (1)..(1077)

SEQ ID NO: 32150 - protein, 358 aa, Mycobacterium paratuberculosis; identical to SEQ ID NO: 14573

SEQ ID NO: 32151 - DNA, 1215 bp, Mycobacterium paratuberculosis; identical to SEQ ID NO: 14574
  CDS (1)..(1215)

SEQ ID NO: 32152 - protein, 404 aa, Mycobacterium paratuberculosis; identical to SEQ ID NO: 14575

SEQ ID NO: 32153 - DNA, 2511 bp, Geobacter sulfurreducens; identical to SEQ ID NO: 14576
  CDS (1)..(2511)

SEQ ID NO: 32154 - protein, 836 aa, Geobacter sulfurreducens; identical to SEQ ID NO: 14577

SEQ ID NO: 32155 - DNA, 1930 bp, Oryza sativa; identical to SEQ ID NO: 14578
  CDS (136)..(1680)

SEQ ID NO: 32156 - protein, 514 aa, Oryza sativa; identical to SEQ ID NO: 14579

SEQ ID NO: 32157 - DNA, 1215 bp, Vibrio vulnificus; identical to SEQ ID NO: 14580
  CDS (1)..(1215)

SEQ ID NO: 32158 - protein, 404 aa, Vibrio vulnificus; identical to SEQ ID NO: 14581

SEQ ID NO: 32159 - DNA, 1287 bp, Gloeobacter violaceus PCC 7421; identical to SEQ ID NO: 14582
  CDS (1)..(1287)

SEQ ID NO: 32160 - protein, 428 aa, Gloeobacter violaceus PCC 7421; identical to SEQ ID NO: 14583

SEQ ID NO: 32161 - DNA, 984 bp, Gloeobacter violaceus PCC 7421; identical to SEQ ID NO: 14584
  CDS (1)..(984)

SEQ ID NO: 32162 - protein, 327 aa, Gloeobacter violaceus PCC 7421; identical to SEQ ID NO: 14585

SEQ ID NO: 32163 - DNA, 972 bp, Gloeobacter violaceus PCC 7421; identical to SEQ ID NO: 14586
  CDS (1)..(972)

SEQ ID NO: 32164 - protein, 323 aa, Gloeobacter violaceus PCC 7421; identical to SEQ ID NO: 14587

SEQ ID NO: 32165 - DNA, 984 bp, Gloeobacter violaceus PCC 7421; identical to SEQ ID NO: 14588
  CDS (1)..(984)

SEQ ID NO: 32166 - protein, 327 aa, Gloeobacter violaceus PCC 7421; identical to SEQ ID NO: 14589

SEQ ID NO: 32167 - DNA, 984 bp, Gloeobacter violaceus PCC 7421; identical to SEQ ID NO: 14590
  CDS (1)..(984)

SEQ ID NO: 32168 - protein, 327 aa, Gloeobacter violaceus PCC 7421; identical to SEQ ID NO: 14591

SEQ ID NO: 32169 - DNA, 1296 bp, Synechococcus sp; identical to SEQ ID NO: 14592
  CDS (1)..(1296)

SEQ ID NO: 32170 - protein, 431 aa, Synechococcus sp; identical to SEQ ID NO: 14593

SEQ ID NO: 32171 - DNA, 1290 bp, Rhodopirellula baltica; identical to SEQ ID NO: 14594
  CDS (1)..(1290)

SEQ ID NO: 32172 - protein, 429 aa, Rhodopirellula baltica; identical to SEQ ID NO: 14595

SEQ ID NO: 32173 - DNA, 1341 bp, Rhodopirellula baltica; identical to SEQ ID NO: 14596
  CDS (1)..(1341)

SEQ ID NO: 32174 - protein, 446 aa, Rhodopirellula baltica; identical to SEQ ID NO: 14597

SEQ ID NO: 32175 - DNA, 1296 bp, Prochlorococcus marinus subsp; identical to SEQ ID NO: 14598
  CDS (1)..(1296)

SEQ ID NO: 32176 - protein, 431 aa, Prochlorococcus marinus subsp; identical to SEQ ID NO: 14599

SEQ ID NO: 32177 - DNA, 1296 bp, Prochlorococcus marinus; identical to SEQ ID NO: 14600
  CDS (1)..(1296)

SEQ ID NO: 32178 - protein, 431 aa, Prochlorococcus marinus; identical to SEQ ID NO: 14601

SEQ ID NO: 32179 - DNA, 1296 bp, Prochlorococcus marinus; identical to SEQ ID NO: 14602
  CDS (1)..(1296)

SEQ ID NO: 32180 - protein, 431 aa, Prochlorococcus marinus; identical to SEQ ID NO: 14603

SEQ ID NO: 32181 - DNA, 1065 bp, Streptomyces sp; identical to SEQ ID NO: 14604
  CDS (1)..(1065)

SEQ ID NO: 32182 - protein, 354 aa, Streptomyces sp; identical to SEQ ID NO: 14605

SEQ ID NO: 32183 - DNA, 2355 bp, Bacillus cereus; identical to SEQ ID NO: 14606
  CDS (1)..(2355)

SEQ ID NO: 32184 - protein, 784 aa, Bacillus cereus; identical to SEQ ID NO: 14607

SEQ ID NO: 32185 - DNA, 1329 bp, Chlamydophila caviae GPIC; identical to SEQ ID NO: 14608
  CDS (1)..(1329)

SEQ ID NO: 32186 - protein, 442 aa, Chlamydophila caviae GPIC; identical to SEQ ID NO: 14609

SEQ ID NO: 32187 - DNA, 1221 bp, Streptomyces avermitilis; identical to SEQ ID NO: 14610
  CDS (1)..(1221)

SEQ ID NO: 32188 - protein, 406 aa, Streptomyces avermitilis; identical to SEQ ID NO: 14611

SEQ ID NO: 32189 - DNA, 2496 bp, Streptomyces avermitilis; identical to SEQ ID NO: 14612
  CDS (1)..(2496)

SEQ ID NO: 32190 - protein, 831 aa, Streptomyces avermitilis; identical to SEQ ID NO: 14613

SEQ ID NO: 32191 - DNA, 1083 bp, Streptomyces avermitilis; identical to SEQ ID NO: 14614
  CDS (1)..(1083)

SEQ ID NO: 32192 - protein, 360 aa, Streptomyces avermitilis; identical to SEQ ID NO: 14615

SEQ ID NO: 32193 - DNA, 1302 bp, Nitrosomonas europaea ATCC 19718; identical to SEQ ID NO: 14616
  CDS (1)..(1302)

SEQ ID NO: 32194 - protein, 433 aa, Nitrosomonas europaea ATCC 19718; identical to SEQ ID NO: 14617

SEQ ID NO: 32195 - DNA, 1425 bp, Zea mays; identical to SEQ ID NO: 14618
  CDS (1)..(1425)

SEQ ID NO: 32196 - protein, 474 aa, Zea mays; identical to SEQ ID NO: 14619

SEQ ID NO: 32197 - DNA, 1476 bp, Oryza sativa; identical to SEQ ID NO: 14620
  CDS (189)..(1274)

SEQ ID NO: 32198 - protein, 361 aa, Oryza sativa; identical to SEQ ID NO: 14621

SEQ ID NO: 32199 - DNA, 1749 bp, Oryza sativa; identical to SEQ ID NO: 14622
  CDS (112)..(1551)

SEQ ID NO: 32200 - protein, 479 aa, Oryza sativa; identical to SEQ ID NO: 14623

SEQ ID NO: 32201 - DNA, 1885 bp, Phaseolus vulgaris; identical to SEQ ID NO: 14624
  CDS (31)..(1578)

SEQ ID NO: 32202 - protein, 515 aa, Phaseolus vulgaris; identical to SEQ ID NO: 14625

SEQ ID NO: 32203 - DNA, 2025 bp, Phaseolus vulgaris; identical to SEQ ID NO: 14626
  CDS (152)..(1729)

SEQ ID NO: 32204 - protein, 525 aa, Phaseolus vulgaris; identical to SEQ ID NO: 14627

SEQ ID NO: 32205 - DNA, 1845 bp, Solanum tuberosum; identical to SEQ ID NO: 14628
  CDS (64)..(1629)

SEQ ID NO: 32206 - protein, 521 aa, Solanum tuberosum; identical to SEQ ID NO: 14629

SEQ ID NO: 32207 - DNA, 1173 bp, Lactobacillus plantarum WCFS1; identical to SEQ ID NO: 14630
  CDS (1)..(1173)

SEQ ID NO: 32208 - protein, 390 aa, Lactobacillus plantarum WCFS1; identical to SEQ ID NO: 14631

SEQ ID NO: 32209 - DNA, 1263 bp, Bradyrhizobium japonicum USDA 110; identical to SEQ ID NO: 14632
  CDS (1)..(1263)

SEQ ID NO: 32210 - protein, 420 aa, Bradyrhizobium japonicum USDA 110; identical to SEQ ID NO: 14633

SEQ ID NO: 32211 - DNA, 1314 bp, Thermosynechococcus elongatus BP; identical to SEQ ID NO: 14634
  CDS (1)..(1314)

SEQ ID NO: 32212 - protein, 437 aa, Thermosynechococcus elongatus BP; identical to SEQ ID NO: 14635

SEQ ID NO: 32213 - DNA, 1146 bp, Thermosynechococcus elongatus BP; identical to SEQ ID NO: 14636
  CDS (1)..(1146)

SEQ ID NO: 32214 - protein, 381 aa, Thermosynechococcus elongatus BP; identical to SEQ ID NO: 14637

SEQ ID NO: 32215 - DNA, 2532 bp, Thermosynechococcus elongatus BP; identical to SEQ ID NO: 14638
  CDS (1)..(2532)

SEQ ID NO: 32216 - protein, 843 aa, Thermosynechococcus elongatus BP; identical to SEQ ID NO: 14639

SEQ ID NO: 32217 - DNA, 1146 bp, Streptococcus mutans; identical to SEQ ID NO: 14640
  CDS (1)..(1146)

SEQ ID NO: 32218 - protein, 381 aa, Streptococcus mutans; identical to SEQ ID NO: 14641

SEQ ID NO: 32219 - DNA, 1134 bp, Streptococcus mutans; identical to SEQ ID NO: 14642
  CDS (1)..(1134)

SEQ ID NO: 32220 - protein, 377 aa, Streptococcus mutans; identical to SEQ ID NO: 14643

SEQ ID NO: 32221 - DNA, 1134 bp, Streptococcus agalactiae; identical to SEQ ID NO: 14644
  CDS (1)..(1134)

SEQ ID NO: 32222 - protein, 377 aa, Streptococcus agalactiae; identical to SEQ ID NO: 14645

SEQ ID NO: 32223 - DNA, 1140 bp, Streptococcus agalactiae; identical to SEQ ID NO: 14646
  CDS (1)..(1140)

SEQ ID NO: 32224 - protein, 379 aa, Streptococcus agalactiae; identical to SEQ ID NO: 14647

SEQ ID NO: 32225 - DNA, 1263 bp, Shewanella oneidensis; identical to SEQ ID NO: 14648
  CDS (1)..(1263)

SEQ ID NO: 32226 - protein, 420 aa, Shewanella oneidensis; identical to SEQ ID NO: 14649

SEQ ID NO: 32227 - DNA, 1107 bp, Oceanobacillus iheyensis; identical to SEQ ID NO: 14650
  CDS (1)..(1107)

SEQ ID NO: 32228 - protein, 368 aa, Oceanobacillus iheyensis; identical to SEQ ID NO: 14651

SEQ ID NO: 32229 - DNA, 1158 bp, Oceanobacillus iheyensis; identical to SEQ ID NO: 14652
  CDS (1)..(1158)

SEQ ID NO: 32230 - protein, 385 aa, Oceanobacillus iheyensis; identical to SEQ ID NO: 14653

SEQ ID NO: 32231 - DNA, 1467 bp, Corynebacterium efficiens YS; identical to SEQ ID NO: 14654
  CDS (1)..(1467)

SEQ ID NO: 32232 - protein, 488 aa, Corynebacterium efficiens YS; identical to SEQ ID NO: 14655

SEQ ID NO: 32233 - DNA, 1119 bp, Corynebacterium efficiens YS; identical to SEQ ID NO: 14656
  CDS (1)..(1119)

SEQ ID NO: 32234 - protein, 372 aa, Corynebacterium efficiens YS; identical to SEQ ID NO: 14657

SEQ ID NO: 32235 - DNA, 1245 bp, Bifidobacterium longum; identical to SEQ ID NO: 14658
  CDS (1)..(1245)

SEQ ID NO: 32236 - protein, 414 aa, Bifidobacterium longum; identical to SEQ ID NO: 14659

SEQ ID NO: 32237 - DNA, 1575 bp, Oryza sativa; identical to SEQ ID NO: 14660
  CDS (1)..(1575)

SEQ ID NO: 32238 - protein, 524 aa, Oryza sativa; identical to SEQ ID NO: 14661

SEQ ID NO: 32239 - DNA, 1800 bp, Hordeum vulgare var; identical to SEQ ID NO: 14662
  CDS (66)..(1571)

SEQ ID NO: 32240 - protein, 501 aa, Hordeum vulgare var; identical to SEQ ID NO: 14663

SEQ ID NO: 32241 - DNA, 1754 bp, Oncidium cv; identical to SEQ ID NO: 14664
  CDS (23)..(1576)

SEQ ID NO: 32242 - protein, 517 aa, Oncidium cv; identical to SEQ ID NO: 14665

SEQ ID NO: 32243 - DNA, 1821 bp, Metroxylon sagu; identical to SEQ ID NO: 14666
  CDS (22)..(1611)

SEQ ID NO: 32244 - protein, 529 aa, Metroxylon sagu; identical to SEQ ID NO: 14667

SEQ ID NO: 32245 - DNA, 1047 bp, Corynebacterium glutamicum ATCC 13032; identical to SEQ ID NO: 14668
  CDS (1)..(1047)

SEQ ID NO: 32246 - protein, 348 aa, Corynebacterium glutamicum ATCC 13032; identical to SEQ ID NO: 14669

SEQ ID NO: 32247 - DNA, 1179 bp, Methanosarcina mazei; identical to SEQ ID NO: 14670
  CDS (1)..(1179)

SEQ ID NO: 32248 - protein, 392 aa, Methanosarcina mazei; identical to SEQ ID NO: 14671

SEQ ID NO: 32249 - DNA, 1194 bp, Methanosarcina mazei; identical to SEQ ID NO: 14672
  CDS (1)..(1194)

SEQ ID NO: 32250 - protein, 397 aa, Methanosarcina mazei; identical to SEQ ID NO: 14673

SEQ ID NO: 32251 - DNA, 2337 bp, Thermoanaerobacter tengcongensis; identical to SEQ ID NO: 14674
  CDS (1)..(2337)

SEQ ID NO: 32252 - protein, 778 aa, Thermoanaerobacter tengcongensis; identical to SEQ ID NO: 14675

SEQ ID NO: 32253 - DNA, 1050 bp, Thermoanaerobacter tengcongensis; identical to SEQ ID NO: 14676
  CDS (1)..(1050)

SEQ ID NO: 32254 - protein, 349 aa, Thermoanaerobacter tengcongensis; identical to SEQ ID NO: 14677

SEQ ID NO: 32255 - DNA, 1164 bp, Fusobacterium nucleatum; identical to SEQ ID NO: 14678
  CDS (1)..(1164)

SEQ ID NO: 32256 - protein, 387 aa, Fusobacterium nucleatum; identical to SEQ ID NO: 14679

SEQ ID NO: 32257 - DNA, 1179 bp, Methanosarcina acetivorans; identical to SEQ ID NO: 14680
  CDS (1)..(1179)

SEQ ID NO: 32258 - protein, 392 aa, Methanosarcina acetivorans; identical to SEQ ID NO: 14681

SEQ ID NO: 32259 - DNA, 1194 bp, Methanosarcina acetivorans; identical to SEQ ID NO: 14682
  CDS (1)..(1194)

SEQ ID NO: 32260 - protein, 397 aa, Methanosarcina acetivorans; identical to SEQ ID NO: 14683

SEQ ID NO: 32261 - DNA, 1218 bp, Methanosarcina acetivorans; identical to SEQ ID NO: 14684
  CDS (1)..(1218)

SEQ ID NO: 32262 - protein, 405 aa, Methanosarcina acetivorans; identical to SEQ ID NO: 14685

SEQ ID NO: 32263 - DNA, 1071 bp, Methanopyrus kandleri; identical to SEQ ID NO: 14686
  CDS (1)..(1071)

SEQ ID NO: 32264 - protein, 356 aa, Methanopyrus kandleri; identical to SEQ ID NO: 14687

SEQ ID NO: 32265 - DNA, 1278 bp, Methanopyrus kandleri; identical to SEQ ID NO: 14688
  CDS (1)..(1278)

SEQ ID NO: 32266 - protein, 425 aa, Methanopyrus kandleri; identical to SEQ ID NO: 14689

SEQ ID NO: 32267 - DNA, 1086 bp, Pyrococcus furiosus; identical to SEQ ID NO: 14690
  CDS (1)..(1086)

SEQ ID NO: 32268 - protein, 361 aa, Pyrococcus furiosus; identical to SEQ ID NO: 14691

SEQ ID NO: 32269 - DNA, 1242 bp, Pyrococcus furiosus; identical to SEQ ID NO: 14692
  CDS (1)..(1242)

SEQ ID NO: 32270 - protein, 413 aa, Pyrococcus furiosus; identical to SEQ ID NO: 14693

SEQ ID NO: 32271 - DNA, 1263 bp, Pyrococcus furiosus DSM 3638; identical to SEQ ID NO: 14694
  CDS (1)..(1263)

SEQ ID NO: 32272 - protein, 420 aa, Pyrococcus furiosus DSM 3638; identical to SEQ ID NO: 14695

SEQ ID NO: 32273 - DNA, 1107 bp, Clostridium perfringens str; identical to SEQ ID NO: 14696
  CDS (1)..(1107)

SEQ ID NO: 32274 - protein, 368 aa, Clostridium perfringens str; identical to SEQ ID NO: 14697

SEQ ID NO: 32275 - DNA, 1224 bp, Pyrobaculum aerophilum; identical to SEQ ID NO: 14698
  CDS (1)..(1224)

SEQ ID NO: 32276 - protein, 407 aa, Pyrobaculum aerophilum; identical to SEQ ID NO: 14699

SEQ ID NO: 32277 - DNA, 1927 bp, Zea mays; identical to SEQ ID NO: 14700
  CDS (141)..(1673)

SEQ ID NO: 32278 - protein, 510 aa, Zea mays; identical to SEQ ID NO: 14701

SEQ ID NO: 32279 - DNA, 1754 bp, Zea mays; identical to SEQ ID NO: 14702
  CDS (6)..(1433)

SEQ ID NO: 32280 - protein, 475 aa, Zea mays; identical to SEQ ID NO: 14703

SEQ ID NO: 32281 - DNA, 1471 bp, Nicotiana tabacum; identical to SEQ ID NO: 14704
  CDS (220)..(1305)

SEQ ID NO: 32282 - protein, 361 aa, Nicotiana tabacum; identical to SEQ ID NO: 14705

SEQ ID NO: 32283 - DNA, 1074 bp, Sulfolobus tokodaii; identical to SEQ ID NO: 14706
  CDS (1)..(1074)

SEQ ID NO: 32284 - protein, 357 aa, Sulfolobus tokodaii; identical to SEQ ID NO: 14707

SEQ ID NO: 32285 - DNA, 1260 bp, Sulfolobus tokodaii; identical to SEQ ID NO: 14708
  CDS (1)..(1260)

SEQ ID NO: 32286 - protein, 419 aa, Sulfolobus tokodaii; identical to SEQ ID NO: 14709

SEQ ID NO: 32287 - DNA, 1080 bp, Thermoplasma volcanium; identical to SEQ ID NO: 14710
  CDS (1)..(1080)

SEQ ID NO: 32288 - protein, 359 aa, Thermoplasma volcanium; identical to SEQ ID NO: 14711

SEQ ID NO: 32289 - DNA, 1758 bp, Oryza sativa; identical to SEQ ID NO: 14712
  CDS (115)..(1617)

SEQ ID NO: 32290 - protein, 500 aa, Oryza sativa; identical to SEQ ID NO: 14713

SEQ ID NO: 32291 - DNA, 1620 bp, Oryza sativa; identical to SEQ ID NO: 14714
  CDS (52)..(1608)

SEQ ID NO: 32292 - protein, 518 aa, Oryza sativa; identical to SEQ ID NO: 14715

SEQ ID NO: 32293 - DNA, 1889 bp, Cicer arietinum; identical to SEQ ID NO: 14716
  CDS (24)..(1574)

SEQ ID NO: 32294 - protein, 516 aa, Cicer arietinum; identical to SEQ ID NO: 14717

SEQ ID NO: 32295 - DNA, 1920 bp, Cicer arietinum; identical to SEQ ID NO: 14718
  CDS (174)..(1739)

SEQ ID NO: 32296 - protein, 521 aa, Cicer arietinum; identical to SEQ ID NO: 14719

SEQ ID NO: 32297 - DNA, 1809 bp, Cicer arietinum; identical to SEQ ID NO: 14720
  CDS (83)..(1660)

SEQ ID NO: 32298 - protein, 525 aa, Cicer arietinum; identical to SEQ ID NO: 14721

SEQ ID NO: 32299 - DNA, 1862 bp, Brassica rapa subsp; identical to SEQ ID NO: 14722
  CDS (85)..(1797)

SEQ ID NO: 32300 - protein, 570 aa, Brassica rapa subsp; identical to SEQ ID NO: 14723

SEQ ID NO: 32301 - DNA, 1858 bp, Brassica rapa subsp; identical to SEQ ID NO: 14724
  CDS (31)..(1590)

SEQ ID NO: 32302 - protein, 519 aa, Brassica rapa subsp; identical to SEQ ID NO: 14725

SEQ ID NO: 32303 - DNA, 1080 bp, Thermoplasma acidophilum; identical to SEQ ID NO: 14726
  CDS (1)..(1080)

SEQ ID NO: 32304 - protein, 359 aa, Thermoplasma acidophilum; identical to SEQ ID NO: 14727

SEQ ID NO: 32305 - DNA, 1083 bp, Streptomyces coelicolor; identical to SEQ ID NO: 14728
  CDS (1)..(1083)

SEQ ID NO: 32306 - protein, 360 aa, Streptomyces coelicolor; identical to SEQ ID NO: 14729

SEQ ID NO: 32307 - DNA, 2496 bp, Streptomyces coelicolor; identical to SEQ ID NO: 14730
  CDS (1)..(2496)

SEQ ID NO: 32308 - protein, 831 aa, Streptomyces coelicolor; identical to SEQ ID NO: 14731

SEQ ID NO: 32309 - DNA, 2741 bp, Chlamydomonas reinhardtii; identical to SEQ ID NO: 14732
  CDS (1)..(1545)

SEQ ID NO: 32310 - protein, 514 aa, Chlamydomonas reinhardtii; identical to SEQ ID NO: 14733

SEQ ID NO: 32311 - DNA, 2134 bp, Perilla frutescens; identical to SEQ ID NO: 14734
  CDS (282)..(1865)

SEQ ID NO: 32312 - protein, 527 aa, Perilla frutescens; identical to SEQ ID NO: 14735

SEQ ID NO: 32313 - DNA, 1887 bp, Perilla frutescens; identical to SEQ ID NO: 14736
  CDS (58)..(1620)

SEQ ID NO: 32314 - protein, 520 aa, Perilla frutescens; identical to SEQ ID NO: 14737

SEQ ID NO: 32315 - DNA, 1877 bp, Perilla frutescens; identical to SEQ ID NO: 14738
  CDS (76)..(1647)

SEQ ID NO: 32316 - protein, 523 aa, Perilla frutescens; identical to SEQ ID NO: 14739

SEQ ID NO: 32317 - DNA, 2034 bp, Citrus unshiu; identical to SEQ ID NO: 14740
  CDS (119)..(1714)

SEQ ID NO: 32318 - protein, 531 aa, Citrus unshiu; identical to SEQ ID NO: 14741

SEQ ID NO: 32319 - DNA, 1889 bp, Citrus unshiu; identical to SEQ ID NO: 14742
  CDS (69)..(1616)

SEQ ID NO: 32320 - protein, 515 aa, Citrus unshiu; identical to SEQ ID NO: 14743

SEQ ID NO: 32321 - DNA, 1563 bp, Lycopersicon hirsutum; identical to SEQ ID NO: 14744
  CDS (1)..(1563)

SEQ ID NO: 32322 - protein, 520 aa, Lycopersicon hirsutum; identical to SEQ ID NO: 14745

SEQ ID NO: 32323 - DNA, 1140 bp, Leishmania major; identical to SEQ ID NO: 14746
  CDS (1)..(1140)

SEQ ID NO: 32324 - protein, 379 aa, Leishmania major; identical to SEQ ID NO: 14747

SEQ ID NO: 32325 - DNA, 1083 bp, Homo sapiens; identical to SEQ ID NO: 14748
  CDS (1)..(1083)

SEQ ID NO: 32326 - protein, 360 aa, Homo sapiens; identical to SEQ ID NO: 14749

SEQ ID NO: 32327 - DNA, 1086 bp, Candida glabrata; identical to SEQ ID NO: 14750
  CDS (1)..(1086)

SEQ ID NO: 32328 - protein, 361 aa, Candida glabrata; identical to SEQ ID NO: 14751

SEQ ID NO: 32329 - DNA, 1218 bp, Vibrio vulnificus; identical to SEQ ID NO: 14752
  CDS (1)..(1218)

SEQ ID NO: 32330 - protein, 405 aa, Vibrio vulnificus; identical to SEQ ID NO: 14753

SEQ ID NO: 32331 - DNA, 1215 bp, Vibrio parahaemolyticus; identical to SEQ ID NO: 14754
  CDS (1)..(1215)

SEQ ID NO: 32332 - protein, 404 aa, Vibrio parahaemolyticus; identical to SEQ ID NO: 14755

SEQ ID NO: 32333 - DNA, 2025 bp, Hordeum vulgare; identical to SEQ ID NO: 14756
  CDS (189)..(1760)

SEQ ID NO: 32334 - protein, 523 aa, Hordeum vulgare; identical to SEQ ID NO: 14757

SEQ ID NO: 32335 - DNA, 1164 bp, Bacillus stearothermophilus; identical to SEQ ID NO: 14758
  CDS (1)..(1164)

SEQ ID NO: 32336 - protein, 387 aa, Bacillus stearothermophilus; identical to SEQ ID NO: 14759

SEQ ID NO: 32337 - DNA, 2040 bp, Clostridium cellulolyticum; identical to SEQ ID NO: 14760
  CDS (510)..(1790)

SEQ ID NO: 32338 - protein, 426 aa, Clostridium cellulolyticum; identical to SEQ ID NO: 14761

SEQ ID NO: 32339 - DNA, 1182 bp, Clostridium perfringens; identical to SEQ ID NO: 14762
  CDS (1)..(1182)

SEQ ID NO: 32340 - protein, 393 aa, Clostridium perfringens; identical to SEQ ID NO: 14763

SEQ ID NO: 32341 - DNA, 1218 bp, Corynebacterium glutamicum; identical to SEQ ID NO: 14764
  CDS (1)..(1218)

SEQ ID NO: 32342 - protein, 405 aa, Corynebacterium glutamicum; identical to SEQ ID NO: 14765

SEQ ID NO: 32343 - DNA, 1242 bp, Deinococcus radiodurans; identical to SEQ ID NO: 14766
  CDS (1)..(1242)

SEQ ID NO: 32344 - protein, 413 aa, Deinococcus radiodurans; identical to SEQ ID NO: 14767

SEQ ID NO: 32345 - DNA, 1155 bp, Fusobacterium nucleatum; identical to SEQ ID NO: 14768
  CDS (1)..(1155)

SEQ ID NO: 32346 - protein, 384 aa, Fusobacterium nucleatum; identical to SEQ ID NO: 14769

SEQ ID NO: 32347 - DNA, 1314 bp, Haemophilus influenzae; identical to SEQ ID NO: 14770
  CDS (1)..(1314)

SEQ ID NO: 32348 - protein, 437 aa, Haemophilus influenzae; identical to SEQ ID NO: 14771

SEQ ID NO: 32349 - DNA, 1140 bp, Lactobacillus plantarum; identical to SEQ ID NO: 14772
  CDS (1)..(1140)

SEQ ID NO: 32350 - protein, 379 aa, Lactobacillus plantarum; identical to SEQ ID NO: 14773

SEQ ID NO: 32351 - DNA, 1320 bp, Pasteurella multocida; identical to SEQ ID NO: 14774
  CDS (1)..(1320)

SEQ ID NO: 32352 - protein, 439 aa, Pasteurella multocida; identical to SEQ ID NO: 14775

SEQ ID NO: 32353 - DNA, 1266 bp, Rhizobium loti; identical to SEQ ID NO: 14776
  CDS (1)..(1266)

SEQ ID NO: 32354 - protein, 421 aa, Rhizobium loti; identical to SEQ ID NO: 14777

SEQ ID NO: 32355 - DNA, 1263 bp, Rhizobium meliloti; identical to SEQ ID NO: 14778
  CDS (1)..(1263)

SEQ ID NO: 32356 - protein, 420 aa, Rhizobium meliloti; identical to SEQ ID NO: 14779

SEQ ID NO: 32357 - DNA, 1263 bp, Rhizobium tropici; identical to SEQ ID NO: 14780
  CDS (1)..(1263)

SEQ ID NO: 32358 - protein, 420 aa, Rhizobium tropici; identical to SEQ ID NO: 14781

SEQ ID NO: 32359 - DNA, 1300 bp, Rhodospirillum rubrum; identical to SEQ ID NO: 14782
  CDS (20)..(1291)

SEQ ID NO: 32360 - protein, 423 aa, Rhodospirillum rubrum; identical to SEQ ID NO: 14783

SEQ ID NO: 32361 - DNA, 1272 bp, Rhodobacter sphaeroides; identical to SEQ ID NO: 14784
  CDS (1)..(1272)

SEQ ID NO: 32362 - protein, 423 aa, Rhodobacter sphaeroides; identical to SEQ ID NO: 14785

SEQ ID NO: 32363 - DNA, 1200 bp, Streptomyces coelicolor; identical to SEQ ID NO: 14786
  CDS (1)..(1200)

SEQ ID NO: 32364 - protein, 399 aa, Streptomyces coelicolor; identical to SEQ ID NO: 14787

SEQ ID NO: 32365 - DNA, 1610 bp, Thermus caldophilus; identical to SEQ ID NO: 14788
  CDS (141)..(1385)

SEQ ID NO: 32366 - protein, 414 aa, Thermus caldophilus; identical to SEQ ID NO: 14789

SEQ ID NO: 32367 - DNA, 1032 bp, Bacillus stearothermophilus; identical to SEQ ID NO: 14790
  CDS (1)..(1032)

SEQ ID NO: 32368 - protein, 343 aa, Bacillus stearothermophilus; identical to SEQ ID NO: 14791

SEQ ID NO: 32369 - DNA, 1800 bp, Arabidopsis thaliana; identical to SEQ ID NO: 14792
  CDS (36)..(1598)

SEQ ID NO: 32370 - protein, 520 aa, Arabidopsis thaliana; identical to SEQ ID NO: 14793

SEQ ID NO: 32371 - DNA, 1761 bp, Brassica napus; identical to SEQ ID NO: 14794
  CDS (33)..(1595)

SEQ ID NO: 32372 - protein, 520 aa, Brassica napus; identical to SEQ ID NO: 14795

SEQ ID NO: 32373 - DNA, 24 bp, Primer
atggttagtttagagaagaacgat

SEQ ID NO: 32374 - DNA, 24 bp, Primer
ttatcgctcctgtttatgccctaa

SEQ ID NO: 32375 - protein, 527 aa, consensus; identical to SEQ ID NO: 15681
  MISC_FEATURE (1)..(527): consensus for the disclosure of xaa see table XV

SEQ ID NO: 32376 - protein, 57 aa, consensus; identical to SEQ ID NO: 15677
  MISC_FEATURE (1)..(57): consensus for the disclosure of xaa see table XV

SEQ ID NO: 32377 - protein, 68 aa, consensus; identical to SEQ ID NO: 15678
  MISC_FEATURE (1)..(68): consensus for the disclosure of xaa see table XV

SEQ ID NO: 32378 - protein, 31 aa, consensus; identical to SEQ ID NO: 15679
  MISC_FEATURE (1)..(31): consensus for the disclosure of xaa see table XV

SEQ ID NO: 32379 - protein, 68 aa, consensus; identical to SEQ ID NO: 15680
  MISC_FEATURE (1)..(68): consensus for the disclosure of xaa see table XV

SEQ ID NO: 32380 - DNA, 588 bp, Escherichia coli
  CDS (1)..(588)
atggtggaccaggcgcaggacaccctgcgcccgaataacagattgtcagatatgcaggcaacaatggaacaaacccaggcctttgaaaaccgtgtgcttgagcgtctgaatgctggcaaaaccgtgcgaagctttctgatcaccgccgtcgagctcctgaccgaggcggtaaatcttctggtgcttcaggtattccgcaaagacgattacgcggtgaagtatgctgtagaaccgttactcgacggcgatggtccgctgggcgatctttctgtgcgtttaaaactcatttacgggttgggcgtcattaaccgccaggaatacgaagatgcggaactgctgatggcattgcgtgaagagctaaatcacgacggcaacgagtacgcctttaccgacgacgaaatccttggaccctttggtgaactgcactgcgtggcggcgttaccaccgccgccacagtttgaaccagcagactccagtttgtatgcaatgcaaattcagcgctatcaacaggctgtgcgatcaacaatggtcctttcactgactgagctgatttccaaaatcagcttaaaaaaagcctttcaaaagtaa

SEQ ID NO: 32381 - protein, 195 aa, Escherichia coli
MVDQAQDTLRPNNRLSDMQATMEQTQAFENRVLERLNAGKTVRSFLITAVELLTEAVNLLVLQVFRKDDYAVKYAVEPLLDGDGPLGDLSVRLKLIYGLGVINRQEYEDAELLMALREELNHDGNEYAFTDDEILGPFGELHCVAALPPPPQFEPADSSLYAMQIQRYQQAVRSTMVLSLTELISKISLKKAFQK

SEQ ID NO: 32382 - DNA, 582 bp, Vibrio cholerae O1 biovar eltor str. N16961
  CDS (1)..(582)
atgtcgagagctgtcactcgctctcgacttaactcaacaacagatcagtttatggcagaaaaaattaacgaatccgacattctggagcgcttgaatcagacccacacggtacgaggattcttcattacaacggttgatgtgctaaccgaagccattgatgcactgatgcaacgtattttccgtaaagacaatttcgcggtgaaatccgtagttgaaccactcttgcacgatacaggaccgctgggtgacctaacggttcgcctgaaacttttatttggtttgggcgtgatcccagatgaggttttccacgatattgaacacttaatcaaactgcgcaatcagctcaatcatgatgcaaccgagtaccaattcaccgacccgcaaattctcgcgccaatcaaagcactcaatctggtcaaaaaaatgggcatgttgcatttaaacgtcgtggagccagacgacgatattgacctcagcttttaccacctgcaattgcaacgccaacagcaagtgatcaaatctggtctctctctggccatcattcaaatttgtaatgcactcaacaaagacagcccgttttaa

SEQ ID NO: 32383 - protein, 193 aa, Vibrio cholerae O1 biovar eltor str. N16961
MSRAVTRSRLNSTTDQFMAEKINESDILERLNQTHTVRGFFITTVDVLTEAIDALMQRIFRKDNFAVKSVVEPLLHDTGPLGDLTVRLKLLFGLGVIPDEVFHDIEHLIKLRNQLNHDATEYQFTDPQILAPIKALNLVKKMGMLHLNVVEPDDDIDLSFYHLQLQRQQQVIKSGLSLAIIQICNALNKDSPF

SEQ ID NO: 32384 - DNA, 519 bp, Pasteurella multocida subsp. multocida str. Pm70
  CDS (1)..(519)
gtgcagtcagtcgatcccatttatgaaaaactcaatgaagccacctcaattcgtggtttcattacggcttctgtcgcgatttttgacgaagcggttgataaacttattaatcgcgtttttcgtaaaacagattttgccgtcaaatctgtagttgactcattattatctaattctggaccgctctgcgatttatcgattcgtttaaaagtcttattaggtttagggattatcgagcatcatgtgtttagcgatatcagccattttattgagattaaagaaaagctgaataacgatgaaaaagaatacgattttgccgatctcattattattgattttatccaacagttaagctgtcaaaatgataaatccttgctcaattttccgatggaaaaagacgaaaaccccgactcactactctatcaagtcaaagccttacgtcgagaaaaattgattcgttcttatctcaccttggcaatcactgaaatttacgagcaactccaaatcgaaagtccattgtga

SEQ ID NO: 32385 - protein, 172 aa, Pasteurella multocida subsp. multocida str. Pm70
MQSVDPIYEKLNEATSIRGFITASVAIFDEAVDKLINRVFRKTDFAVKSVVDSLLSNSGPLCDLSIRLKVLLGLGIIEHHVFSDISHFIEIKEKLNNDEKEYDFADLIIIDFIQQLSCQNDKSLLNFPMEKDENPDSLLYQVKALRREKLIRSYLTLAITEIYEQLQIESPL

SEQ ID NO: 32386 - DNA, 510 bp, Escherichia coli O157:H7
  CDS (1)..(510)
atggcgacgctgtcagaagatgatgtgcttgagcaactggatgcacaggacaatttattttcatttatgaaaactgcgcattctattttgctccaggggatacgccagtttctgccgtcgctgtttgtcgataacgatgaagagagcgtcgaatatgcagtgaagccgttactcgcccaaagcggcccgcttgacgatattgatgttgcactgcgtttgatttatgcgctggggaaaatggataaatggctgtacgccgatatcacgcatttttcccagtactggcattacctgaaagaacaggatgaaacgctcggatttgccgatgacatgacttgggattttatcagcaacgtcaatagcataacctgcaatgcgacgctctatgacgcgttgaaagcgatgaagttcgccgatttcgccgtctggtcagaggcgcgttttagcggaatggtcaaaacggcgctgacgctggcagtaacgaccaccttaaaggaattaacgccgtga

SEQ ID NO: 32387 - protein, 169 aa, Escherichia coli O157:H7
MATLSEDDVLEQLDAQDNLFSFMKTAHSILLQGIRQFLPSLFVDNDEESVEYAVKPLLAQSGPLDDIDVALRLIYALGKMDKWLYADITHFSQYWHYLKEQDETLGFADDMTWDFISNVNSITCNATLYDALKAMKFADFAVWSEARFSGMVKTALTLAVTTTLKELTP

SEQ ID NO: 32388 - DNA, 591 bp, Salmonella typhimurium LT2
  CDS (1)..(591)
atgacgcagaatccggcgcaggttagcctgcgcccaaataacagattgtcagatatgcaggcaataatggaacaaacccaggcctttgaaaatcgtgtgcttgagcgtctgaatgctggcaaaaccgtacggagcttcctgattaccgccgtcgagttattgaccgaggcggtgaatattctggtgcttcaggtgtttcgcaaagacgactatgccgtgaaatacgctgtggaaccgttgctggacggcgacgggccgctgggcgatctttcggtacgtctgaaacttatctatggcctgggcgtactcagccgcaccgaatatgaagatgcggagctgttaatggcgctgcgcgaagagctgaatcacgatggcaatgagtacgcctttaccgacgatgaaatcctcgggccgtttggcgaactgcactgcgtcatggcgctaccgccgccgccgcattttgatacgtccgacgcggcgctatacgccatgcaaattcagcgctaccagcaggcggtgcgttcgacgatggtcctctctctgaccgagctgatttctaaaatcagcttaaaaaaggcctttcaaaagtaa

SEQ ID NO: 32389 - protein, 196 aa, Salmonella typhimurium LT2
MTQNPAQVSLRPNNRLSDMQAIMEQTQAFENRVLERLNAGKTVRSFLITAVELLTEAVNILVLQVFRKDDYAVKYAVEPLLDGDGPLGDLSVRLKLIYGLGVLSRTEYEDAELLMALREELNHDGNEYAFTDDEILGPFGELHCVMALPPPPHFDTSDAALYAMQIQRYQQAVRSTMVLSLTELISKISLKKAFQK

SEQ ID NO: 32390 - DNA, 555 bp, Yersinia pestis KIM
  CDS (1)..(555)
atgattgaaaaaaaacaagcatttgagaatcgggttcttgaacatttgaacgctgggaagaccgtgcgcagcttcttgatggcggcagtcgatttattggctgaagcactgaatatactcgtggtgcagatttttcgtaaagatgactatgcggtgaagtatgccgtggagccgttattggtcggtgacgggccattgagtgaactctctgtgcggttgaagctggtttatgcccttggggtgatcacccggcatgaatatgaagatgctgagctattaatggcgctacgtgaagagctaaaccacgatggcactgagtatcgctttaccgatgacgaaatcctcgggccatttggtgaattgcattgtgtcgatgaattaccgccagtacccacttttttacgccctgatgaagccgatgcttcgctgattgctatgcaacgccagcgttatcagcaaatggtccgctccaccatggtgttgtcgatcactgaactgctctctcgcatcagcgtcaaacaggtctctaagctctcgccattaagtcaaggttaa

SEQ ID NO: 32391 - protein, 184 aa, Yersinia pestis KIM
MIEKKQAFENRVLEHLNAGKTVRSFLMAAVDLLAEALNILVVQIFRKDDYAVKYAVEPLLVGDGPLSELSVRLKLVYALGVITRHEYEDAELLMALREELNHDGTEYRFTDDEILGPFGELHCVDELPPVPTFLRPDEADASLIAMQRQRYQQMVRSTMVLSITELLSRISVKQVSKLSPLSQG

SEQ ID NO: 32392 - DNA, 531 bp, Vibrio parahaemolyticus RIMD 2210633
  CDS (1)..(531)
atggcagataacatcaacgaaagcgagatcattgaacgactcaacagcgcaccatcggtacgtggcttctttattgcgaccgtcgacgtatttaacgaatccatcgacggactcatccaaagaatcttccgtaaagataactttgctgtgcaatcggtcgtcggcccattactgcaagattcaggaccgcttggcgacttatcggttcgtttgaagttattgtttggtctaggtgtattgcccgacgacatctaccacgatatcgaagacatcattaagctgaaaaaccatctcaatagcgacgcttctgactacgagttcactgatcctaatattctagaaccgatcaaaaagctgcatttggtgaagaaaatgggcatggtgcaattggaagtcaacgaacccgatgacgacatcgatcttgagttttaccaactccagcttcagcgccaacaacaaatcattaagtccggcctgtcactcgcgattgtcgaaatttgcaatgaactgggcaaggacagccctttttaa

SEQ ID NO: 32393 - protein, 176 aa, Vibrio parahaemolyticus RIMD 2210633
MADNINESEIIERLNSAPSVRGFFIATVDVFNESIDGLIQRIFRKDNFAVQSVVGPLLQDSGPLGDLSVRLKLLFGLGVLPDDIYHDIEDIIKLKNHLNSDASDYEFTDPNILEPIKKLHLVKKMGMVQLEVNEPDDDIDLEFYQLQLQRQQQIIKSGLSLAIVEICNELGKDSPF

SEQ ID NO: 32394 - DNA, 519 bp, Vibrio parahaemolyticus RIMD 2210633
  CDS (1)..(519)
ttgtcacgtgaagacgaattactggagaaattggatgagtgtgaaaatgccactgcgtttcttcaggtttctaacaaaataattaacctcaagttaaaagcattacttccgagtgtgttcgtccaagacgacttagtgaaggagtatgctgtggatcctttattgagagaagatgggccattggtcacgaccgatgttgtctccaagttgatgtttgcgatggggaaaatctcattacaaacttatgcagacattggcttgtacgatcaggtattggagtatgtggttactcagcctgaaaagatcgcgtttacagatgatgtgatttatgacttcatcaaaaaccaagcggtactctcttctcagcaagactgcttttatcttgagtcgatcaatcagctaaagttctcttcgtttgagtccttttcgcaaatgagatacgaatctctcatcaaaacagtgctcaagctgtcgtgtgaaatgttgatagaaagaatcgaagaggaaatcaatcagtaa

SEQ ID NO: 32395 - protein, 172 aa, Vibrio parahaemolyticus RIMD 2210633
MSREDELLEKLDECENATAFLQVSNKIINLKLKALLPSVFVQDDLVKEYAVDPLLREDGPLVTTDVVSKLMFAMGKISLQTYADIGLYDQVLEYVVTQPEKIAFTDDVIYDFIKNQAVLSSQQDCFYLESINQLKFSSFESFSQMRYESLIKTVLKLSCEMLIERIEEEINQ

SEQ ID NO: 32396 - DNA, 543 bp, Vibrio vulnificus YJ016
  CDS (1)..(543)
ttgattcagtttatggcagagcatacaaacgaaagtgacatcattgaacgattaaatcacgcccccagtgtacgcggtttttttgttgagaccgtcgacatccttaccgaggccgtcgatggcttggtacaacgaatttttcgcaaagataattttgccgtgcaatctgtcgttgggccgcttttgcaggactctggtccattaggtgatgtttctgtacgcttaaaactgctctttggtttaggcgtgttatcagatcatcactaccacgatattgaagacatcattaagctcaaaaacaaactcaacagcgatagcacagaatacgagtttaccgatccccaaatactcgaaccgattaagaaacttcatctcgtgcagaaaatgggcatggtgcaacttgaagtcgatgaccctgatgacgatatcgagctgagtttttatcagcttcaactgcaaagaaagcaacaaatcatccgctctggtctctcactcgccattgtcgaaatctgtcatgaattgggcaaggacagcccattttag

SEQ ID NO: 32397 - protein, 180 aa, Vibrio vulnificus YJ016
MIQFMAEHTNESDIIERLNHAPSVRGFFVETVDILTEAVDGLVQRIFRKDNFAVQSVVGPLLQDSGPLGDVSVRLKLLFGLGVLSDHHYHDIEDIIKLKNKLNSDSTEYEFTDPQILEPIKKLHLVQKMGMVQLEVDDPDDDIELSFYQLQLQRKQQIIRSGLSLAIVEICHELGKDSPF

SEQ ID NO: 32398 - DNA, 603 bp, Erwinia carotovora subsp. atroseptica SCRI1043
  CDS (1)..(603)
atgtcgccacacctgccggtaagcatgctaccgagatgggtatgttgtgcggatttaaaggtacgagaagtgacgatggaagaaacacaggcgtttgaaaaccgagttctggaagcgctgaactcagggaagacagtgcgcgactttatgctctgcgccgttgaattgctggccgaagcggccagtatcttgatgttgcaggtgttccgtaaagacgactatgcggtgaaatatgccgttgaacctctgatgacgggaacgggcccgctgggtgacctttccgtgcgcctgaaactgatttatggcctggggatgatcagccgtaaagagtatgaagatgcggaactgttaatggcgctgggcgaagagttggcgcatgacgatcggcactatcgttttaccgatgatgaaattctggggcccatcggcgagttgcactgcgttgcggcgttgcccgcagaaccgacgttgccgctgggggctgatgccgatccacttctggtgagtatgcagcagcagcgttatcagcagatggtgcgttccacgctggttttatccctgaccacgttgattgcgcaaatcagtctgaaaaaggcgttttaa

SEQ ID NO: 32399 - protein, 200 aa, Erwinia carotovora subsp. atroseptica SCRI1043
MSPHLPVSMLPRWVCCADLKVREVTMEETQAFENRVLEALNSGKTVRDFMLCAVELLAEAASILMLQVFRKDDYAVKYAVEPLMTGTGPLGDLSVRLKLIYGLGMISRKEYEDAELLMALGEELAHDDRHYRFTDDEILGPIGELHCVAALPAEPTLPLGADADPLLVSMQQQRYQQMVRSTLVLSLTTLIAQISLKKAF

SEQ ID NO: 32400 - DNA, 519 bp, Mannheimia succiniciproducens MBEL55E
  CDS (1)..(519)
gtgacatcagaagatccaatttacgaaaaacttaacgaaactacctccattcgcggatttattaccgcttgcgttgcgatttttgacgagtcggtagaccagttaatcaaccgggtttttcgaaaaacggattttgccgtaaaatccgtagttgactcgctttttatcaattccggcccgttattcgacctttctatccgattaaaagtcctgcttgggcttggcattatttcccatgaaacctttatggatatcaatgcgtttattcagctcaaagaggcgttaaacaatgatggtaaagaatatgaattctttgatcctatcattatctcgttcattcaggggctgaatgtccgccaggataagtccttccttaatcttgatacaaaaatcgacggcacaaaagattccttgctttatcaggtaaaagtgttacgtcgcgaaaaattaatccgttcttatcttattttatccgtaacggatctctatgaccaactgcaagttgaaagccctctttaa

SEQ ID NO: 32401 - protein, 172 aa, Mannheimia succiniciproducens MBEL55E
MTSEDPIYEKLNETTSIRGFITACVAIFDESVDQLINRVFRKTDFAVKSVVDSLFINSGPLFDLSIRLKVLLGLGIISHETFMDINAFIQLKEALNNDGKEYEFFDPIIISFIQGLNVRQDKSFLNLDTKIDGTKDSLLYQVKVLRREKLIRSYLILSVTDLYDQLQVESPL

SEQ ID NO: 32402 - DNA, 531 bp, Photobacterium profundum SS9
  CDS (1)..(531)
atggcacaaagtgaccaagagtcagacatccttgaacgattaagtgatacatctaatgtgcgaggtttcattatcacttctgtcgaagtgtttgaagaagctgtcgatagcttaatccaacgtatatttcgtaaagacgatttcgccgttaagtctgtggtcggtcctttactggataactctggccccttaggtgaaataacggttcgccttaagctattgctgggtttaggcgttgtttcacacaacatttaccaagatatcgatgcttttcttaaactgcgtgattttcttaacagcgatggtagcgattactgttttactgatcccaaaatattacaacccatcaaaaaaatgcatgcggtacaaaatatgggcgtggtacaacttgaaatcgcctcaccaagtgacgatgtcgaccttattttttatcaaatgcagttagctcgccaagaacagatcattaagtcagcgcttgcccttgcaattgctggcatctgtaatgaacttggtcgtgatagtccattttga

SEQ ID NO: 32403 - protein, 176 aa, Photobacterium profundum SS9
MAQSDQESDILERLSDTSNVRGFIITSVEVFEEAVDSLIQRIFRKDDFAVKSVVGPLLDNSGPLGEITVRLKLLLGLGVVSHNIYQDIDAFLKLRDFLNSDGSDYCFTDPKILQPIKKMHAVQNMGVVQLEIASPSDDVDLIFYQMQLARQEQIIKSALALAIAGICNELGRDSPF

SEQ ID NO: 32404 - DNA, 516 bp, Haemophilus somnus 2336
  CDS (1)..(516)
ttgttatctgaagatcctatttatgaaaaattaaacagtactgtttccgtgcgaggttttatgattgctactgtggcaatttttgaagaggcggtagatagtctgatcaatcgagtatttcgaaaaacagattttgtggtgcagtcggtgattgactctctttttaccaacgatggtcctcttggtgatctcagtgtacgtctcaaagtgttactcggacttggcgtgatccaacacaatctattttccgacgtaaatgcctttattcaatttaaggaaacattaaataaggacgaaaaggaatacactttcgatgatgaaattgtactcacttttttgcaaaaattaacgctgttgatggataaatcagcacttgattttgagccattaatcgaagacaaaaacagccttacttaccagatgaaatctctgcgacgggaaaaaattattcgttcttgtttaatattgaccattgcagatatttaccgtcaattacaaatcgaaagtccattttga

SEQ ID NO: 32405 - protein, 171 aa, Haemophilus somnus 2336
MLSEDPIYEKLNSTVSVRGFMIATVAIFEEAVDSLINRVFRKTDFVVQSVIDSLFTNDGPLGDLSVRLKVLLGLGVIQHNLFSDVNAFIQFKETLNKDEKEYTFDDEIVLTFLQKLTLLMDKSALDFEPLIEDKNSLTYQMKSLRREKIIRSCLILTIADIYRQLQIESPF

SEQ ID NO: 32406 - DNA, 525 bp, Actinobacillus pleuropneumoniae serovar 1 str. 4074
  CDS (1)..(525)
atgccatattcagataattttatcgaacaattaagcgaagttccctctttacgagggttctttgcactttcagtgaatcagtttgcgcaaaatattgaacggcttattcaaagagtatttcgtaaaaccgactttgctttaaagtcggtggtcgattccttgtttgaacatcaaggaccgcttgcggaattgactgttcgtctaaagttattattgggtttgggggtgatttccgccgccgtttttgaagatatttcgctttttatcgaagtgaaacagcaattaagcgatgaggtggaggaattaccgttttcccatccggcaatcgtacaattcgccaaagatcttcatcacattgatctcagcccggttgcggatctgttgaaatttgcttcgtcggtagaaaataaagattcaatgttataccaaatgcaacaaattcgtttggaacgtgtgatgcgatccagtttgattcttgccattactgaaattaacgagaagttaaatgtagaaagccctttataa

SEQ ID NO: 32407 - protein, 174 aa, Actinobacillus pleuropneumoniae serovar 1 str. 4074
MPYSDNFIEQLSEVPSLRGFFALSVNQFAQNIERLIQRVFRKTDFALKSVVDSLFEHQGPLAELTVRLKLLLGLGVISAAVFEDISLFIEVKQQLSDEVEELPFSHPAIVQFAKDLHHIDLSPVADLLKFASSVENKDSMLYQMQQIRLERVMRSSLILAITEINEKLNVESPL

SEQ ID NO: 32408 - DNA, 597 bp, Klebsiella pneumoniae
  CDS (1)..(597)
atgcacaacctggcgcggccgacgtcgcgcccattacgactcctgtcagatatgcaggcaatgatggaagaaacacaagcatttgaaaaccgtgtgcttgagcgtctgaatgctggcaaaaccgtacgaagctttctgatcgccaccgtcgagctgttaacggaagcggtcaatattctggtgcttcaggtgttccgtaaagacgactacgcggtgaaatacgccgtcgagcccttgctggagggcagcgggccgctcggcgatctctctgtacgcctgaagctgatttatggccttggggtgataagtcgtgccgaatatgaagacgctgagctgctgatggccctgcgtgaagagcttaaccacgacggcaatgagtacagctttaccgacgacgaaattatcggtccgttcggcgaactgcactgcgtcgccgccctgccgccaacgccgcaatttgatgacagcgatgccgaactgctggcaatgcagaaactgcgttaccagcagatggtgcgctcaacgatggtgctgtccctgactgagctgatttcacgaatcagcttaaaaaaagcctttcagaaatcaacgctctga

SEQ ID NO: 32409 - protein, 198 aa, Klebsiella pneumoniae
MHNLARPTSRPLRLLSDMQAMMEETQAFENRVLERLNAGKTVRSFLIATVELLTEAVNILVLQVFRKDDYAVKYAVEPLLEGSGPLGDLSVRLKLIYGLGVISRAEYEDAELLMALREELNHDGNEYSFTDDEIIGPFGELHCVAALPPTPQFDDSDAELLAMQKLRYQQMVRSTMVLSLTELISRISLKKAFQKSTL

SEQ ID NO: 32410 - DNA, 21 bp, Primer
atggtggaccaggcgcaggac

SEQ ID NO: 32411 - DNA, 27 bp, Primer
ttacttttgaaaggctttttttaagct

SEQ ID NO: 32412 - protein, 157 aa, consensus
  MISC_FEATURE (1)..(157): consensus for the disclosure of xaa see table XV
EXXXXEXLXXXXXXRXFXXXXVXXXXEXXXXLXXXXFRKXXXXAVXXXVXXLXXXXGPLXXXXVRLKLXXGLGXXXXXXXXDXXXXXXXXXXLXXDXXXYXFXDXXIXXXXXXLXXXXXXXXXXXXXXXXXXXXXXXXXXXXXXXRXXXXXXSXXXL

SEQ ID NO: 32413 - protein, 34 aa, consensus
  MISC_FEATURE (1)..(34): consensus for the disclosure of xaa see table XV
XXEXLXXXXXXXXFXXXXXXXXXXXXXXXXXXXF

SEQ ID NO: 32414 - protein, 34 aa, consensus
  MISC_FEATURE (1)..(34): consensus for the disclosure of xaa see table XV
XXXLXXXXGPLXXXXXXXXXXXXXGXXXXXXXXD

SEQ ID NO: 32415 - protein, 21 aa, consensus
  MISC_FEATURE (1)..(21): consensus for the disclosure of xaa see table XV
RXXXXXXXXXXLXXXXXXXXX

SEQ ID NO: 32416 - DNA, 1518 bp, Escherichia coli
  CDS (1)..(1518)
atgtctgaacaagaaacacggggagccaatgaggctattgattttaacgatgaactgagaaatcgccgcgaaaaactggcggcactacgtcagcaaggtgtggcgtttcccaatgattttcgccgsgaccatacctctgaccagttgcacgaagagtttgatgcgaaggataaccaggaactggaatccttaaacattgaagtctcggttgctggccgaatgatgacccgtcgtatcatggggaaagcctcctttgtaacgttgcaggatgtcggtggccgtattcaactgtacgtcgcacgagatagcctgccagaaggtgtttataacgatcagtttaaaaaatgggatctgggtgacattatcggtgcccgcggtacgctgtttaagacgcaaacgggtgagctttccattcactgtactgagttgcgcctgctgactaaagcactacgtcctttaccagataaattccatggtctgcaggatcaggaagtccgttatcgtcaacgttatctggacctcatcgctaacgataaatcccgtcaaacgtttgttgtccgttcaaaaattctggccgctatccgccagttcatggtcgcgcgcggctttatggaagtagaaaccccgatgatgcaggtaattccaggtggggcatctgctcgcccgtttattacccatcataatgctctggatttagatatgtatctgcgtatcgcgccggagctgtatctgaaacgtctggttgtaggcggttttgaacgggtattcgaaatcaaccgtaacttccgtaatgaaggtatttctgttcgccataatcctgagttcacaatgatggaactctacatggcgtatgcggattaccacgatttgattgaactgacagagtccctgttccgcaccctggcacaagaggttctgggtaccactaaagtcacttatggcgagcatgtgtttgatttcggcaaaccgtttgaaaaactcaccatgcgcgaagcaatcaaaaaatatcgtccagaaaccgatatggccgacctggataattttgatgctgctaaagcattagctgaatctatcggtattacggtagagaaaagctgggggctgggacgtattgtcacggagatctttgatgaagtggcagaagcacatctgattcagccaacctttattacggaatatccggcagaagtgtcaccgctggcacgccgtaatgatgttaacccggaaatcaccgaccgttttgaattcttcatcggtggtcgtgaaatcggtaatggttttagcgaattaaacgacgcagaagatcaggctgaacgtttccaggaacaggttaacgctaaagccgcaggtgacgacgaagccatgttctatgacgaagattacgtgactgcgctggaatatggtctgccgccaaccgctggtctgggtattggtatcgaccgaatgattatgctgtttactaacagccatactattcgcgacgttattctcttcccggcgatgcgcccacagaaataa

SEQ ID NO: 32417 - protein, 505 aa, Escherichia coli
MSEQETRGANEAIDFNDELRNRREKLAALRQQGVAFPNDFRRDHTSDQLHEEFDAKDNQELESLNIEVSVAGRMMTRRIMGKASFVTLQDVGGRIQLYVARDSLPEGVYNDQFKKWDLGDIIGARGTLFKTQTGELSIHCTELRLLTKALRPLPDKFHGLQDQEVRYRQRYLDLIANDKSRQTFVVRSKILAAIRQFMVARGFMEVETPMMQVIPGGASARPFITHHNALDLDMYLRIAPELYLKRLVVGGFERVFEINRNFRNEGISVRHNPEFTMMELYMAYADYHDLIELTESLFRTLAQEVLGTTKVTYGEHVFDFGKPFEKLTMREAIKKYRPETDMADLDNFDAAKALAESIGITVEKSWGLGRIVTEIFDEVAEAHLIQPTFITEYPAEVSPLARRNDVNPEITDRFEFFIGGREIGNGFSELNDAEDQAERFQEQVNAKAAGDDEAMFYDEDYVTALEYGLPPTAGLGIGIDRMIMLFTNSHTIRDVILFPAMRPQK

SEQ ID NO: 32418 - DNA, 1536 bp, Streptococcus thermophilus CNRZ1066
  CDS (1)..(1536)
atgaattatgatacaatattaacgactattttatggaggactaacatgccaaatcaacacatggaagaattaaacgatcaacagattgtccgtcgtgaaaaaatggcggccttggctgaacaaggaatcgatccttttggtaagcgattcgaacgcacagctacatctggtcaattaaaagaaaaatacgctgataaaacaaaagaagaactgcacgaaatcaatgaaactgctactatcgcaggccgtttgatgactaagcgtggtaaaggtaaagttggctttgctcacatccaagatcgcgatggtcaaatccaaatctacgtgcgtaaagatgctgtcggtgaagaaaactacgaaatcttcaagaaagctgaccttggtgacttcctcggtgtcgagggtgaaattatgcgtacagatatgggagaactttctatcaaggctactcatatcacgcacttgtctaaagcccttcgtccattgcctgagaaattccacggactttcagacattgaaacgatttaccgtaaacgttaccttgatttgatttctaatcgtgaaagctttgaccgctttgtcacacgttcaaaaatcatctctgaaatccgtcgctatctcgatgctcaaggtttccttgaagtagaaactcctgttcttcacaacgaagctggtggtgctgctgctaaacctttcatcactcaccacaacgctcagaatattgatatggtacttcgtatcgcaactgagcttcacctcaaacgcctcatcgttggtggtatggaacgtgtctacgaaatcggacgtgtcttccgtaacgaaggcatggatgccactcacaaccctgaattcacaactatcgaagtttaccaagcttatgctgacttccatgatatcatgaacttgactgaaggtatcatccaacacgctgctaaagcggttaaaggtgatggacctatcaactaccaaggaactgaaatcaagatcaacgaaccatttaaacgcatccacatggttgacgccatcaaggaaatcaccggtgttgacttctggcaagatatgactttggaagaagctaaagctgtcgctgctgaaaagaatgttccagttgaaaaacactacactgaggttggtcacatcatcaacgccttcttcgaagaatttgttgaagaaactttgattcaaccaacattcgtttacggtcacccagttgctgtgtcaccactagctaagaaaaacccagaagacccacgcttcactgaccgtttcgaactcttcatcatgactaaagagtacggaaatgccttcaccgaattgaacgacccaattgatcaattgtcacgtttcgaagcacaagctgctgctaaagaactcggtgacgacgaagcaacaggcatcgactacgactacgttgaagccctcgaatatggtatgcctccaacaggtggactcggaatcggtatcgaccgtctctgcatgcttcttactgacacaacaaccatccgtgatgtcttgttgttcccaacgatgaaataa

SEQ ID NO: 32419 - protein, 511 aa, Streptococcus thermophilus CNRZ1066
MNYDTILTTILWRTNMPNQHMEELNDQQIVRREKMAALAEQGIDPFGKRFERTATSGQLKEKYADKTKEELHEINETATIAGRLMTKRGKGKVGFAHIQDRDGQIQIYVRKDAVGEENYEIFKKADLGDFLGVEGEIMRTDMGELSIKATHITHLSKALRPLPEKFHGLSDIETIYRKRYLDLISNRESFDRFVTRSKIISEIRRYLDAQGFLEVETPVLHNEAGGAAAKPFITHHNAQNIDMVLRIATELHLKRLIVGGMERVYEIGRVFRNEGMDATHNPEFTTIEVYQAYADFHDIMNLTEGIIQHAAKAVKGDGPINYQGTEIKINEPFKRIHMVDAIKEITGVDFWQDMTLEEAKAVAAEKNVPVEKHYTEVGHIINAFFEEFVEETLIQPTFVYGHPVAVSPLAKKNPEDPRFTDRFELFIMTKEYGNAFTELNDPIDQLSRFEAQAAAKELGDDEATGIDYDYVEALEYGMPPTGGLGIGIDRLCMLLTDTTTIRDVLLFPTMK

SEQ ID NO: 32420 - DNA, 1512 bp, Idiomarina loihiensis L2TR
  CDS (1)..(1512)
atgactgataaatcgcaggcacctgaagtagacgtaaacgaacagatcgcgcagcgaaaggcgaaactgtcggcgcttcgcgataagggtatcgcattcccgaacgatttccgtcgggactcgttagctgctgacttacacgctgaatacgataatctgagcaaagaagagctggcggaaaaaggcattcgcgtgaaagttgccggccgtatgatgacccgccgtattatggggaaagccagtttcgcaaccatccaggatatgagcggcaaaattcaactgtatgttgcccgcgacaatctgcctgaaggttattacaacacggaatttaaaaaatgggatttaggcgatattctcggcgcctctggcaccttgtttattaccggaaccggtgagttaagcgtgcaagttgacgaagtacgtttgctgactaaagcactgcgtcctttgccggataaattccatggcttgtcagatcaggaaatgcgctatcgtcagcgttatctggacctgattaccaacgaagagtctcgcagtactttcatggctcgctctaaaatcattgactatattcgtcgttttttaagtgaccgtcagtttctggaagttgaaactcctatgatgcaggcgattccgggcggcgccgcagctcgtcctttcagcacgcaccataacgcactggatatggaactgtttttacgtattgcaccagaactttacctgaaacgtttagtcgttggtggttttgagaaggtgttcgaaattaaccgtaatttccgtaatgaaggcctgtcaacgcgccacaaccctgagttcactatgttggagttctactgggcgtacgcggattatcacgacttaatggatttaaccgagcagatgttacgtggtgcggctgagtcggtcttaggctctgctcagtttaccagccagggcgtggattatgatttcggtaagccgtttgagcgcatgacagtgttggaagctattgttaagtacatgccggaagtgagccttgagcagcttaatgacatgaatacagcaactgaaattgccgagcaggttggtgtcagtgttaagccgtcatggggcttaggtaaagttcagatcgaaatttttgagactgttgctgagcatcgtttaattcagcctacctttattactgcgtacccggctgaagtttcaccgttggctcgtcgtcacgacgacaatccgtttgtgactgatcgttttgaattttttgccggtggtcgtgagttggcgaatggtttctcggagcttaacgatgctgaagatcaggctgaacgttttcgcgagcaagttgaacagaaagaagcgggcgatgatgaagccatgttctacgacgaagattatgtcaccgcactggaacacggtatgccgccaacagccggtcagggcattggtattgaccgtctggtaatgttgctaacggattctgcgtctattcgcgacgtattattgttcccgcatatgcgcccaaaagcggattaa

SEQ ID NO: 32421 - protein, 503 aa, Idiomarina loihiensis L2TR
MTDKSQAPEVDVNEQIAQRKAKLSALRDKGIAFPNDFRRDSLAADLHAEYDNLSKEELAEKGIRVKVAGRMMTRRIMGKASFATIQDMSGKIQLYVARDNLPEGYYNTEFKKWDLGDILGASGTLFITGTGELSVQVDEVRLLTKALRPLPDKFHGLSDQEMRYRQRYLDLITNEESRSTFMARSKIIDYIRRFLSDRQFLEVETPMMQAIPGGAAARPFSTHHNALDMELFLRIAPELYLKRLVVGGFEKVFEINRNFRNEGLSTRHNPEFTMLEFYWAYADYHDLMDLTEQMLRGAAESVLGSAQFTSQGVDYDFGKPFERMTVLEAIVKYMPEVSLEQLNDMNTATEIAEQVGVSVKPSWGLGKVQIEIFETVAEHRLIQPTFITAYPAEVSPLARRHDDNPFVTDRFEFFAGGRELANGFSELNDAEDQAERFREQVEQKEAGDDEAMFYDEDYVTALEHGMPPTAGQGIGIDRLVMLLTDSASIRDVLLFPHMRPKAD

SEQ ID NO: 32422 - DNA, 1731 bp, Francisella tularensis subsp. tularensis
  CDS (1)..(1731)
atggggctactaattgctaatgtgcaacaaataattacagggtttaaaatgagtagtaaattaaaagatttgataaaaacaacgataaaagaatatttagaagctaatgatatcacagttaaagatgctattagaggcaagattagagagcagattagtgagtttttaggcgaggtaagcgagataaatgagcaggttaaagaacaaatttcagcgcttgtgaaaaagcatgtaacagaattacaagaaagctcacaaattgctttaagaaaagaaaagctaaaaactttagctcagcaaaataatggcataagccatccaaatagtttccgaagaaatgctgttgctatagagttacaggctcgctatgctgataagactaagcaagaattagaagagctagataataaacaacaatatagtttgacaggtagagtagttctacgccgtgtcatgggtaaagcatcttttataacactacaagattatactggtagaatccaagtttatctaaaaaagagtgacttgccagatgggcaatatgaaacttttaagaatctatgtgacttgggtgatatagttggtattactggtactatgtttaagacaaatactggtgaactttctgttgaagcaaatcactttgagattttgacaaaggcaattcgtcctttgcctgataaattccatggtttggcagatcaagaaatgagatatcgtcaaagatatgttgatttaattacaaatgaaaaggcaagagaagtctttaaagtacgctcaaaagttgtgaactttatccgtaactattttgatagactagattttatggaagtagagacgccgatgatgcatgttttgcaaggtggtggtgctgctaagccatttaaaactcatcacaatgctttggatatgcctttatatttgcgtattgctccagaactttatctaaaaagactagttgttggtggttttgagcgagtttatgagataaaccgtaattttagaaacgaaggtgtatcttcacgccataatccagaatttacaatgctagagttctatatggcgtatgctgattataatgaccttatggatctaacagaagatatgctatctaaacttgtacaggaagtaattggtagcgagatacttgagtatggtgagtataaaatcaactttggtggtaagtacgaacgaatctcaatggttgactcaattgttaagtataatgatgatattaccaaagaagatttagtaacatttgaatctgctaaaaagattgctgagaaactaaaaataaaagttgaagcttaccatgaacttggacatttgataaacgaaatatttgaagaaactgtcgagcatcagcttattcaaccgacatttattacagattatccagctgtagtttcaccattggcgcgtagacaagacggtaaccctgagtttaccgatagatttgagttctttattggagcacgtgaagttgctaacggcttctctgagctaaatgatgctgaagatcaagcagagcgtttcagaaaacaggttgaagctgcggcatctggagatgatgaagctatgccttatgataaagactatatccgcgcactagagtatggtatgcctcctacagcgggacaaggaatcggtattgatagactggtaatgtatctaacaaactctcaatcaattagagatgtgattctatttccgcatatgaagcctgagtaa

SEQ ID NO: 32423 - protein, 576 aa, Francisella tularensis subsp. tularensis
MGLLIANVQQIITGFKMSSKLKDLIKTTIKEYLEANDITVKDAIRGKIREQISEFLGEVSEINEQVKEQISALVKKHVTELQESSQIALRKEKLKTLAQQNNGISHPNSFRRNAVAIELQARYADKTKQELEELDNKQQYSLTGRVVLRRVMGKASFITLQDYTGRIQVYLKKSDLPDGQYETFKNLCDLGDIVGITGTMFKTNTGELSVEANHFEILTKAIRPLPDKFHGLADQEMRYRQRYVDLITNEKAREVFKVRSKVVNFIRNYFDRLDFMEVETPMMHVLQGGGAAKPFKTHHNALDMPLYLRIAPELYLKRLVVGGFERVYEINRNFRNEGVSSRHNPEFTMLEFYMAYADYNDLMDLTEDMLSKLVQEVIGSEILEYGEYKINFGGKYERISMVDSIVKYNDDITKEDLVTFESAKKIAEKLKIKVEAYHELGHLINEIFEETVEHQLIQPTFITDYPAVVSPLARRQDGNPEFTDRFEFFIGAREVANGFSELNDAEDQAERFRKQVEAAASGDDEAMPYDKDYIRALEYGMPPTAGQGIGIDRLVMYLTNSQSIRDVILFPHMKPE

SEQ ID NO: 32424 - DNA, 1737 bp, Xenopus tropicalis
  CDS (1)..(1737)
atggcggatgtagaggcagctgctcctggtaactctgagcccaaactgagcaagaatgagcaaaagaggcgattgaaagctgaaaagaaagccactgaaaaggaagccaagcacaaagaacagaatgagaaactgcacacagaagaagctgctattgatgaggaaaccttggatcctaatcaatatttcaagattcgtacacaggcaattcagcagctgaaaggcacaaaggatgacccctatcctcacaagtaccatgttgatatgtccctcacagagtacattcagaagtacaacaaccttcagactggagaccagttatcagaagttgtcagtatagcaggtcgaatccatgccaagcgtatttctggagctaaactaattttctatgatttgcgaggtgaaggaacaaagttgcaagtgatggccaattcacgattttacaaatctgaggaagaatttgcaacaattaataacaagctccgtaggggtgatttgattggagttaaaggaaatcctggaaaaactaaaaaaggggaactgagtatcataccacatgaaatgattctgctttccccatgtcttcatatgcttccacatctccactttggattgaaagacaaggaaactagatatcgacagcgatacctggatcttatcttgaatgactatgtgagacagaaattcattgttcgtgccaagcttataacatatcttagaaaattccttgatgatttaggattccttgagattgaaactccaatgatgaacgttattccgggaggtgcagtagccaaaccgttcattacctatcacaatgagttggacatgaagctatatatgagaatagctcctgagctataccacaagatgcttgtggttggtggaattgacagagtctatgaaataggcaggcagttccgaaacgagggaattgacctcacccacaatccagagttcacaacatgtgaattttacatggcatatgcagactactatgatctcatggaaatcacagaaaaattgctctcaggtatggttaaacatattactggtggttacaaagtaatctaccaccctgagggaccagaaggcccagaatatgagattgacttcactccacccttcagaagaataagtatggtacatgaacttgaaaaagccttggggaaaaaattgcctgcaacagaccagttcgacacagaagaaacccgcaaacttcttgatgacatttgtgtggaaaaagaggttgagtgcccagcaccaagaaccactgccaggctgctagacaagctcgttggagatttcctggaggttacctgtattaatccaacatatatttgcgaccatccacaaattatgagccctcttgcaaaatggcaccgatctgaaaagggacttacagagaggtttgaactttttgtaatgaaaaaggagatctgcaacgcctatacagagttgaatgatccagtcaggcaaagggagctgtttgaagatcaagctaaggccaaagcagcaggtgatgatgaggcaatgttcattgatgagactttctgcactgcactagagtatgggcttccaccaactgctggatggggaatgggcattgatcgagtggccatgtttcttacagattccaataacataaaggaggttttactctttcctgccatgaagcctgaagataataagaaagatcctaattcaaccccaaattctgatgggacatctgtgtaa

SEQ ID NO: 32425 - protein, 578 aa, Xenopus tropicalis
MADVEAAAPGNSEPKLSKNEQKRRLKAEKKATEKEAKHKEQNEKLHTEEAAIDEETLDPNQYFKIRTQAIQQLKGTKDDPYPHKYHVDMSLTEYIQKYNNLQTGDQLSEVVSIAGRIHAKRISGAKLIFYDLRGEGTKLQVMANSRFYKSEEEFATINNKLRRGDLIGVKGNPGKTKKGELSIIPHEMILLSPCLHMLPHLHFGLKDKETRYRQRYLDLILNDYVRQKFIVRAKLITYLRKFLDDLGFLEIETPMMNVIPGGAVAKPFITYHNELDMKLYMRIAPELYHKMLVVGGIDRVYEIGRQFRNEGIDLTHNPEFTTCEFYMAYADYYDLMEITEKLLSGMVKHITGGYKVIYHPEGPEGPEYEIDFTPPFRRISMVHELEKALGKKLPATDQFDTEETRKLLDDICVEKEVECPAPRTTARLLDKLVGDFLEVTCINPTYICDHPQIMSPLAKWHRSEKGLTERFELFVMKKEICNAYTELNDPVRQRELFEDQAKAKAAGDDEAMFIDETFCTALEYGLPPTAGWGMGIDRVAMFLTDSNNIKEVLLFPAMKPEDNKKDPNSTPNSDGTSV

SEQ ID NO: 32426 - DNA, 1809 bp, Danio rerio
  CDS (1)..(1809)
atgttgactctggtcagaatatgccaactgcaagcgctcaggccgcggacgcttgctcttcccggctcacaaaacctgcctttgcttattcaaggaatacgctggaaaagtgacaaaagtgagctgaaaaggcgcatgaaagctgagaagaaagcagctgagaaggaagccaaggtcaaagagcagcaggaacagaaggagaccaatgacaagccacagcagaacgcatacggggcagatgaggaaacactggaccccaatcaatacttcaagatacgttcacaagccattcaagccttgaagggaacagccgaagatccttaccctcacaaatttcacgtggacttgtctcttactgagttcattgagcgctataaccaccttcagcctggagaccacttgacagatgttgtcctcaatttatcaggtcgtgttcatgctaagagggcttcaggcgccaagctgctgttctatgatctgcgaggagaaggagtcaagctgcaggtcatggccaactccagaaactacacatcagaagaagcgtttgtgcacatcaacaacaaactgaggcgtggagacatcatcggggtccgggggaaccctggcaagacaaagaagggcgagttgagcatcatcccagtggagatgaccctgctgtctccatgtcttcatatgcttccacatcttcactttggcctgaaagacaaggaaaccaggttcagacagcgatatctggacctgattcttaatgattttgtgagacagaagtttgttactcgttccaagattatcacgtatctccgcagctttcttgaccagcttggatttctggagattgaaaccccaatgatgaacctgatccctggtggcgcagtagcaaagccatttatcacctatcacaatgatctgaacatgaacctgtacatgagaattgctcctgagctttaccataagatgttggtagttggaggaatcgaccgcgtgtacgagattggccgtcagttccgtaatgaaggcatcgatctcactcacaacccagagttcaccacctgtgagttctacatggcctatgccgactatcacgacctgatggaaatcacagagaagcttctctcaggaatggtgaagcacattaccggagcttataaagtgacgtatcatcctgatggtccagagggacaggcctacgaaatagacttcacccctcccttcaggcgaatcagcatgacccaagagctggagaaggagttgggtgtgaagtttccacctcctgacacctatgacagtgacgaaatgcgcaagttcttagacgacctgtgtgttcagaaagaagttgaatgtcctcctcccaggacaactgctcgacttcttgataagttggtgggagacttcctggaggtgaagtgcatcaacccaacatacatctgcgatcatccacagataatgagtcctcttgctaaatggcacaggtcacagaaaggtctaactgaacgttttgaactctttgtgatgaagaaggagatctgcaatgcctacacagagttgaacgatcccatcagacagcgagaactgtttgagcagcaggctaaggctaaggcagaaggtgacgacgaggccatgttcattgatgagaccttctgcaccgctttagagtacggtcttccccccacagcaggatggggaatgggcatcgaccgcctcaccatgttcctcacagactccaacaacatcaaggaggtgctgcttttccctgccatgaagccagaagacaataaaccagctgcacctgcagagggcacatcagtctaa

SEQ ID NO: 32427 - protein, 602 aa, Danio rerio
MLTLVRICQLQALRPRTLALPGSQNLPLLIQGIRWKSDKSELKRRMKAEKKAAEKEAKVKEQQEQKETNDKPQQNAYGADEETLDPNQYFKIRSQAIQALKGTAEDPYPHKFHVDLSLTEFIERYNHLQPGDHLTDVVLNLSGRVHAKRASGAKLLFYDLRGEGVKLQVMANSRNYTSEEAFVHINNKLRRGDIIGVRGNPGKTKKGELSIIPVEMTLLSPCLHMLPHLHFGLKDKETRFRQRYLDLILNDFVRQKFVTRSKIITYLRSFLDQLGFLEIETPMMNLIPGGAVAKPFITYHNDLNMNLYMRIAPELYHKMLVVGGIDRVYEIGRQFRNEGIDLTHNPEFTTCEFYMAYADYHDLMEITEKLLSGMVKHITGAYKVTYHPDGPEGQAYEIDFTPPFRRISMTQELEKELGVKFPPPDTYDSDEMRKFLDDLCVQKEVECPPPRTTARLLDKLVGDFLEVKCINPTYICDHPQIMSPLAKWHRSQKGLTERFELFVMKKEICNAYTELNDPIRQRELFEQQAKAKAEGDDEAMFIDETFCTALEYGLPPTAGWGMGIDRLTMFLTDSNNIKEVLLFPAMKPEDNKPAAPAEGTSV

SEQ ID NO: 32428 - DNA, 1809 bp, Arabidopsis thaliana
  CDS (1)..(1809)
atggaggcacttaaggtatggagtctaacggcgacgccactgaaacaattactccgtctatcctcttcttctacacgtctcgccaccacaatatatggacgaagatcctaccacttatcacctgcgctacgatgtgcctccgcagcttcttcttcttcttccagtgccacgacggctgaaacttctaaaccctccggccgcaatcgccggtctgcgtcatcttccaattccacctctgatcgtgaagctatccgctccattcgccttaaaaaggttgaagaattgagaggccaaggtcttgaaccttatgcttataagtgggaaaaatcccacagtgcaaatcagcttcaagagatatataagcatttagctaacggtgaagaatcagacaatgagattgattgtgtttctatagctggtagagtcgttgctcgtagagcctttggaaaacttgcattcttgactctcagggatgactctggaactattcagctttactgtgagaaggaaagactttcagatgatcagtttgaacagttgaagcaatttatcgacattggtgatattttgggtgctagtggctcgatgaagaggactgagaaaggggagctttctatatgtgtgaattctttttcaattctcacaaagtctctccttccacttccagacaaatatcatggtctaactgatattgataaacgttaccgccaacggtatgttgatatgattgctaatcctgaagtggctgatgtgttccggagaagggcaaaaatcgtttcagagatacgcaagacagttgagtcttttggatatttggaggttgaaactccagttcttcagggagcagctggtggagctgaagcaagaccttttgtaacgtttcataactcacttgggagggatctctacctgaggattgcaactgagcttcacttgaagagaatgctagttggtgggtttgagaaagtgtatgaaattggtcgtatatttagaaacgaaggcatttcaacacgtcacaatcctgaattcacgaccatcgagatgtatgaagcttattcggactaccatagcatgatggacatggcagaattaattgtcactcaatgttcaatggcagttaatgggaagctaacaattgattaccagggaacagagatctgccttgagcggccttggagaagagaaaccatgcataatctcgttaaagagataacaggaatcaatttcagtgagctaggggaagatctcggaaatgccaaagacacagttctgctcgcactccaggacgtgcttgagcccaaggacaaatctggaattagagcttgctcttccctaggccatcttcttaatgagatttttgaagttgttgtagagccaaagcttgtgcagcccacatttgtcttggactacccaatcgagatatctcctttggccaagccacatcgcggcaatgccggtttgactgaaagatttgagctgttcatctgtggtcgtgaaatggcaaacgcattctctgaattgactgatcccgtggaccagaggacacggttggaagagcaagtaaggcagcataacgcaaagagagcagaggctgttcgggaatctcctgaaccaaacgcaaagaaagatgatgatgatgatgagtcatacgaagtgacccttgacgaagactttctcactgccttggaatacggaatgcctccggcttcgggaatggggcttggaattgacaggctggtgatgctgttgacgaactccgcgagtataagagacgtcattgcttttcctgttctgaaacttcagcagtaa

SEQ ID NO: 32429 - protein, 602 aa, Arabidopsis thaliana
MEALKVWSLTATPLKQLLRLSSSSTRLATTIYGRRSYHLSPALRCASAASSSSSSATTAETSKPSGRNRRSASSSNSTSDREAIRSIRLKKVEELRGQGLEPYAYKWEKSHSANQLQEIYKHLANGEESDNEIDCVSIAGRVVARRAFGKLAFLTLRDDSGTIQLYCEKERLSDDQFEQLKQFIDIGDILGASGSMKRTEKGELSICVNSFSILTKSLLPLPDKYHGLTDIDKRYRQRYVDMIANPEVADVFRRRAKIVSEIRKTVESFGYLEVETPVLQGAAGGAEARPFVTFHNSLGRDLYLRIATELHLKRMLVGGFEKVYEIGRIFRNEGISTRHNPEFTTIEMYEAYSDYHSMMDMAELIVTQCSMAVNGKLTIDYQGTEICLERPWRRETMHNLVKEITGINFSELGEDLGNAKDTVLLALQDVLEPKDKSGIRACSSLGHLLNEIFEVVVEPKLVQPTFVLDYPIEISPLAKPHRGNAGLTERFELFICGREMANAFSELTDPVDQRTRLEEQVRQHNAKRAEAVRESPEPNAKKDDDDDESYEVTLDEDFLTALEYGMPPASGMGLGIDRLVMLLTNSASIRDVIAFPVLKLQQ

SEQ ID NO: 32430 - DNA, 1539 bp, Vibrio cholerae O1 biovar eltor str. N16961
  CDS (1)..(1539)
atgcaaatgactgatgctgttcaaaacgagattaatcaagagcaaatcgcgcaagaagaaaacaaactgattgcagagcgtcgcagcaagttggatcacatccgcaagaactgtaaagcaaacgggcacccaaactcgttccgtcgcgacagcctagcgggtgatctgcagaagaagttcggtgaaaagagtaaggaagaactggaagcgctcaatcacgtggtgtctatcgctggtcgtgtgatggcaaaacgtggcccattcttggtgattcaagaaacctctggccgcattcaggcttatgcatcgaaagaagtgcaacaagagctgaaagataaataccaaggtttggatatcggtgacatcatcggtgtgcaaggtgccctgcacaaatccggtaaaggcgatttgtacgtcaacatggagcaattccaactgctgaccaaagcactgcgcccgctgccagagaaattccacggtctgactgaccaagaaatgcgttaccgccagcgttacgttgacctgatcgtcaacgaaaactctcgcaacgctttcattgtacgttctaaggtgatgtcagccattcgtaacttcatgatctcaaaacagttcatggaagtggaaacgccgatgatgcacgtgatccctggtggtgctagtgcgcgcccattcatcacgcaccacaacgcgctcgacatgccgatgtacctgcgtatcgcgcctgagctgtacctgaagcgtctggttgtcggtggttttgatcgtgtattcgaaatcaaccgtaacttccgtaacgaaggtctttctccacgtcacaacccagaattcaccatgatggaattctatatggcgtacgcggactacaaagatctgatggatctgacggaagagctgctcagctctgtggcgttagaagttctcggttcaacctccatgccttacggtgagcataccgttgaatttggtggtaaatacgcgcgtatgagcatgtttgatgcgatcaagcactacaacccaaatcacgcgcagatccaagctctgaccgaagaagacatccaaaaccgtgacctcatggtttctatcgcgaaatccgttcacgttgatgtggagcctttctggacctgtggtcagcttctcgaagagatctttggtgaaacggctgagccgaaactgatgcagccaactttcatcactggctacccagcagatatctctccactggcacgtcgtagcgatgacaacccgttcttcactgaccgctttgagttcttcatcggtggccgtgaagtggcaaacggcttctcagagctgaacgatgctgaagaccaagatgcgcgtttcaaagcccaagtggaagcgaaagagtctggtgatgatgaagccatgttctatgatgccgactacattaccgctttagagcacggcttaccgccaacagcgggtcaaggtattggtattgatcgtctggttatgctcctgaccaatactcacactatccgtgatgtgattttgttcccagcgatgcgccctcagcaataa

SEQ ID NO: 32431 - protein, 512 aa, Vibrio cholerae O1 biovar eltor str. N16961
MQMTDAVQNEINQEQIAQEENKLIAERRSKLDHIRKNCKANGHPNSFRRDSLAGDLQKKFGEKSKEELEALNHVVSIAGRVMAKRGPFLVIQETSGRIQAYASKEVQQELKDKYQGLDIGDIIGVQGALHKSGKGDLYVNMEQFQLLTKALRPLPEKFHGLTDQEMRYRQRYVDLIVNENSRNAFIVRSKVMSAIRNFMISKQFMEVETPMMHVIPGGASARPFITHHNALDMPMYLRIAPELYLKRLVVGGFDRVFEINRNFRNEGLSPRHNPEFTMMEFYMAYADYKDLMDLTEELLSSVALEVLGSTSMPYGEHTVEFGGKYARMSMFDAIKHYNPNHAQIQALTEEDIQNRDLMVSIAKSVHVDVEPFWTCGQLLEEIFGETAEPKLMQPTFITGYPADISPLARRSDDNPFFTDRFEFFIGGREVANGFSELNDAEDQDARFKAQVEAKESGDDEAMFYDADYITALEHGLPPTAGQGIGIDRLVMLLTNTHTIRDVILFPAMRPQQ

SEQ ID NO: 32432 - DNA, 1584 bp, Chlamydophila pneumoniae J138
  CDS (1)..(1584)
atgacggcgagagcagaatatttagaccatgaggattttttatataggagtcacaaacttcaggaactttctgagttgggtgtagtcctttatccttacgagtttcctggagttttttcatgcgaagatattaaaaaaacgtttgctagtcaagagttagggaatagtgaagctgctatgagtaggtccactcctagagtgcgttttgctgggcgtttggttcttttccgtgcgatggggaaaaatgcttttgggcaaattttagaccataatcaaaccatccaagtgatgttcaaccgtgagtttacctccgtacacggactttctgaagatgctgagattactccgattaagtttatagaaaaaaagttagatttaggagatatccttgggatcgatggctatttatttttcacccattccggagagcttaccgttcttgtagagactgtaaccctactttgtaaatccttactttcgttgcctgataagcacgcaggtttgagtgacaaagaagtccgctaccgcaagcgttggttagatctaatttcctcaagagaggttagcgatacctttgtgaaaagaagctatattattaagcttatccgtaattatatggatgctcatggatttttagaggtagagactcctatattacaaaatatctacgggggagcagaagctaagcctttcacaacaacaatggaagctttacattcggagacgtttttaagaatctccctggaaatcgctttgaagaaaatcctagtaggaggagctcctcgtatttatgaactcggtaaagtcttcagaaacgaaggaatcgatagaacacataatcctgaatttaccatgatagaagcgtatgctgcttacatggactataaagaggtcatggtctttgtagaaaatcttgttgagcatcttgtccgtgctgtaaatcacgacaatacctctctagtctattcttattggaaacatggcccccaagaggtagattttaaagctccttggattcgtatgacaatgaaagaaagtatcgcgacctatgcaggtattgatgttgacgttcacagtgatcagaagcttaaggaaatcttaaagaagaaaactacctttcctgagactgcatttgcgacagcttcccgggggatgttgatagcagccttatttgatgaacttgtctctgataatttaatagctcctcaccacattacagatcaccctgtagagacaaccccgttatgtaaaactctgcgttccggagataccgcatttgtagagcgcttcgaaagtttttgcttagggaaagagttgtgtaatgcctattcggaactcaatgatcctatccgtcaaagagaactcttggagcaacagcatactaaaaaagaactccttccggatagtgagtgtcatcctatcgatgaagagtttttagaagctctgtgtcagggaatgccccctgcaggaggatttggtataggtgtcgatagacttgttatgattcttacaaatgctgcatctatacgcgatgtgctgtatttccctgtaatgcggcgcttcgatgcagagaagacgaattaa

SEQ ID NO: 32433 - protein, 527 aa, Chlamydophila pneumoniae J138
MTARAEYLDHEDFLYRSHKLQELSELGVVLYPYEFPGVFSCEDIKKTFASQELGNSEAAMSRSTPRVRFAGRLVLFRAMGKNAFGQILDHNQTIQVMFNREFTSVHGLSEDAEITPIKFIEKKLDLGDILGIDGYLFFTHSGELTVLVETVTLLCKSLLSLPDKHAGLSDKEVRYRKRWLDLISSREVSDTFVKRSYIIKLIRNYMDAHGFLEVETPILQNIYGGAEAKPFTTTMEALHSETFLRISLEIALKKILVGGAPRIYELGKVFRNEGIDRTHNPEFTMIEAYAAYMDYKEVMVFVENLVEHLVRAVNHDNTSLVYSYWKHGPQEVDFKAPWIRMTMKESIATYAGIDVDVHSDQKLKEILKKKTTFPETAFATASRGMLIAALFDELVSDNLIAPHHITDHPVETTPLCKTLRSGDTAFVERFESFCLGKELCNAYSELNDPIRQRELLEQQHTKKELLPDSECHPIDEEFLEALCQGMPPAGGFGIGVDRLVMILTNAASIRDVLYFPVMRRFDAEKTN

SEQ ID NO: 32434 - DNA, 1335 bp, Sulfolobus tokodaii str. 7
  CDS (1)..(1335)
atgtttgacatttccactgctggaagagtagcaaacataagaagacacgggaaaatttcatttgttgatattttcgatgaaggagaaaaattacaattacagctaagagtaaacgaactaggcgaaaaatatgataaattttttgagattgttgatagaggtgatataattggtgtaaaaggagatcttctatatactataaagggcgaattaacacttaggataaaagattatacaatgcttgcaaaatcattaatagagcctccagattggagtaaactgtctccagagtttaggtatgctcatagatatgttgattttctgtataacgataatgctaggaaagctatggagattaggtttttaataattagactgattagagagtacctctattcaaaaggattcatagaagttgaaacaccgattttacagccagtttatggaggtgcattagcaaaaccttttaagagtcacgtaaactatctcgaggaagattggtatttgagaatttctctcgaactatatcttaagagatttatagtaggtggtttcaataaagtttttgaaatagggaaagtctttagaaatgaggatattgatgtaactcacaaccctgaatttactctaatggagttatactgggcttatgcagattacaacgatattatgagattaacagaagatatgctacaatatgtggttaaaagtatttttcacgatactaaaattaagtataccataagcggtaaagattatgaaatagacttctcacaatttaaaaaagtaacaatttatgatgctctttcagaagctttaggcaaaaatgttgaaaacgtaagtgatgaggagttaaagaatttgatggataaatatggtctgaaacctaggggtaacatgtatattaggggtttaatgatagagaaactatttgataaattagttgagcctaacttaatacaaccaacgttcattttagattatcccatagagactacaccattatgtaaaccacataggagtaaaccaggtttagttgaaagatttgagttatttatagctggaatggagcttgcaaatgcctatactgagttaaacgaccctattcttcaagacaaattattcaaacaggaacaagagatgtttagaagaggggatgaagaggctcatccttatgatgtggattttgttagagctttaagctatggcatgcctcctactggaggactaggtattggtattgacagacttgtaatgttgctcacaaacaattatagtataaaagaagttatacctttcccaatgcttagtagtaaaattattgaagaggattga

SEQ ID NO: 32435 - protein, 444 aa, Sulfolobus tokodaii str. 7
MFDISTAGRVANIRRHGKISFVDIFDEGEKLQLQLRVNELGEKYDKFFEIVDRGDIIGVKGDLLYTIKGELTLRIKDYTMLAKSLIEPPDWSKLSPEFRYAHRYVDFLYNDNARKAMEIRFLIIRLIREYLYSKGFIEVETPILQPVYGGALAKPFKSHVNYLEEDWYLRISLELYLKRFIVGGFNKVFEIGKVFRNEDIDVTHNPEFTLMELYWAYADYNDIMRLTEDMLQYVVKSIFHDTKIKYTISGKDYEIDFSQFKKVTIYDALSEALGKNVENVSDEELKNLMDKYGLKPRGNMYIRGLMIEKLFDKLVEPNLIQPTFILDYPIETTPLCKPHRSKPGLVERFELFIAGMELANAYTELNDPILQDKLFKQEQEMFRRGDEEAHPYDVDFVRALSYGMPPTGGLGIGIDRLVMLLTNNYSIKEVIPFPMLSSKIIEED

SEQ ID NO: 32436 - DNA, 1518 bp, Escherichia coli K12
  CDS (1)..(1518)
atgtctgaacaacacgcacagggcgctgacgcggtagtcgatcttaacaatgaactgaaaacgcgtcgtgagaagctggcgaacctgcgcgagcaggggattgccttcccgaacgatttccgtcgcgatcatacctctgaccaattgcacgcagaattcgacggcaaagagaacgaagaactggaagcgctgaacatcgaagtcgccgttgctggccgcatgatgacccgtcgtattatgggtaaagcgtctttcgttaccctgcaggacgttggcggtcgcattcagctgtacgttgcccgtgacgatctcccggaaggcgtttataacgagcagttcaaaaaatgggacctcggcgacatcctcggcgcgaaaggtaagctgttcaaaaccaaaaccggcgaactgtctatccactgcaccgagttgcgtctgctgaccaaagcactgcgtccgctgccggataaattccacggcttgcaggatcaggaagcgcgctatcgtcagcgttatctcgatctcatctccaacgatgaatcccgcaacacctttaaagtgcgctcgcagatcctctctggtattcgccagttcatggtgaaccgcggctttatggaagttgaaacgccgatgatgcaggtgatccctggcggtgccgctgcgcgtccgtttatcacccaccataacgcgctggatctcgacatgtacctgcgtatcgcgccggaactgtacctcaagcgtctggtggttggtggcttcgagcgtgtattcgaaatcaaccgtaacttccgtaacgaaggtatttccgtacgtcataacccagagttcaccatgatggaactctacatggcttacgcagattacaaagatctgatcgagctgaccgaatcgctgttccgtactctggcacaggatattctcggtaagacggaagtgacctacggcgacgtgacgctggacttcggtaaaccgttcgaaaaactgaccatgcgtgaagcgatcaagaaatatcgcccggaaaccgacatggcggatctggacaacttcgactctgcgaaagcaattgctgaatctatcggcatccacgttgagaagagctggggtctgggccgtatcgttaccgagatcttcgaagaagtggcagaagcacatctgattcagccgaccttcattactgaatatccggcagaagtttctccgctggcgcgtcgtaacgacgttaacccggaaatcacagaccgctttgagttcttcattggtggtcgtgaaatcggtaacggctttagcgagctgaatgacgcggaagatcaggcgcaacgcttcctggatcaggttgccgcgaaagacgcaggtgacgacgaagcgatgttctacgatgaagattacgtcaccgcactggaacatggcttaccgccgacagcaggtctgggaattggtatcgaccgtatggtaatgctgttcaccaacagccataccatccgcgacgttattctgttcccggcgatgcgtccggtaaaataa

SEQ ID NO: 32437 - protein, 505 aa, Escherichia coli K12
MSEQHAQGADAVVDLNNELKTRREKLANLREQGIAFPNDFRRDHTSDQLHAEFDGKENEELEALNIEVAVAGRMMTRRIMGKASFVTLQDVGGRIQLYVARDDLPEGVYNEQFKKWDLGDILGAKGKLFKTKTGELSIHCTELRLLTKALRPLPDKFHGLQDQEARYRQRYLDLISNDESRNTFKVRSQILSGIRQFMVNRGFMEVETPMMQVIPGGAAARPFITHHNALDLDMYLRIAPELYLKRLVVGGFERVFEINRNFRNEGISVRHNPEFTMMELYMAYADYKDLIELTESLFRTLAQDILGKTEVTYGDVTLDFGKPFEKLTMREAIKKYRPETDMADLDNFDSAKAIAESIGIHVEKSWGLGRIVTEIFEEVAEAHLIQPTFITEYPAEVSPLARRNDVNPEITDRFEFFIGGREIGNGFSELNDAEDQAQRFLDQVAAKDAGDDEAMFYDEDYVTALEHGLPPTAGLGIGIDRMVMLFTNSHTIRDVILFPAMRPVK

SEQ ID NO: 32438 - DNA, 1518 bp, Salmonella typhimurium LT2
  CDS (1)..(1518)
atgtctgaacaaaacgcacagggcgctgacgaggtagtcgatcttaacaatgaaatgaaggcacgtcgcgagaagctggctgcactgcgtgagcagggtatcccgttcccgaacgatttccgtcgtgaccgtacctcagaccaactgcacgcagagtttgacgcgaaagaagctgaagaactggaagcgctgaatattgaagtgtccgtcgcgggccgtatgatgactcgccgtattatgggtaaagcctcttttgttaccctgcaagacgtaggcggccgcattcagctgtatgtggcgcgcgatgatctgccggaaggcgtttacaacgagcagttcaagaagtgggatcttggcgatatcctcggcgcgaaaggtaagctgttcaaaaccaaaaccggcgagctgtctatccactgcaccgaactgcgcctgctgacgaaagcgctgcgtccgttgccggataaattccacggcctgcaggaccaggaagcgcgctatcgccagcgttatctggatctcatctctaacgatgaatcccgtaacaccttcaaaacccgttcgaagatcctggccggtattcgccagtttatggttgctcgcggctttatggaagtcgaaacgccgatgatgcaggtgatcccaggcggcgcgtctgcccgtccgtttatcacccatcacaacgcgctggatctggacatgtacctgcgtatcgcgccggaactgtacctcaagcgtctggtggttggcggcttcgaacgcgtattcgaaattaaccgtaacttccgtaacgaaggcatctccgtgcgccataatcctgagttcaccatgatggaactctatatggcgtatgcggactacaaagacctgatcgagctgacggagtctctgttccgtacgctggcgcaggatgttctgggcaccacccaggttccgtacggtgatgaagtgtttgacttcggtaagccgttcgaaaaactgaccatgcgtgaagcgatcaagaaatatcgtccggaaacagatatggctgatctggacaacttcgattccgcgaaggcgattgctgaaagcatcggcattcacgtcgagaagagctggggtctgggccgtatcgtcaccgagatctttgacgaagtcgctgaagcgcatctgattcagccgaccttcatcaccgaatatccggctgaagtgtctccactggcgcgtcgtaatgatgtgaacccggaaatcactgaccgcttcgagttctttatcggcggtcgtgaaatcggcaatggctttagcgagttgaacgatgcggaagaccaggcgcagcgtttcctggatcaggttaatgcaaaagcggcgggcgacgacgaagccatgttctacgacgaagactacgtgacggcgctggaacacggtttaccgccgacagcgggtctgggaattggtatcgaccgtatggtgatgctgtttactaacagccacacgattcgcgacgttattctgttcccggcgatgcgtccggtgaaataa

SEQ ID NO: 32439 - protein, 505 aa, Salmonella typhimurium LT2
MSEQNAQGADEVVDLNNEMKARREKLAALREQGIPFPNDFRRDRTSDQLHAEFDAKEAEELEALNIEVSVAGRMMTRRIMGKASFVTLQDVGGRIQLYVARDDLPEGVYNEQFKKWDLGDILGAKGKLFKTKTGELSIHCTELRLLTKALRPLPDKFHGLQDQEARYRQRYLDLISNDESRNTFKTRSKILAGIRQFMVARGFMEVETPMMQVIPGGASARPFITHHNALDLDMYLRIAPELYLKRLVVGGFERVFEINRNFRNEGISVRHNPEFTMMELYMAYADYKDLIELTESLFRTLAQDVLGTTQVPYGDEVFDFGKPFEKLTMREAIKKYRPETDMADLDNFDSAKAIAESIGIHVEKSWGLGRIVTEIFDEVAEAHLIQPTFITEYPAEVSPLARRNDVNPEITDRFEFFIGGREIGNGFSELNDAEDQAQRFLDQVNAKAAGDDEAMFYDEDYVTALEHGLPPTAGLGIGIDRMVMLFTNSHTIRDVILFPAMRPVK

SEQ ID NO: 32440 - DNA, 1449 bp, Pyrobaculum aerophilum str. IM2
  CDS (1)..(1449)
atgtctgagaggcagagccgggataaaattgaggagtggcggatgctaattgcctcgctgcggggggcgggggttgagccctatccgcactcctactcgcctacgcacagcgtgagggcgcttaatgagctcaggcggcaggccctcctcgacccgtggctcggcatgactataaagaccgcggggagagtgtctgacataaggcggcatccaaacgtggtgtttatagacttatacgaagacggggcgcggtttcaagtaatggccgatcccaagctccccttgttggagcacatatggcggggggattttatcggcgttgagggccctcttgtgaaaacccagcggggggactacgcggtgagagccgcttctattgtcctcttggccaaggcggttcagcctctgcctgagtggggcaaggtggatagggactcgcccttttacatgaggtaccgctctgtggcaatggtgctggacctccagttgaggtggcgcatagcggctagggccaagctcatacaagcgtttagagaggccatgtggaaaaggggctttttggaaatccccacccccgtcctccagcctatatacggcggcgccgcggcgaggcccttcactacaaagatctgggctattgacgaagagtggtacctccgcatatcccccgagctttacctcaagcggtatataatagcgggctttcccaaggtctttgaaataggccctcaattccgcaatgaggatatcgacgcattgcacaaccccgagttctggtcgctggaggcctatcaggcctacgccgactataaagacattatgagactcactgaggaagtggtttacgaggctgttagctctgtgttgggcactggcgttgttaaatacagggactggaacattaacttcaacccgccgtggaggcgcattactctccacgacgccctccgggaattcgcgggggtagaccccgacaagctcactgacgatcaaattaaggagaggctgagagagctccaagtacccataagggtgtacaacaggggggtggccttggtgaagctctttgagaagctcgtggagaaaaagctagtagagcccacttttgtcatggactacccagaggagtcaacgccgttgtgcaagccgcatagagagaggcccggcctggtggagcgttttgaggcctttgtgggaggccacgaagtggctaatgcctatacagagctgaacgacccggtgaggcagtatgagtacttcgtgcgggaggaggagctgttccccaaggacgaggcgcaccccctggactgggatttcgtcgaagagctttccttcggcatgccgcccactggcggcgtgggaattggcgtcgacaggctggcgatgattatcactaacgccgagtctattaaagacgtcatcccctacccaattgtgaagaggggatag

SEQ ID NO: 32441 - protein, 482 aa, Pyrobaculum aerophilum str. IM2
MSERQSRDKIEEWRMLIASLRGAGVEPYPHSYSPTHSVRALNELRRQALLDPWLGMTIKTAGRVSDIRRHPNVVFIDLYEDGARFQVMADPKLPLLEHIWRGDFIGVEGPLVKTQRGDYAVRAASIVLLAKAVQPLPEWGKVDRDSPFYMRYRSVAMVLDLQLRWRIAARAKLIQAFREAMWKRGFLEIPTPVLQPIYGGAAARPFTTKIWAIDEEWYLRISPELYLKRYIIAGFPKVFEIGPQFRNEDIDALHNPEFWSLEAYQAYADYKDIMRLTEEVVYEAVSSVLGTGVVKYRDWNINFNPPWRRITLHDALREFAGVDPDKLTDDQIKERLRELQVPIRVYNRGVALVKLFEKLVEKKLVEPTFVMDYPEESTPLCKPHRERPGLVERFEAFVGGHEVANAYTELNDPVRQYEYFVREEELFPKDEAHPLDWDFVEELSFGMPPTGGVGIGVDRLAMIITNAESIKDVIPYPIVKRG

SEQ ID NO: 32442 - DNA, 1725 bp, Drosophila melanogaster
  CDS (1)..(1725)
atggccgctgcaagtggagaactgtccaagaatgagctaaagcgtcgcctgaaggccgagcaaaaggccaaggagaaggctgagaaggcggccgctgcgccggcggaaaatactgctggcaagaagaagagcagtgccgccgaggaggaggagatctcgccgaatgaatactttaagctgcgctccgccgccgttcaggagctgaaacgttcacccgcaacggatccctatccacacaagttccatgtgagtagctcgctggaagacttcattgccaagtacgagaacagcctcaaggagggcgagaccctggagaatgtcaaactgagcgtggctgggcgcgtgcatgccatacgcgagtcgggcgccaagctcattttctacgatctgcgcggcgagggcgtcaaggtgcaggtgatggccagcgctaagtcctacaagtcggaggcggatttcgaaatcgatacgtccaaattgcgacgtggtgatatcatcggcgttgtcggacatcccggcaaaaccaagaagggtgaactgtccgttatgcccagcgagatcaagctgctatcgccctgtctacacatgctgccccatctgcatttcgggttgaaggacaaggagacgcgctaccgccagcgctatcttgatctcattctcaacaacaatgtgcgagagaaattccagatccgtgccaagatcatctcgtacgtgcgtcagttcctggatcgtctgggtttcctggagatcgagacgcccatgatgaacatgatcgccggtggagccactgccaagcccttcgtgacgcatcacaatgacctcaagatggatctgttcatgcgcattgctccggagctgtatcacaagatgctggtggtgggtggactcgatcgtgtgtacgagatcggacggcagttccgcaacgagggcatcgacctcacccacaatcctgaattcaccacgtgcgagttctacatggcgtatgccgactacgctgacattatggatatcaccgagcagttggtctcgggaatggtgaaagcgatccgtggctcctacaaggtcatctatcatccggagggtccagagggacctgagcaagaacttgactttacgccgccctttaagcgcgtatccatgatcaaaacgctggaagagaagctgcaggtgaagttccccgcggccgacaccttcaattcgccagagacgaatcagttcctgtctcagctgtgcgctaagcaccaggtcgagtgcccagctccgcgcaccactgcccgcctgctggacaagctcgtcggcgaattcatcgaggagttttgcgtgaatccaacgttcatctgtgagcatccgcagatcatgtcgccgctggccaagtaccatcgcagtattcccggcctgacggagcgcttcgaactgtttgtggccaagaaggagatttgcaacgcgtataccgagttgaacgatccggttgtgcagcgcgagcgtttcgagcagcaggccagcgacaaggcggccggcgatgatgaggcccagctggtcgacgagaacttctgcacgtccctggagtacggactgccgcccaccggtggttttggcatgggcatcgatcgcctggccatgttcctcacggactccaacaacatcaaggaggttctgctgttccccgccatgaaaccggaggatgccaaccgcacggcagcggaaactgctcccaccgcacagcagtag

SEQ ID NO: 32443 - protein, 574 aa, Drosophila melanogaster
MAAASGELSKNELKRRLKAEQKAKEKAEKAAAAPAENTAGKKKSSAAEEEEISPNEYFKLRSAAVQELKRSPATDPYPHKFHVSSSLEDFIAKYENSLKEGETLENVKLSVAGRVHAIRESGAKLIFYDLRGEGVKVQVMASAKSYKSEADFEIDTSKLRRGDIIGVVGHPGKTKKGELSVMPSEIKLLSPCLHMLPHLHFGLKDKETRYRQRYLDLILNNNVREKFQIRAKIISYVRQFLDRLGFLEIETPMMNMIAGGATAKPFVTHHNDLKMDLFMRIAPELYHKMLVVGGLDRVYEIGRQFRNEGIDLTHNPEFTTCEFYMAYADYADIMDITEQLVSGMVKAIRGSYKVIYHPEGPEGPEQELDFTPPFKRVSMIKTLEEKLQVKFPAADTFNSPETNQFLSQLCAKHQVECPAPRTTARLLDKLVGEFIEEFCVNPTFICEHPQIMSPLAKYHRSIPGLTERFELFVAKKEICNAYTELNDPVVQRERFEQQASDKAAGDDEAQLVDENFCTSLEYGLPPTGGFGMGIDRLAMFLTDSNNIKEVLLFPAMKPEDANRTAAETAPTAQQ

SEQ ID NO: 32444 - DNA, 1323 bp, Encephalitozoon cuniculi
  CDS (1)..(1323)
atgagcatgaggctccatgcaaggttttgcttttttgttgttacctcgaacggggagagtctccaggttgttgtggacaccaaggaggcggggagagagcagatggccaagttcctcaggagaggagatgttgttgggtttaccgggaaccctggaaggacgagaacactggaggcgtctgtatttgccacggatataattgtccttacgccgtgcctcaggactattcctacggagcactttgggctgaaggaccccgagaccatctacaggaaaagatatatggatcttttgattaacagggaatcaaggaacaggttccagaagagagcgcagatcattggatacattaggagctttttggattcgagagggtttctggaggttgaaacgccgatgatgaacctgattcctggaggagcagcggcaaagccctttataacccaccacaacgagctcaagctggatctgtacatgagggtatctcctgagctgtacctgaagaagcttgttgttgggggtcttgagcgggtgtatgagatagggaagcagtttaggaacgaagggattgatcttacccacaacccggagttcacgtcttgcgagttctacatggcgtatgcagactacaacgaccttatggagatgactgaggagctgataagtggaatggttgaaaacatgtttggtacggacacgatagtgtacagcccgaagaagagagaggaaaggacggagtctgtggagctgtcgttcaagaggcccttccgagtcataagtattctcgaggagcttaatgctagactcgggctggatctcagtggggagactcttgacagggaggagactctggagaagctcttgtctgcctgtgataaggaggggctatctgttgaaaagcctcggactctatcacgggtacttgacaagctgattggacatgttattgagccgcagtgtgtgaacccaacctttgtcaaggaccacccaatagcaatgtcgccgctggccaagaaccataggtcgaaggccgggttgactgagaggtttgagctctttatcaactgcaaggagatatgtaatgcctatacagagctgaacaacccgtttgagcaacgagaaaggttcctccagcagacccaggacctgaatgctggagatgatgaagcaatgatgaatgatgaggacttttgcacagcccttgagtatggactgccccccactgggggatgggggataggaattgacaggcttgtgatgtatctgaccgatgcggcgaatatccgggacgtgatctttttccccacgatgaagcctgaataa

SEQ ID NO: 32445 - protein, 440 aa, Encephalitozoon cuniculi
MSMRLHARFCFFVVTSNGESLQVVVDTKEAGREQMAKFLRRGDVVGFTGNPGRTRTLEASVFATDIIVLTPCLRTIPTEHFGLKDPETIYRKRYMDLLINRESRNRFQKRAQIIGYIRSFLDSRGFLEVETPMMNLIPGGAAAKPFITHHNELKLDLYMRVSPELYLKKLVVGGLERVYEIGKQFRNEGIDLTHNPEFTSCEFYMAYADYNDLMEMTEELISGMVENMFGTDTIVYSPKKREERTESVELSFKRPFRVISILEELNARLGLDLSGETLDREETLEKLLSACDKEGLSVEKPRTLSRVLDKLIGHVIEPQCVNPTFVKDHPIAMSPLAKNHRSKAGLTERFELFINCKEICNAYTELNNPFEQRERFLQQTQDLNAGDDEAMMNDEDFCTALEYGLPPTGGWGIGIDRLVMYLTDAANIRDVIFFPTMKPE

SEQ ID NO: 32446 - DNA, 1596 bp, Schizosaccharomyces pombe
  CDS (1)..(1596)
atgatttcacgaggtcttttatccaaagggatcttatccattattaaaagaaaaaatacaggaaatttaatcccccatgtttattatagtgaataccatgcagacatcgaagagagaagaaaagcgctaggacgactgggaatcagcttgtatccgtcagttacttcagatgcctcaacgactacaattcctgtaataatcgagaaatggaggaacaagattaccaagtctgagatcgcaatggtcaggtatacggtgtgtggtcgaatttcaagcatccgttattcaggttccaaacttgcattttttgatgtcctttatggaaataaaaagcttcaggttgtttttaataaaaagaatattggcacagaagaagaaatgaagggaaagtttattcctcgattaaaagctctccaaaaaggagattgcattcaatgttctggcaacgttggaagaagtggaagtggagagctttccatatatgctacagaactaccaaaattgttatctccatgtctccatccaattcccgttaaactaacgaactacgaaaaaagatttgaaaaacgctttgtcgatatgatgtcaaataccaaatcacttgagttacttgagaagagatatcgaataattgaatccattagaaaattctttagtgaaagaggatttttagaagttgaaacccctattctttcacatcactttggaggtgctactgcgcgaccctttatcactagtgatattcataaactacccttgacactccggtgtgctccagagctatggctcaaacaactagtaatagggggaatgaatcgagttttcgaattaggaaaaaatttccgaaatgaaggtatcgatgctacgcataatcctgagtttactagttgtgaagcctactgcgcatatttaaatttggagggtatgaaaaaacttactgaagagctaattagatttatctgtttaacaattaatggaaacttgcaaataagcggtcaaaccgtagacctagaaaaaggatttgaagtcattgagtttattcctgcattacagaaggagcttaatgtagagctttcccctctagataactctgaaaactgccggaaacagctgatatcaatctttaaacgttgtgaaatcatgctgccaaagacgtgtacagtagctcatttgttggataaacttttcgattctttggtcttaaaatataatacctcttcccctaaatttgtcattaaccatcccgaagtaatgtcacctcttgccaaatcagatatcaaattatacggcgctgtcgagcaacggatttcaaaaagatttgagctttatattggtggctatgaaatatgtaatgcctatgaggaagaaaatgatccagttgctcaatatcataaatttcaagcacaaaaatatgaccgtcttcaactaggagatgatgaaactcccgcgccagactctgattttgtacatgccttggaatacggtttaccacctacagctggatggggaatgggcgttgatagactagtcatgctaatgacaggacagtcaaagatatcggagatccttccatttggatctcttcgatatgtttag

SEQ ID NO: 32447 - protein, 531 aa, Schizosaccharomyces pombe
MISRGLLSKGILSIIKRKNTGNLIPHVYYSEYHADIEERRKALGRLGISLYPSVTSDASTTTIPVIIEKWRNKITKSEIAMVRYTVCGRISSIRYSGSKLAFFDVLYGNKKLQVVFNKKNIGTEEEMKGKFIPRLKALQKGDCIQCSGNVGRSGSGELSIYATELPKLLSPCLHPIPVKLTNYEKRFEKRFVDMMSNTKSLELLEKRYRIIESIRKFFSERGFLEVETPILSHHFGGATARPFITSDIHKLPLTLRCAPELWLKQLVIGGMNRVFELGKNFRNEGIDATHNPEFTSCEAYCAYLNLEGMKKLTEELIRFICLTINGNLQISGQTVDLEKGFEVIEFIPALQKELNVELSPLDNSENCRKQLISIFKRCEIMLPKTCTVAHLLDKLFDSLVLKYNTSSPKFVINHPEVMSPLAKSDIKLYGAVEQRISKRFELYIGGYEICNAYEEENDPVAQYHKFQAQKYDRLQLGDDETPAPDSDFVHALEYGLPPTAGWGMGVDRLVMLMTGQSKISEILPFGSLRYV

SEQ ID NO: 32448 - DNA, 1776 bp, Schizosaccharomyces pombe
  CDS (1)..(1776)
atgagtgaggaacaggtgaatggagttacacaggctgtaaaggctttagtccttgatcccgtcactggtgaacaagtctcaaagactgagttaaagaagcgcgaaaaacaacgtgctcgtgaattagctaaagcaaaaaagcaagccgaaaaggctgcgtctgctcctgttgctgctcctaagagctcttcaaagaaggaagaagatttggacccttcccagtactttgaaaatcgttctcgtactatcatggaattacgccaaacgaaggatcctaatccttatccccacaagttccaggtcaccatcaccctccctgaatttatagccaaatatgagggactagctcgtggtgaaactaagcctgaagttgaagttgcagttgccggccgtgttcttgggcttcgtactgctggtaataagctgcgtttctatgaaatccatgctgatgggaaaaagcttcaagttatgtgtcaagcgcaagatgctgacactgtcgactttgctgctcagcatgagcatttaagacgtggtgatattatcggtattcgcggatatcctggtcgttccaaccctaagggacgtgctgatggtgaactttcaatctttgctcgtcaatgcgttttacttagtccttgtttacgcatgcttcctaaagaacattatggtttgaaggatttagaaattcgtcaccgccaacgttatttagaccttattatgaatcgctcaactcgtgaccgttttgttatgcgtagccgtatcattcaatacatccgtcactttttcgatagccgtgactttatggaggtggagactcctatgatgaacatgattgctggtggtgctactgccaaaccttttgttactcatcataatgatttagatatggatttgtacatgcgtatcgctcccgaactgtatcttaaaatgcttgttgtaggtggtttggatcgggtttacgaaattggccgtcaatttcgtaacgaaggtgccgacttgacccataacccagaattcacatctattgaattttatcaagcctatgctgattactatgatctcatggacacaactgaagagctactttctggtcttgtgaaagaccttaccggttcctacaaagttccctaccatcctgaaggacctgaaggccctaagtgggaacttgattttagtcgtccttggcgtcgtattaacatgattgagtatttggaggagaaacttaacactaaattcccacctggtgaccaattgcatactcctgaagccaatgcatttttaagagacttgtgtgctaagcacggtgttgaatgcgccccacctcaaacgtgctcccgactcttggacaaattggttggcgagttcattgaaagtgaatgtatcaatcctactttcattattggtcatcctcaaatgatgtctccattggctaaataccatcgttctgatgcgggcctgtgtgaacgctttgaagctttcgttgcaactaaggaaatctgcaatgcttatactgagttgaacgatatttttgaccaacgagctcgtttcgaagaacaagctcgtcaaaaggctcagggtgatgatgaagctcaaatcattgatgagaacttctgcacggcccttgagtatggtctacctcctaccggtggttggggaatgggtgttgaccgtcttgttatgtttttgactgacagtaacactatccgtgaagtcttgctttttcctcatatgaagcccgaagtgcaagctgcagaacctactgtcgttaaagagtaa

SEQ ID NO: 32449 - protein, 591 aa, Schizosaccharomyces pombe
MSEEQVNGVTQAVKALVLDPVTGEQVSKTELKKREKQRARELAKAKKQAEKAASAPVAAPKSSSKKEEDLDPSQYFENRSRTIMELRQTKDPNPYPHKFQVTITLPEFIAKYEGLARGETKPEVEVAVAGRVLGLRTAGNKLRFYEIHADGKKLQVMCQAQDADTVDFAAQHEHLRRGDIIGIRGYPGRSNPKGRADGELSIFARQCVLLSPCLRMLPKEHYGLKDLEIRHRQRYLDLIMNRSTRDRFVMRSRIIQYIRHFFDSRDFMEVETPMMNMIAGGATAKPFVTHHNDLDMDLYMRIAPELYLKMLVVGGLDRVYEIGRQFRNEGADLTHNPEFTSIEFYQAYADYYDLMDTTEELLSGLVKDLTGSYKVPYHPEGPEGPKWELDFSRPWRRINMIEYLEEKLNTKFPPGDQLHTPEANAFLRDLCAKHGVECAPPQTCSRLLDKLVGEFIESECINPTFIIGHPQMMSPLAKYHRSDAGLCERFEAFVATKEICNAYTELNDIFDQRARFEEQARQKAQGDDEAQIIDENFCTALEYGLPPTGGWGMGVDRLVMFLTDSNTIREVLLFPHMKPEVQAAEPTVVKE

SEQ ID NO: 32450 - DNA, 1581 bp, Corynebacterium glutamicum ATCC 13032
  CDS (1)..(1581)
gtgactaattccaatcccacttccaagaacaattccgccgatttgcctgagcagctgcgaattcgtcgcgaaaagcgcgagcgcattctggacagtggattggacgcctacccagtcgaggttgatcgcaccatctcaatctctgacctgcgctcccaatttgttgtcattacagaagacctccaagagcgcgaagaaggcgtaacctacctcgaagtaggcgaagaaaccgacgttgaggtcgcaatcgctggccgcgtcatgttcgttcgcaacaccggcaagctctgcttcgcatccatccaagaaggaaacggcaccaccgtccaagcaatgctgtccctggcagcagtcggtgaagaatccctcaaggcctggaaagccgatgtggacatgggtgacatcgtttccgtccgcggcaaagtaatctcctccaagcgtggcgaactctccgtgatggctgactcctggcacatggcctccaagtccctgcgcccactgccagtcgcattcgcggacctcagcgaagacacccgcgtccgccaccgctacaccgacctcatcatgcgcgaacaagcccgcaccaacgcgctcacccgcatcaaggtcatgcgtgcactccgccactacctcgaagaccaagacttccttgaggtagaaacccccatgctgcaaaccctccacggtggcgcagcagcacgaccattcgaaacccactccaacgccctcgacattgacctctacctgcgcatcgcaccagagctttacctcaagcgctgcgttgtcggcggcatcgagcgcgtcttcgaagtcaaccgcaacttccgcaacgaaggcgtcgactcctcccactccccagaattcgccatgctcgaaacctacgaagcctggggaacctacgaaaccggcgcgaaactgatcaagggtctcgtccaatccgtcgcccaagaagtcttcggaaccaccctggtcaccctcgcagacggcaccgaatacgacctcggcggcgagtggaaagtcatcgagatgtacccttccctcaacgaagccctcgcacgcaaattcccaggacaaccagaagtaaccatcgactccaccgtcgaagaactccgcgaaatcgccaaggtaatcggcctctccgtccccgaaaacggcggctggggacacggcaaactcgtcgaagaaatctgggaactcctctgcgaagaccaactctacggaccaatctttgtcaaagacttcccagtagaaacctccccactcacacgccaacaccgcaccaagccaggcgtcaccgaaaagtgggacctctacgtccgcggatttgaactagcaaccggatactccgaactcatcgacccagtcatccaacgcgaacgcttcgaagaccaagcccgcctcgccgccgacggagacgacgaagccatggtcctcgacgaagacttcctcaccgcaatggaacaaggcatgccaccaacctccggcaacggcatgggaatcgaccgcctcctcatggccctcaccggcctcggaatccgcgaaaccgtactcttcccaatggtgaaaccagaacaaaagtag

SEQ ID NO: 32451 - protein, 526 aa, Corynebacterium glutamicum ATCC 13032
MTNSNPTSKNNSADLPEQLRIRREKRERILDSGLDAYPVEVDRTISISDLRSQFVVITEDLQEREEGVTYLEVGEETDVEVAIAGRVMFVRNTGKLCFASIQEGNGTTVQAMLSLAAVGEESLKAWKADVDMGDIVSVRGKVISSKRGELSVMADSWHMASKSLRPLPVAFADLSEDTRVRHRYTDLIMREQARTNALTRIKVMRALRHYLEDQDFLEVETPMLQTLHGGAAARPFETHSNALDIDLYLRIAPELYLKRCVVGGIERVFEVNRNFRNEGVDSSHSPEFAMLETYEAWGTYETGAKLIKGLVQSVAQEVFGTTLVTLADGTEYDLGGEWKVIEMYPSLNEALARKFPGQPEVTIDSTVEELREIAKVIGLSVPENGGWGHGKLVEEIWELLCEDQLYGPIFVKDFPVETSPLTRQHRTKPGVTEKWDLYVRGFELATGYSELIDPVIQRERFEDQARLAADGDDEAMVLDEDFLTAMEQGMPPTSGNGMGIDRLLMALTGLGIRETVLFPMVKPEQK

SEQ ID NO: 32452 - DNA, 1683 bp, Bifidobacterium longum NCC2705
  CDS (1)..(1683)
atggctgaagttgtcgaaaataccgaaaacactgagaatgaaaccccggccgtcccgcagatgagcaccgtcgaacgtgcggaaatgctgctcaagcaggacgccaccatccgcgagaagatcaagtccggtgccacgctggacgaagccgtggacccctccaacaaggagttcggcccgctggcccaccccgagcaggtgcagatgcgcgtggccaagcgcgcgatgatgcttgaggccggcatcgccccctacccggtgcacttggacgtcaccgacaccatcgaggcggtccgcgccaagtatgacggcaagctcgaggctggcgaagagaccgaagacatggtcggcattgctggccgcgtgctgttcctgcgcaacgcgggcggcctgtgcttcgtgcagctgtccgccggtgacggcaccaagattcagggcatgatctccaagaaggagattggcgccgattcgctcaagcagttcaagcagctcgtcgaccttggcgatcacttgtacctcaagggccgcgtcatcgcctccaagaccggcgagctgtccgtattcgccactgagtgggctatcgcctctaaggccctgcagccgctgccggccctgcacaaggacctgaacgaagacacccgcacccgcaagccgtacatcggcatgatcgcggacgagaacatccgcaacatggtgcgcaaccgctccaaggccgtggcctccctgcgccgcacctttgacgaccacgacttcctcgaggtcgaaaccccgatgctgcagaccctgcacggtggcgcggccgcccgcccgttcaccacgcacatgaacgccttcgaccttgacctgtaccttcgcatcgccccggaactgttcctcaagcgctgcctggtcggcggcatcgatcgcgtgttcgaaatcaaccgtgacttccgcaatgagggcgtcgacgccacgcacgcccccgaattcaccatggtcgaggcctaccaggcctatggcacctatgattccatcggccagctggtcaaggagctcgtgcagaagaccgccatggacgtctacggctcgcacaaggtcaccctgctcgacggcaccgaatacgacttcggcggcgaatggaagaccatcagcatgtacgactccctgtccgaatcgttgggcgaggagatcgtgccgaacggcggcccggacgcccccggcacctccgttgagcacctgggcgccatcgccgacaagctcggcgtagagcgcgacgacgtggagaaccacggcaagctcgtcgaacacctgtgggagcacttctacgaggacaagctttacgagcccaccttcgtgcgtgacttcccggtcgaaacctccccgctggtcaagggccaccgcaccaagcccggcgtggtggagaagtgggatctctacgtgcgcggcttcgagctggctaccggctactccgagctcaacgacccgatcgtgcagcgtgaacgtttcgtggctcaggccaaggacgcgctcgctggcgacgaagaggcttgcgacatcgatgaggacttcctcgaggctctcggcgtgggcatgcctccggccggcggtatgggtatgggtattgatcgactgcttatcgccttgaccggtgccacgattcgcgagaccatcaccttcccgctggtcaagccgctcgttggctga

SEQ ID NO: 32453 - protein, 560 aa, Bifidobacterium longum NCC2705
MAEVVENTENTENETPAVPQMSTVERAEMLLKQDATIREKIKSGATLDEAVDPSNKEFGPLAHPEQVQMRVAKRAMMLEAGIAPYPVHLDVTDTIEAVRAKYDGKLEAGEETEDMVGIAGRVLFLRNAGGLCFVQLSAGDGTKIQGMISKKEIGADSLKQFKQLVDLGDHLYLKGRVIASKTGELSVFATEWAIASKALQPLPALHKDLNEDTRTRKPYIGMIADENIRNMVRNRSKAVASLRRTFDDHDFLEVETPMLQTLHGGAAARPFTTHMNAFDLDLYLRIAPELFLKRCLVGGIDRVFEINRDFRNEGVDATHAPEFTMVEAYQAYGTYDSIGQLVKELVQKTAMDVYGSHKVTLLDGTEYDFGGEWKTISMYDSLSESLGEEIVPNGGPDAPGTSVEHLGAIADKLGVERDDVENHGKLVEHLWEHFYEDKLYEPTFVRDFPVETSPLVKGHRTKPGVVEKWDLYVRGFELATGYSELNDPIVQRERFVAQAKDALAGDEEACDIDEDFLEALGVGMPPAGGMGMGIDRLLIALTGATIRETITFPLVKPLVG

SEQ ID NO: 32454 - DNA, 1752 bp, Plasmodium falciparum 3D7
  CDS (1)..(1752)
atgacaagtaagtcatttttattatcctttttaaaatataaacacgtgaatacatatatttttgaaaaatcattctccaaaattttaaaaaacacaaaaaagcacatagattgtcatctaaaaagttgttttgtcacaatgaatgagaaaaaggagcacgttcttgaaggcgaaaagaataagcgagtcgtgaatgcaagcaaagataagaaaaaagaggaggaaggtgaagtggatccaagattatattttgaaaatcgatccaaatttatacaagaccaaaaagataaaggaatcaacccttatccacacaaatttgagaggacaataagtattcctgagtttattgagaaatataaagatttaggtaatggggaacatttagaagataccatattaaatattaccggtcgtataatgagagtatctgcttctggtcagaaattacgtttctttgatttggttggagatggagagaagattcaagtgttagcaaattattcttttcataatcatgagaaaggtaatttcgctgaatgttatgataagataagaagaggtgacattgtgggtattgtaggctttcctggtaaaagtaagaaaggtgaattaagtattttccctaaggaaactatattactttcagcttgtttacatatgttacctatgaaatatggtttaaaagatactgaaataagatatagacaaagatatttagatttattaataaatgaatcatctcgacatacttttgtaacaagaacaaaaataattaatttcttaagaaattttttaaatgaaagaggtttctttgaagtagaaacaccaatgatgaatttaatagccggtggagcaaatgcacgaccatttattacacatcataatgatttagatttagatctatatttacgaatagctactgaattacctttaaaaatgttaatagtaggtggtatagataaagtctatgaaattggtaaagtatttagaaatgaaggtatagataatacacataatcctgaatttacttcgtgtgaattttattgggcatatgctgattataatgatttaataaaatggtcagaagatttcttctcacaattagtatatcatttatttggtacatataaaatttcatataataaagatggtccagaaaatcaaccgatagaaatagatttcacaccaccttatcctaaggtttccattgtagaggaaatagaaaaagtaaccaacaccatattagagcaaccattcgattcaaatgaaactattgaaaaaatgattaatattattaaagaacataaaatcgaattacctaatcctccgacagctgccaaattattagatcaactagcttctcattttatagaaaataaatataacgataaaccatttttcattgttgaacatccacaaattatgagcccccttgcaaaataccacagaaccaaacctgggctcacagaaagattagaaatgtttatttgtggaaaagaagttctaaatgcttacacagaattaaacgatccttttaaacaaaaagaatgtttcaaattacaacaaaaagatagagaaaaaggtgatactgaagcagcacaactcgattcggcattctgcacttctctagaatatggtttaccacctaccggaggcttaggattaggtattgatagaattactatgtttttaaccaacaagaattccataaaagatgttatattatttcccactatgcgaccagcaaattga

SEQ ID NO: 32455 - protein, 583 aa, Plasmodium falciparum 3D7
MTSKSFLLSFLKYKHVNTYIFEKSFSKILKNTKKHIDCHLKSCFVTMNEKKEHVLEGEKNKRVVNASKDKKKEEEGEVDPRLYFENRSKFIQDQKDKGINPYPHKFERTISIPEFIEKYKDLGNGEHLEDTILNITGRIMRVSASGQKLRFFDLVGDGEKIQVLANYSFHNHEKGNFAECYDKIRRGDIVGIVGFPGKSKKGELSIFPKETILLSACLHMLPMKYGLKDTEIRYRQRYLDLLINESSRHTFVTRTKIINFLRNFLNERGFFEVETPMMNLIAGGANARPFITHHNDLDLDLYLRIATELPLKMLIVGGIDKVYEIGKVFRNEGIDNTHNPEFTSCEFYWAYADYNDLIKWSEDFFSQLVYHLFGTYKISYNKDGPENQPIEIDFTPPYPKVSIVEEIEKVTNTILEQPFDSNETIEKMINIIKEHKIELPNPPTAAKLLDQLASHFIENKYNDKPFFIVEHPQIMSPLAKYHRTKPGLTERLEMFICGKEVLNAYTELNDPFKQKECFKLQQKDREKGDTEAAQLDSAFCTSLEYGLPPTGGLGLGIDRITMFLTNKNSIKDVILFPTMRPAN

SEQ ID NO: 32456 - DNA, 1641 bp, Rhodopirellula baltica SH 1
  CDS (1)..(1641)
gtgaatgaggcggcaaattcacaatcgtcagcccgattgattgtttccaccttcgcaagtgcatttgccgtgaccgatacgccttccaacgctgacgaccttgatttgaccgacccgcacgcggctcgtcggcacaaactggaagaaatcaccgcgaaaggcatcgatccctggggccagcgtttcgacgaccgtttgctggtcagcgagtgccgcgaccggattccacaaatccagtggcagcaaaaggacggcgaaacaatcgctctgcccgacgttgaaagcgacgaagtcgattaccgccaatggaaagccgacaacggcccaggcgaggaaatcggcccgatcgttcgcgttgccggacggattttgttggcccggccgaccggcaagttgatcttcatgaatatccgcgactggaccggcgacatccagatctttgtcggcaagaagcaagtcggcgacgaaaactttgatctggccaaactgtttgacctgggcgatttgatcggtgttcaagggcgactgggccgcaccaacacgggcgagctgaccgtgttcgcggaagagctgttcttgctgacgaagatgttggaagtcccgccggaaaagcacgccgggatgaccaatcaagacctgcgtcaacggatgcggtatgccgacttggcgttcaacgatggcgtgatgcaaacattcctcgatcgcaccaaaatcatcaaaagcattcgctcgacgctggacgaccaaggtttctgcgaagtcgaaggcccgacgctgcacaccgttcccggtggcgccgctgctcgtccgtttgaaacgcatcacaacgcgttggacatgcagttgaccatgcggatcgcgttggagctgcacctcaagcgattgatggtcggcgggatggaacgcgtttacgaactgggacgcgtctatcgcaacgaaggtttgtcaccacggcacaaccccgagttcacgatgctggaaacctatcaggcgtacggcaactacgaatccatgatggatctgactgaaaagatcatctgtgacgcgatcgaaaagatcggcggcggattcaaacgtgaatacaacggcacgatgttggacttcactccaccgttccagcgtgcgacgtatgcggagttgttccagaaggccaccggcatcgatcccgctaacgaagacgcggtcaaggaatacgccaaggggctgaagctgaccatcgaaggcaaacaccccgatgtgatccgcaacgagatcttcgaagagaaggtcgaagattcattgcaaggcccgatcttcgtgacggactatcccgccagcatttgcccgctaaccaaacgcaagaaggacaaccccgaaatcgccgagcgtttcgagatgttcatttgcgggatggaattggccaacgcttacaccgaactgaacgatcccgacctgcaagaagagttgttcaagactcaactcgaaggtcaggacgacgaagactcgatggccaaaatggaccacgacttcgtccgcgcgttgcgttacgggatgccgcccgctggcggattggggattggcatcgaccgcttggtgatggttctgacgaaccaaaaatccatccgcgacgtgatcctgttccccgtgcttcgccctgaatga

SEQ ID NO: 32457 - protein, 546 aa, Rhodopirellula baltica SH 1
MNEAANSQSSARLIVSTFASAFAVTDTPSNADDLDLTDPHAARRHKLEEITAKGIDPWGQRFDDRLLVSECRDRIPQIQWQQKDGETIALPDVESDEVDYRQWKADNGPGEEIGPIVRVAGRILLARPTGKLIFMNIRDWTGDIQIFVGKKQVGDENFDLAKLFDLGDLIGVQGRLGRTNTGELTVFAEELFLLTKMLEVPPEKHAGMTNQDLRQRMRYADLAFNDGVMQTFLDRTKIIKSIRSTLDDQGFCEVEGPTLHTVPGGAAARPFETHHNALDMQLTMRIALELHLKRLMVGGMERVYELGRVYRNEGLSPRHNPEFTMLETYQAYGNYESMMDLTEKIICDAIEKIGGGFKREYNGTMLDFTPPFQRATYAELFQKATGIDPANEDAVKEYAKGLKLTIEGKHPDVIRNEIFEEKVEDSLQGPIFVTDYPASICPLTKRKKDNPEIAERFEMFICGMELANAYTELNDPDLQEELFKTQLEGQDDEDSMAKMDHDFVRALRYGMPPAGGLGIGIDRLVMVLTNQKSIRDVILFPVLRPE

SEQ ID NO: 32458 - DNA, 1563 bp, Corynebacterium diphtheriae NCTC 13129
  CDS (1)..(1563)
gtgagtaacgctaaaaacacccaagacgtacctgagcagctccgcattcgtcgcgagaagcgccagaagcttatcgacgccggcgtggagccgtatccagtcatcgttgaccgcacccactcgatcaccgagctgcgcgagaagtttgcagctgtgccagagggtgaaaagggcgacaagccaggcgttacctacctcgaaccaggcgaggattccggcgtagaggttgccatcaccggccgcgccctgtttatccgcaacaccggcaagctgtgcttcgctgctctccaagagggcaacggcgagtacatgcaggctatgttgtccttggctgaggttggcgaggaatccttggcatcgtggaaggccgatgttgacctaggcgacatcgtttccatccgcggtaccgtcgtcgcttccaagcgtggcgagctttctgtgatggtgaactcgtggcacatggcgtcgaaatcgctacgcccactgcctgtggccttcgctgatatgagcgaggacatgcgtatccgccaccgttacaccgacttgattatgcgtgaacaggctcgtaccaacgctatgactcgtattaaggtcatgcgcgcgctacgccattaccttgaaggccaggacttcatggaagttgaaacccccatgctgcaaaccctgcacggcggcgcagcggcacgtccgtttgttacgcactccaacgcccttgatatcgacctctacctgcgtatcgcgccagaactttacctcaagcgctgcgtggttggtggtatcgagcgtgtattcgaggttaaccgcaacttccgcaacgagggcgtggactcctcgcactccccagagttcgccatgctggaaacctaccaagcgtggggcacctacgatgacggcgcgaagatgatccaagagctcatccagtccgtcgcaatggaagtctttggctccaccaccgtcacgcttgtcgacggcaccgagtacgacctcggcggcgaatggaagaccatcgagatgtacccatcactcaacgaggcgttgacacgcaagttcccaggccagccagaggtcaccatcgactccaccgtggatgaactcaaagcaatcgccgctgttatcggtttggacgttccagccaagggcggttggggccacggcaagctggtcgaagagatctgggagcacctgtgcgaagaccagctctacggcccaatcttcgttcgtgacttcccagtggaaacctcgccgctgactcgccagcaccgctccaagccaggtgttaccgaaaagtgggacctctacgtgcgcggtttcgaactagcaaccggctactccgagcttgtcgaccccgtcatccagcgcgagcgcttcgaggaccaagctcgtcttgccgccggtggcgacgatgaggccatggtcttggacgaggacttcctcgcagctatggagcagggcatgccaccaacggcaggctgcggcatgggcattgaccgcctcctgatggccctgaccggccttggcatccgcgagacagtactgttcccaatcgtgaagccggagcgctaa

SEQ ID NO: 32459 - protein, 520 aa, Corynebacterium diphtheriae NCTC 13129
MSNAKNTQDVPEQLRIRREKRQKLIDAGVEPYPVIVDRTHSITELREKFAAVPEGEKGDKPGVTYLEPGEDSGVEVAITGRALFIRNTGKLCFAALQEGNGEYMQAMLSLAEVGEESLASWKADVDLGDIVSIRGTVVASKRGELSVMVNSWHMASKSLRPLPVAFADMSEDMRIRHRYTDLIMREQARTNAMTRIKVMRALRHYLEGQDFMEVETPMLQTLHGGAAARPFVTHSNALDIDLYLRIAPELYLKRCVVGGIERVFEVNRNFRNEGVDSSHSPEFAMLETYQAWGTYDDGAKMIQELIQSVAMEVFGSTTVTLVDGTEYDLGGEWKTIEMYPSLNEALTRKFPGQPEVTIDSTVDELKAIAAVIGLDVPAKGGWGHGKLVEEIWEHLCEDQLYGPIFVRDFPVETSPLTRQHRSKPGVTEKWDLYVRGFELATGYSELVDPVIQRERFEDQARLAAGGDDEAMVLDEDFLAAMEQGMPPTAGCGMGIDRLLMALTGLGIRETVLFPIVKPER

SEQ ID NO: 32460 - DNA, 1536 bp, Onion yellows phytoplasma OY-M
  CDS (1)..(1536)
atggcaacaaaattaagcgaacaagaaattattagacatcaaaaaatgaatgaattaaaaaaaataaacatcgatccttttggaaaaaaatttgtcccttctcattccatcgaacaaattcttttgcaataccaaaaagcagatagtctagctctcgaacaatcacaaatccatgtttgtgtagctggcagaatcgttttaaaaagaggacaaggcaaagcaggttttttgcatttacaagattttaatttccgaatgcaagcatatataaaactggatttagtgggcaaagatgcttttcagatttatcaaaattgtgatttaggagatatcataggcatcaaaggttttttatttaaaaccaaaacgcaagaattaaccattaaagccttggaatttattcatcttaccaaagccctaaaacctttacctgacaaatttcatggcttgcaaaaccgcgaagagatgagaaaaaatcgctatgttgatctaatcgtaaacgaaaaaacaagacaagtatttttaactcgcagtttgattatgaaatacattagaaatttttttgataatcagggctttttagaagtagaaactcctattttacaaccaactttgggaggcgcttctgccaaaccttttatcactcatcacaacgctcttaattgtgatttttacttgagaattgctaccgaattaccccttaaaaaattaattgttggtggaatgaataaagtctatgaaatcggacgtcttttcagaaatgaaggaattgatgccacacataatcccgaatttagcactattgaggcttacttggcttatgctgatatgcaagatattatggacttaacaaagcaatgcttgcaagaattggcccaaaaattgtttggcaagttgcaatttacttaccaaaaccaagaaattgatttttcccattttgcaaaagtaagtatggttgcatcaatcaaggaaaaaacaggaattgattttacagataattttaccttggaacaatgcctttctttggcaaaaaaacaccaaattgaagttatgccccattttagtcaaggacatatcattgaggctttttttggaaaatacgtagaaaacactctcattcagcctacttttgtctacggacatccactggaaataagtcctttggcaaaacaaaacgaagctgatcctcgctttactgaccgttttgaactttttattgtaggtaaggaatttgctaatgcttttagcgaacttaacgaccctatcgaacaagaaaaacgttttttaaatcaattacaacaaaaacaattaggcaacgacgaagccaatgacatggactatgatttcctaaacgcccttaattatggcatgcctccaactggcggtcttggaatgggacttgatcgtttggttatgcttttaaccgatactgcaaatattcgtgatgttattttatttccacattgtaaaaatcaaaataaatttagtcaaaacaaaacagcaaataaagtcctaacgaataacgataacgaataa

SEQ ID NO: 32461 - protein, 511 aa, Onion yellows phytoplasma OY-M
MATKLSEQEIIRHQKMNELKKINIDPFGKKFVPSHSIEQILLQYQKADSLALEQSQIHVCVAGRIVLKRGQGKAGFLHLQDFNFRMQAYIKLDLVGKDAFQIYQNCDLGDIIGIKGFLFKTKTQELTIKALEFIHLTKALKPLPDKFHGLQNREEMRKNRYVDLIVNEKTRQVFLTRSLIMKYIRNFFDNQGFLEVETPILQPTLGGASAKPFITHHNALNCDFYLRIATELPLKKLIVGGMNKVYEIGRLFRNEGIDATHNPEFSTIEAYLAYADMQDIMDLTKQCLQELAQKLFGKLQFTYQNQEIDFSHFAKVSMVASIKEKTGIDFTDNFTLEQCLSLAKKHQIEVMPHFSQGHIIEAFFGKYVENTLIQPTFVYGHPLEISPLAKQNEADPRFTDRFELFIVGKEFANAFSELNDPIEQEKRFLNQLQQKQLGNDEANDMDYDFLNALNYGMPPTGGLGMGLDRLVMLLTDTANIRDVILFPHCKNQNKFSQNKTANKVLTNNDNE

SEQ ID NO: 32462 - DNA, 1542 bp, Lactobacillus johnsonii NCC 533
  CDS (1)..(1542)
gtggcaaagaatgaaatgaacgaccaactaatcgctcgtcgtgaaaaaatggacgaaatgcgtgaaaacggtattgaaccttttggcgtaagaaaatttgatcgtcaagacttagctcgtactttgaatgaaaagtatagtaatgaagataaagatgaattaaatgctgatatgcctatgactaagattgcaggtcgtatgcttgcaaaacgtggtaagggtaaagttggatttgcagatctttatgaccgtactggtaaaattcaaatttacgtacgtaaagatatcgttggtgaagataactacaagatttttaagaagtctgatattggtgactttttaggtattgatggtgaagtaatgaagaccgatactggtgagttgactattcgtgctactcacattactttcttgtctaaggctcttcgtccattgcctaataaatgggatggtttaaaggatgttgaacaaatttatcgtcagcgctaccttgacttaattacaaatcatgatagttacatgcgttttgttcaccgtactcaaattattcaagctattcgtgactatttgaataatagagatttcttagaagttgaaactccagttctccacaatattcctggtggtgctgaagctcgtccatttattactcaccacaatgctttggatattgatctttacatgagaattgctttggaacttccattgaagcgtttaattgttggtggtatggaacgtgtttatgaaatcggccgtgtatttagaaatgaaggtcttgatactaagcacaacccagaatttactgaacttgaaacttatgcagcttactgggacttccatgatgtaatggatgaggcagaaggaattattagagcagctgctaaagttgtttcaccagatggtaagattacttaccaaggaactgatattgacttaggtaagccattccgccgtgttcacatggttgatttaatcaaggaaaagactggtgttgacttctggaagccaatgactattgaagaagcaagaaaagttgctgatgaacacaacgttcactatgaaagctactggaaggttggccacattattaatgccttctttgaagaattcggtgaaggatcaattgttcaacctacttttgtttatggacacccagtagaagtatcaccacttgctaagaagaatgctgatgatccaagatttactgatcgttttgaaatcttcattatgggtgcagaatatggtaatgcattctcagaattaaatgatccagatgatcaacgtcatcgtttcgaagaccaaatggctgaaagagaagctggtaacgatgaagcagatatgattgatgaggattaccttcgtgctatggaattcggtatgcctcctacaggtggtctaggtattggtattgatcgtttggtaatgcttttaactgatgctcctgctattcgtgatgtcttactcttcccaacaatgcgccctgaaaaggttgaaagtgttgaagcagaagttcaagaagatttgaagaaaaagaacaaatag

SEQ ID NO: 32463 - protein, 513 aa, Lactobacillus johnsonii NCC 533
MAKNEMNDQLIARREKMDEMRENGIEPFGVRKFDRQDLARTLNEKYSNEDKDELNADMPMTKIAGRMLAKRGKGKVGFADLYDRTGKIQIYVRKDIVGEDNYKIFKKSDIGDFLGIDGEVMKTDTGELTIRATHITFLSKALRPLPNKWDGLKDVEQIYRQRYLDLITNHDSYMRFVHRTQIIQAIRDYLNNRDFLEVETPVLHNIPGGAEARPFITHHNALDIDLYMRIALELPLKRLIVGGMERVYEIGRVFRNEGLDTKHNPEFTELETYAAYWDFHDVMDEAEGIIRAAAKVVSPDGKITYQGTDIDLGKPFRRVHMVDLIKEKTGVDFWKPMTIEEARKVADEHNVHYESYWKVGHIINAFFEEFGEGSIVQPTFVYGHPVEVSPLAKKNADDPRFTDRFEIFIMGAEYGNAFSELNDPDDQRHRFEDQMAEREAGNDEADMIDEDYLRAMEFGMPPTGGLGIGIDRLVMLLTDAPAIRDVLLFPTMRPEKVESVEAEVQEDLKKKNK

SEQ ID NO: 32464 - DNA, 1515 bp, Bdellovibrio bacteriovorus HD100
  CDS (1)..(1515)
gtggaggggcccgcgggccccgtaactggagtaattatgagcatcaatgaaaatccgctaagagccgagaagcgcaaaaaacttcatgcgcttcgtgaaaaaggcatcaacccgtatccatacgtctttgaaaacaaggcgaagatctctgaagtgactgcggagcatgctgcgactttgcaggcgggtgaaaagaagccggaatttacctatcgcattgctggccgtctgatgaccctgcgtatgatggggaaagcgtctttcttcaatcttcaggatcagacgggttccgttcaggtctatgtaaaaactgaggagctgtctgaacaggaccgcatggcattcgagctggtggatctgggtgacatcgtcggtattgaggggtttgttttcaaatcccaaaaaggtgagttttcgatttacgcaaaatccttccagattctgacgaaaaccatcgagccgttgccagagaaattccacggcgttcaggacatcgaaatcaagtatcgtcacagacacctggatttgatgaccgatgcggattcccgcaaggtgtttgaaactcgttccaagatcatcaaagaagtacgtcgcttccttgatgaccgtggttttatggaagtggaaaccccgacattgcagccggtttacggcggtgctgcggcgactccgttcaccacacaccacaaagctttggacatgaagctttacatgcgtatttcccctgaactttatctgaaacgcctgatcgtgggtggtttcgagaaagtttacgaaatcagcaaaaacttccgtaacgaaggtatcgaccgcactcacaacccggaatttgcgttgcttgagttctacgaggcttacacggactacaactatcagatgaaacagttcgaagaactgatctcttctttggccttgaaaatcaccggcagcatgaaggtgacttatcagggtaaagagatcgacttcactcctccttggagacgtctgacggttcatgaaggtgttaaagaatacgcgggcattgatccggacaaggcaactgatcaggaaatcttccaggccatccgtaaaaacggtggcgatatcgatgagccgggtaaacgcggcgaaatgatcatggaactgtttgaactgacagcagagcagcacctggtgcagccgacattcgtgatggatcacccggtggagatttctccgctgacgaagattcaccgtcgcgacagcagactggttgagcgtttcgaaccgttcgcagcctgcatggaaatcggcaatgcttactctgagctgaacgatccggaagatcagttggcccgtttgaaagaacaggaagccaaccgtgcgaaggacgaagaagcgcatccgatggatgaagacttcctgctggcgatcgacgctggtatgccgccaacaggtggcgtgggaatcggtatcgagcgtatcgtgatgttgctaacggatagaccaagtatccgtgacatcatctttttcccaacaatgcgtattacaaaatag

SEQ ID NO: 32465 - protein, 504 aa, Bdellovibrio bacteriovorus HD100
MEGPAGPVTGVIMSINENPLRAEKRKKLHALREKGINPYPYVFENKAKISEVTAEHAATLQAGEKKPEFTYRIAGRLMTLRMMGKASFFNLQDQTGSVQVYVKTEELSEQDRMAFELVDLGDIVGIEGFVFKSQKGEFSIYAKSFQILTKTIEPLPEKFHGVQDIEIKYRHRHLDLMTDADSRKVFETRSKIIKEVRRFLDDRGFMEVETPTLQPVYGGAAATPFTTHHKALDMKLYMRISPELYLKRLIVGGFEKVYEISKNFRNEGIDRTHNPEFALLEFYEAYTDYNYQMKQFEELISSLALKITGSMKVTYQGKEIDFTPPWRRLTVHEGVKEYAGIDPDKATDQEIFQAIRKNGGDIDEPGKRGEMIMELFELTAEQHLVQPTFVMDHPVEISPLTKIHRRDSRLVERFEPFAACMEIGNAYSELNDPEDQLARLKEQEANRAKDEEAHPMDEDFLLAIDAGMPPTGGVGIGIERIVMLLTDRPSIRDIIFFPTMRITK

SEQ ID NO: 32466 - DNA, 1503 bp, Mycoplasma mycoides subsp. mycoides SC str. PG1
  CDS (1)..(1503)
atgttagataatagaaaatttagtgaacaagaattagtcagaagaaataaatataaaactttagttgaacaaaacaaagatccttataaagttactaattgaaaaagaaacactacattattaaagttaaatgaaaaatataaagattatagtaaagaagatttattaaatttaaatcaagaattagtagtagttgctggaagaattaaattatatagagaggctggtaaaaaagctgcttttgttaatattgatgaccaagattcaagtattcaattatatgtaagattagatgaaataggtgatcaatcttttgaagattttagaaacttcgatttaggagatattattggggttaaaggaatcatgatgagaactgatcatggcgaactttcaattagatgtaaagaagttgttttattatctaaagctttaagaccactacctgataaacacgctggaattcaagatatagaagaaaaatatcgtagaagatatgttgatttaattgtaaatcatgacgttagaaaaacatttcaagctcgaactaaaataataagaactttacaaaactttttagataataaaggttatatggaagttgaaactccgattttacactcattaaaaggaggagcttctgctaagccttttattactcactataatgttttaaatactgatgtttatttaagaatagctacagaactacatttaaaacgtttaattgttggtggttttgaaggggtttatgaaataggtcgtatttttagaaatgaaggaatgagtactcgccacaatcctgaatttacaagtattgaattatatgttgcttatgaagatatgttctttttaatgaatttaacagaagaaatttttagagtatgtaatgctgcagttaattcaaattctataattgaatataataatgtaaaaatcgatctatcaaaaccatttaaaagattacatatggttgatggtattaaacaagtaacaggtgttgatttttgaaaagaaatgactgtacaacaagctttagaattggctaaaaaacataaagttcatgttgaaaaacatcaagaatcagttggacatattattaatttattttatgaagaatttgttgaatcaactattgttgaaccaacttttgtttatggtcatccaaaagaaatttctccactagcaaaatctaatccaagcgatccaagatttactgatagatttgaattgtttattcttggaagagaatatgctaatgcatttagtgagttaaacgatccaattgatcaatatgaaagatttaaagctcaaattgaagaagaatctaaaggaaatgatgaagccaatgatatggatattgactttattgaagccttagaacacgcaatgccaccaactgctggaattggtataggaattgatagattagtaatgcttttaactaattcagaatctattaaagatgtattattatttccacaaatgaagccaagagaataa

SEQ ID NO: 32467 - protein, 500 aa, Mycoplasma mycoides subsp. mycoides SC str. PG1
MLDNRKFSEQELVRRNKYKTLVEQNKDPYKVTNWKRNTTLLKLNEKYKDYSKEDLLNLNQELVVVAGRIKLYREAGKKAAFVNIDDQDSSIQLYVRLDEIGDQSFEDFRNFDLGDIIGVKGIMMRTDHGELSIRCKEVVLLSKALRPLPDKHAGIQDIEEKYRRRYVDLIVNHDVRKTFQARTKIIRTLQNFLDNKGYMEVETPILHSLKGGASAKPFITHYNVLNTDVYLRIATELHLKRLIVGGFEGVYEIGRIFRNEGMSTRHNPEFTSIELYVAYEDMFFLMNLTEEIFRVCNAAVNSNSIIEYNNVKIDLSKPFKRLHMVDGIKQVTGVDFWKEMTVQQALELAKKHKVHVEKHQESVGHIINLFYEEFVESTIVEPTFVYGHPKEISPLAKSNPSDPRFTDRFELFILGREYANAFSELNDPIDQYERFKAQIEEESKGNDEANDMDIDFIEALEHAMPPTAGIGIGIDRLVMLLTNSESIKDVLLFPQMKPRE

SEQ ID NO: 32468 - DNA, 1500 bp, Bacillus cereus ATCC 10987
  CDS (1)..(1500)
atggataacatgaaccacgaagaattaaacgaccaattgcttgttcgtcgtgaaaagctacataacttacgtgagcaagggatcgatccgttcggtaaacgttttgaacgtacaaatgcaacaaatgaattattaagcctatatggagagttctctaaagaagaattagaggagaaagaaatctctgtttctatcgctggtcgtattatgacaaaacgcggtaaaggaaaagctggatttgcacatattcaagatttacatggacaagttcaaatttacgttcgtaaagatgctgttggagatgaagagtacgaattatttaaaacagcagatttaggtgacttagtaggtattgaaggtaaagttttcaaaacgaacgttggagaactttcggtgaaagcaacgggctttacgctattaacgaaatctcttcgtccattaccggataaatatcatggactaaaagatgttgaacaacgctaccgtcaacgttacttagacttaattacaagtatggaaagccgtgaaacatttgttactcgcagtaaaatcattcgtgaaatgagaagatacttagatgacaatggttatcttgaagtggaaacacctatgatgcacgcaattgcaggtggagcttctgcgcgtcctttcatcacgcaccataatgcgttagatatggaattatatatgcgtatcgcaattgaacttcatttaaaacgccttattgtgggtggattagaaaaagtttatgaaatcggccgtgtattccgtaacgagggtgtatcaactcgtcataatcccgagtttacgatgattgaattatatgaagcgtatgctgattataaagatattatgaaactaacagaaaatatggttgctcatatcgcgaagcaagtactaggtacaacaacaatccagtatggtgactatgaaattaatctagaaccagaatggacacgtcttcatatggtagatgcaattaaagaacattctggagcagatttctggaatccgatgagtgtagaagaagcgcgtgaacttgcaaaagaacataatgtagaaattaaggatacaatggaagttggtcatattattaatgaattcttcgaacaaaaagtagaagataaattaatccaaccaacatttatttacggtcatccggtagaaatttcgccacttgcgaaaaagaatgacgaagatccacgattcacagatcgtttcgaattatttattgttgcacgtgaacatgcaaatgcattcactgaattaaatgatccaattgatcagaaagaacgttttgaagcacaattaaaagaacgcgaacaaggtaatgatgaagctcacatgatggatgatgattatattgaagctcttgagtatggtatgcctcctacaggtggactaggaattggtattgatcgtcttgttatgttattaacgaatgcaccatctattcgtgacgtactattattccctgctatgcgtcataaacaagactaa

SEQ ID NO: 32469 - protein, 499 aa, Bacillus cereus ATCC 10987
MDNMNHEELNDQLLVRREKLHNLREQGIDPFGKRFERTNATNELLSLYGEFSKEELEEKEISVSIAGRIMTKRGKGKAGFAHIQDLHGQVQIYVRKDAVGDEEYELFKTADLGDLVGIEGKVFKTNVGELSVKATGFTLLTKSLRPLPDKYHGLKDVEQRYRQRYLDLITSMESRETFVTRSKIIREMRRYLDDNGYLEVETPMMHAIAGGASARPFITHHNALDMELYMRIAIELHLKRLIVGGLEKVYEIGRVFRNEGVSTRHNPEFTMIELYEAYADYKDIMKLTENMVAHIAKQVLGTTTIQYGDYEINLEPEWTRLHMVDAIKEHSGADFWNPMSVEEARELAKEHNVEIKDTMEVGHIINEFFEQKVEDKLIQPTFIYGHPVEISPLAKKNDEDPRFTDRFELFIVAREHANAFTELNDPIDQKERFEAQLKEREQGNDEAHMMDDDYIEALEYGMPPTGGLGIGIDRLVMLLTNAPSIRDVLLFPAMRHKQD

SEQ ID NO: 32470 - DNA, 1578 bp, Eremothecium gossypii
  CDS (1)..(1578)
atgtggtgcggagccagagcgatgatagcgggcgtgttacgggcaggtatagcacggcgtgtgtgtgtgcggttacagcacaccctgagctacacgggcagaactacgctagggcaggcggagatggccgccttttatccgtcggtgtccagtgtacccaggcccacggcatccattgcagaatttaataatcgatatgtggggaaactttccaacgacgaaccagagcgcacgtacgtcattaacggtcagattcggggtatccgcgttgttgggcgatctatgtgctttgtggacctgcagcagcagggctcagcgctgcaactgatggtcaaccactcgctggtaagggcccagttggttgccaagcggccattccagaacgcgattgcggggctccgacttggtgaccatgtgcagccgacggggttccccgggctgtcgaagacggagcggacgctatcgctcaaatgccggaaggtgcctaggatgctggctgccgcacagatagcgattccgcagcgcctgacggaccgggtcaagcggcagcagaacaggacgctggattaccttgtgaacgggctaaaggtcttggagtttcggcacaaggcgctgacggcgctgcgggcgtacctgaaccgtcgaggtttcctcgaggtggagacgccgatgctgtctgccaaatcgagtggcgcgaacgccacgccctttgtcactcacctgcgcgggcaagacaaacaggcactagagttgcgcatcgccccggaactctggctgaagcgcctctgcgttggcggcgcgcagcgtgtgtacgagatcggtaaggtattccgcaacgaaggcatcgacgcgacgcacaacccggagtttaccaccctggagctataccaatgctacgcgcccctggatgagctgcttgagctggcgcaggtactcctcagagatatttgtgtcgcggtggacacaccggtctcgcggcaactgcttgccgagatggcgcaaaacggaggtgctttccgccgtgtggagtttctgccgaccttgagccgtgaaacgggggttgattgggctgcagtcgaccttgcagatagcactgccatccgcgtcgctctttccggcgcgggcattgacgtgccggagtccattgtgtcgccccagcaaatcctcaacaagctatgcgcagactatattgaggaccgctactgtcagtctttgctgcccactgctatcctacatcatcccgccgtcatgtcgcccttggcgaagagcgcgggcctcgtcgccaaccgcttcgaactcttcgtctgcggccgggagcttatcaacgcgtatgaggaagagaattgccctcaggagcagttaaagaagatgcagctccagcagaggcacagagagcagtttcacgaccaggagtcgatgcagatcgaccaccactacatcgaggcaatgaagtacggaatgccaccaatcggcggcctgggcttaggcatcgatcgcctctgtatgttacttttagccaaggctcggatcgaagaagtgctgccattcggatgtctagacgacgtcaaccgccagtag

SEQ ID NO: 32471 - protein, 525 aa, Eremothecium gossypii
MWCGARAMIAGVLRAGIARRVCVRLQHTLSYTGRTTLGQAEMAAFYPSVSSVPRPTASIAEFNNRYVGKLSNDEPERTYVINGQIRGIRVVGRSMCFVDLQQQGSALQLMVNHSLVRAQLVAKRPFQNAIAGLRLGDHVQPTGFPGLSKTERTLSLKCRKVPRMLAAAQIAIPQRLTDRVKRQQNRTLDYLVNGLKVLEFRHKALTALRAYLNRRGFLEVETPMLSAKSSGANATPFVTHLRGQDKQALELRIAPELWLKRLCVGGAQRVYEIGKVFRNEGIDATHNPEFTTLELYQCYAPLDELLELAQVLLRDICVAVDTPVSRQLLAEMAQNGGAFRRVEFLPTLSRETGVDWAAVDLADSTAIRVALSGAGIDVPESIVSPQQILNKLCADYIEDRYCQSLLPTAILHHPAVMSPLAKSAGLVANRFELFVCGRELINAYEEENCPQEQLKKMQLQQRHREQFHDQESMQIDHHYIEAMKYGMPPIGGLGLGIDRLCMLLLAKARIEEVLPFGCLDDVNRQ

SEQ ID NO: 32472 - DNA, 1770 bp, Eremothecium gossypii
  CDS (1)..(1770)
atgtctgaggaagcagccgtccaacaggtagccgaaaatgtggccaaccttcacctagatgaggtaaccggggagatggtttccaagtcggaattgaagaagcgtatcaagcaacgtcaggtcgaggccaagaaggctgcgaaaaaggccacgagcaagcctaagccagagccaaagaaaaaggtggagaacatggccgatctagatccatccaagtactttgaggcacgttctcggcagattcaggagctgcggaagacgcaggagcccaacccatatccgcacaagttcaacgtgactatcggactgccagcgttcttgaataaatacgcccacctacagcgcggagagactttgcccgaggagcgcgtgtcgattgccggtagaattcatgctaagcgtgaatccggctcgaagttgcggttctacgttcttcacgccgacggtgtggaagtccaggtcatgtcccagctgcaggattaccattctgaggaggcctacgagcaggaccatggtttgttgaagagaggtgatattgtgggtgtggagggatacgtcggcagaacgcagccaaagaagggtggtgaaggtgaaatttctgtttttgtttcgcgcattcagctattgacgccgtgcttgcacatgctgccagccgaccactttggcttcaaggaccaggaaacaagatacagaaagagatacctggacttgatcatgaacaaggacgcccgtggacgctttatcaccagatccaaaatcatcacctacatccgcaagtttttggacaacagagacttcattgaggtggagacgccaatgatgaacgtcattgctggcggtgctactgctaagccattcgttacccaccacaatgacttggacatgcagatgtacatgagaattgcccccgagctatttttgaagcagctagttgtgggcgggatggacagagtctacgaaatcggccgccagttcagaaatgagggtatcgacatgactcacaaccctgagtttaccacctgtgaattctaccaagcatatgccgatgtgtatgatctgatggacatgactgaattgctcttctccgagatggttaaggaaataaccggtgattacaagatcaagttccacccagatccaaacgaccctagcaaagaatatgacatcaacttcgctagaccttggaagagaatcaacatgattgaggaacttgagaagaggttcaatgtcacattcccagcaggagaccaattgcacactgctgagacaggagagttcttgaagaagatcctctctgacaacaagatggactgcccacctccactaaccaatgcgcgtatgctggacaagcttgtaggcgaacttgaggacacttgcattgatccaacattcatttttggtcacccacaaatgatgtcgccattggctaagcactcgagagaccagccaggtctttgcgagcgtttcgaagtcttcgtggccaccaaggagatctgtaacgcttacaccgagctaaacgatcctttcgaccaaagagctcgtttcgaagagcaggctagacaaaaggaccagggtgacgacgaggcacagttgattgacgaaacattctgcaacgcacttgaatacggtttgccaccaactggtggatggggatgtggtgttgacagactggcgatgttcttgaccgactctaacaccatcagagaggttcttctcttcccaactttgaagccagacgtactaaaggaggatttgaagaaggaaaactag

SEQ ID NO: 32473 - protein, 589 aa, Eremothecium gossypii
MSEEAAVQQVAENVANLHLDEVTGEMVSKSELKKRIKQRQVEAKKAAKKATSKPKPEPKKKVENMADLDPSKYFEARSRQIQELRKTQEPNPYPHKFNVTIGLPAFLNKYAHLQRGETLPEERVSIAGRIHAKRESGSKLRFYVLHADGVEVQVMSQLQDYHSEEAYEQDHGLLKRGDIVGVEGYVGRTQPKKGGEGEISVFVSRIQLLTPCLHMLPADHFGFKDQETRYRKRYLDLIMNKDARGRFITRSKIITYIRKFLDNRDFIEVETPMMNVIAGGATAKPFVTHHNDLDMQMYMRIAPELFLKQLVVGGMDRVYEIGRQFRNEGIDMTHNPEFTTCEFYQAYADVYDLMDMTELLFSEMVKEITGDYKIKFHPDPNDPSKEYDINFARPWKRINMIEELEKRFNVTFPAGDQLHTAETGEFLKKILSDNKMDCPPPLTNARMLDKLVGELEDTCIDPTFIFGHPQMMSPLAKHSRDQPGLCERFEVFVATKEICNAYTELNDPFDQRARFEEQARQKDQGDDEAQLIDETFCNALEYGLPPTGGWGCGVDRLAMFLTDSNTIREVLLFPTLKPDVLKEDLKKEN

SEQ ID NO: 32474 - DNA, 1917 bp, Magnaporthe grisea 70-15
  CDS (1)..(1917)
atgttttcacttggtcggtcctcgttgcgctgtgcgcaccgggccgggctgccacggccaagattggcgtctgaggttgtggttcagaatagaactctgccgcggtgttatagcgtatcccgagatccttcagagttgaagggccggagggaacccgccgcaagtgagcccagcaatttcttgtcatctgtaaaggatgccaagcctaaccagactggtcaggccaccactcaagtagatgctgtgaaaccttcctggaccgtggaatccaaaactaccactaagattaaaaacatagccgacatgcccctttcaaaactgttcgacgtgtgtccttcagatagtaactccggccgtatgagagtggtgcgtgggatcgaagatatagatgaacccctgaccgcaaaaggccgcatcatgaacatccgcagccacggctccctgatattcctggacatcgccggcgactacgagacgctgcaggtcgctatcagctacgcatttctgaaagaaaagtccccagctgagatggaaggcgtcagcctccgcgactttaaagcaaagggtgcccagctgcagcgcggcgactgggtcgtcgccgccgggcacatggaggcagacaggcgtgacggcctgcgcatgcgcgcacataacttcccctcgatccgcgccaaggccctcaacataccgcccctttccgtcatcgacgatgggctcatgagccaatctcgccacctggacctgatgctcaacaaggtgagcgtcgatgcgctgcgcgcccgcgcccgcatcatccagaccgtccgccgcaccctcgacgaccgcggctacgtcgaggtccagacgccgctgctggcgggttcggccggtggggcgacggcccgcccatttgccacgacggccacagagtttggttcctcgcagcacctcgccctccgcgtcgccccggagctctggctcaagaggctcgtcatgggcggcatggaccgcgtctacgaggtcgggccttgcttccgcaacgagggcgtcgacgccacccataaccccgagttcaccatgtgcgagttctacgaggcctgggcagacctagaccacctcatgctcatgacggagaggctgatgcagctcatctcatccgacctcaaggccgcgtccaaagacgcagaggccgtgggccgtcgcccctggctgctgcccgacatggaccgcatcgcctccactttctgtgaagaaggcaccacccccaaagtccacttcatcacgaggcttgagcaagcgctgggcttcaagctccccgacctggaatccaccacagcgttggcggaattaataatgaaactacgcgagcggggcgaggatgctgacatccttgccgccgccgactacccggagcagggagacgccgccaccaccacggcgcccatgacgctacccaagctccttgacgacctgggctcaaaatacgtcgagaagtgctcgaccgttgggccccaccgggcattctttgtcacgcaccacccggcctgcatggcgccgctggcgcgaagcggcgtgtgccccatcaccaagcagaaggtcgctctcagggccgagttctttgtcaatggcgtcgagctggccaacatgtacgaggaggagtttgaggccgacgagcaggagcgcaagttcaacgcagcggcgcggttgaggcgtgatgccgtcgggctcaacagcgacgaggccagctacgtcttggccatgcgtggcggcatgccgcccacaggaggatggggctgtggtattgacaggcttgccatgctcttcaccggcaagccgaggatccgggacgtcctgacctttgggaacttgaggaacgtggtgcacgcgacgcggttgccgggaccatggaatgccgcagcgaagcgttttcggttgtga

SEQ ID NO: 32475 - protein, 638 aa, Magnaporthe grisea 70-15
MFSLGRSSLRCAHRAGLPRPRLASEVVVQNRTLPRCYSVSRDPSELKGRREPAASEPSNFLSSVKDAKPNQTGQATTQVDAVKPSWTVESKTTTKIKNIADMPLSKLFDVCPSDSNSGRMRVVRGIEDIDEPLTAKGRIMNIRSHGSLIFLDIAGDYETLQVAISYAFLKEKSPAEMEGVSLRDFKAKGAQLQRGDWVVAAGHMEADRRDGLRMRAHNFPSIRAKALNIPPLSVIDDGLMSQSRHLDLMLNKVSVDALRARARIIQTVRRTLDDRGYVEVQTPLLAGSAGGATARPFATTATEFGSSQHLALRVAPELWLKRLVMGGMDRVYEVGPCFRNEGVDATHNPEFTMCEFYEAWADLDHLMLMTERLMQLISSDLKAASKDAEAVGRRPWLLPDMDRIASTFCEEGTTPKVHFITRLEQALGFKLPDLESTTALAELIMKLRERGEDADILAAADYPEQGDAATTTAPMTLPKLLDDLGSKYVEKCSTVGPHRAFFVTHHPACMAPLARSGVCPITKQKVALRAEFFVNGVELANMYEEEFEADEQERKFNAAARLRRDAVGLNSDEASYVLAMRGGMPPTGGWGCGIDRLAMLFTGKPRIRDVLTFGNLRNVVHATRLPGPWNAAAKRFRL

SEQ ID NO: 32476 - DNA, 1833 bp, Gibberella zeae PH-1
  CDS (1)..(1833)
atggctgacgctgctgcccccccgaccgagcaggttgccaacctgcacctcgatgaggtaactggtgagaagatctccaagaccgagttgaagaagcgccagaaggcccgccagaaggaggaggaaaagaagaagaaggctgccgagcgtggtcccgctcccgctcccaagaaggctgccggtggtgctgaggcttctgagaaggacctcacccccaaccagtacttcgagatccgatccaggaacatcaacaagctccgcgagaccaagagccccaacccctacccccacaagttcaatgttacatacgacctgcgaaagttcgtcgaggagtttggtcacctcaagtctggcgagcatgccaaggacaagatcattcaaattggtgcccgtgtccacggaaagcgagcatctggcgccaagctcctcttctacgatgtccgaactgagggtgtcaaggtccagatcatgtgccaggctcaagaggttcgtgagggagctccctcttttgaggaccagcacgagcaccttcgccgaggtgatatcatcggaattatcggataccctggccgaactgcacccaagaccaagatcgagaagggtgaggagggtgagctgtccattttcgccaccgaagttgttctcctgactccttgcctgcatgcccttcccgatgaccactacggcttcaaggatctcgagcagcgataccgtaagcgatacctcgatctcatctgcaacgagaaggcccgtaacgtcttcatcactcgatctaagatgatcacctggatccgcaaatacttcgacgagcgtgacttcgtcgaggttgagactcccatgatgaaccagattgctggtggtgccactgccaagcccttcaccactcaccacaacgagtatgatatgcccatgttcatgcgtgtcgcccctgagctttacctcaagatgcttgtcgtcggtggtctcaaccgcgtgtacgagattggacgtcagttccgaaacgaaggtgctgatcttactcacaaccccgaattcaccaccattgaattttacgaggcctacgctgatgtcaacgacttaatgaagaccaccgaggaaatgatctccggcctcgtcaagtacctcaccggtggctacaagactactttccatactcagagtggcgagaagtacgaggtcaactgggaggcgccttggccccgatatgagatgatccccactcttgaggaggctactggcgagaagtttccttcgggtgaccagctccacactcaagagaccaacgagttcctcaagaatgtccttaagaagatgaacctggagtgcacacctcctctgactaacgcccgcatgattgacaagctggttggcgagttcatcgaggagaagtgtgtcaacccttctttcatcactggccaccctcaggtcatgagccctctcgccaagtaccaccgtgagatccccggtctgtgcgagcgattcgaggctttcgtgtgcaagaaggagatcgccaacgcttacaccgagttgaacgatcccttcgaccagcgcctgcgtttcgaggagcaggcccgccagaaggaccagggtgacgacgaggctcagcttgtcgatgagaacttctgtacctcgctcgagtacggtctgcctcctaccggtggctggggtatgggtattgaccgaatggtcatgttcctgactgacaactacaccattcgtgaggtccttactttcccattcatgaaggatgacaagctggagcagaagaagcaactggccgccgaggtggctggcattgaacccatgcctgaggaaggtattgctcacaagtaa

SEQ ID NO: 32477 - protein, 610 aa, Gibberella zeae PH-1
MADAAAPPTEQVANLHLDEVTGEKISKTELKKRQKARQKEEEKKKKAAERGPAPAPKKAAGGAEASEKDLTPNQYFEIRSRNINKLRETKSPNPYPHKFNVTYDLRKFVEEFGHLKSGEHAKDKIIQIGARVHGKRASGAKLLFYDVRTEGVKVQIMCQAQEVREGAPSFEDQHEHLRRGDIIGIIGYPGRTAPKTKIEKGEEGELSIFATEVVLLTPCLHALPDDHYGFKDLEQRYRKRYLDLICNEKARNVFITRSKMITWIRKYFDERDFVEVETPMMNQIAGGATAKPFTTHHNEYDMPMFMRVAPELYLKMLVVGGLNRVYEIGRQFRNEGADLTHNPEFTTIEFYEAYADVNDLMKTTEEMISGLVKYLTGGYKTTFHTQSGEKYEVNWEAPWPRYEMIPTLEEATGEKFPSGDQLHTQETNEFLKNVLKKMNLECTPPLTNARMIDKLVGEFIEEKCVNPSFITGHPQVMSPLAKYHREIPGLCERFEAFVCKKEIANAYTELNDPFDQRLRFEEQARQKDQGDDEAQLVDENFCTSLEYGLPPTGGWGMGIDRMVMFLTDNYTIREVLTFPFMKDDKLEQKKQLAAEVAGIEPMPEEGIAHK

SEQ ID NO: 32478 - DNA, 1821 bp, Aspergillus nidulans FGSC A4
  CDS (1)..(1821)
atgaccgactccaaccctgttcaggaggccgaggcctctatggccaaccttttgctcgatgaggtcactggcgagaaggtctcgaagtctgagctgaagagacgccagaagctgcgcgagaaggaagccaagaagaaggagaaggaggctgctgctcctcccaagcctgctgcgcaaaaaaaggtctccgctgaagacgaggaggcgaacttaactcctaaccaatactttgaaatccgcagcaagagaatcaacaagctccgagagaccaagcagccggacccctatccccacaagttccaagtcaccgatgacctccgcaaatacttgaaggagtatgagagcctcgcgaagggcgaacagaagccggatacgaccgttcggattgctggcagaatctacacaaagcgttcatctggtgcgaagctgattttttacgatatccgagctgagggtgtcaaggtgcaggtggtatgccaggctcagaacgcttcgggcgctgtttcgtttgaggaccagcacgagcacctccggagaggcgatatcgtcggtattgtcggtttccccggccgcagcaaccccaagaaccgaccggacggagagctgtccatttttgcgaccgaggtggttctgcttgctccctgccttcacgccattccttccgagcactacggcttccaagacaaggagcagcgctaccgccagcgttaccttgacttgatcatgaatgacaagtctcgcaacgttttcattacccgttccaagatggtcacgtacattcgcaacttcttcgaccagcgggactttgtcgaagtcgagactcctatgatgaacgccatcgccggtggtgcgacagccaagcctttcatcacccaccacaacgaacacgacatgaacctcttcatgcgtgtcgcccccgagctgtacctcaagatgctcattgtcggaggccttgagcgtgtttacgagcttggccgtcagttcagaaacgagggtgttgaccttacccacaaccctgaattcacaacctgcgagttctactgggcttatgctgatgtttacgacgtcatgaacctaacggaggagcttgtgtctggcctggtcaagcacatcactggtggctacgagaccaccttccacacacagactggcgaggaatacaaggtcaactggaaggccccttggaggcgagtggagatgattcccgctctagaggaagctactggcgagaagttcccacccggtgaccagctgcacactgctgaaactggcgagttcctcaagaaggtcctaaagaagactggagtcgagtgctcaccgcccctcaccaacgcccgtatgcttgacaagctcgttggcgagtttattgaagaaacatgcattaaccccaccttcatcactggccaccctcaaatgatgtctcctctggccaagtaccaccgccagaacgctggtctctgcgagcgttttgaggcattcgtctgcaaaaaggaaattgtcaatgcttacactgagttgaacgaccccttcgaccagcgtctccgcttcgaggagcaggctcgccagaaggaccagggtgacgacgaggctcagattatcgacgagaacttctgtactagcttggagtatggtctgcctcccacaggtggttggggtatgggcattgaccgcttggttatgttcttgacggataactacagcatcaaggaggttcttgccttccccttcatgaaggatgataagaccgcggctgagggcaagtcggcagccgaggttgttggcatccagccccagcccgaggagggaatccctcacaaatag

SEQ ID NO: 32479 - protein, 606 aa, Aspergillus nidulans FGSC A4
MTDSNPVQEAEASMANLLLDEVTGEKVSKSELKRRQKLREKEAKKKEKEAAAPPKPAAQKKVSAEDEEANLTPNQYFEIRSKRINKLRETKQPDPYPHKFQVTDDLRKYLKEYESLAKGEQKPDTTVRIAGRIYTKRSSGAKLIFYDIRAEGVKVQVVCQAQNASGAVSFEDQHEHLRRGDIVGIVGFPGRSNPKNRPDGELSIFATEVVLLAPCLHAIPSEHYGFQDKEQRYRQRYLDLIMNDKSRNVFITRSKMVTYIRNFFDQRDFVEVETPMMNAIAGGATAKPFITHHNEHDMNLFMRVAPELYLKMLIVGGLERVYELGRQFRNEGVDLTHNPEFTTCEFYWAYADVYDVMNLTEELVSGLVKHITGGYETTFHTQTGEEYKVNWKAPWRRVEMIPALEEATGEKFPPGDQLHTAETGEFLKKVLKKTGVECSPPLTNARMLDKLVGEFIEETCINPTFITGHPQMMSPLAKYHRQNAGLCERFEAFVCKKEIVNAYTELNDPFDQRLRFEEQARQKDQGDDEAQIIDENFCTSLEYGLPPTGGWGMGIDRLVMFLTDNYSIKEVLAFPFMKDDKTAAEGKSAAEVVGIQPQPEEGIPHK

SEQ ID NO: 32480 - DNA, 1776 bp, Candida glabrata CBS138
  CDS (1)..(1776)
atgtctcaggaagaagccaccaaagctgccactgaaggtgttgccaaccttcacttggatgaagtcaccggtgaaatggtgtccaagtccgagttgaagaagcgtatgaaggccagacaggtcgaggccaagaaggccgccaagaaagcctctgctcagccaaagccggagccaaagaagaagaagaacgaccttttggctgacctggacccatcccagtacttcgaggctagatcacgtcaaattctggaattgagaaagacccacagcccaaacccatacccacacaagttccaagtctctatcagcaaccctgaattcttggccaagtatgcgcacttgaagagaggtgagactttgccaaacgaaatcgtcagcatcgccggtagaatccacgccaagagagaatccggttccaagttgaagttctacgttctccacggtgacggtgtcgaagtccaagtcatgtctcaattgcaagactacgccgatgccgaggcttacgagaacgaccacgacttgatcaagagaggtgacattgtcggtgttgaaggttacgtcggtagaacccaaccaaagaaaggtggtgaaggtgaaatctctgtctttgttaagcgtattgaattgttgaccccatgtctgcacatgttgccagctgaccacttcggtttcaaggaccaagagaccagatacagaaagcgttaccttgacttgatcatgaacaaggactccagaaagagattcatcacaagatccaagattatcaagtacatcagaaagtttttggacaacagagactttatcgaagttgaaacccctatgatgaatgttattgccggtggtgccaccgccaagcctttcgttacacaccacaacgacttggacatggacatgtttatgagaattgccccagaattgttcttgaaggaattggttgtcggtggtatggaccgtgtctacgaaattggtagacaattcagaaatgaaggtatcgatatgactcacaaccctgaattcaccacttgtgaattttaccaagcttatgccgatgtttatgacctaatggatatgactgaattgctattttccgaaatggtcaaggaaatcaacggctcttacgttatcaagtaccacccagatccaaacaacccagaaaaggaaatggaattgaacttcgctagaccatggaagagaatcaacatgattgaagaattggagaagagattcaatgttacattcccagctggtgaccaactacatactaaagaaactggtgagttcttgcaaaaggtcttgaaggacaacaacttggaatgtccaccaccaatcactaacgcccgtatgctagataagcttgtcggtgaattagaagacacatgtatcaacccaactttcatctttggtcacccacaaatgatgtctccattagctaaatactctagagatcaaccaggtttgtgtgaacgtttcgaagtcttcgttgctaccaaggaaatctgtaacgcttacactgaattgaatgatccatttgaccaaagagctcgtttcgaagaacaagccagacaaaaggaccaaggtgatgacgaagctcaattaatcgatgagaccttctgtaacgctttggaatacggtctaccacctactggtggttggggttgtggtattgatagattggccatgttcttgactgactctaacacaatcagagaagtcctattgttcccaactttgaagccagatgttctaagagatgaggttaagaaggaagagaactaa

SEQ ID NO: 32481 - protein, 591 aa, Candida glabrata CBS138
MSQEEATKAATEGVANLHLDEVTGEMVSKSELKKRMKARQVEAKKAAKKASAQPKPEPKKKKNDLLADLDPSQYFEARSRQILELRKTHSPNPYPHKFQVSISNPEFLAKYAHLKRGETLPNEIVSIAGRIHAKRESGSKLKFYVLHGDGVEVQVMSQLQDYADAEAYENDHDLIKRGDIVGVEGYVGRTQPKKGGEGEISVFVKRIELLTPCLHMLPADHFGFKDQETRYRKRYLDLIMNKDSRKRFITRSKIIKYIRKFLDNRDFIEVETPMMNVIAGGATAKPFVTHHNDLDMDMFMRIAPELFLKELVVGGMDRVYEIGRQFRNEGIDMTHNPEFTTCEFYQAYADVYDLMDMTELLFSEMVKEINGSYVIKYHPDPNNPEKEMELNFARPWKRINMIEELEKRFNVTFPAGDQLHTKETGEFLQKVLKDNNLECPPPITNARMLDKLVGELEDTCINPTFIFGHPQMMSPLAKYSRDQPGLCERFEVFVATKEICNAYTELNDPFDQRARFEEQARQKDQGDDEAQLIDETFCNALEYGLPPTGGWGCGIDRLAMFLTDSNTIREVLLFPTLKPDVLRDEVKKEEN

SEQ ID NO: 32482 - DNA, 1782 bp, Debaryomyces hansenii CBS767
  CDS (1)..(1782)
atgtctgaagaagttgcgaaggttgctgaacaattacaaaaaacctatttggatgatgtcaccggtgaacaagtgtcgaaaaccgaattaaaaaagagacaaaagcaaagagccaatgacgctaagaaggcagaaaaggctgctaagagtgctgcttcagctccaaaggtcgctaagaagaaggatcaattagttgatttaaatccaaatcaatattttgaaatcagatctcgtcaaattgacgaattgaggcaagccaacctcgctgacggctccgctttcaacccttacccacacaagttccatgtttccattcagttaccggccttcgctgaaaagtacaaggatttgaagaagggtgaatctttgaaagatgttgaagtcaaggtcagtggtagaattatgggtaagagagaatctggatccaagttgaagttctacgttttgaagggtgatggtgttcaaattcagatcatggctcaagctcaggatgttgaaaatgctgaagaatacgaaaagatgcacgaatacttgagaagaggtgatattattggtgttactggttatcctggtagaacaagccctgccaagggtggtgagggtgaagtatccgttttcgccacttccgttcaattattgaccccatgtttgcacatgttaccaactgagcattatggtttcaaggatcaagaagccagatatagaaagcgttacttagatttgattatgaacgaatctaccagagatcgtttcaaggtcagatctcagatcatttctttcattcgtaagtttttagatactagagattttactgaagttgaaaccccaatgatgaatgttattgctggaggtgctactgctaaaccattcgttactcatcacaatgatttgaacatggatatgttcatgagaattgcgccagaattattcttaaaagaattagttgttggtggtatggatagagtctacgaaatcggtcgtcaatttagaaatgaaggtatcgatatgacccataacccagaatttaccacttgtgaattctatcaagcttatgccgatgtttatgacttaatggatatgactgaattacttttctccgaaatggtcaagaaaattactggtgattacaaggttacttaccatccagaaggtccagaaggtaaagctttgactttagatttcaccagaccatggaagagagtcaatatgatcgaagaattagaaaaggttttcaatgttaccttcccagctggtgatcaattgcataccgaagaaacaggtaaatttttgaaacaaatcttaatcgaccacaaattagattgttctccaccattaaccaacgctagaatgttagataagttggttggtgaattagaagacgcttctattaacccaactttcattttcggtcatcctcaaatgatgtccccattagccaagaaagatagagataatgttggtttatgtgaaagatttgaggtttttgttgctactaaagaaatttgtaatgcttacacagaattaaacgatccatttgatcaaagacaaagattcgaagaacaagctagacaaaaggctcaaggtgatgacgaagcacaaatggttgatgaaaccttctgtaacgctttggaatacggtttaccaccaaccgctggttggggttgtggaattgatagattagccatgttcttaactgactctaatactatcagggaagttttgttattcccaactttaaagcctgatgcattagttaaaggtgaagagacatctgataattag

SEQ ID NO: 32483 - protein, 593 aa, Debaryomyces hansenii CBS767
MSEEVAKVAEQLQKTYLDDVTGEQVSKTELKKRQKQRANDAKKAEKAAKSAASAPKVAKKKDQLVDLNPNQYFEIRSRQIDELRQANLADGSAFNPYPHKFHVSIQLPAFAEKYKDLKKGESLKDVEVKVSGRIMGKRESGSKLKFYVLKGDGVQIQIMAQAQDVENAEEYEKMHEYLRRGDIIGVTGYPGRTSPAKGGEGEVSVFATSVQLLTPCLHMLPTEHYGFKDQEARYRKRYLDLIMNESTRDRFKVRSQIISFIRKFLDTRDFTEVETPMMNVIAGGATAKPFVTHHNDLNMDMFMRIAPELFLKELVVGGMDRVYEIGRQFRNEGIDMTHNPEFTTCEFYQAYADVYDLMDMTELLFSEMVKKITGDYKVTYHPEGPEGKALTLDFTRPWKRVNMIEELEKVFNVTFPAGDQLHTEETGKFLKQILIDHKLDCSPPLTNARMLDKLVGELEDASINPTFIFGHPQMMSPLAKKDRDNVGLCERFEVFVATKEICNAYTELNDPFDQRQRFEEQARQKAQGDDEAQMVDETFCNALEYGLPPTAGWGCGIDRLAMFLTDSNTIREVLLFPTLKPDALVKGEETSDN

SEQ ID NO: 32484 - DNA, 1761 bp, Oryza sativa (japonica cultivar-group)
  CDS (1)..(1761)
atggaggcgctgcgggcgtggagggcttcctccaatctcctcggcttcgcggcctctcgcgccgccaaggccgccccagcggcgaggcccctccgcccccacgtccgctgctgctccccggccgccgcctccaccacgaagccgcccccgcccccacctcaggaccgccgccgccgaagcgcctcctcgtcctcgtcctccacctccgaccgcgaatccatccgcgccattcgcctcaaaaaggttgaggagctgagagggaagggctacgagccgtacgcgtacaagtgggacaggactcacactaccaaggagcttcaggatgggtacacccatctcgagaatggcgaggtctgcgcggacgtggcggtgtccattgctgggaggattgtcgcccgaagagcgtttggaaagcttgtttttatgaccgtaagagacgattccgggactattcagctttactgtgagaaagacagccttactgaggaacagtttgaacaactgaagacaattattgatattggtgatataataggtgcaaatggttccataaagaagacagaaaaaggggaactatctgtttacgtgaaaaactttgaaatccttacaaaatccttactcccactacctgataagtaccatggcttaactgatgtggacaagcggtatcgccaaaggtatgttgacatgattgcaaatcctgaggttgctgatgtattccgaacaagagcaaaggctgtatctgaaatccgcaagacaatggaatcatttggcttcatagaagttgaaacgccagttctacagggagcagcaggtggtgctgaagcaagaccatttataacccaccataactcactgcaaagagatctttacttgaggattgcaacagagctgcatttgaaaaggatgctggttggagggcttgagaaagtttatgagattgggagaatatttcggaatgaaggcatttccactcgccataatcctgaatttaccacaattgagatgtatgaagcctattcagactatgaaagcatgatgaatttggctgaagaaattgttactagatgtgcaatggctactcatggcaaacttagggttgattatcagggaactgaaatctcccttgaaagaccatggaggagggaaaccatgcattctcttgtcaaagaagcaactggaattgactttaatagctttggagaagatcttgaatccgccaaaaatgctgcaagagggatcaaaacagagagcaatgagaatatctcattgcaagcttgttcatctgttggacatgttctcaatgaggtctttgagactgttgttgaatcaagtctggtacagccaacatttgttcttgactacccagttgagatatcaccattggccaaaccacataggaggtatgctggtcttaccgagcgatttgaacttttcatatgtggtcgtgagattggtaatgcattttctgagctcacagacccaattgatcagaggggtcgttttgaaaatcaaattaagcagcacaatgctaagcgtgctgcaatgaccaaggaggtcaaatctactgagggtaaacacgaggaagatgatttttcgtatgaagttaccttagatgaagacttcctgacttccctagagtacggaatgccacctgcttccggaatgggccttggaatcgaccgactagtaatgcttttgaccaactcggcgagtataagggatgttattgcctttccagtcctaaagattcaacaatag

SEQ ID NO: 32485 - protein, 586 aa, Oryza sativa (japonica cultivar-group)
MEALRAWRASSNLLGFAASRAAKAAPAARPLRPHVRCCSPAAASTTKPPPPPPQDRRRRSASSSSSSTSDRESIRAIRLKKVEELRGKGYEPYAYKWDRTHTTKELQDGYTHLENGEVCADVAVSIAGRIVARRAFGKLVFMTVRDDSGTIQLYCEKDSLTEEQFEQLKTIIDIGDIIGANGSIKKTEKGELSVYVKNFEILTKSLLPLPDKYHGLTDVDKRYRQRYVDMIANPEVADVFRTRAKAVSEIRKTMESFGFIEVETPVLQGAAGGAEARPFITHHNSLQRDLYLRIATELHLKRMLVGGLEKVYEIGRIFRNEGISTRHNPEFTTIEMYEAYSDYESMMNLAEEIVTRCAMATHGKLRVDYQGTEISLERPWRRETMHSLVKEATGIDFNSFGEDLESAKNAARGIKTESNENISLQACSSVGHVLNEVFETVVESSLVQPTFVLDYPVEISPLAKPHRRYAGLTERFELFICGREIGNAFSELTDPIDQRGRFENQIKQHNAKRAAMTKEVKSTEGKHEEDDFSYEVTLDEDFLTSLEYGMPPASGMGLGIDRLVMLLTNSASIRDVIAFPVLKIQQ

SEQ ID NO: 32486 - DNA, 1749 bp, Yarrowia lipolytica CLIB99
  CDS (1)..(1749)
atgtctgatattaaggaaactaccgaggctctggccaagacctatctcgacgaggagaccggcgagcaggtctccaagtccgaactcaagaagcgacagaagcttcgagatctggcccgaaagaaggccgagaaggctgccgcccagcccaagaccgagaagaaggagaagggccccaacgaggaggagctgacccccaaccagtactttgagatccgatctcgacagattgatgctctgcgacagtccaagactcccaacccttacccccacaagttcaacgtcactaccaaggtggacgagtttgtggagaagtacaagggtcttgctcgaggagagatcaagaaggacgaggaggtttctgttgctggccgagtgcacaccctgcgagctgctggctctaagctgcgattctacgttctccaccaggagggcaagaccgtgcagatcatggcccagggccaggacaatgagggtgactggggtatccatgatctgatccgacgaggagatgtcattggtatccgaggttaccccggccgaaccgagcccaagaagggtggtgagggtgagctttccgtcttttgcaaggagctcgtgctgctgaccccctctctgcatatgctgcctacccaccagtctggctttaaggacgttgagacccgattccgacagcgataccttgatctgatcatgaacgactccacccgagagcgattcattgtgcgatccaagatcatccagtacatccgaaagttcctggacaacaaggacttcattgaggtcgagacccccatgatgaacatcattgccggaggagccaccgccaagcctttcgtcacccaccacaacgacctcaacctcgacatgtacatgcgaatcgcccccgagctgtacctgaagcagcttgtggttggaggtatggagcgagtctacgagattggccgacagttccgaaacgagggcattgatcagacccataaccccgagttcacaacctgtgagttctacgaggcctatgccgacgtctacgacctcatggagaccaccgagctgctcttctccgagatggtcaaggagatcaccggaggatacaaaattgagtaccagccccagggccccgagggcgagactctcaccattgacttctctcgaccctggaagcgactcgacattatcggcactcttgaggagaagctgggtgtcaagttccctcctggagatcagctgcacaccgctgagaccaaccagttcctgcaggagcagctcaagaaggtcggtcttgtctgcactcctcctcttaccaatgcccgaatgctggacaagctgattggcgactacctggaggacacctgtatcaaccccaccttcctgtacggccatcctgagatgatgtctcctctggccaagtactctcgagaccgacccggtatctgtgagcgattcgaggtctttgtggccaccaaggagatctgtaacgcctacaccgagttgaacgatccctttgaccagcgacagcgattcgaggagcaggctcgacagaaggacgccggtgacgatgaggctcagcttgttgacgagaccttctgcaccgcccttgagtacggtctgccccctactgccggatggggttgtggtgttgatcgactcaccatgttcctgaccaactccaacactatcaaggaggttcttctgttccccgccatgaagcctgaacagacctccgataagaaggagcagcaggagtag

SEQ ID NO: 32487 - protein, 582 aa, Yarrowia lipolytica CLIB99
MSDIKETTEALAKTYLDEETGEQVSKSELKKRQKLRDLARKKAEKAAAQPKTEKKEKGPNEEELTPNQYFEIRSRQIDALRQSKTPNPYPHKFNVTTKVDEFVEKYKGLARGEIKKDEEVSVAGRVHTLRAAGSKLRFYVLHQEGKTVQIMAQGQDNEGDWGIHDLIRRGDVIGIRGYPGRTEPKKGGEGELSVFCKELVLLTPSLHMLPTHQSGFKDVETRFRQRYLDLIMNDSTRERFIVRSKIIQYIRKFLDNKDFIEVETPMMNIIAGGATAKPFVTHHNDLNLDMYMRIAPELYLKQLVVGGMERVYEIGRQFRNEGIDQTHNPEFTTCEFYEAYADVYDLMETTELLFSEMVKEITGGYKIEYQPQGPEGETLTIDFSRPWKRLDIIGTLEEKLGVKFPPGDQLHTAETNQFLQEQLKKVGLVCTPPLTNARMLDKLIGDYLEDTCINPTFLYGHPEMMSPLAKYSRDRPGICERFEVFVATKEICNAYTELNDPFDQRQRFEEQARQKDAGDDEAQLVDETFCTALEYGLPPTAGWGCGVDRLTMFLTNSNTIKEVLLFPAMKPEQTSDKKEQQE

SEQ ID NO: 32488 - DNA, 1488 bp, Leptospira interrogans serovar Copenhageni str. Fiocruz L1-130
  CDS (1)..(1488)
atgtcagaatcaaatgaactcattgaacaaagaattcagaaaatcgaagaattaaaaaaacagggaatcaatccctacccggttcgttttttcccggattccaaatcgaaagacatagccgaaaagttcgaaaaaaatccgactggtccagaaaccaaatttaagttaggcggaagactacattccaaaagagtaatggggaaagcgagttttgctcatctcaaagacaactccggaatcatacaactttatgctactaaagacgatttaggtgaaactcaatactccatttttaaatcccttgatttgggagatattatcggtttggaaggatatctttttaaaacccaaaaaggagagattacgttacacgtcacatcggtggaactgctctcaaaatgtatccgccctcttcccgtagtaaaagaaaaagacggggttgtctacgatgcgtttgccgacgtagaacaaagatatagaatgcgttatgtggacttaatagtaaacgatcacgttagagatacatttattacaagaagtaaaatcgtttctgaaattagaagttttctgactcaagaaggatttttagaagtggaaacacctatgatgcaaccgattgcgggaggtgctgctgcaagaccgtttgtcactcatcataatactctggatatgcaattatttctaagaatcgctccagaactttatctcaaacgtttgatcgttggcggaatggatcgagtttttgaactcaaccgaaattttagaaacgaaggaatctctacaaaacacaatcctgaatttacgatgatggaagcttatatggcatttggagatatgagtacgatgctcgatcttacggaaagactcattactcacctggcccaaaaaatttgtggaactttaaaaattcaatacggcaaggatttaatcgatctttctcctccttggaaaagaactacttatgtggatattatcaaagaatacagtggaattgattttagtcagattatttctctggaagaagccaagaaaaaagcttcggaattaaaagtagacgtttccaaatgccaaacaatttggaaagtagcggatgaagttttttccgaaaaagcagaaccaaatctgattcaaccgatctttatcaccgattatccgaaagaactttctcctcttgcaaaatctaacccagataaacctggttatgtggaaagattcgaaccatacgtagccggaagagaaatcggaaacgcctttaccgagttaaatgatccttttgatcaaaaagaaagatttgaagatcaggtaaaacaaagagaggctggagacgacgaagcgtttatgatggacgaggattacatacgagctttggaatatggaatgcctcctaccggcgggctcggaattggaatcgatcgtctggtaatgcttttgacgaattctcattcgattcgagataccattttatttccgttgatgagaccagaataa

SEQ ID NO: 32489 - protein, 495 aa, Leptospira interrogans serovar Copenhageni str. Fiocruz L1-130
MSESNELIEQRIQKIEELKKQGINPYPVRFFPDSKSKDIAEKFEKNPTGPETKFKLGGRLHSKRVMGKASFAHLKDNSGIIQLYATKDDLGETQYSIFKSLDLGDIIGLEGYLFKTQKGEITLHVTSVELLSKCIRPLPVVKEKDGVVYDAFADVEQRYRMRYVDLIVNDHVRDTFITRSKIVSEIRSFLTQEGFLEVETPMMQPIAGGAAARPFVTHHNTLDMQLFLRIAPELYLKRLIVGGMDRVFELNRNFRNEGISTKHNPEFTMMEAYMAFGDMSTMLDLTERLITHLAQKICGTLKIQYGKDLIDLSPPWKRTTYVDIIKEYSGIDFSQIISLEEAKKKASELKVDVSKCQTIWKVADEVFSEKAEPNLIQPIFITDYPKELSPLAKSNPDKPGYVERFEPYVAGREIGNAFTELNDPFDQKERFEDQVKQREAGDDEAFMMDEDYIRALEYGMPPTGGLGIGIDRLVMLLTNSHSIRDTILFPLMRPE

SEQ ID NO: 32490 - DNA, 1590 bp, Parachlamydia sp. UWE25
  CDS (1)..(1590)
atgagttttatgacaaaaaaacctgattatcaccaacatgaagaataccaaaatcgcttacgtaaacttgttgaaatacgtcaatgcaagatagatccttatcccgctaaatatacaccaactcatacagcagaatctcttcatcaagaatacgatacaaaacaaattggacatagtgaagatgcagcttcaggatccacaccttttgtttgtttggctggccgtcttgtcctttttcgttccatgggaaaaaatgcctttggtcatctacaagatgaaacaggacgcatacaaatcatgtttaatcgggaccaaacgctagtcacgaactttgaacctagttctgaagaacccgaattatctccatataaatttatcgaaaaaaaaatcgatctcggagatatcattggagttgaaggctacttattccatactcaaaaaggagaactaactgtttttgtcaaacagctgactcttctttgtaaaactctacttccgcttgccgataaacatggtggactggctgataaagaattgcgttatcgtaaacgttggttagatttgatttcccatttagatgtagctaaagtttttcgtatccgtagtcatatcttgaaagaaatccgatcttactttgaccagtatcaattcctagaagtagaaacaccaatcctacaaagcatttatggaggagcagaagcccgcccctttatcacaaaattaaatgcgctggatcaagaaatgtttttacgcatttctttagaaattcctcttaaaaagttaattgtaggagggatgcataaagtttatgaaatggcacgtgtatttcgtaatgaaggcattgatcgcaatcataatcctgaatttaccttgttagaagcttatgcttcctattgggattatttcgatatgatgaactttgtggaaaatcttttcgaaaagcttgctctagacctctatggaaccacgaaagttccttatacagcacatgaaggagctgaaacaatttatatcgatatgaaagctccttggattcgattgactatgaaagaaagcattaaaaaatatgctaatctcgatcctaatgttttatctgatgaagagatgcgacatttattgctcgagagtgcacattgtgatcctaaaaaaattaaaggattgagtcgcggacttctgattgcggctttatttgaggtttttgtagaacctcatttaattcaaccccaccacatttacgaccatcccattgagacaacgcctctttgtaaaccacatcgtgatcttaaataccgcgaagaaggacttgttgaacgttttgaaagttttattttaacacaagaagtgtgcaattcttacagcgaattgaacgatcctgaaattcaacgtcatttgcttgagctacagtcagatcgccgtgaagctggtgatgaagaagctagtcccttggatgaagaatttattgaagcgatttgccaaggtatgcctcccacagggggaattggaattggaattgaccgactggtaatgatattaactaattctcattcgattcgggatgtcctttattttccttggatgaaaacaatttaa

SEQ ID NO: 32491 - protein, 529 aa, Parachlamydia sp. UWE25
MSFMTKKPDYHQHEEYQNRLRKLVEIRQCKIDPYPAKYTPTHTAESLHQEYDTKQIGHSEDAASGSTPFVCLAGRLVLFRSMGKNAFGHLQDETGRIQIMFNRDQTLVTNFEPSSEEPELSPYKFIEKKIDLGDIIGVEGYLFHTQKGELTVFVKQLTLLCKTLLPLADKHGGLADKELRYRKRWLDLISHLDVAKVFRIRSHILKEIRSYFDQYQFLEVETPILQSIYGGAEARPFITKLNALDQEMFLRISLEIPLKKLIVGGMHKVYEMARVFRNEGIDRNHNPEFTLLEAYASYWDYFDMMNFVENLFEKLALDLYGTTKVPYTAHEGAETIYIDMKAPWIRLTMKESIKKYANLDPNVLSDEEMRHLLLESAHCDPKKIKGLSRGLLIAALFEVFVEPHLIQPHHIYDHPIETTPLCKPHRDLKYREEGLVERFESFILTQEVCNSYSELNDPEIQRHLLELQSDRREAGDEEASPLDEEFIEAICQGMPPTGGIGIGIDRLVMILTNSHSIRDVLYFPWMKTI

SEQ ID NO: 32492 - DNA, 1506 bp, Desulfovibrio vulgaris subsp. vulgaris str. Hildenborough
  CDS (1)..(1506)
atgctcgaaagcctcgaagcccgcgacgagcttaacgaggtggtgaagaaccgcgtcgtgaagacgtgcgaacttctcgacgccggagtgtcggcctacccgaacggtttcatcaagaagcacgacatcgcaccggtacttgccgagtacgaggggctcgatgctgatgagctcgaaacggtggacgccgccttcacgatggcggggcgcatcgtttcgcaccgttcgttcggcaaggtggccttcttccatataatggatcgcacggggcgcatgcagtgctatgccgcgcgtgaggaactgggcgaagaagcctacaagaccttcaagaagctcgacatcggcgatatcgtcggcgtgagcggaaggctctttcgcaccaagacgggcgagctcacgctctcctgtaccgaggtgcgcctgctgaccaagtccatccggcccctccccgagaagtatcacggcctcaaggacgtggaaatccgctatcgccagcgctacgtcgacctcatcgtcacgccgcgggcccgcgacatcttccgcaagcgcacgatcatcgtccgtgagttcaggcgcttcctcgaagcccgcggtttcatggaagtcgagacgccgatgatgcaggccatccccggcggcgccacggcaaagccgttcgtcaccttccacaacgcgctggatatgcagctctacatgcgcatcgcgcccgagctctatctgaaacgcctgctcgtgggcggtttcgagaaggtcttcgagatcaaccgcaacttccgcaacgagggcatatccacccagcacaaccctgaattcaccatgtgtgagttctactgggcctatgccacgttcgaagacctgatggacctcaccgaggagctgttctcgcacatcgcgcgcgaggtctgtggctcttcggtcatcacctatcaggggcaggaggtcgacctcacgcccggcaagtgggtgcgtctgaccttccacgagtcgcttgagaaggtgggtgggcattcccccgagttctacaacgactacgagaaggttcgtgcctacgtgcgtgagcgtggcgagaaggtgcttcagggcgagaagctgggcaagctacaggccaagctgttcgacctcgacgtggaaccccggctcatccagcccacgttcatctaccactacccgaccgacatctcgcccctgtcgcgcaggaacgagcagaacccggacgtcaccgaccgtttcgaactgttcatcaccgggcgcgaactcgccaacgccttctctgaattgaacgaccccgtcgaccagcgcatgcgcttcgaggaccaggtcaaggagaaggaggctggtgacgacgaggcgcatttcatggacgaggactacctgcgcgcgctcgaatacggtatgccgcccgcggctgggcagggcgtgggtatcgaccgcctcgtcatgctgctgaccgactcgccctccatccgcgaggtcatcctctttccgctgctgaagccggagagctga

SEQ ID NO: 32493 - protein, 501 aa, Desulfovibrio vulgaris subsp. vulgaris str. Hildenborough
MLESLEARDELNEVVKNRVVKTCELLDAGVSAYPNGFIKKHDIAPVLAEYEGLDADELETVDAAFTMAGRIVSHRSFGKVAFFHIMDRTGRMQCYAAREELGEEAYKTFKKLDIGDIVGVSGRLFRTKTGELTLSCTEVRLLTKSIRPLPEKYHGLKDVEIRYRQRYVDLIVTPRARDIFRKRTIIVREFRRFLEARGFMEVETPMMQAIPGGATAKPFVTFHNALDMQLYMRIAPELYLKRLLVGGFEKVFEINRNFRNEGISTQHNPEFTMCEFYWAYATFEDLMDLTEELFSHIAREVCGSSVITYQGQEVDLTPGKWVRLTFHESLEKVGGHSPEFYNDYEKVRAYVRERGEKVLQGEKLGKLQAKLFDLDVEPRLIQPTFIYHYPTDISPLSRRNEQNPDVTDRFELFITGRELANAFSELNDPVDQRMRFEDQVKEKEAGDDEAHFMDEDYLRALEYGMPPAAGQGVGIDRLVMLLTDSPSIREVILFPLLKPES

SEQ ID NO: 32494 - DNA, 1518 bp, Erwinia carotovora subsp. atroseptica SCRI1043
  CDS (1)..(1518)
atggctgaatcacaatcacagggtgccgatcaggcgcaagatctgaataatgaattaaaagcgcgtcgtgaaaagctggtgacgctgcgtgaaaacgggatcgcattcccgaatgatttccgccgtgacagcatctccgatcacttgcacgctgagttcgatgccaaagagaacgaagagctggaagaactgggtatcgaagtgaccgttgcgggccgtatgatgacccgtcgcatcatgggtaaagcctctttcgtaaccttgcaggacgtcggtggccgcattcagctgtatgtttcccgcgacgatctggcggaaggcatctataacgagcagttcaagaaatgggatctgggcgatatcctgggtgcgcgcggcaagctgttcaaaaccaaaacgggcgagctgtccattcactgtaccgagctgcgtctgctgaccaaagcgctgcgcccgctgccggataaattccacggtctggccgatcaggaaacccgctatcgtcagcgctatctggatctgatcgctaacgacgactctcgtaataccttccgcatccgttctaacgtgatggcggccattcgccgcttcatggtggataacggctttatggaagtggaaacgccgatgatgcaggtgatccccggcggcgcgtctgctcgtccgtttatcacgcaccataacgcgctggacattgacatgtacctgcgtattgcaccggaactgtatctgaagcgtctggttgtaggtggttttgagcgtgtgttcgagattaaccgtaacttccgtaacgaaggtgtttccccacgtcacaaccctgaattcaccatgatggaactttatatggcgtatgccgattataaagacctgattgtgttgacggaaaacctgttccgtacgctgacgcaggacgtgctgggctcgacgacggtggtgtacggcgatcagacattcgacttcggtaagccgtttgataagctgacgatgcgcgaagcgatctgtaaataccgtcctgaaaccaacgttgccgatctggacgatctggagaaagcgaccgcgatcgcactgtctctgggcatcaagatcgagaaaagctggggcttgggacgcatcgttaccgagatcttcgaagagacagcagaaagcagcctgatccaaccaaccttcatcaccgaatatccggctgaagtgtcgccgctggcgcgtcgtaacgatcagaactcggaaatcaccgatcgctttgagttcttcatcggcggtcgtgaaattggcaacggtttctccgagctgaatgatgccgaagatcaagcagagcgttttgctcagcaggtcaatgctaaagatgcgggcgatgacgaagcgatgttctacgacgaagactacgtgacggcgttggagcacggtttgccgccgacagcgggtctgggtattggtatcgaccgtatggtgatgttgttcacgaacagccacaccattcgcgacgtcatcctgttcccagcgatgcgtccgcagaaataa

SEQ ID NO: 32495 - protein, 505 aa, Erwinia carotovora subsp. atroseptica SCRI1043
MAESQSQGADQAQDLNNELKARREKLVTLRENGIAFPNDFRRDSISDHLHAEFDAKENEELEELGIEVTVAGRMMTRRIMGKASFVTLQDVGGRIQLYVSRDDLAEGIYNEQFKKWDLGDILGARGKLFKTKTGELSIHCTELRLLTKALRPLPDKFHGLADQETRYRQRYLDLIANDDSRNTFRIRSNVMAAIRRFMVDNGFMEVETPMMQVIPGGASARPFITHHNALDIDMYLRIAPELYLKRLVVGGFERVFEINRNFRNEGVSPRHNPEFTMMELYMAYADYKDLIVLTENLFRTLTQDVLGSTTVVYGDQTFDFGKPFDKLTMREAICKYRPETNVADLDDLEKATAIALSLGIKIEKSWGLGRIVTEIFEETAESSLIQPTFITEYPAEVSPLARRNDQNSEITDRFEFFIGGREIGNGFSELNDAEDQAERFAQQVNAKDAGDDEAMFYDEDYVTALEHGLPPTAGLGIGIDRMVMLFTNSHTIRDVILFPAMRPQK

SEQ ID NO: 32496 - DNA, 1500 bp, Mesoplasma florum L1
  CDS (1)..(1500)
atgtcagaaagaaaatttactgaacaagaattagttcgtagagctaaacttgaaaaattaattgaaaacaaatctaatccttatgaagttagcaagtatgtaagaacacattctttaaaagaattgattgaattatttggtggatatgaaaaagatgagttagcaactttacaacaaacagaaattagcattgcaggaagaattaaactttatcgtgaggctggtaataaagcagcattcttaaatattgaagatcaagattcagatattcaagtttatgtaagacaagacgaaattggtgatgcagcatttgctaacttcagagaactagatcttggagatattgttgggtttaaaggaattatgatgaaaacaaaccatggtgaactttcactaagagcaaaagaatatactttattatcaaaagctttaagacctttaccagataaacatgctggtattcaagacattgaagaaaaatacagaagaagatatgttgacttaatcacaaaccctgaatcaaaaagagtttttcaagcaagaactaaaattattagaacaatgcaacaaattcttgatgaacgtgggtatatggaagttgaaacacctattttgcacagtgtaaaaggtggagccgctgctaaaccttttattacacattacaatgctttagatgttgatgtatatttaagaattgcaacagagctacatttaaaaagattaattgttggtggatttgatggagtttatgaaattggaagaatctttagaaatgaaggaatgagcacaagacacaatccagaatttacttctttagaattgtatgttgcatatgaagatatgttcttcttaatggacttaactgaagaaatattcagaaaatgtaatgctgcagttaacgaatcatcagttatagaatatggtggacataaactagatttatcaaaaccatttaaacgcttacatatggttgatggaattaaacaagtgacaggagtagatttctgaaaagaaatgactgttgaagaagctctagagttagctaaaaaacataatgtgcatgttgaaaaacataattatacagttggacatattattaacttattctatgaagaatttgttgagtctacaattattgaaccaacttttgtttatggacatccaaaagaaatatcacctttatctaaatcgaatgctgaagattcaagattcactgatcgttttgagttgtttattgtcggaagagaatatgcaaatgcatttagtgaattaaatgatccaatcgatcaatatgatagatttaatgaacaaataaaagaagctgcggcgggaaatgatgaagcaactgaaatggacattgactttattgaagcgttggaacacgcaatgccaccaactgcaggtatcggatttggaattgatcgtttagttatgttattaacaaattctgaatcaattaaggatgtattattattcccacagttaaaaccaagagattaa

SEQ ID NO: 32497 - protein, 499 aa, Mesoplasma florum L1
MSERKFTEQELVRRAKLEKLIENKSNPYEVSKYVRTHSLKELIELFGGYEKDELATLQQTEISIAGRIKLYREAGNKAAFLNIEDQDSDIQVYVRQDEIGDAAFANFRELDLGDIVGFKGIMMKTNHGELSLRAKEYTLLSKALRPLPDKHAGIQDIEEKYRRRYVDLITNPESKRVFQARTKIIRTMQQILDERGYMEVETPILHSVKGGAAAKPFITHYNALDVDVYLRIATELHLKRLIVGGFDGVYEIGRIFRNEGMSTRHNPEFTSLELYVAYEDMFFLMDLTEEIFRKCNAAVNESSVIEYGGHKLDLSKPFKRLHMVDGIKQVTGVDFWKEMTVEEALELAKKHNVHVEKHNYTVGHIINLFYEEFVESTIIEPTFVYGHPKEISPLSKSNAEDSRFTDRFELFIVGREYANAFSELNDPIDQYDRFNEQIKEAAAGNDEATEMDIDFIEALEHAMPPTAGIGFGIDRLVMLLTNSESIKDVLLFPQLKPRD

SEQ ID NO: 32498 - DNA, 1533 bp, Propionibacterium acnes KPA171202
  CDS (1)..(1533)
gtgagttctgacactgcatccagccagtcccctgacgtctccgagcagatgcaggtccgcctcgacaagcgggcccggatcatcgctgacggaggccaggcttatccggtcgatttgctacgcgaccacaccctggtccaggttcgtcagaaatacaccgacgacaccggggagctgaccttggcgcctggcgaggagaccaccgatgaggtcaccgtcggcggacgtgtcgtctttgtccgcaataccggcaaactgtgtttcgccagcttgcaggacgggtttaccgagacttccaacggtgagcggttgcagatcatgctttccaaagccgaggtgggcgatgagtccttggctgcgtggaagtccgacgttgacctgggtgaccacgtctgggtgcgtggccgagtcgtcgtctctcgtcgtggtgagttatccatcatggctgctgagtggcggatggcctccaaggctctgcgtccgctgccgaccctccataaggagctctcggaggagagccgggtgcgtcgtcgctacgcggatctcgtcgttcgtgaagagtctcgccagatggtgcgcacccgcgccgttatcacccgcgcggtgcgtcgcgccctcgacgagcgcggtttccttgagatcgagactccgatcctgcagttggtccacggtggtgccgcagcccgcccgtttaatacccacctcaatgccttcgacattgacatgagtttgcgtatcgctcttgagctctatctcaagcggacgatggtcggcggcaccgatcgggtctacgagatgggtcgggtcttccgcaacgagggtattgattccagccactcggccgagttctctatgctcgaggcctacatgagctggggcaaccaattcactattgctgaggtgatcaaggacatcatcatggcggtggccgacgccctcgacgtccatcagattgagacccccaagggcactatcgacctcgacgggcagtggcgttgggtcagcgtctacccaggcctgtcggaaaaactagggcgtgaagtcacccttgacaccccgttggaggagttgcagtccatcgccgctgagcacgagattgagatcgaccagtcttgggaggccggcaaggtcgttatggagcttttcggtgaactcgtcgagccgggccttatcaaccccaccttcgtctgtgattacccggctatcgcccagccgctggcccgtccgcaccgcgacgatcctcgcatggttgaggcctgggacctcatcattggcgggatggagcgcggtactggcttctccgagctcgtcgacccagtcatccagcgcgaagtgcttaccaagcaatccctcgctgctgccgcgggtgaccctgaggcgatgcagcttgacgaggacttcctcgaggccctggaattcggctgcccgcccatgggtggtctggggctgggtgtcgaccggctggtgatgctctttaccaacgctgggatccgcgagacgatcctcttcccgctgctcaagccggaacactga

SEQ ID NO: 32499 - protein, 510 aa, Propionibacterium acnes KPA171202
MSSDTASSQSPDVSEQMQVRLDKRARIIADGGQAYPVDLLRDHTLVQVRQKYTDDTGELTLAPGEETTDEVTVGGRVVFVRNTGKLCFASLQDGFTETSNGERLQIMLSKAEVGDESLAAWKSDVDLGDHVWVRGRVVVSRRGELSIMAAEWRMASKALRPLPTLHKELSEESRVRRRYADLVVREESRQMVRTRAVITRAVRRALDERGFLEIETPILQLVHGGAAARPFNTHLNAFDIDMSLRIALELYLKRTMVGGTDRVYEMGRVFRNEGIDSSHSAEFSMLEAYMSWGNQFTIAEVIKDIIMAVADALDVHQIETPKGTIDLDGQWRWVSVYPGLSEKLGREVTLDTPLEELQSIAAEHEIEIDQSWEAGKVVMELFGELVEPGLINPTFVCDYPAIAQPLARPHRDDPRMVEAWDLIIGGMERGTGFSELVDPVIQREVLTKQSLAAAAGDPEAMQLDEDFLEALEFGCPPMGGLGLGVDRLVMLFTNAGIRETILFPLLKPEH

SEQ ID NO: 32500 - DNA, 1515 bp, Leifsonia xyli subsp. xyli str. CTCB07
  CDS (1)..(1515)
atgaccgatacgccgacggaaacccctgagctcaccgacgaggagatcagcgagcagaaggccgtccggctcggcaagcgcgagcggctcatcgccggtgccggcgacctcggtggcggtgcgtacccggtacggctcccggtgacgacgacgattccggaggtacgcgagaagtgggggcacctcgccgcggacgaggtctctgcggagaccgtgggtgtcgcgggtcgcgtcgtcttcctccggaacaccggcaagctgtgcttcgctgtgcttcagtcgggagacggttcgcgcattcaggcgatggtgtcgctggccgaggtcggcgaggagtcgctggcgcgctggaaggagttcgtggacctgggcgatcatgtcttcgtctcgggcgaggtcatctccagccgtcgtggcgagctgtcgatcatggccgtgggctggcagatcgcctcgaaggcgatcctcccgctcccgaacctccacaatgagctgagcgaagagacgcgcgttcgctcccgttacctcgacctgatcgcgcgcgatcgagcccgccggaacgtcctcgatcgcgccgccgccgtggcgagcctccgcacgaccttcgccgacagcggttttatcgaggtcgagaccccgatgctgcaggtcatgcacggcggtgcctcggcccgtccgttcgtgacccactcgaacgccttcgacacggagctctttctccgcatcgcgccggagctctacctcaagcgcgccgtcgtcggcggcatcgaccgggtgttcgagatcaaccgtaacttccgcaacgagggagcggattccacgcacttgccggagttcgccatgcttgaggcgtaccaggcgtacggcgactacaacaccatcgccgacctgacgcaggcgctcatccagaacgcggcggtcgccgtctccggttcgcatgtcgtcacctgggcagacgggaccgagtacgacctcagcggcgactgggaccgcatccggatgtacgacagcctctcggaggcgctcggcgaggagatcaccccggagaccccgctgcagcggctgcgcgagcttgcggccgaggccggtgtcgagatcgagcacccactgcccggcaagtacgtggaggaactctgggagcatcatgtcaagagcgggctcgtccgcccgacgtttgtcatggacttccctgtggacaccagcccgctcgtgcgtgtacaccgttcgctcccgggcgttgtcgagaagtgggacctctacatgcgcggcttcgagctggctaccggctactcggaactggtggatccggtcgtccagcgcgaacgctttgtcgagcaggcgcgattggccgctgcgggcgacgacgaggcgatgcgcctggacgaggagttccttcgcgcgctcgagttcgggatgccgcccaccggcgggatgggaatgggcatcgaccgcttgctgatggccctgaccggcctcggcattcgtgagaccatcctgttcccgctcgtcaagtag

SEQ ID NO: 32501 - protein, 504 aa, Leifsonia xyli subsp. xyli str. CTCB07
MTDTPTETPELTDEEISEQKAVRLGKRERLIAGAGDLGGGAYPVRLPVTTTIPEVREKWGHLAADEVSAETVGVAGRVVFLRNTGKLCFAVLQSGDGSRIQAMVSLAEVGEESLARWKEFVDLGDHVFVSGEVISSRRGELSIMAVGWQIASKAILPLPNLHNELSEETRVRSRYLDLIARDRARRNVLDRAAAVASLRTTFADSGFIEVETPMLQVMHGGASARPFVTHSNAFDTELFLRIAPELYLKRAVVGGIDRVFEINRNFRNEGADSTHLPEFAMLEAYQAYGDYNTIADLTQALIQNAAVAVSGSHVVTWADGTEYDLSGDWDRIRMYDSLSEALGEEITPETPLQRLRELAAEAGVEIEHPLPGKYVEELWEHHVKSGLVRPTFVMDFPVDTSPLVRVHRSLPGVVEKWDLYMRGFELATGYSELVDPVVQRERFVEQARLAAAGDDEAMRLDEEFLRALEFGMPPTGGMGMGIDRLLMALTGLGIRETILFPLVK

SEQ ID NO: 32502 - DNA, 1512 bp, Desulfotalea psychrophila LSv54
  CDS (1)..(1512)
atgagcacagataataagacccttcaacaacgacgagaaaaagcagcagaacttgcagatctcggcgttaagctgtacgacaatacctttcatcccgcccacagtgtagcccaagttcttcccatgggagaatctctggtggcagagcagcacgacgaaagcacgacagagtattctgttgcgggccgggttatggccatgcgcaagtttggtaaggctgccttctttcaggtcatggacaagaccggccgtgttcagatctatatcaaaaaagatgtgatcggcgaagagatctttgctcaatttaaaaaatgggatatcggtgacattgttggtatcaagggtcacctctttaagaccaaggtgggcgaactctccatcgcagcgagtagcgtgcagatgatctccaaatccctccgccccctgcccgacaaatggcacggactgagcgatgtggagacccgttatcgtcaacgctatgttgacctcatcgttaccccggagagccgcgaagtcttccgcaaacgcggagagatcattcgtcatatccgtgatttcctcagcgaccgtggttttatggaagttgagactccgatgatgcaggctgttccaggtggtgccaccgccaagccctttaagacccatcacaatgcccttgatatggacctctacctacgggtagcacctgagctctatctcaagcgcctgcttgttggtggccttgagcgtgtatttgaaatcaatcgtaactttcgtaacgagggactctctacccgccataacccggaattcaccatgcttgaattctatcaggcctatgccacctacgaggatatgatggatatcaccgaagagatggtatctactgcctgtgaaaaggtgaatggttccatgcagatccaatatcaaggcaccgatgttaatctggcaccaccatggcaacgtatgaccatgcaggagtctctgaccaaggttgcaggcattgcccctgaaatcatggcagatgccgaggcaaccatcgccctggccaaagagaagggcatcagactcgaagagaccgcaggtcacggtaaggcgatgaccgaactcttcgaacttctggtggaagagaagcttatcgacccaacctttatcacctcctacccaacagaggtttctccacttgcccgccgtaacgacgaagacccaagcaccaccgatcgttttgagctcttcatcaccggtcgtgagttggccaatgccttcagtgagttgaacgatcccgtcgatcagtaccagcgttttgccaagcaaattgcagagcgtggcgatgacgaagagatccatccagagcttgatcacgactatatccgcgccctggaatacggcatgccttctgctgccggagagggtatcggcattgatcgcctgaccatgcttctgacagatagtccgtcaatcagagacgttatcttcttcccacatctcaaagccgagacaaagaagcaggacaaggaagtagaaaaaaaatag

SEQ ID NO: 32503 - protein, 503 aa, Desulfotalea psychrophila LSv54
MSTDNKTLQQRREKAAELADLGVKLYDNTFHPAHSVAQVLPMGESLVAEQHDESTTEYSVAGRVMAMRKFGKAAFFQVMDKTGRVQIYIKKDVIGEEIFAQFKKWDIGDIVGIKGHLFKTKVGELSIAASSVQMISKSLRPLPDKWHGLSDVETRYRQRYVDLIVTPESREVFRKRGEIIRHIRDFLSDRGFMEVETPMMQAVPGGATAKPFKTHHNALDMDLYLRVAPELYLKRLLVGGLERVFEINRNFRNEGLSTRHNPEFTMLEFYQAYATYEDMMDITEEMVSTACEKVNGSMQIQYQGTDVNLAPPWQRMTMQESLTKVAGIAPEIMADAEATIALAKEKGIRLEETAGHGKAMTELFELLVEEKLIDPTFITSYPTEVSPLARRNDEDPSTTDRFELFITGRELANAFSELNDPVDQYQRFAKQIAERGDDEEIHPELDHDYIRALEYGMPSAAGEGIGIDRLTMLLTDSPSIRDVIFFPHLKAETKKQDKEVEKK

SEQ ID NO: 32504 - DNA, 1488 bp, Symbiobacterium thermophilum IAM 14863
  CDS (1)..(1488)
atgctgtcccgagaggagcaactgcgggaggcgcgccgggccaagatgcgcaccctgcgggaagcgggggtcgatcccttcggcacccggttcggcgaccggcggctgatgggcgacctgcgccgccagtacggggaggcgtctgccgaggagctggacgccgcacggattcccgcgcgggtggcgggccgggtcgtcaccgtccggtcccacggcaagatcgggttcgcccacctgcaggatggctccggccggctgcagatctacctgcggcttccggagctgagcgaacgggagcgcctggtctgggagcacctcgacctgggcgacatcgtcggcgcggagggggtcctgatgcgcacccgcaccggcgagctgacggtgaaggtggagtcgctgaccatgctgaccaaggcgctcagaccgctgccggacaagcatgccgggttgcgggacgtggagctccgctaccgggagcgccacctggacctgctggtcaaccccgagagccgggccgtcttcgaggcgcggtcccgcatcgtcgccagcctgcgccgcacgctggacgagctgggcttcatcgaggtggagaccccggtgctggtgccgctggcgggcggagcggccgcccgccccttcctgacctaccacaacgccctggaccggcagctctccctccgcatcgccacggagctgcacctgaagcggctggtggtcggcggcatggagcgggtctacgagatcggccgggtcttccgcaatgaggggctctccacccggcacaacccggagttcacctcgctggaggcctatcaggcctacgcggactaccgggacatgatggacctcaccgagcggctggtgcagaacgcggcccgggccgtgaacggcagcctccgggccggggagatcgacctgaccggccccttccggcgcatcacgatggccgaggcggtgaaggaggccacgggcatcgacgtcatggccctcgggtcgtcgggggacgagcggagggacgcggaggcggtgcgggccgccgccgaggccgccggatacgaggtggaggctgcgacctggggcgggctgctggccgagctgttcgagcggtacgccgaggaccggctggttcagcccaccttcgtcctcgggcacccggtggagacgtccccgctggccaggcgcgacccccgcgatccacggctgaccgagcggttcgagctgtacgtgcaggggcgggagatcgccaacgcgttctcggagttgaacgacccggaggaccagcgccggcggttcgaggcgcagctggcgcagcggcaggcgggcgacgaggaggcgcacccgatggacgaggacttcctcgccgccctggaggtgggcctgccgccgacgggcggcctgggcatcggcgtggaccggctggtcatgctgctcaccggggcgccgtccattcgcgatgtcatcctgttcccgaccatgcggaaccggtag

SEQ ID NO: 32505 - protein, 495 aa, Symbiobacterium thermophilum IAM 14863
MLSREEQLREARRAKMRTLREAGVDPFGTRFGDRRLMGDLRRQYGEASAEELDAARIPARVAGRVVTVRSHGKIGFAHLQDGSGRLQIYLRLPELSERERLVWEHLDLGDIVGAEGVLMRTRTGELTVKVESLTMLTKALRPLPDKHAGLRDVELRYRERHLDLLVNPESRAVFEARSRIVASLRRTLDELGFIEVETPVLVPLAGGAAARPFLTYHNALDRQLSLRIATELHLKRLVVGGMERVYEIGRVFRNEGLSTRHNPEFTSLEAYQAYADYRDMMDLTERLVQNAARAVNGSLRAGEIDLTGPFRRITMAEAVKEATGIDVMALGSSGDERRDAEAVRAAAEAAGYEVEAATWGGLLAELFERYAEDRLVQPTFVLGHPVETSPLARRDPRDPRLTERFELYVQGREIANAFSELNDPEDQRRRFEAQLAQRQAGDEEAHPMDEDFLAALEVGLPPTGGLGIGVDRLVMLLTGAPSIRDVILFPTMRNR

SEQ ID NO: 32506 - DNA, 1512 bp, Mannheimia succiniciproducens MBEL55E
  CDS (1)..(1512)
atgtcagaacaacaaaatgcagaattagattttcacggtgaaatggcggtacgtcgcgaaaaattagcggccttacgtgcaaaaggtaacgcctttccgaacacatttcgccgtgatgcattagctcaggatttacataatcaatacgatgaaacggacggcgaacaattaaaagaaaaagatctgcatgttgccgttgccggtcgcattatgacccgtcgtaccatgggaaaagcgacttttataaccattcaggatatgagcggtaaaattcagctttatgtggctcgcgataaccttcctgaaggcgtctacggggaagatgtaaaaagctgggatttaggcgatattgtcgggatcaaaggtactttatttaaaaccaaaaccaacgaattaaccgtaaaagctcatgaagtgcaattattaaccaaagcgcttcgtccgttgccggataaattccacggtttgagcgatcaggaaacccgttatcgccaacgttatttagatttaatttctaacgaagaatcccgtcgtacttttgtgattcgctcaaaagttatcgccggtatccgcgaatacttcatcggtaaaggcttcatcgaagtagaaacaccgatgctgcaggtaattccgggcggcgcggcggcgcgtccgttcgtaactcaccacaacgctctggatatcgatatgtacctgcgtatcgcccccgaactttacttaaaacgcttagtggtgggcggctttgaacgggtattcgaattaaaccgtaacttccgcaacgaaggggtttccgtgcgccacaacccggaattcactatgatcgaatactatcaggcatacgcggattaccacgatttaatggataacaccgaagaattgttacgtaaattagcccttgatattttaggtaccaccattgtgccttacggcgaatatgaattcgatttcggcaaaccgttcgaacgtatcacaatgcatgatgcggtgattaaatacggcgcggaaaaaggtattgtaaaagaagatttatacgatttagaccgtgccaaagcggcagccgccaaattaggcattgaaatccaaaaatcctggggcttaggttcaatcgtcaatgccatttttgaagaagtggcggaacatcacctgattcaaccgacattcttaatggctcaccctgcggaaatttcgccgttggcgcgccgtaatgacgaaaacccggaagtaaccgatcgttttgaattattcatcggcggccgtgaaatcggtaacggtttctcggaattgaacgacgccgaagaccaagctgaacgtttcgacgcccaagtagcggcgaaagacgcaggcgacgatgaagccatgtttaaagatgacgacttcgtcaccgcactggaacacggcttaccgccgactgcgggcgaaggtttggggatcgaccgtttagcaatgctgttcgccaacgctccgtcaatccgcgatgtgattctattcccggcaatgaaacacaaagggtaa

SEQ ID NO: 32507 - protein, 503 aa, Mannheimia succiniciproducens MBEL55E
MSEQQNAELDFHGEMAVRREKLAALRAKGNAFPNTFRRDALAQDLHNQYDETDGEQLKEKDLHVAVAGRIMTRRTMGKATFITIQDMSGKIQLYVARDNLPEGVYGEDVKSWDLGDIVGIKGTLFKTKTNELTVKAHEVQLLTKALRPLPDKFHGLSDQETRYRQRYLDLISNEESRRTFVIRSKVIAGIREYFIGKGFIEVETPMLQVIPGGAAARPFVTHHNALDIDMYLRIAPELYLKRLVVGGFERVFELNRNFRNEGVSVRHNPEFTMIEYYQAYADYHDLMDNTEELLRKLALDILGTTIVPYGEYEFDFGKPFERITMHDAVIKYGAEKGIVKEDLYDLDRAKAAAAKLGIEIQKSWGLGSIVNAIFEEVAEHHLIQPTFLMAHPAEISPLARRNDENPEVTDRFELFIGGREIGNGFSELNDAEDQAERFDAQVAAKDAGDDEAMFKDDDFVTALEHGLPPTAGEGLGIDRLAMLFANAPSIRDVILFPAMKHKG

SEQ ID NO: 32508 - DNA, 1728 bp, Bacteroides fragilis YCH46
  CDS (1)..(1728)
atgaacatattagaactaagtgaacaggaaatcatccgacgtaacagtctgaatgaacttcgcgcgatgggcatcgaaccctatcccgcagcagagtatgtaaccaatgctttctcaactgatattaaagccgaattcaaagatgacgagacaccccgccaggtatccgtagccggtcgcatgatgagccgccgcataatgggtaaagcctctttcattgaattgcaggactctaaaggccgcatccaggtatatatcacccgtgatgacatctgcccgggagaagacaaggaaatgtacaacactgtgttcaaacgcctgctcgacttaggcgacttcatcggaatcgaaggcttcgtattccgcacacagatgggcgaaatcagtatccatgcacaaaagctgacggtactcgccaaatcgatcaaaccactgcctattgttaaatacaaagacggcgtaacttacgactcttttgaagatcctgaattgcgttaccgccagcgctatgtcgacctggctgtcaacgaaggcgttaaagatattttcatcaaacgcagcaaagtatacagttccatgcgcgaatacttcaactcaaagggatacatggaagtggaaactccgatcctgcaggccattgccggaggagcagccgcgcgtccgttcatgactcaccacaatgctttggatattcctttatacatgcgaatcgccagtgagctttacctgaaacgccttattgtcggcggttttgaaggtgtatacgagatcggtaaaaacttccgtaacgaaggtatggaccgtacacacaatccagaattcacctgtatggagatatatgtagcctacaaagactacaactggatgatggaatttactgaaaaaatgatcgaaaagatctgtctggacgtaaacggtactaccgaagtaaaagtaggcgacaacatcatcaatttcaaagcgccctataagcgtgtcactatgctgggagccatcaaagagcacaccggttacgatctgacaggaatgaatgaagagcagattcgcgaagtttgcaagaaactgaacatggaaatcgatgatacgatgggtaaaggtaaactgatcgatgagatcttcggtgagttctgcgaaggcacttatatacagcctacattcatcacggattacccgatcgagatgtctcctctgaccaagaagcatcgtgacaaccctgaactgacagaacgtttcgaattgatggtaaacggtaaagagttgtgtaacgcatattctgagttgaacgatccgatcgaccagttggaacgtttcgaagaccagatgaagctgagcgaaaagggagatgatgaagcgatgatcatcgataaggacttcgtccgtgcattggaatatggtatgcctcctacttcgggtatgggtatcggtatggaccgtctgactatgctgatgaccggtcagtcgaccattcaggaagtattgttcttcccgcagatgcgtccggagaaagtcgtaccgaaagacagtgcttccaaatttatggaactgggcattaccgaagagtgggtacctgtcatccagaaagcaggatacaatcaggtggccgacatgaaagaggttaatccgcagaaattccaccaggatatttgtggcatcaacaagaaatacaaattggaactgaccaatccgtcagttaacgatgtagccgagtggatacaaaaaattaaataa

SEQ ID NO: 32509 - protein, 575 aa, Bacteroides fragilis YCH46
MNILELSEQEIIRRNSLNELRAMGIEPYPAAEYVTNAFSTDIKAEFKDDETPRQVSVAGRMMSRRIMGKASFIELQDSKGRIQVYITRDDICPGEDKEMYNTVFKRLLDLGDFIGIEGFVFRTQMGEISIHAQKLTVLAKSIKPLPIVKYKDGVTYDSFEDPELRYRQRYVDLAVNEGVKDIFIKRSKVYSSMREYFNSKGYMEVETPILQAIAGGAAARPFMTHHNALDIPLYMRIASELYLKRLIVGGFEGVYEIGKNFRNEGMDRTHNPEFTCMEIYVAYKDYNWMMEFTEKMIEKICLDVNGTTEVKVGDNIINFKAPYKRVTMLGAIKEHTGYDLTGMNEEQIREVCKKLNMEIDDTMGKGKLIDEIFGEFCEGTYIQPTFITDYPIEMSPLTKKHRDNPELTERFELMVNGKELCNAYSELNDPIDQLERFEDQMKLSEKGDDEAMIIDKDFVRALEYGMPPTSGMGIGMDRLTMLMTGQSTIQEVLFFPQMRPEKVVPKDSASKFMELGITEEWVPVIQKAGYNQVADMKEVNPQKFHQDICGINKKYKLELTNPSVNDVAEWIQKIK

SEQ ID NO: 32510 - DNA, 1491 bp, Methylococcus capsulatus str. Bath
  CDS (1)..(1491)
atgagtgaactgcaagacgaaaacaaactggtcgcgctgcgccgcgaaaagctcggcaagctgcggcaaacaggggtcgctttcccaaatgacttccgccgcgacgccctcgccgccgaactacgggcacgctacggggacgaaacggccgaggcactggaagaaaccgccgtatcggtcaagctggccgggcggctgatgggcaagcgtatcatgggcaaagccagctttgcccatatccaggacatgtccggccgtatccagattttcctgcagcgcgatggactggccgaaggcgtgtacgaggagttcaagagttgggacatcggcgatgtgatcggcgtggaaggcacggtgttccgcaccaagaccggcgagctgtcggtgaaggcatcgaacatccgcctgctcaccaaatcactgcgtccgctgcccgagaaattccacggcctgaccgacgccgagacccgctaccgccagcgctacctcgacctcctcatgaacgaggagtcgcgccgggtattccagctccgcagcgccatcgtgcgctacatccgcgacttcttgagcgagcgtggcttcatcgaggcagagacgccgatgatgcaggtgatccccggcggcgcccgggccaaaccgttcgtcacccatcataatgcgctggggctggatctgtatctgcgcatcgctcccgagctctacctgaagcggctggtggtgggcggcttcgaaaaagtattcgagatcaaccgcagcttccgcaacgagggcttgtccactcggcacaatcccgaattcacgatgatcgagttctatcaggcctatgccgattaccgcgacctgatggatctgaccgaaacgctgatgcggggaatcgcgcagaacctgctgggcggcaccgtcgtcacccatcagggcaaggattacgatctgggccggccgttccggcgcatgacggtgctggaatcgatcatccactacaacccggacatccgggccgaagacttggccgagcgcgaaagcgccgcggccatcgcggccgggctgggcattccggttgccgccggcgacggactcggcaagatccagaccgaaatcttcgaaaagaccgtggaagaccggctggatgaaccaaccttcatcaccgcctatccggccgaagtctcgccgctggcgcggcgcaacgacgaaaaccccttcatcacagaccgcttcgagtttttcgtgggcgggcgcgagctggcgaacggcttttccgagctcaacgacccggaagaccaggcggaacggttcagaaagcaggtggaagacaaggccgcgggcgacgaggaggccatgcactacgatgccgactacatccgcgcgctcgaatacggcctaccgcccaccgcgggcgagggcatcggcatcgaccgcctggtgatgttcttcaccgactctccctcgatccgcgacgtcatcctgttcccgcacatgcggcccgaaagctga

SEQ ID NO: 32511 - protein, 496 aa, Methylococcus capsulatus str. Bath
MSELQDENKLVALRREKLGKLRQTGVAFPNDFRRDALAAELRARYGDETAEALEETAVSVKLAGRLMGKRIMGKASFAHIQDMSGRIQIFLQRDGLAEGVYEEFKSWDIGDVIGVEGTVFRTKTGELSVKASNIRLLTKSLRPLPEKFHGLTDAETRYRQRYLDLLMNEESRRVFQLRSAIVRYIRDFLSERGFIEAETPMMQVIPGGARAKPFVTHHNALGLDLYLRIAPELYLKRLVVGGFEKVFEINRSFRNEGLSTRHNPEFTMIEFYQAYADYRDLMDLTETLMRGIAQNLLGGTVVTHQGKDYDLGRPFRRMTVLESIIHYNPDIRAEDLAERESAAAIAAGLGIPVAAGDGLGKIQTEIFEKTVEDRLDEPTFITAYPAEVSPLARRNDENPFITDRFEFFVGGRELANGFSELNDPEDQAERFRKQVEDKAAGDEEAMHYDADYIRALEYGLPPTAGEGIGIDRLVMFFTDSPSIRDVILFPHMRPES

SEQ ID NO: 32512 - DNA, 1467 bp, Nocardia farcinica IFM 10152
  CDS (1)..(1467)
atgcggattcgccgggagaagcgcgagcggttgctcgaggcggggaccgaggcctacccggtggtcgtgccgcgcacgcacagcctggccgagatccgcgccgcccacccggacctggcgccggacacgcagaccggtcagcaggtcggcgtcgcgggccgcgtcatcttcctgcgcaacaccggcaaactgtgctttgccaccctgcaggagggtgacggcaccaagctgcaggcgatgatcagcctcaacggggtcggcgcggacgcgctggccgcctggaaagccgatgtcgacctgggcgacttcgtgttcgtgcacggcgaggtgatcgcttcgcgcaccggcgaattgagcgttatggccgattcctggtcgatggcggcgaaatcgctgcggccgttgccggtggcgcacaaggagatgaacgaggagtcccgggtccgtcagcgctacgtggacctcatcgtgcgcccggaggccaggcagatggccaggacccgggtggccgtcgtgcgtgccctgcgcaacgcgctggagcgccgcggattcctcgaggtcgagacgccgatgctgcagacgctgcacggtggtgcggccgcgcgcccgttcgtcacccattccaacgccctcgacatggacctctacctgcgcatcgcgccggagttgttcctgaagcgctgtgtggtgggcggactggagaaggtcttcgagatcaaccggaacttccgcaacgagggtgccgactccacccattcgccggagttcgcgatgctggaaacctatgaggcgtacggcacctacgacgactccgccacgatgatccgggaattgatccaggaggtggcacaggaggctttgggcacccaggtggtgaccctggccgacggcaccgaatacgatcttcgcggcgagtgggcgaccgtggagatgtatccgtcgctgtcggccgccctcggcgagccggtgactccggaaaccacggtcgaggaattgcgtgccatcgcagcgcgtgtcgggctggaaattccggaggagaaggggtacggccacggcaaactggtcgaagaactctgggaacaccagtacggcgacaagctgtatgccccgactttcgttcgcgacttcccggtggagacctctccgctcacccggcaacatcgcagcaagcccggcgtgaccgagaagtgggatctgtatgtgcgcggcttcgagctggccaccggttattccgaactggtcgacccggtgatccagcgcgagcggttcgtcgatcaggccagactcgcggcccagggggacgacgaggcaatggtcctggacgaggacttcctcgccgcgatggagcacggcatgccgccgaccaccggaaccggtatgggaatcgatcgcttgttgatggcgctcaccggtttgggaatccgggaaacgatactgttcccaattgtgcgtccggtcgctcgctga

SEQ ID NO: 32513 - protein, 488 aa, Nocardia farcinica IFM 10152
MRIRREKRERLLEAGTEAYPVVVPRTHSLAEIRAAHPDLAPDTQTGQQVGVAGRVIFLRNTGKLCFATLQEGDGTKLQAMISLNGVGADALAAWKADVDLGDFVFVHGEVIASRTGELSVMADSWSMAAKSLRPLPVAHKEMNEESRVRQRYVDLIVRPEARQMARTRVAVVRALRNALERRGFLEVETPMLQTLHGGAAARPFVTHSNALDMDLYLRIAPELFLKRCVVGGLEKVFEINRNFRNEGADSTHSPEFAMLETYEAYGTYDDSATMIRELIQEVAQEALGTQVVTLADGTEYDLRGEWATVEMYPSLSAALGEPVTPETTVEELRAIAARVGLEIPEEKGYGHGKLVEELWEHQYGDKLYAPTFVRDFPVETSPLTRQHRSKPGVTEKWDLYVRGFELATGYSELVDPVIQRERFVDQARLAAQGDDEAMVLDEDFLAAMEHGMPPTTGTGMGIDRLLMALTGLGIRETILFPIVRPVAR

SEQ ID NO: 32514 - DNA, 1491 bp, Legionella pneumophila str. Paris
  CDS (1)..(1491)
atgagtgaagaacatgtacatttagatgaaagtgaagtttatcatattcgcaaacaaaaattagcggaattgcgcacaagcgggtttaattttccaaatacctttcgccgcgaacatttagccgatgctttgctgaagcaatactccgaaactgaaaaacaaacattagaacaaaagcatgtgaaagtatctgttgcaggccgaatcgttctgagaagaattatgggtaaagccagtttttttcatattcaggatgtatcaggtcggatacaagtttatcttcgttcaaatgatcttcctgacgtttatgaacagtttaaacattgggatttaggagatattgttggtgtacagggtgagttatttaaaacaaacactggtgaactgaccattaatgcagaatatgttgagttattaaccaaatctttaaggccgcttcctgataaattccatggtttggctgatcaggaattgaaatatcgtaaacgttatgttgacttgattgcaaatgaagacagtcgaaaaacttttttaatacgttcacatttaatcaaagccttcagagaatttatggatgataatcattttctggaagtagaaacaccaatgatgcatccaattcctggaggtgctttggctcgtcctttcgtaactcatcacaatacattggatatgaccatgtatttgaggatagcccccgagttgtacttaaaacgcttggttgttggtggttttgagagagtatatgaaattaatagaaatttccgtaacgaaggaatttctactcgtcataatccagagtttacgatgctggaattttaccaggcttatgccgattacaatgatttgatgaatttcactgaacaattgtttcattatctatgcgataaagtattagctactcggcaaatagaatatcaaggtcaagtcattgatttcaataaaccttttgaacggttgagcgtaaaagaagctatattaaaatatcatcctgatattaaggcgcagcagttagaaacgttagagggatgcagaacacttctgaatgatttaggtctgccttataaagaaactgatggcctgggtaaactacaaattattctttttgaggagacagtagagcaccaattatttcagcccacttttattacggaataccctacagaaatatctcctttagcgagacgttctgataccaatccggaagtcaccgatcgatttgagttttttattgctggtcgtgagattgcgaatggattctctgaattaaacgatgccgaggatcaagctgagcgctttcgaaagcaagttgaagaaaaggatgcaggtgatttagaggcaatgcattttgatagtgattatattgaagcattggaatatggcttgccgcctacagctggtgaagggattggaatcgatcgcttggtgatgttatttactaattcgcaatcaatcagagacgttattttatttccgcatttgagacagtaa

SEQ ID NO: 32515 - protein, 496 aa, Legionella pneumophila str. Paris
MSEEHVHLDESEVYHIRKQKLAELRTSGFNFPNTFRREHLADALLKQYSETEKQTLEQKHVKVSVAGRIVLRRIMGKASFFHIQDVSGRIQVYLRSNDLPDVYEQFKHWDLGDIVGVQGELFKTNTGELTINAEYVELLTKSLRPLPDKFHGLADQELKYRKRYVDLIANEDSRKTFLIRSHLIKAFREFMDDNHFLEVETPMMHPIPGGALARPFVTHHNTLDMTMYLRIAPELYLKRLVVGGFERVYEINRNFRNEGISTRHNPEFTMLEFYQAYADYNDLMNFTEQLFHYLCDKVLATRQIEYQGQVIDFNKPFERLSVKEAILKYHPDIKAQQLETLEGCRTLLNDLGLPYKETDGLGKLQIILFEETVEHQLFQPTFITEYPTEISPLARRSDTNPEVTDRFEFFIAGREIANGFSELNDAEDQAERFRKQVEEKDAGDLEAMHFDSDYIEALEYGLPPTAGEGIGIDRLVMLFTNSQSIRDVILFPHLRQ

SEQ ID NO: 32516 - DNA, 1509 bp, Photobacterium profundum SS9
  CDS (1)..(1509)
atgactgatcaagtacaagatgaaaacaagctgattgctgagcgccgtgcaaagctagatatgatccgcaaaaactgtaaagcaaacggtcacccaaatgatttccgtcgcgacagcttagctgccgacctacaggctactttcggtgagaaaacgaaaccagagcttgaagaagaaggccacatcgttgctatcgctggccgtgttatggctaaacgtggtccatttttagcgattcaagatgtatcgggtcgtattcaggcttatgctgataaaacagtacaaaaagaattaaaagagaagtactcaggtcttgatatcggtgacatcatcggtgttaaaggtcagcttcacttatcaggtaaaggcgatctttacgtgactatggataactacgagttgctaacaaaagcacttcgtccgttaccagagaagttccacggtcttaccgaccaagaaacgcgttaccgtcagcgttatgttgatttgattgttaacgaagattctcgtaacacgatgatcatgcgttctaaagttgtgagtgcaattcgtaacttcatgatgaagaaagacttcatggaagttgaaacaccaatgatgcacgttatccctggtggtgcaacggcacgtccatttattactcaccacaatgcgctagatatcgatatgtatctacgtgttgcaccagagctttacttgaagcgtctagtggttggtggttttgagcgtgtattcgaaattaaccgtaacttccgtaacgaaggtctttctcctcgtcataatccagaattcaccatgatggaattctacatggcgtacgcagattacaacgacttgatggatctgacggaagaaatgctaagcagcattgcaacagacctacacggttcgcctaaactaccgtacggcgatgcaattgttgatttcggtggcccatacccacgtatcagcatgctcaatgcaatcaagcaatacaacccagacaacgctgaaatccaagcgcttacttacgagcaagttgcagatcgcgaactgatggctaacatcgcacgtggtcttgatatctacgttgaaaaattctggacgtgtggtcaacttcttgaagaaatctttggtgagacagcggaacctcagttaatgcaaccaacgttcattactgaatacccagcagatatctctccattagcgcgccgtaacgatacgaatgatttcattactgaccgttttgaattcttcattggtggccgtgaagtcgcgaatggcttctctgagcttaacgatgcacaagatcaagatcagcgttttaaagcgcaagttaacgcgaaagatgcgggtgatgatgaagcaatgtactacgatgcagactacattactgcactagaacacggcttaccgccaacagctggtcagggtatcggtatcgaccgtttagtaatgttgttcactaacacacatactatccgtgacgtaatcttgttccctgcactacgtccacaaaacaaagcataa

SEQ ID NO: 32517 - protein, 502 aa, Photobacterium profundum SS9
MTDQVQDENKLIAERRAKLDMIRKNCKANGHPNDFRRDSLAADLQATFGEKTKPELEEEGHIVAIAGRVMAKRGPFLAIQDVSGRIQAYADKTVQKELKEKYSGLDIGDIIGVKGQLHLSGKGDLYVTMDNYELLTKALRPLPEKFHGLTDQETRYRQRYVDLIVNEDSRNTMIMRSKVVSAIRNFMMKKDFMEVETPMMHVIPGGATARPFITHHNALDIDMYLRVAPELYLKRLVVGGFERVFEINRNFRNEGLSPRHNPEFTMMEFYMAYADYNDLMDLTEEMLSSIATDLHGSPKLPYGDAIVDFGGPYPRISMLNAIKQYNPDNAEIQALTYEQVADRELMANIARGLDIYVEKFWTCGQLLEEIFGETAEPQLMQPTFITEYPADISPLARRNDTNDFITDRFEFFIGGREVANGFSELNDAQDQDQRFKAQVNAKDAGDDEAMYYDADYITALEHGLPPTAGQGIGIDRLVMLFTNTHTIRDVILFPALRPQNKA

SEQ ID NO: 32518 - DNA, 1488 bp, Leuconostoc mesenteroides subsp. mesenteroides ATCC 8293
  CDS (1)..(1488)
atggctgaagaaaaagcccttaatgatcaaatgctagcgcgtcgacaaaagttggcaacaatcgttagtgatttacacttagacccattcggtaagcgatttgaacgtacagcaaaagcgcaagaactgcataatctatatgatgccagctctttagaagagttagagaatgcaaaacatgaagttgttattgcaggtcgtatggttgcaaagcgtggcgcaggtaaagttattttcgctgattttcgtgatgtttctggaaaaattcaggtttatgcaagacgtgatgatttagcagataattatccgattattaaaagagcagatttgggtgacttccttggaatcaagggaattatgatgaagactgaagctggtgaattaacagttttggctacagaattaacacatttatctaaggctcttcgtccaatgcctgataagttccatggtatttctgatgttgaaacacggtatcgtaagcgttacttggatttgattgccaatgaagattctttcaaaaagttccaagaacgctcacatatcatttctgctattcgtgcatatatggatagaaatgatttccttgaggttgaaacgccaattttgcaaactgaagccggtggggctgcagcccgtccatttatcacacatcataatgctttgaatattgatatgtacatgcgtatcgcaacagaattgtacttaaagcgtttggttgtgggtggcatggaacgtgtatatgaaattggccgtattttccgtaatgagggtatggatccaaagcacaatcctgagtttacaacaatggagtcatatgcagcttatatggactttacagatgttatggacgaaactgaaggtattttcaaagctgccgcttctgtcgtctcagatgacttgaaaattacttatcagggaactgaaattgatcttggcacaaagtttgcgcgcaaacatctagtcgacttgattaaagaacaaactggtattgatttttggcaggaaatgtccgttgaagaagcacaaaagttggccgatgataaccatgtaaagtacgaaaaatactggggtgtgggtcatattatcaatgcattcttcgaagaatttgtagaggatactttggtacagccaacatttgtttatggacatccagttgaagtgtcaccactcgctaagaaaaatactgatgatcctcgttttactgatcgttttgaattgtttattatgggtagcgagtatgcgaatgcctttactgagttaaacgatcctattgaccaacgtgcacgttttgaggctcaagcggctgaacgtgagaatggtaatgacgaagctgaaggtattgatgaagacttcatagaagctttggaatatggtatgccacctacaggtggacttggtgttggtattgatcgtttggtcatgttattgactgattctgacacaattcgtgacgttgtgttgttcccaacaatgcgtccagaataa

SEQ ID NO: 32519 - protein, 495 aa, Leuconostoc mesenteroides subsp. mesenteroides ATCC 8293
MAEEKALNDQMLARRQKLATIVSDLHLDPFGKRFERTAKAQELHNLYDASSLEELENAKHEVVIAGRMVAKRGAGKVIFADFRDVSGKIQVYARRDDLADNYPIIKRADLGDFLGIKGIMMKTEAGELTVLATELTHLSKALRPMPDKFHGISDVETRYRKRYLDLIANEDSFKKFQERSHIISAIRAYMDRNDFLEVETPILQTEAGGAAARPFITHHNALNIDMYMRIATELYLKRLVVGGMERVYEIGRIFRNEGMDPKHNPEFTTMESYAAYMDFTDVMDETEGIFKAAASVVSDDLKITYQGTEIDLGTKFARKHLVDLIKEQTGIDFWQEMSVEEAQKLADDNHVKYEKYWGVGHIINAFFEEFVEDTLVQPTFVYGHPVEVSPLAKKNTDDPRFTDRFELFIMGSEYANAFTELNDPIDQRARFEAQAAERENGNDEAEGIDEDFIEALEYGMPPTGGLGVGIDRLVMLLTDSDTIRDVVLFPTMRPE

SEQ ID NO: 32520 - DNA, 1503 bp, Azotobacter vinelandii
  CDS (1)..(1503)
atgagcgaacaaccgctgaaccagcatgccctccacgaggaagaaaacaagctgatcgccctgcgcaaggagaaactcgccgccgagcgcgcgaaaggcaatgccttccccaacgacttccgccgcgacagctactgcgccgacctgcagaagcgctatgccgaggcgggcaaggaggagctggaagcggccgcgatcccggtcaaagtggccgggcgcatcatgctcaaccgcggcgccttcatggtcatccaggacatgaccgggcgcatccaggtctacgtcgaccgcaagggcctgccggccgagacgctggaggcggtcaagcactgggacctgggcgacatcatcgccgccgagggcaccctggcgcgctccggcaagggcgatctctacgtgcacatgagcacggtgcgcctgctgaccaagtcgctgcgcccgctgccggacaagcatcatggcctgaccgacaccgagcagcgctaccgccagcgttacgtcgacctgatggtcaacgaggaaacccgccacaccttccgcgtgcgttcgcagatcatcgcccacattcgcaggttcctcgccgagcgcgacttcctcgaggtggaaacgccgatgctccaggtcatccccggcggcgccgcggccaagcccttccagacccaccacaacgcgctggacctgccgatgttcctgcgcatcgcacccgagctctacctcaagcgcctggtggtcggcggcttcgagcgggtcttcgagatcaaccgcaacttccgcaacgaaggcgtctcgacccgccacaaccccgaattcaccatgctcgagttctaccaggcctacgccgactacgaggacaacatggacctcaccgagcagttgttccgcgaactggcgcaactggtgctggggaccaccgacgtgccctaccagggtaaggtgttccacttcggcgagcccttcgcccgcctgtcggtgttcgactcgatcctctactacaacccggaagtctccgccgcggacctgcgcgacatcgagaaatgccgcgccatcgccaggaaggccggcgccgacgtcaagggtttcgagggactgggcaagctgcagacgatgatcttcgaggagttggtcgagcaccgcctggaacagccgaccttcatcacccgctatcccttcgaggtttcgccgctggcgcggcgcagcgacgacgatccgagcgtcaccgaccgcttcgagctgttcatcggcggccgcgagatcgccaacgcctactccgagctgaacgacgccgaggaccaggccgagcgcttcatgcagcaggtccgggacaaggatgccggcgatgacgaggccatgcacttcgacgccgacttcgtgcgcgccctggaatacggcatgccgccgaccgccggcgaaggcatcggcatcgaccgtctggtgatgctgctgaccgattcgccgtcgatccgcgacgtgatccttttcccgcacatgcgtccggaagtctga

SEQ ID NO: 32521 - protein, 500 aa, Azotobacter vinelandii
MSEQPLNQHALHEEENKLIALRKEKLAAERAKGNAFPNDFRRDSYCADLQKRYAEAGKEELEAAAIPVKVAGRIMLNRGAFMVIQDMTGRIQVYVDRKGLPAETLEAVKHWDLGDIIAAEGTLARSGKGDLYVHMSTVRLLTKSLRPLPDKHHGLTDTEQRYRQRYVDLMVNEETRHTFRVRSQIIAHIRRFLAERDFLEVETPMLQVIPGGAAAKPFQTHHNALDLPMFLRIAPELYLKRLVVGGFERVFEINRNFRNEGVSTRHNPEFTMLEFYQAYADYEDNMDLTEQLFRELAQLVLGTTDVPYQGKVFHFGEPFARLSVFDSILYYNPEVSAADLRDIEKCRAIARKAGADVKGFEGLGKLQTMIFEELVEHRLEQPTFITRYPFEVSPLARRSDDDPSVTDRFELFIGGREIANAYSELNDAEDQAERFMQQVRDKDAGDDEAMHFDADFVRALEYGMPPTAGEGIGIDRLVMLLTDSPSIRDVILFPHMRPEV

SEQ ID NO: 32522 - DNA, 1686 bp, Nostoc punctiforme PCC 73102
  CDS (1)..(1686)
atgtcggaagaagatatccgagccgcaaggctggaaaaagtagaacaactcaagcagctagggactaatccctacgcctatcgctgggaatctacccatcatgcagcacagttgcaagaacagtttgccgatttagccagtggtgaagaagttgatttagaagttgcgatcgctggacgcattatggcgcgtcgcgttttcggtaaactggctttcttcaccttgcaagatgaaactggcacaattcagctttatttggataaaaatcgcatccaagaaagcatggcagatattgatgctgatgccttcaatcatttaaaacaactcacagatgcaggcgatatcctgggagttaaaggtactattaaacggactgaaaagggcgagttatctgtctacgttaaacaatatactatcctgactaaatccctgttgcccctacccgacaagtggcatggattgacggatgttgccaagcgctaccgtcagcgttacgttgacctgattgttaacccggaagtgcggcaaactttccgccgtcgtgcccaaattacagctgggattcgccgttatttggaacagcgagattttctcgaaattgaaacgccagttttacagagtgaagctggaggtgcagatgcgcgtccatttatcacccaccacaacaccttagaaatggaattgtatctgcgaattgccacagaactccatctcaagcggttgattgtaggtggttttgaaaaggtgtttgaattgggaaggattttccgtaatgaaggaatttcgactcgacacaatcccgaatttacaacgattgaagtttaccaagcctacgccgactacaacgatatgatggcgctgactgaagggattattaccactgtcgcccaagaggtactcggcacgctgcaaattacctaccaaggggaacctatagatttaacaccaccttggcggcgagtgacaatgcacgatttagttaaagaatttactggcttagatttcaattctttccaaaccttggaagaagcaaaaacagcaagtaaaaatgctggtattcctggtgtagatgaagccaaatcaattggtaaattactgaatttagcctttgaagagaaagtagaagctaatttaattcaacctacctttgtaattgattacccagtagaaatttcgcccctagcaaaaccccaccgttctcaacctggtttggtggaaagatttgagttatttatcgtcgggcgagaaactgggaatagcttctcagaacttacagatcccatcgatcaaagagaacgcctagaagcccaagccgaaagaaaagctgctggcgacttagaagcccaaggtgtagatgaagactttttgacagcccttgaatacggtatgccgcctacaggtggcttagggattgggatcgatcgcttagtaatgttgttaactgattctgccagcattcgggatgtaattgctttccctctgcttaagcctgaaggcagcgttattaagcaatttagctatgaacaaaaaacccaaacactgactattgaatttgacagtggaagtgtttacgagtatttcaaagtccctcccagtgtcaaagaagacttggataatgcaccgtctaaaggtcaacactttaacaagttcattaaaggaaaattcaagtttgaacagttaagttga

SEQ ID NO: 32523 - protein, 561 aa, Nostoc punctiforme PCC 73102
MSEEDIRAARLEKVEQLKQLGTNPYAYRWESTHHAAQLQEQFADLASGEEVDLEVAIAGRIMARRVFGKLAFFTLQDETGTIQLYLDKNRIQESMADIDADAFNHLKQLTDAGDILGVKGTIKRTEKGELSVYVKQYTILTKSLLPLPDKWHGLTDVAKRYRQRYVDLIVNPEVRQTFRRRAQITAGIRRYLEQRDFLEIETPVLQSEAGGADARPFITHHNTLEMELYLRIATELHLKRLIVGGFEKVFELGRIFRNEGISTRHNPEFTTIEVYQAYADYNDMMALTEGIITTVAQEVLGTLQITYQGEPIDLTPPWRRVTMHDLVKEFTGLDFNSFQTLEEAKTASKNAGIPGVDEAKSIGKLLNLAFEEKVEANLIQPTFVIDYPVEISPLAKPHRSQPGLVERFELFIVGRETGNSFSELTDPIDQRERLEAQAERKAAGDLEAQGVDEDFLTALEYGMPPTGGLGIGIDRLVMLLTDSASIRDVIAFPLLKPEGSVIKQFSYEQKTQTLTIEFDSGSVYEYFKVPPSVKEDLDNAPSKGQHFNKFIKGKFKFEQLS

SEQ ID NO: 32524 - DNA, 1503 bp, Actinobacillus pleuropneumoniae serovar 1 str. 4074
  CDS (1)..(1503)
atgtccgaagttgaacatcaagaattagatcttaacggtgaaatgttagctcgccgtgagaaattagcaaaattacgtgaacaaggtaatccgttcccaaatactttccgtcgtgatgcttacgcagaaaaattacacgcacaatacgatgaagtagagggtgaagcgttaaaagaacaagatattcaagtgaaagttgccggtcgtattatgcttaaacgtgtaatgggtaaggcatctttctttaccattcaagatgtaagcggtcaaatccagctttatgttgcacgtgataaccttgcggaaggtgtttatgcggataaagtcagtatgtgggatttaggcgatatcgtcggtgttgccggtacgcttttcaaaacgaaaacgggcgaattaaccgttcgttgttcggaagtggagttattaactaaatcacttcgtccgttaccaaataaagtacaaggcttaaccgaccaagaaacacgttatcgtcagcgctatttagacttaatttctaatgaagaatctcgccgcacgtttatgattcgctcaaaagtggtttcaggcattcgtcaattcttcttagagaaagactttattgaagttgaaacgccaatgttacaagtgattccgggcggtgcggctgcaaaaccgtttatcactcaccataatgcgttagacgtagatatgtatttacgtatcgcacctgagctttacttaaaacgtttagtagttggcggttttgagcgtgtattcgaattaaaccgtaacttccgtaatgaaggtgtttcagtgcgtcacaaccctgagttcactatgatcgaatactatcaagcgtatgcggattatcacgatttaatggataacaccgaagaattattacgtaaattagcgattgatattcttggcacgacaaccgttccttacggtgaatacgtgttcgatttcggtaaaccgtttgaacgtatcacaatgcacgatgcaatcgtgaaatacggtaacggcattacacgtgaagatttagacagctttgaaaaatcagtagaaattgcaaaaggcttaggtattgaaatccaaaaatcttggggcttaggttctgtggttaatgcgatttttgaagaagttgcggaacatcaattaattcaaccgaccttcttaatggcacatccggcagaaatttcaccgcttgcgcgccgtaatgatgaaaaccctgaagtaactgatcgtttcgaattatttatcggtggtcgtgaaatcggtaacggtttctcagaattaaatgatgcggaagaccaagcagagcgttttgatgcacaagtggcagcaaaagatgcgggtgatgatgaagcgatgtttaaagatgaagacttcgttgttgcgttagaacacggtttaccgccgacagccggcgaaggtttaggtatcgaccgtttagcaatgatttttgcaaacgcaccgtcaattcgtgatgtgatcttattccctgcgatgcgtcagaaataa

SEQ ID NO: 32525 - protein, 500 aa, Actinobacillus pleuropneumoniae serovar 1 str. 4074
MSEVEHQELDLNGEMLARREKLAKLREQGNPFPNTFRRDAYAEKLHAQYDEVEGEALKEQDIQVKVAGRIMLKRVMGKASFFTIQDVSGQIQLYVARDNLAEGVYADKVSMWDLGDIVGVAGTLFKTKTGELTVRCSEVELLTKSLRPLPNKVQGLTDQETRYRQRYLDLISNEESRRTFMIRSKVVSGIRQFFLEKDFIEVETPMLQVIPGGAAAKPFITHHNALDVDMYLRIAPELYLKRLVVGGFERVFELNRNFRNEGVSVRHNPEFTMIEYYQAYADYHDLMDNTEELLRKLAIDILGTTTVPYGEYVFDFGKPFERITMHDAIVKYGNGITREDLDSFEKSVEIAKGLGIEIQKSWGLGSVVNAIFEEVAEHQLIQPTFLMAHPAEISPLARRNDENPEVTDRFELFIGGREIGNGFSELNDAEDQAERFDAQVAAKDAGDDEAMFKDEDFVVALEHGLPPTAGEGLGIDRLAMIFANAPSIRDVILFPAMRQK

SEQ ID NO: 32526 - DNA, 1482 bp, Fusobacterium nucleatum subsp. vincentii ATCC 49256
  CDS (1)..(1482)
atggagaaatattttgacagattagagaaagaacctctaattgctgaaagatggaaaaaaattgaagagttggaaagctatggtataaagccatttggtaaaaaatatgataaacaaataatgataggagatattttaaaacataagccagaagaaaatttaaagtttaaaactgctggaagaataatgtctttaaggggaaaaggaaaagtatattttgctcatatagaagaccaatctggtaaaatccaaatttatataaagaaagatgaattaggagaagaacaatttgaccatattgttaaaatgttaaatgttggagatataattggacttgaaggagaattatttataactcatacagaagaattaactttaagagttaaaagtattgctcttttaacaaaaaatgtaaggtctcttcctgaaaaatatcatggacttacagatgttgaaatcagatatagaaaaagatatgttgacttaataatgaacccagaggttagggatacttttataaaaagaactaaaataataaaagctataaggaaatatttagatgatagaggatttttagaagtagaaactcctataatgcacccgattttaggtggagctgctgcaaaaccttttataactcaccataatactttaaatattgatttatatctaagaattgcacctgaattatatttaaaaaaattaatagttggtggctttgaaagagtatatgacttaaatagaaattttagaaatgaaggaatatctacaaggcataatcctgaatttactatggttgaattataccaagcccatgcagattttcatgatatgatggatttatgtgaaggaataatctcatctgtgtgtaaagaagtgaatggaacaactgatattgaatatgatggagttaaattatcacttaaaaactttgcaagagtacatatggttgatatgataaaagaagttacaggggttgatttctggaaagaaatgacttttgaagaagctaaacaaatagctaaggagcatcatattgaggttgcagatcatatgaatagtgttggacatattataaatgaattctttgaacaaaaatgtgaagaaaaagttatacaaccaacatttgtatatggacatcctgttgaaatatctccacttgcaaaaagaaatgaagataatccaaactttacagatagatttgaattattcattaataaaagagaatatgcaaatgctttcactgaattaaatgacccagcagaccaaagaggaagatttgaatcacaagttgaagaagcaatgcatggaaatgaagaagcaacacctgaaatagatgaaagttttgtagaagctcttgaatatggtttaccacctactggtggactaggaataggtatagatagacttgtaatgttacttacaggggcaccatctataagagatgttattcttttcccacaaatgaaaccaagagattaa

SEQ ID NO: 32527 - protein, 493 aa, Fusobacterium nucleatum subsp. vincentii ATCC 49256
MEKYFDRLEKEPLIAERWKKIEELESYGIKPFGKKYDKQIMIGDILKHKPEENLKFKTAGRIMSLRGKGKVYFAHIEDQSGKIQIYIKKDELGEEQFDHIVKMLNVGDIIGLEGELFITHTEELTLRVKSIALLTKNVRSLPEKYHGLTDVEIRYRKRYVDLIMNPEVRDTFIKRTKIIKAIRKYLDDRGFLEVETPIMHPILGGAAAKPFITHHNTLNIDLYLRIAPELYLKKLIVGGFERVYDLNRNFRNEGISTRHNPEFTMVELYQAHADFHDMMDLCEGIISSVCKEVNGTTDIEYDGVKLSLKNFARVHMVDMIKEVTGVDFWKEMTFEEAKQIAKEHHIEVADHMNSVGHIINEFFEQKCEEKVIQPTFVYGHPVEISPLAKRNEDNPNFTDRFELFINKREYANAFTELNDPADQRGRFESQVEEAMHGNEEATPEIDESFVEALEYGLPPTGGLGIGIDRLVMLLTGAPSIRDVILFPQMKPRD

SEQ ID NO: 32528 - DNA, 1545 bp, Psychrobacter sp. 273-4
  CDS (1)..(1545)
atgtcaaagcccaacaatcaaaatcagcaaaataaccaagagcaaatcccagaagacgccaacgaactgattgctcagcttcaagccaagctggaggatatcgttgcttcaggcaaacaaccgtatccgaatacgtttaaacgtacggattatgcgcaagacttgcagacggcttttgagggtatctcaaaacaagaaattgctgataatgatgctaaaggcgaaaaaacacaggtgaatgtcgccggtcgcgtcatgctcaaccgtggtgcatttattgtcatccaagacatgacaggtcgtatccaattatatgtggcacgcaaagagctagatgaagagacgttagccgacatcaaatcgctagatttgggtgatatcgttggcgtatcaggttacatcggtcgctctggtaaaggtgatttgtacgtacatatcgaagagatgcaattattgaccaaagcattacgcccaatgccaaataagtttcatggtttagcagatgtggaagcccgctatcgcaaccgtcatcttgatttgatgaccaatgagacgacccgtgatacttttatggtacgcagccaagtcatcagcggtattcgcaaatttatgttgaatgagcgttttatggaagtggaaacgcctatgatgcatcccattccaggtggtgcggtggcgcgtccgtttgtgactcatcataatgcgttagacatgccattatatctgcgtattgctcctgagctttatcttaaacgcttagtcgttggtggctttgagaaagtatttgagattaaccgcagcttccgtaatgagggcgtgtcaacccgtcataatcctgaatttaccatgattgagttttatcaggcgtatgctgattatcatgatttgatggatttgactgagcgcttatttaacgaattggcgacagatatcttgggtaccactgagattacctatcaagaagaagatatcagcctaaaagcgcctttcgagcgtctatctatgtctaatgcgattgccaaatatgccgaaaacttcgatatggcacgtatcaatgatcgtgattatctcgcagagtacgcatcgacaacgcttaagcagcaggtaaaagatgtctttggtgtgggtaaattgcagaccattatctttgaagaaaccgctgagcatcaattacgtcagccaacattcatcactgaataccctgctgaaacctcaccactagcacgccgcagtgatgacaatcctgagattactgaccgcttcgagctgtttgttggtggtcgtgaattggcgaatggctttagtgagctgaatgatcctgcggatcaggctgagcgtttccttggtcaagtggctgaaaaagacgctggcgatgatgaagcgatgcactttgatgcagaatatatcgaggcattgtcttatggcttaccgccgactgctggtgaaggtattggtattgatcgcttggtaatgctattgacagactctgccagtattcgtgatgtgattttattcccacatatgcgccgtaagcttgagggttaa

SEQ ID NO: 32529 - protein, 514 aa, Psychrobacter sp. 273-4
MSKPNNQNQQNNQEQIPEDANELIAQLQAKLEDIVASGKQPYPNTFKRTDYAQDLQTAFEGISKQEIADNDAKGEKTQVNVAGRVMLNRGAFIVIQDMTGRIQLYVARKELDEETLADIKSLDLGDIVGVSGYIGRSGKGDLYVHIEEMQLLTKALRPMPNKFHGLADVEARYRNRHLDLMTNETTRDTFMVRSQVISGIRKFMLNERFMEVETPMMHPIPGGAVARPFVTHHNALDMPLYLRIAPELYLKRLVVGGFEKVFEINRSFRNEGVSTRHNPEFTMIEFYQAYADYHDLMDLTERLFNELATDILGTTEITYQEEDISLKAPFERLSMSNAIAKYAENFDMARINDRDYLAEYASTTLKQQVKDVFGVGKLQTIIFEETAEHQLRQPTFITEYPAETSPLARRSDDNPEITDRFELFVGGRELANGFSELNDPADQAERFLGQVAEKDAGDDEAMHFDAEYIEALSYGLPPTAGEGIGIDRLVMLLTDSASIRDVILFPHMRRKLEG

SEQ ID NO: 32530 - DNA, 1506 bp, Dechloromonas aromatica RCB
  CDS (1)..(1506)
atgtccaacgccgaacagcaagccccggtccagcaagacgaaaaccaactcatcgcagagcgccgtgccaaactggccgagtggcgcaagaccgggaaggctttcccgaatgatttccagcgtgagaacaccgctgccaaggtcctcgaaggctatggcgagaaaacggcggaagagcttgaaggcctgccgattgaagtcaaggttgccggccgcctgatgctcaagcgcgtcatgggcaaggcttcctttgccaccattcaggatctgtcgggccgtatccagatctacatcacccgggaccgcgttggtgaagaggtctatgccgacttcaagacctgggacttgggcgacatcattggcgtcaccggtagcctgatgaagaccaagaccggcgagctgtcgattcaggccgccgaaatccgcctgctgaccaagtcgctgcgcccgctgccggacaagttccacggcctggccgatcaggaaatgaagtatcgccagcgctatgtcgacctgatcatgaacgaggaaacgcgcttcaccttccgcgcccgttcggccatcgttgcctctatccgcaactacatgaccggccatggcttcatggaagtcgaaacgccgatgatgcacccgatcccgggcggtgcctcggccaagccgtttgtcacgcaccacaacgcgctcgacatgcagcagttcctgcgcatcgcgccggagctgtacctgaagcgcctggtcgtcggcggtttcgagaaggttttcgaaatcaaccgcaatttccgcaatgaaggtctctcgccgcgccacaaccccgaattcacgatgatggagttctacgaggcctacgcgaactaccacacgctgatggacttcaccgaaggcctgctccgccacgccgcccgcgaggcactgggcaaggaagtcttcgtctatcagggccgcgaactggacctctccaagcctttccatcgccttaccatcaaccaggccatccagcgccagcatccggaatttagtgatgccgagctggccgatccggaattcctgaaagccaagatcaaacacttcggtgagccgctcaagccgggcggtctgggcagcctgcaactgcaactgttcgaagcctgcgccgaagcccactgctgggagccgactttcatcatcgactacccggtcgaagtgtccccgctggcccgtgcctcggacaccaacccggaaatcaccgagcgttttgagctgttcatcgttgggcgtgaaatcgccaacgggttctcggagttgaatgatgccgaagatcaggcagcgcgcttccaggaacagatgaaagcgaaggatgccggcgacgaggaagcgatgtattacgacgccgatttcattcgcgcgctggaatatggcctgccgccgaccggtggctgtggcatcggcattgatcgcctgatcatgctgctgaccgacgccgccgcgattcgggatgtcatcctattcccctccatgcgccccgaatga

SEQ ID NO: 32531 - protein, 501 aa, Dechloromonas aromatica RCB
MSNAEQQAPVQQDENQLIAERRAKLAEWRKTGKAFPNDFQRENTAAKVLEGYGEKTAEELEGLPIEVKVAGRLMLKRVMGKASFATIQDLSGRIQIYITRDRVGEEVYADFKTWDLGDIIGVTGSLMKTKTGELSIQAAEIRLLTKSLRPLPDKFHGLADQEMKYRQRYVDLIMNEETRFTFRARSAIVASIRNYMTGHGFMEVETPMMHPIPGGASAKPFVTHHNALDMQQFLRIAPELYLKRLVVGGFEKVFEINRNFRNEGLSPRHNPEFTMMEFYEAYANYHTLMDFTEGLLRHAAREALGKEVFVYQGRELDLSKPFHRLTINQAIQRQHPEFSDAELADPEFLKAKIKHFGEPLKPGGLGSLQLQLFEACAEAHCWEPTFIIDYPVEVSPLARASDTNPEITERFELFIVGREIANGFSELNDAEDQAARFQEQMKAKDAGDEEAMYYDADFIRALEYGLPPTGGCGIGIDRLIMLLTDAAAIRDVILFPSMRPE

SEQ ID NO: 32532 - DNA, 1509 bp, Haemophilus influenzae R2866
  CDS (1)..(1509)
atgtcagaacaagaagttaaagaattagatctgaacggcgaaatgctcgttcgtcgtgaaaaattagccgcattacgtgcaaaaggtaatgcatttccaaacaagtttcgtcgtgatgctctcgcacaagatttacacaatcaatatgattcagaagacggggaaatcttaaaagaaaaaggcattgaagtacaagttgctggtcgtattatgactcgccgtgcaatgggtaaagcaacttttatcactattcaagatatgagcggtaaaatccagctttacgttgcacgcgataatttgcctgaaggtgtttatgctgaagatgtaggtaactgggatttaggcgatatcattggagtgaaaggtacacttttcaaaactaaaaccaatgaattaaccatcaaaacaactgaagttcaacttttaaccaaagcacttcgtccattaccagacaaattccatggtttaaccgaccaagaagttcgttatcgccaacgttatttagatttaatttctaacgaagaatctcgccgcacttttattattcgttctaaagttgtcgcgggtattcgtgaatatttcatttctaaaggttttatggaagtggaaacgccaatgttacaagttattccaggcggtgcatctgcgcgtcctttcgtaacccatcacaacgcgttagacgttgatatgtatttacgtattgcacctgaactttatttaaaacgcttagtagtgggtggctttgaacgagtatttgaattaaaccgtaacttccgtaatgaaggggtttctgttcgtcataatccagaatttactatgcttgaatattatcaagcctatgcagattaccatgatttaatggataacaccgaagaactgcttcgtaaattagcgattgatattcttggtactactattgtgaaatacggcgaatacgaatttgattttggtaaaccattcgaacgtattacgttacacgatgcaaccattaaatatggtgctgacaaaggtatcgtaaaagaagatttatatgactttgatcgtgcaaaagccacagcagaacgcttaggtattgaagtacaaaaatcttggggtttaggcagcattgtcaatgcaatttttgaagaagtggctgaacatcacttaattcaaccaaccttcttaatggctcaccctgcggaaatttcgccacttgcacgtcgtaatgatgaaaatcctgatgtaacagatcgttttgagctatttatcggtggccgtgaaatcggtaatggtttctcagaattaaatgatgcagaagatcaaaatgaacgctttgatgcacaggttgcagcaaaagaagcgggcgatgatgaagcgatgtttaaagatgaagactttgttgttgcactagaacacggcttacctccaacagctggggaaggtctaggtatcgaccgtctagcgatgctttatgcaaatgcaccgtcaattcgtgatgtgatcttattccctgcaatgcgtcagaaataa

SEQ ID NO: 32533 - protein, 502 aa, Haemophilus influenzae R2866
MSEQEVKELDLNGEMLVRREKLAALRAKGNAFPNKFRRDALAQDLHNQYDSEDGEILKEKGIEVQVAGRIMTRRAMGKATFITIQDMSGKIQLYVARDNLPEGVYAEDVGNWDLGDIIGVKGTLFKTKTNELTIKTTEVQLLTKALRPLPDKFHGLTDQEVRYRQRYLDLISNEESRRTFIIRSKVVAGIREYFISKGFMEVETPMLQVIPGGASARPFVTHHNALDVDMYLRIAPELYLKRLVVGGFERVFELNRNFRNEGVSVRHNPEFTMLEYYQAYADYHDLMDNTEELLRKLAIDILGTTIVKYGEYEFDFGKPFERITLHDATIKYGADKGIVKEDLYDFDRAKATAERLGIEVQKSWGLGSIVNAIFEEVAEHHLIQPTFLMAHPAEISPLARRNDENPDVTDRFELFIGGREIGNGFSELNDAEDQNERFDAQVAAKEAGDDEAMFKDEDFVVALEHGLPPTAGEGLGIDRLAMLYANAPSIRDVILFPAMRQK

SEQ ID NO: 32534 - DNA, 1686 bp, Anabaena variabilis ATCC 29413
  CDS (1)..(1686)
atgtcggaagaagatatccgtgccgctaggctggagaaagtagaacaactcaagcagctaggaactaacccctacgcttaccgttgggagtctacccatcacgccgcccaattgcaagaaaaatttgctgatttaaccagtggtgaagaagtcgatacagaagttgccattgccggacgcattatggcgcgtcgcgttttcggtaaattggctttcttcaccttggaagatgaaacaggcactattcagctttatttagagaaaaatcgtatccaagaaagcatggcagaaactgatgccgatgcttttaatcatctcaaacaactcacagatgtaggagatattctgggagccaagggaaccataaaacggactgaaaagggcgagttatcgatttacgtcaaagaatataccatcctcaccaaatccctactgccgctacccgacaagtggcatgggttaacggatgttgccaagcgctaccgtcaacgctacgttgatttaattgttaaccccgaagtccgccaaactttccgccgtcgcgcccaaattacggctgggattcgccgctatttggaacaaagggattttctagagattgaaaccccagttttgcaaagtgaaactggtggtgctgatgcgcgtcccttcatcacttaccacaacaccttagaaatggagttgtatctgcggattgccacagaactccacctcaaacggttgattgtcggtggttttgaaaaagtatttgagttggggcgcgttttccgcaatgagggaatttctaccagacacaaccctgaatttacctcaattgaaatttaccaagcctacgccgactacaacgatatgatggcgctaacagaaggtattatcaccactgttgcccaagatgtactcggtacgctgcaaattacctaccaaggcgaaacggtagatttgacaccaccttggcgacgggtgacaatgcacgatttagtgaaagaatatacgggcttggatttccattctttccaaacactagaagaagcgaaatcagcaagtaaaaatgctggaattcctggtgtagatgaagcccaaactataggaaaaatcctgaatttagcatttgaagaaaaggtagaagctaacttaattcagccgacctttgtcattgattatcctgtagaaatttcgccattagctaaacctcaccgttctcaacctgggttagtagaaagatttgaattattcatagtcgggcgggagactgcgaatagtttctcagaattaacagaccccatcgaccaaagagaacgtttggaagcccaagcagccaaaaaagccgccggtgacttagaagcccaaggtgtagatgaagatttcttaactgcgttggaatatggtatgccacccacaggcggtttaggtattgggattgatcggttagtcatgttattaactgattctgccagcattcgagatgtaattgctttccctctactcaaacccgaaggcagctttattaaggaatatcgctatgagtcaacaactcaaacactgactatggagtttgatagtggaagtgtttacgaatatttcaaagtaccgcttactgtcaaggaagaattagataatgcaccgtctaagggtcaatatttccataagtttattaaagggaaattcaagtatgaacaattgagttga

SEQ ID NO: 32535 - protein, 561 aa, Anabaena variabilis ATCC 29413
MSEEDIRAARLEKVEQLKQLGTNPYAYRWESTHHAAQLQEKFADLTSGEEVDTEVAIAGRIMARRVFGKLAFFTLEDETGTIQLYLEKNRIQESMAETDADAFNHLKQLTDVGDILGAKGTIKRTEKGELSIYVKEYTILTKSLLPLPDKWHGLTDVAKRYRQRYVDLIVNPEVRQTFRRRAQITAGIRRYLEQRDFLEIETPVLQSETGGADARPFITYHNTLEMELYLRIATELHLKRLIVGGFEKVFELGRVFRNEGISTRHNPEFTSIEIYQAYADYNDMMALTEGIITTVAQDVLGTLQITYQGETVDLTPPWRRVTMHDLVKEYTGLDFHSFQTLEEAKSASKNAGIPGVDEAQTIGKILNLAFEEKVEANLIQPTFVIDYPVEISPLAKPHRSQPGLVERFELFIVGRETANSFSELTDPIDQRERLEAQAAKKAAGDLEAQGVDEDFLTALEYGMPPTGGLGIGIDRLVMLLTDSASIRDVIAFPLLKPEGSFIKEYRYESTTQTLTMEFDSGSVYEYFKVPLTVKEELDNAPSKGQYFHKFIKGKFKYEQLS

SEQ ID NO: 32536 - DNA, 1515 bp, Synechococcus elongatus PCC 7942
  CDS (1)..(1515)
atgtctgatttgcgcgccacccgcctcgaaaaagccctgcaattgcgagagctgggatttgagccctacgcctaccgttgggactgtagccatagtgccgcgcagctccaagcgctctatgctgacttgccagccggggaggaagtggcggttgaggtcgcgatcgcgggccgaattatggcgcggcgcgtcttcgggaagctggccttcttcacgctgcaggatgaaagcggccaaattcagctctacctcgagaagcagcggctcagtgaatcgatggccgcgatcgatgccgaagctttcagtcacctcaaagccctgacagatgtgggcgacattcttggtgtcaaaggtagtgtgcgccgcacggagaaaggcgaactctcgatcgcagtggatcagtacgccattctcactaagtccctgcaacccctgccggataaatggcatggactgacggatgtggagaagcgctaccgccagcgctacgtggacctgatcgtcaacccagaagtacgggagacgtttcggcgtcgcgccaaaatcaccgctgccattcgtcgccacctcgaagatcagggcttcatcgaaatcgaaacgccagtgctgcaagcggaggcaggcggtgcagaagctcggcctttcatcacttaccacaacaccttagaactcgacctttatctgcgaattgcaaccgagttgcacctcaagcgcctaattgtcggcggcttcgagaaagtgtttgaactagggcgcattttccgcaacgagggcatttcaacccgccacaaccctgagttcacctcgatcgaggtctatcaggcctatgccgactacgaagacatgatgcggctaacggaaaccttgattgcccaagttgctgagcaggtggtggggtcgctgcaagtgccctaccaaggtcagacgatcgatctggcgccaccgtggaaacgggcaacgatggcggaactggtgttggcagcgacggggatcgacttcgagtccctgaaagacctagaagcaggaattgcagccgtgaaagcagcaggtattccggtgcctgaggactgccccaacctcggcaaactgctcaaccactgcttcgaagaaaaagtggaagcaacgctgattcagccgacgtttgtgatcgactatccggtggagatttcgccgctggcgaagccgcaccgcagcaaaccagggttagtggaacgctttgagctatttattgtcggccgagaaactgctaacagcttctcggagttaaccgatccggtggatcagcgacaacggttggaagcgcaagcggcagacaaagcagcaggcaatgtcgaagcgaacgacgtcgacgaagacttcttgctggcgctggagcatggcatgccaccgaccggtggcctcggaattggcatcgatcgcctcgtgatgttgctgaccgatagccccagcatccgtgacgtgattgccttcccactgctacgccccgaagcgagctcggaagaggccgaagcctaa

SEQ ID NO: 32537 - protein, 504 aa, Synechococcus elongatus PCC 7942
MSDLRATRLEKALQLRELGFEPYAYRWDCSHSAAQLQALYADLPAGEEVAVEVAIAGRIMARRVFGKLAFFTLQDESGQIQLYLEKQRLSESMAAIDAEAFSHLKALTDVGDILGVKGSVRRTEKGELSIAVDQYAILTKSLQPLPDKWHGLTDVEKRYRQRYVDLIVNPEVRETFRRRAKITAAIRRHLEDQGFIEIETPVLQAEAGGAEARPFITYHNTLELDLYLRIATELHLKRLIVGGFEKVFELGRIFRNEGISTRHNPEFTSIEVYQAYADYEDMMRLTETLIAQVAEQVVGSLQVPYQGQTIDLAPPWKRATMAELVLAATGIDFESLKDLEAGIAAVKAAGIPVPEDCPNLGKLLNHCFEEKVEATLIQPTFVIDYPVEISPLAKPHRSKPGLVERFELFIVGRETANSFSELTDPVDQRQRLEAQAADKAAGNVEANDVDEDFLLALEHGMPPTGGLGIGIDRLVMLLTDSPSIRDVIAFPLLRPEASSEEAEA

SEQ ID NO: 32538 - DNA, 1551 bp, Ralstonia eutropha JMP134
  CDS (1)..(1551)
atgactgaacccaaccgcgcccaggccgcaccggcctctccgaccgcagagctgcccgccgcagacgagaacaagatcatcgccgagcgtcgcgagaaactggcggccctgcgccggcaaggcgtggccttccccaacgatttccgcccgacccaccaggccgccgcgctgcacgagcagtacggcgagaccgaccagcccgcgctggaagcgaccccggtggaagtcgccattgccggccgcatgatgctcaagcgcgtcatgggcaaggcaagcttcgccaccgtgcaggatggcagcggccagatccagttctacatcacgcgcgacaaggttggtgaagacgtctacgccgccttcaagcactgggaccttggcgacatcatcagcgcgcgcggcgtgctgttccgcaccaacaagggcgagctgtccgtgcaggtgcaggaactgcgcctgctgtccaagtcgctgcgcccgctgccggacaagttccacggcctggccgaccaggaaatgaagtaccgccagcgctatgtcgacctgatcgtctcgccggaaacccgcaacaccttccgcgcgcgcaccaaggccatgtcatcgctgcgccgccatatgtccgacgccggcttcatggaagtcgaaacgccgatgctgcacccgatcccgggcggcgccgcggccaagccgttcatcacgcaccacaatgcgctggacatgcagatgttcatgcgcatcgcgccggagttgtacctgaagcgcctgatcgtcggcggcttcgagcgcgtgttcgagatcaaccgcaacttccgcaatgaaggggtgagcccgcgccacaaccccgagttcacgatgatggagttctacgcggcctacacggactaccgctggctgatggactttaccgagaacctgatccgccaggccgccatcgacgccagcggtaccgcggtgctgacctaccagggccgcgagctggacttgtcgaagccgttccaccgcctgaccatctgccaggcgatccaaaagttcgcgccgcaatacaccgacgcgcaactggccgatgccgatttcctgcgcaccgagctgaagaaatttggcgtgaacaccagcgcgccgcagttcctcaatgcaggcatcggtacgctgcaactcgtgctgttcgaggagaccgcggaaagccagctgtgggagccgactttcatcgtcgattacccggtggaagtctcgccgctggcacgtgcatcggacacagtgccgggcatcaccgaacgcttcgagctgttcatcacgggccgcgagatcgccaacggcttctcggagctcaacgacgcagaagaccaggccgatcgtttccgcaagcaggtcgagcagaaggacgccggcgatgaagaggcaatgtactacgacgccgactacattcgcgcgctggaatacggcatgcccccgacgggcggctgcggtatcggtatcgaccgactggtgatgctgctgacggacagcccgaacatccgcgacgtcattctgttcccgcacctgcgccgcgaagactga

SEQ ID NO: 32539 - protein, 516 aa, Ralstonia eutropha JMP134
MTEPNRAQAAPASPTAELPAADENKIIAERREKLAALRRQGVAFPNDFRPTHQAAALHEQYGETDQPALEATPVEVAIAGRMMLKRVMGKASFATVQDGSGQIQFYITRDKVGEDVYAAFKHWDLGDIISARGVLFRTNKGELSVQVQELRLLSKSLRPLPDKFHGLADQEMKYRQRYVDLIVSPETRNTFRARTKAMSSLRRHMSDAGFMEVETPMLHPIPGGAAAKPFITHHNALDMQMFMRIAPELYLKRLIVGGFERVFEINRNFRNEGVSPRHNPEFTMMEFYAAYTDYRWLMDFTENLIRQAAIDASGTAVLTYQGRELDLSKPFHRLTICQAIQKFAPQYTDAQLADADFLRTELKKFGVNTSAPQFLNAGIGTLQLVLFEETAESQLWEPTFIVDYPVEVSPLARASDTVPGITERFELFITGREIANGFSELNDAEDQADRFRKQVEQKDAGDEEAMYYDADYIRALEYGMPPTGGCGIGIDRLVMLLTDSPNIRDVILFPHLRRED

SEQ ID NO: 32540 - DNA, 1530 bp, Methylobacillus flagellatus KT
  CDS (1)..(1530)
atgagtgacgcgcaaaatgccaagacggtaaatgaagcagccagtgtgcagccggacgaaaaccatgtgatcgccgagcgccgcgagaagctcaaggcgattcgcgaacagggcgtggcctttcccaacgatttcaggcctgagcatatcgcacaaagcctgcatgatagttacgatgccgttgaagccgaggcgctggagtctcaggcactaggcgtggcgatcgctggtcgcatgatgctcaagcgcgtcatgggcaaggccagctttgccactgtgcaggatagaagcggccgcatccagatatttattaccagagaaaatgtcggcgaagcaacctacgacgctttcaagaaatgggacctgggcgatatcatcgcggcccggggaactttgttcaagaccaagacgggggagctttcggtcaaggtaagcgagctacgcctgctgaccaagtccctacgccccttgccggaaaagtttcatggtttggcagatcaggaaaccaaatatcgccagcgctatgtcgacctgattgtctccgaggaaacccgcaagactttcgtggcgcgcagcaagatcgtggcggcgattcgtgcgttcatgctcagccacgagtttctggaagtggagacgcctatgttgcatcccatccccgggggcgccgcagccaagcccttcatcacccaccataatgcgctggacctgcaaatgtacatgcggattgcgcccgagctttatctcaagcgcctcgtggttggcggtttcgaacgggtgttcgagatcaaccgtaatttccgcaacgaaggcttgagcgtaagacacaatcccgagttcaccatgatggagttttatgcggcctatacggactacaagtggctgatggatttcaccgagagttgcattcgtgctgcagcgattgcggcctgcgggtcagccgtggtcgaatatcaggggcgggagctggacttgggcaagccatttgaacgactgaccattatcggcgcaatccagaaatacgcgccgcagtacacgctggagcaattgagcgaccaggcatttctacgccaggagctcaaaaagttcggagtggaggccttaccccacttgggcctgggtgccttgcaactggccttgttcgaggaaacggcggaaagccagctctggaacccgacctatatcatcgattatccggtcgaggtatccccgctggcgcgtgcatccgatagcgatccctcaatcactgagcggtatgagttatttattacggggcgtgaaattgcgaatggcttctcggagttgaacgatgccgaagaccaggccgcccgcttccatgcgcaggtggccgccaaggaggctggcgatgacgaggccatgtattacgatggggacttcattcgtgcactcgagtacggcatgccgccgacaggggggtgcggtatcggcatcgatcgcttggtaatgctgctgaccgatagccccagtatacgtgacgtgatcctgtttccgcatatgcggccagaacattaa

SEQ ID NO: 32541 - protein, 509 aa, Methylobacillus flagellatus KT
MSDAQNAKTVNEAASVQPDENHVIAERREKLKAIREQGVAFPNDFRPEHIAQSLHDSYDAVEAEALESQALGVAIAGRMMLKRVMGKASFATVQDRSGRIQIFITRENVGEATYDAFKKWDLGDIIAARGTLFKTKTGELSVKVSELRLLTKSLRPLPEKFHGLADQETKYRQRYVDLIVSEETRKTFVARSKIVAAIRAFMLSHEFLEVETPMLHPIPGGAAAKPFITHHNALDLQMYMRIAPELYLKRLVVGGFERVFEINRNFRNEGLSVRHNPEFTMMEFYAAYTDYKWLMDFTESCIRAAAIAACGSAVVEYQGRELDLGKPFERLTIIGAIQKYAPQYTLEQLSDQAFLRQELKKFGVEALPHLGLGALQLALFEETAESQLWNPTYIIDYPVEVSPLARASDSDPSITERYELFITGREIANGFSELNDAEDQAARFHAQVAAKEAGDDEAMYYDGDFIRALEYGMPPTGGCGIGIDRLVMLLTDSPSIRDVILFPHMRPEH

SEQ ID NO: 32542 - DNA, 1722 bp, Crocosphaera watsonii WH 8501
  CDS (1)..(1722)
atgtcttccaatcaaccgcaacgggaacccaattcatcctctaatttagacgaaattcgcgccacacgcctcgaaaaagtagaacagttgaaaaaaataggcttaattccctatgcttatcaatggaaatctagccatgatgctgctagtttacaagataaatatgccagtttaaaaaatggggaagaagtcgaggtagacgttgcgatcgcaggaagaattatcgcccgtcgtgtctttggaaaactcgcttttttcagtttacaagacgaaagcggaactatccaattatatctggataaaaaagaaattcaggcacacatgagcgaactcgaaagtgcctttaatcatctcaaaaaattaacggacacaggggacattatcggagtcaaagggagtattaaaagaacggagaaaggagaactttctgttaaagtcaaagagtacgaaatattaactaaatccttattacctttacccgataaatggcacggtttaaccgatacagaaaaacgctatcgtcaacggtatgtagacttaattgttaacccccaagttagacaaacatttcgtcgtcgggcgcagattaccgcatctattagacgttacttagataaccagggttttatagaaatagaaacccccgttttacagtcagaagcagggggggcagaagcccgtccttttatcacctatcataacaccttagagatggatttgtatctgagaattgccacagaattacatctcaaacggttaattgtggggggttttgagaaagtatttgaaatgggaagaattttccgtaacgaaggggtttctaccaaacataatcctgagtttacctccattgaactatatcaagcttatgccgattataacgatatgatggagctaaccgaagcgattattaccaccgcagcagaagaagttttaggcactttaaacataacttatcaaggggaacaaattgacttatcaaccccttggagaagggtgacaatgaacgatattgttaaagagaaaagtgggttggattttgaggcatttacagactttgaaacagcaaaaactgaggtaaaaaaagcaggtttagaagtccctgagacctgtcaaagtttaggaaagttattaaacgaagtgtttgagcagactgtagaagaaagcctcattcaacccacatttatccttgattttcccgtagaaatttctcctttagctaaaccacaccgtgataaacaaggattagttgaacgctttgaattgtacattgtcggacgagaattagccaatagtttttcagaattaactgaccccattgatcaaagggaaagactagaaaaacaagcagaacaaaaagcagccggagacttggaggcacatagtgttgacgaagatttcttaacagcattagaatatggaatgcctcctactggtggtttaggaattggtattgatcgcctaattatgttattaactgattctgcgagtattcgggatgttattgctttccccttgctaaaaaatcagagtgttgccatcaaatcttttgactatgatgaagaaaaagaaactctcagggttgagtttactaatggtagtgtgtatcaatatcatgatgttcctaaaactatttatgaggagttagaaaaatcaccatctaaaggacagtatttcaatggcgaaattaaagataaatttggatttgatcgagaaaattaa

SEQ ID NO: 32543 - protein, 573 aa, Crocosphaera watsonii WH 8501
MSSNQPQREPNSSSNLDEIRATRLEKVEQLKKIGLIPYAYQWKSSHDAASLQDKYASLKNGEEVEVDVAIAGRIIARRVFGKLAFFSLQDESGTIQLYLDKKEIQAHMSELESAFNHLKKLTDTGDIIGVKGSIKRTEKGELSVKVKEYEILTKSLLPLPDKWHGLTDTEKRYRQRYVDLIVNPQVRQTFRRRAQITASIRRYLDNQGFIEIETPVLQSEAGGAEARPFITYHNTLEMDLYLRIATELHLKRLIVGGFEKVFEMGRIFRNEGVSTKHNPEFTSIELYQAYADYNDMMELTEAIITTAAEEVLGTLNITYQGEQIDLSTPWRRVTMNDIVKEKSGLDFEAFTDFETAKTEVKKAGLEVPETCQSLGKLLNEVFEQTVEESLIQPTFILDFPVEISPLAKPHRDKQGLVERFELYIVGRELANSFSELTDPIDQRERLEKQAEQKAAGDLEAHSVDEDFLTALEYGMPPTGGLGIGIDRLIMLLTDSASIRDVIAFPLLKNQSVAIKSFDYDEEKETLRVEFTNGSVYQYHDVPKTIYEELEKSPSKGQYFNGEIKDKFGFDREN

SEQ ID NO: 32544 - DNA, 1482 bp, Exiguobacterium sp. 255-15
  CDS (1)..(1482)
atggaaatgaacgatcaaatgcaggtgcgtctcggtaagatgaacgccatgcgtgaacaaggactcgatccgtttggtgcccgtttcgaacgtacaacagatacgacgagtattcgtgccgcttacggcgaacatgaaaaagaagaattggcagagctgaagccggacgtctcaatcgcgggtcgcgtcatgacgacacgccgtaaagggaaagttggctttacaaacgtccaggacgtcaatggtcaaatccaactgtatgtacgtaaagacgatgttggcgaagaagcgtacgaaatctataaaacatgtgacttaggtgatatcgtcggaatcagcggttacgtgttcaaaacgaatgtcggggaactgtctgttcacgtcacgtcgtttacattactgacgaaagcattgcgtccgcttccggataaatatcacggattaaaagacgtcgaacaacgctaccgtcagcgttacctggatttgatcacgaatacagaatcacgggaaacatttattgcacgcagtaaagtcattcgcggcattcgtcagtatctcgacagcctcggatacttggaagtcgaaacaccgatgttgcatacgattgcaggtggcgcttcggcacgtccgtttatcacgcatcataacgcactggatatgacgctttacatgcggatcgcgattgagttacatctcaaacgtttgattgtcggtggacttgaaaaagtttacgaaatcggccgcgtcttccggaatgaaggaatctcgacgcgtcataaccctgagtttacaatgattgagttatatgaagcctatgcagactataacgacatcatgaatctgacggaaaacttgattgcccacgtcgctcaagaagtacttggcacaacacaagtcacttacggtgaagatgtgattgatctgtctgtcggatggaaacgggcacacatggcggatctcgttaaagaagcaacgggtgttgatttctttgaagagatttcaaaagaacgtgcacatgaactcgcacatgaacatggcgttgaagtacaagcccatatgacgacaggacatattctcaatgaattcttcgagcagaaaatcgaagagtcgttggttcaaccgacattcgtctatggtcatccggttgaaatttcaccgcttgcgaagaagaatccggaagatcctcgctttacggatcgatttgaattgttcatcgttcgccgggaacatgccaatgcctttacggaattgaacgatccaatcgaccaacgtgaacgtttcgaagcccagcttgtcgaaaaagaagcagggaatgatgaagcgcatgaaatggacaatgatttcattgaagcgcttgagtacggtatgccgccgacaggaggtcttggtatcggaatcgaccgtcttgtcatgttgttgacaaacgctccttcgattcgtgatgtcttgctcttcccgacaatgcgtcaccagcaaaactaa

SEQ ID NO: 32545 - protein, 493 aa, Exiguobacterium sp. 255-15
MEMNDQMQVRLGKMNAMREQGLDPFGARFERTTDTTSIRAAYGEHEKEELAELKPDVSIAGRVMTTRRKGKVGFTNVQDVNGQIQLYVRKDDVGEEAYEIYKTCDLGDIVGISGYVFKTNVGELSVHVTSFTLLTKALRPLPDKYHGLKDVEQRYRQRYLDLITNTESRETFIARSKVIRGIRQYLDSLGYLEVETPMLHTIAGGASARPFITHHNALDMTLYMRIAIELHLKRLIVGGLEKVYEIGRVFRNEGISTRHNPEFTMIELYEAYADYNDIMNLTENLIAHVAQEVLGTTQVTYGEDVIDLSVGWKRAHMADLVKEATGVDFFEEISKERAHELAHEHGVEVQAHMTTGHILNEFFEQKIEESLVQPTFVYGHPVEISPLAKKNPEDPRFTDRFELFIVRREHANAFTELNDPIDQRERFEAQLVEKEAGNDEAHEMDNDFIEALEYGMPPTGGLGIGIDRLVMLLTNAPSIRDVLLFPTMRHQQN

SEQ ID NO: 32546 - DNA, 1527 bp, Burkholderia cepacia R1808
  CDS (1)..(1527)
atgaccgaaccgacccaaacgcagcccgccgtcgcggcggacgaaaaccagatcattgccgagcgccgcgacaagctgcgcgcgttgcgcgagcaaggcgtcgcgtatccgaacgatttccggccgacgcatcacgccgccgagctccagtcgacctacgccgactcggacaaggctgcgctcgaagcgaacccggtcgaggtgtcggtcgccggccgcatgatgctcaagcgcgtgatgggcaaggcgagcttcgcgacggtgcaggacggttcgggccagatccagttcttcgtgacgccgaacgacgtcggcgcggaaacctacgacgcgttcaagaagtgggacctcggcgacatcgtcgccgcgcgcggcgtgctgttccgcaccaacaagggcgagctgtcggtgcagtgcaaggagctgcgtttgctggcgaaggcgctgcgcccgctgccggacaagttccacggcctcgccgaccaggaaatgcgctatcgccagcgctacgtcgacctgatcgtcacgccggagacgcgcgacacgttccgcgcgcgcaccaagacgatctcgtcgatccgccgcttcatggagaacgccgacttcatggaagtcgaaacgccgatgctgcacccgatcccgggcggcgcggcggccaagccgttcatcacgcatcacaacgcgctcgacatgcagatgttcctgcgcatcgcgccggagctgtatctgaagcggctgatcgtcggcggcttcgagcgcgtgttcgagatcaaccgtaacttccggaacgaaggtgtgtcgccgcgccacaacccggaattcacgatgatggagttctacgccgcgtacaccgactaccgctggctgatggacttcaccgagcagctgatccgccaggcggcgatcgatgcgctcggcactgcgacgatccagtatcaaggccgcgagctcgatctcgcgaagccgttccatcgtctgacgatcacgcaggcgatccagaagtacgcgccgcagtacaccgacggccagctgtcggacgacgcattcctgcgcaccgaactgaagcgcctcggcgtcgacgtgtcgcagccggccttcctgaacgccggcatcggcgcgctgcagctcgcgctgttcgaggaaaccgccgagtcgcaactgtgggagccgacctacatcatcgactacccggtcgaagtgtcgccgctcgcgcgcgcgtccgatacggtgccgggcatcaccgagcgcttcgagctgttcatgacgggccgcgagatcgcaaacggcttctcggagctgaacgatccggaagatcaggctgcacgcttcaagaagcaggtcgagcaaaaggacgcgggcgacgaggaagcgatgttcttcgacgccgactacatccgcgcgctcgaacacgggatgccgccgaccggcggttgcgggatcggcatcgaccgtctcgtgatgctgctgaccgacagcccgacgatccgcgacgtgctgctgttcccccatctgcgccgcgaagactga

SEQ ID NO: 32547 - protein, 508 aa, Burkholderia cepacia R1808
MTEPTQTQPAVAADENQIIAERRDKLRALREQGVAYPNDFRPTHHAAELQSTYADSDKAALEANPVEVSVAGRMMLKRVMGKASFATVQDGSGQIQFFVTPNDVGAETYDAFKKWDLGDIVAARGVLFRTNKGELSVQCKELRLLAKALRPLPDKFHGLADQEMRYRQRYVDLIVTPETRDTFRARTKTISSIRRFMENADFMEVETPMLHPIPGGAAAKPFITHHNALDMQMFLRIAPELYLKRLIVGGFERVFEINRNFRNEGVSPRHNPEFTMMEFYAAYTDYRWLMDFTEQLIRQAAIDALGTATIQYQGRELDLAKPFHRLTITQAIQKYAPQYTDGQLSDDAFLRTELKRLGVDVSQPAFLNAGIGALQLALFEETAESQLWEPTYIIDYPVEVSPLARASDTVPGITERFELFMTGREIANGFSELNDPEDQAARFKKQVEQKDAGDEEAMFFDADYIRALEHGMPPTGGCGIGIDRLVMLLTDSPTIRDVLLFPHLRRED

SEQ ID NO: 32548 - DNA, 1527 bp, Rubrivivax gelatinosus PM1
  CDS (1)..(1527)
atgaccaccacgcccccgaacgccgccacgcccggcaccgacgacaaccagctgatcgccgaacgccgcgagaagctcgctgcactgcgtgcgcaggcccaggccacggggagagccgccttccccaatgacttcaagccgggcgaccatgccgtcgacctgcaccgcctgcacgagggcaagagcgccgaggagctggaggcgctggccatcccggcccgcatcgccggccgcatgatgctcaagcgcgtgatgggcaaggcctgcttcgcgacgctgcaggacggctcgggccgcatccagctctacatcacgtccgacgccgtcggcccggaggcgctggccgccttcaagcactgggacctgggcgacatcctcggcgccgagggcacgctgttcaagacccgcaccggcgagctgagcctcaaggtcggcacgatccggctgctgaccaagagcctgcggccactgcccgacaagttccacggcatggccgaccaggagctcaagtaccgccagcgcgaggtcgacctgatcatggacgaggcctcgcgcgagcgcttccgcgcgcgcagcaaggccgtgagctcgatccggcagttcatggtcgagcacggcttcctcgaggtcgagacgccgatgctgcaccccatccccggcggcgcgaacgccaagcccttcgtgacgcaccacaacgcgctcgaccagcagatgttcctgcgcatcgcgcccgagctctacctgaagcggctggtggtgggcggcttcgagcgggtgttcgagatcaaccgcaacttccgcaacgagggcgtgtcggtccggcacaaccccgagttcacgatgatggagttctacgcggcctactggacccaccacgacctgatggacttcaccgagcagatcctgcgccacgccgcgcgcaaggcggtgggcacggcgcagctcgcctacggtgggcaggccgtcgacctggaatcgccgttcgcgcggctctcggtgcgcgactcgctgatcgcccatgcaggattgagcgcggcggaagccgccgacaccacggtgctgcgcgcgaagctcgaagcgcatggcgagaaggctccggcgcactggtcgctcgccgaactgcagttcggcctgttcgaggcggccgtcgaggaaaagctgtggcagccgaccttcatcgtcgactacccggtggaggtgtcgccgctggcccgcgcctccgatgccgacccgacgatcaccgagcgcttcgagctcttcatcaccggccgcgagttcggcaacggcttctcggagctcaacgaccccgaggaccaggccgcgcgcttcgcggcccaggcctcgaacaaggacgccggtgacgaggaggcgatgtacttcgacaccgactacatccgcgcgctcgagcacggcctgccgcccaccggcggctgcggcatcggcatcgaccgactgatgatgctgttgaccgactcgccgaacatccgcgacgtgatcctgttccccgcgctgcggcgcgagggctga

SEQ ID NO: 32549 - protein, 508 aa, Rubrivivax gelatinosus PM1
MTTTPPNAATPGTDDNQLIAERREKLAALRAQAQATGRAAFPNDFKPGDHAVDLHRLHEGKSAEELEALAIPARIAGRMMLKRVMGKACFATLQDGSGRIQLYITSDAVGPEALAAFKHWDLGDILGAEGTLFKTRTGELSLKVGTIRLLTKSLRPLPDKFHGMADQELKYRQREVDLIMDEASRERFRARSKAVSSIRQFMVEHGFLEVETPMLHPIPGGANAKPFVTHHNALDQQMFLRIAPELYLKRLVVGGFERVFEINRNFRNEGVSVRHNPEFTMMEFYAAYWTHHDLMDFTEQILRHAARKAVGTAQLAYGGQAVDLESPFARLSVRDSLIAHAGLSAAEAADTTVLRAKLEAHGEKAPAHWSLAELQFGLFEAAVEEKLWQPTFIVDYPVEVSPLARASDADPTITERFELFITGREFGNGFSELNDPEDQAARFAAQASNKDAGDEEAMYFDTDYIRALEHGLPPTGGCGIGIDRLMMLLTDSPNIRDVILFPALRREG

SEQ ID NO: 32550 - DNA, 1506 bp, Magnetococcus sp. MC-1
  CDS (1)..(1506)
atggaaaccaacaccatgtcccaacaggaagagaaccagcagatcgccgcccgtaaagttaaactagaagccctgcgtgaagcgggggttaacccctatcccagcggctttaaacccgatattgacctcgcgagtgtgagtcgggccaacggcaatgagatggatccggctaccctggagcgggtgagcgtcaaggtggcggggcgcattatgctgctgcgcaactttggcaaactgacctttgccaccttgcaggatgagagtggtcgcctacagattagtgctcagcgggatgttgtgggggccgagctctacagcacggtttttcgcaagattgaggtaggggatattctaggggtggaggggcatctgttccgtaccaaggtgggggagctgacggtgcaggtggagcgctttgagctgctctctaaggcggtgcgccccctgccagagaagtttcacggcttggaggatgtagagacccgctaccgccagcgctatgtggatctgattgtgaataccgaggtgcgggagatctttaaaacccgcagtcgagtgattagccgcattcgccagtttatggagcatcggggctttttggaggtcgaaacccccatgatgcaccccattcctggtggcgcgacggcgcgtccctttgtgacccaccacaatgccttggataccgatctctatctgcgcattgcccctgagctctaccttaaacggctgattgtgggtggctttgagcgggtgttcgagattaaccgtaacttccggaatgaggggctttcgccccggcataacccagaatttaccatgatggagttttaccaagcctataccgactatcgggagttgatggattttaccgaggcgctggtgcaggatgtggtgaaagatgtcaatgagggtgaattgacggtggcgtatcaggggcaagagctggattttagcggcccatgggcgcggctaaccccggctgaggcgattgtgcgttatatggaggccgacgccgcacgcatcacagagcgtggttatctggagagtctggccgaatcgctgggcattaaagccgaaaccagttgggatgatggcatgctgctgctcaccatctttgaagagggggtggagcataagttgatggctcctacctttattatagactaccccatttcggtctcgccgctctcccgccgcagtgatgacaatcctgacattgcggagcggtttgagctctttattgcgggtcgtgaaatcgccaacgccttttccgagctcaatgaccccgccgatcaagccagccgctttcaaaagcaggtagaggccaaagatgcaggtaatgaggaggcgatgcactttgacgccgactatatccgcgccttggagtatggcatgccccccaccggtggtgagggcatcggcatcgaccgtttggtgatgctgttaaccgatgcggccaatattcgtgaagtattactcttcccgcagatgaagcgggaggggtga

SEQ ID NO: 32551 - protein, 501 aa, Magnetococcus sp. MC-1
METNTMSQQEENQQIAARKVKLEALREAGVNPYPSGFKPDIDLASVSRANGNEMDPATLERVSVKVAGRIMLLRNFGKLTFATLQDESGRLQISAQRDVVGAELYSTVFRKIEVGDILGVEGHLFRTKVGELTVQVERFELLSKAVRPLPEKFHGLEDVETRYRQRYVDLIVNTEVREIFKTRSRVISRIRQFMEHRGFLEVETPMMHPIPGGATARPFVTHHNALDTDLYLRIAPELYLKRLIVGGFERVFEINRNFRNEGLSPRHNPEFTMMEFYQAYTDYRELMDFTEALVQDVVKDVNEGELTVAYQGQELDFSGPWARLTPAEAIVRYMEADAARITERGYLESLAESLGIKAETSWDDGMLLLTIFEEGVEHKLMAPTFIIDYPISVSPLSRRSDDNPDIAERFELFIAGREIANAFSELNDPADQASRFQKQVEAKDAGNEEAMHFDADYIRALEYGMPPTGGEGIGIDRLVMLLTDAANIREVLLFPQMKREG

SEQ ID NO: 32552 - DNA, 1491 bp, Thermobifida fusca
  CDS (1)..(1491)
atgagtgaagtactggatgatctgccggaacagatgcgggttcgccgcgagaagctggaccgactgcgtcgggagggtgtcgacccctacccggtgaccttcccgcgcacgacgacgatcgcagaggtccgggcgaaacacggcgatctcgctccggacgtctacaccggggaacgcgtggccctgaccgggcgggtcatgctgtatcggaccggcggcaaactctgcttcgccacgatccgggacgcgtccggggacatccaggtcatgctctccctggacagggtgggcgccgagcgtttggcggcgtggaagagcgacgtcgacctgggcgaccacatcggtgtcgaaggggaagtgatcacttctcggcgaggcgagttgtcgatcctcgcggacacctggacgctgacctccaagtgcctgcgcccgctgccggacaagcacaaggggctgaccgaccctgaggcacgggtgcgccagcgctacgtggaccttatcgtcaaccccgagtcgcgggagatggtgatgcgccgcgcccgcacggtgcgtgcgctgcgcgacgggctgcacaaccgcggctacatcgaggttgagacgccgatgctgcagcaggtgcacggcggggcgacggcacgccccttcgtcacccacatcaacgcctacgacctcgacctctacctgcgcatcgcccccgaactgtacttgaagcggatggtggtcggcggggttgagaaggtcttcgaaatcaaccggaacttccggaacgagggcgcggactccacgcacaaccccgagttcacgatgctggagttctaccaggcctacgcggactacaacgtgatggccgacatcacccgcgaactcatccaggaagccgccgtcgcagtgttcggcagcacggtggtccagcggggcgacacagaggtcgacttgggcggcgagtggccgcagatcaccttgtacggcgcggtctctgaagcgctgggcgaagaagtcactccgcggaccccggtggagacgctgcggaagctggcggatgcgcgcggtgtcgaatggaacccggagtggggtccgggcaagctcgtcgagcaccttttcgaggagttggtccaagacagcctggtgcagccgacttttgtccgggactacccgcttgaaaccagcccgctgacccgccagcaccgtgaagacccgctgctcaccgagaagtgggatctcatcggattcggtatggagttgggcaccggatattccgagttgattgatccggtggagcagcgccgccgcttgactgagcagtctctgctggctgccgggggcgatcccgaggcaatgcagttggacgaggattttctgcgcgccttggagtacgccatgccgcctaccggcggtgtcggtgtgggcgtcgaccggctgttgatggcctttaccggaaagaacattcgcgagacgatcctgttcccattggtccgacaggaacagagataa

SEQ ID NO: 32553 - protein, 496 aa, Thermobifida fusca
MSEVLDDLPEQMRVRREKLDRLRREGVDPYPVTFPRTTTIAEVRAKHGDLAPDVYTGERVALTGRVMLYRTGGKLCFATIRDASGDIQVMLSLDRVGAERLAAWKSDVDLGDHIGVEGEVITSRRGELSILADTWTLTSKCLRPLPDKHKGLTDPEARVRQRYVDLIVNPESREMVMRRARTVRALRDGLHNRGYIEVETPMLQQVHGGATARPFVTHINAYDLDLYLRIAPELYLKRMVVGGVEKVFEINRNFRNEGADSTHNPEFTMLEFYQAYADYNVMADITRELIQEAAVAVFGSTVVQRGDTEVDLGGEWPQITLYGAVSEALGEEVTPRTPVETLRKLADARGVEWNPEWGPGKLVEHLFEELVQDSLVQPTFVRDYPLETSPLTRQHREDPLLTEKWDLIGFGMELGTGYSELIDPVEQRRRLTEQSLLAAGGDPEAMQLDEDFLRALEYAMPPTGGVGVGVDRLLMAFTGKNIRETILFPLVRQEQR

SEQ ID NO: 32554 - DNA, 1548 bp, Methanosarcina barkeri str. fusaro
  CDS (1)..(1548)
atgagcatggaaattaacaatgaaaaaatgtcagatagccttgtaccgtctgacaatgaatctgacaataatgatatttcagatagcagggtctttgatgattctaaacttgcaaaactaaacggcatcaaaagccagggacttaatccgtacccctataaatttgaaaagaatggggatatctgtgatatccagaaaaagttcgaggactttgaaaagaatgaagggctaacggttagaaccgcaggaaggctttacaatattcgcaggcttggaaaaatgatatttgccgatcttggagaccaggggggcagaattcaggttactttaaggaaaggaaatcttcctgatgaggatttcaagacttttaaaaccctggtagattcaggagatatcgtaggtgttcagggcacacttttcaggacaaaacggggtgagaactctatcagcgtgtccgaattctcccttctctcaaaatctctctgtgcccttcccgaaaaattccacggcttaaaagacgttgaaaccaggtacagaaaaaggtatcttgaccttatagtcaatgctgataagagagagattttcgtcatgaggagcaaactcatctctgagatcagacgatacctttctgacagggaatttctggaatttgaaactccaatactccagaatgtgtacggaggcgcaaatgcaaggcctttcacgactttccataactgtctcggtcagaaactcttccttagaattgctcctgaactttatcttaagaggcttgttgttggcggttacgagaaggtctttgagatctccaagaatttcaggaatgaagatatcgacacaactcataaccctgagttcaccatgatcgaagtctatgaagcttacagggattacaatgacatgatggatttaaccgaaggcctaatttcggaacttgtgttcaagctgactggcagctatgaagttaaaattggcgaaaacacacttaatcttcataccccctggaaaagaatttccatggaagatgccttaaaagaatatgctggacttgatgtttttgcacactcgcttgaagaattgaaacaaatcgcaatcgaaaacagaatcgaggactacgaaaaagcaaaaacttacggagagttccttgccttgctctttgaaggcctggtagaggacaagctgataaatccgactttcatttatgatttccctgtggaaaactcccctcttgccaaaaatcacaggtcaaaagaaggctttgtcgagagattcgagctcttcttaaatggctgggaattggcaaatggttattccgaactgaacgatcctattgaacagcaaaaaaggttcgaagaacaggacaagaaaagaaagttaggagaccttgaagcccagaccattgattacgatttcgtaaatgccctcggatacggaatgccccctacaggcggcatgggacttggaatcgacaggcttaccatgattctagcgggcctggactctatcaaagaagtaatccttttcccacagatgaaaagggaagactga

SEQ ID NO: 32555 - protein, 515 aa, Methanosarcina barkeri str. fusaro
MSMEINNEKMSDSLVPSDNESDNNDISDSRVFDDSKLAKLNGIKSQGLNPYPYKFEKNGDICDIQKKFEDFEKNEGLTVRTAGRLYNIRRLGKMIFADLGDQGGRIQVTLRKGNLPDEDFKTFKTLVDSGDIVGVQGTLFRTKRGENSISVSEFSLLSKSLCALPEKFHGLKDVETRYRKRYLDLIVNADKREIFVMRSKLISEIRRYLSDREFLEFETPILQNVYGGANARPFTTFHNCLGQKLFLRIAPELYLKRLVVGGYEKVFEISKNFRNEDIDTTHNPEFTMIEVYEAYRDYNDMMDLTEGLISELVFKLTGSYEVKIGENTLNLHTPWKRISMEDALKEYAGLDVFAHSLEELKQIAIENRIEDYEKAKTYGEFLALLFEGLVEDKLINPTFIYDFPVENSPLAKNHRSKEGFVERFELFLNGWELANGYSELNDPIEQQKRFEEQDKKRKLGDLEAQTIDYDFVNALGYGMPPTGGMGLGIDRLTMILAGLDSIKEVILFPQMKRED

SEQ ID NO: 32556 - DNA, 1476 bp, Geobacter metallireducens GS-15
  CDS (1)..(1476)
atggaagaactgagcgaattgctgcttcaaaggcggcgcaaggtcgatgccctctgggaggcagggatcaacccctaccccaatgactataaaccccggcacacatcggcggacgtggtggctgcgtatggaaagtgcgagattatagaagagggggcagacccctttgtggtggccggtcggatcattgctcgccgctccttcggcaaggccgccttcgtccagctccaggaccgcaaggggcgcatacagctctacgtgcgcaaggacactctcggtgacgaggcctatgaagcctttgagtccttcgatatcggcgacattatcggcgccaccggcacccccttccgcaccaagaccggcgagctctcccttaacgcgagcgaggtcaggctcctcaccaaatcgttccttcctcttccggagaaattccacggtctcaccgatgtcgagacccgatatcgccagcgctacgttgacctgatcgtgaatcccgaggtgcgggaggtcttcatcaagcgctcccggatcgtcaacctgatccgcgaattcatggtgcgtcacgacttcctcgaagtggaaacgcccatgatgcagccgattcccggaggagccacggcccgtcccttcgttacccaccacaacgccctcgacatggagctttttctccgcatcgcgccggagctctatctcaagcgtctggtggtcggagggttcgaacgggtcttcgagattaaccgcaacttccgcaatgagggaatttcggtccgtcacaacccggagtttaccatgatggagttctaccaggcctacgccaccttcgaggacctgatggatttcaccgaggagcttctctgtcacgtgacccaggaggtgctcggaaccctcgacttcacctatcagggggtggagatcagcttccagcgtccctggaagcggcttaccgtgaaggaggcgatcctcgagtacggcgacatcgacgcaaaatccctcgaagatcgcgacctggcctatgcctacgcccggagcatcgggctcgacctgccgaccgacgtgggctacggcaagcttatcaccgagattttcgaggaggtggcggaggtaaagctgatccagcccaccttcatcaccgcgtatcccacggaggtgtcgcccctttcacgcaagagcgacaaggatcccgatatcgtcgaccgtttcgagttcttttgcgccggccgcgagatggccaatgccttctcggagctcaacgaccccgtggaccagaaggagcgcttcctgggtcaggttgcccagaaagccaagggtgacgaagaggcccactacatggacgaggactacatacgcgcccttgagtacgggatgcctccgacggccggagaagggatcggcatcgaccgcctcgtcatgctcctgaccgactccccgtccatccgggacgtcattctcttcccgcaacttcgcaaggagaaataa

SEQ ID NO: 32557 - protein, 491 aa, Geobacter metallireducens GS-15
MEELSELLLQRRRKVDALWEAGINPYPNDYKPRHTSADVVAAYGKCEIIEEGADPFVVAGRIIARRSFGKAAFVQLQDRKGRIQLYVRKDTLGDEAYEAFESFDIGDIIGATGTPFRTKTGELSLNASEVRLLTKSFLPLPEKFHGLTDVETRYRQRYVDLIVNPEVREVFIKRSRIVNLIREFMVRHDFLEVETPMMQPIPGGATARPFVTHHNALDMELFLRIAPELYLKRLVVGGFERVFEINRNFRNEGISVRHNPEFTMMEFYQAYATFEDLMDFTEELLCHVTQEVLGTLDFTYQGVEISFQRPWKRLTVKEAILEYGDIDAKSLEDRDLAYAYARSIGLDLPTDVGYGKLITEIFEEVAEVKLIQPTFITAYPTEVSPLSRKSDKDPDIVDRFEFFCAGREMANAFSELNDPVDQKERFLGQVAQKAKGDEEAHYMDEDYIRALEYGMPPTAGEGIGIDRLVMLLTDSPSIRDVILFPQLRKEK

SEQ ID NO: 32558 - DNA, 1755 bp, Cytophaga hutchinsonii
  CDS (1)..(1755)
ttgaggttctattataatacgaaagacatgcaattgagtgaacaagaactggtacgccgccaggaacgtgaagagttattaaaaatgggtattgaaccataccctgcagaacttttccctgtaaatgtttcaacaaaagatattcatcagaattacgaaaagcgaaagacagattataaaaatatttctatcgctggccgtgtgatgagccgccgtattatgggtaatgcctctttcgttgagattcaggatgcaagcggtagaatccaggcatacttcagaagagatgatctttgtccggatgaagacaaaacacaatacaacaccgtatttaaaaagcttgtcggtatcggtgatattattggtatttacggatatgtgtttacaacacaaaccggagagatcacgattcatgttacttcatttaaaattttaacaaaagcacttcgtccgttgcccatgccaaaagaggcggtagatgagaacggagagaaaaaaatatttgatgcattcaccgatcctgaacagcgttaccgcatgcgttatgtggatctgattgtgaacccgcatgtgcgcgatgcttttatcaaacgtacacgtctggtaaataccatgcgtgagtacctgaataacaaaggatatttagaagtggaaacgccgatcttgcagcccttgtatggcggtgctgctgcgcgtccgttcaagacacaccacaatacattagatatgcctttgtatttgcgtatcgcaaatgagttatatctgaaacggttgatcgttggcggatttgatggagtatatgaattctctaaagatttccgtaacgaaggtatgtcccgtttccacaacccggaattcactcaggtagaattgtatgttgcatacaaggattactactggatgatggatctggttgaagagatggttgaaaaagttgctgttgccttacacggtactacagaggtacaggttggtccgcatacgatcagcttccagcgcccctggaaacgtttcactatgtttgaagcaatcgaacattatacaggtattaacattggtgaaatggatgaagcacaattacgtgcaacatgtaaatcattaaatgtggatgtagatgattcaatgggtaaaggtaaactcattgatgagatctttggcgcaaaatgcgaaccattattgatccagcctacattcattacagactatccggttgaaatgtcgccgttagcgaagaaacacagggacaagccaggtttggttgaacgttttgaagccatctgtaatggtaaagaaatctgcaattcattctctgaactgaatgacccgattgatcagcgtcagcgttttgaagaacagctggagcttggcaaaagaggtgacagcgagagtatggtactggatgaagattttcttcgtgcacttgaatacggaatgccgcctacagcaggccttggtattgggattgaccggttagcgatggttatgactaattcagcttcgatacaggatgtattattcttcccgcagatgcgtccggaagttggtacacagggagcatcttccaatggtttccagggcatagagatccgcggggaacttgttccgttgattgagaaattaggtatctctacggtagaacaattaaaagcagcaaacccgaataaattatttaatgatttgtgcggcttacgtaaaaaaatgaagcttgaaatcgcaaaccctacggctgatgaggtgaagggatggcaggcgtga

SEQ ID NO: 32559 - protein, 584 aa, Cytophaga hutchinsonii
MRFYYNTKDMQLSEQELVRRQEREELLKMGIEPYPAELFPVNVSTKDIHQNYEKRKTDYKNISIAGRVMSRRIMGNASFVEIQDASGRIQAYFRRDDLCPDEDKTQYNTVFKKLVGIGDIIGIYGYVFTTQTGEITIHVTSFKILTKALRPLPMPKEAVDENGEKKIFDAFTDPEQRYRMRYVDLIVNPHVRDAFIKRTRLVNTMREYLNNKGYLEVETPILQPLYGGAAARPFKTHHNTLDMPLYLRIANELYLKRLIVGGFDGVYEFSKDFRNEGMSRFHNPEFTQVELYVAYKDYYWMMDLVEEMVEKVAVALHGTTEVQVGPHTISFQRPWKRFTMFEAIEHYTGINIGEMDEAQLRATCKSLNVDVDDSMGKGKLIDEIFGAKCEPLLIQPTFITDYPVEMSPLAKKHRDKPGLVERFEAICNGKEICNSFSELNDPIDQRQRFEEQLELGKRGDSESMVLDEDFLRALEYGMPPTAGLGIGIDRLAMVMTNSASIQDVLFFPQMRPEVGTQGASSNGFQGIEIRGELVPLIEKLGISTVEQLKAANPNKLFNDLCGLRKKMKLEIANPTADEVKGWQA

SEQ ID NO: 32560 - DNA, 1509 bp, Microbulbifer degradans 2-40
  CDS (1)..(1509)
atgagcgattcacaaacaccaattaataccgatgacgaaaataaattagtagcagagcgccgcgccaagttagcggcaattcgcgagcagggcaatgcgttcccgaatgagtttcgtccgcaaaatcaagcgcaagatttacaagaaagccatggcgataaaactaaagaggctttagaagaagcggctgaagtggtgagtgtggccggtcgtattattcgcaaccgcggtgcgtttatggagctgcaagatggcagcggccgcatccagctatacgtaaccaaagaagcgcgtccgttcgcgaagtcgttggacttgggcgacattgttggtgcaaaaggtgtgctgcataagtccggtaaaggcgacttgtatgtaagcttagatgaataccagttgcttactaaggcattgcgcccgctaccggataagttccatggattggctgaccaagaaatgcgttatcgtcagcgctatgtggatttaattgcaaacccagaagtgcgaaaaacctttgttactcgatcgcgcgttgtgcaatttattcgaaactatttaaacgaaaaagcgtttttagaagtagaaacgcccatgctgcaaactattcctggtggtgcgtctgcacgcccatttattacgcaccacaatgcgctagatatggatatgtatttgcgcatcgcacccgagctttaccttaagcgtttggtggtaggtggtttcgaaagggtatacgagattaaccgcaacttccgcaacgaagggttatctactcgtcacaatccagaatttactatgttggagttttatcaggcttacgcggattacaatgacctgatggacttaaccgaagacatgctgcgcaacctagctcaaactgtgttaggcgatacgaaagttgtgaatacgttgccaagcaaaggcgacgacgagccagaaaccgttacctacgactttgctcagccgtttacacgtctatctgtgtttaactctattttgcagtacaacccagaattaaaagcagagaatatcgatacccttgaggccgcgcgtgaagtagctaaaaacctcggtgttcagctaaaagacagctacggtttaggcaaggttcaaatcgagatattcgagaaaaccgttgagcacagattaattcagccaacttttattacagagtacccaaccgaggtatctccacttgctcgtcgaagcgacagtaacccttttgttaccgatcgttttgagttctttgtgggtggtcgtgaaattgctaatggtttttcggagcttaacgatgctgaagatcaggcgcagcgctttaaagagcaggttgccgaaaaagacgccggcgatgacgaggctatgcattacgatgccgactatgtgcgagcacttgaatacggtttgccgccaactgcgggtgaaggtataggtatcgatcgtttggttatgttactaaccgattctccatctattcgcgacgtattgttgttcccgcatatgcgtcctgagtaa

SEQ ID NO: 32561 - protein, 502 aa, Microbulbifer degradans 2-40
MSDSQTPINTDDENKLVAERRAKLAAIREQGNAFPNEFRPQNQAQDLQESHGDKTKEALEEAAEVVSVAGRIIRNRGAFMELQDGSGRIQLYVTKEARPFAKSLDLGDIVGAKGVLHKSGKGDLYVSLDEYQLLTKALRPLPDKFHGLADQEMRYRQRYVDLIANPEVRKTFVTRSRVVQFIRNYLNEKAFLEVETPMLQTIPGGASARPFITHHNALDMDMYLRIAPELYLKRLVVGGFERVYEINRNFRNEGLSTRHNPEFTMLEFYQAYADYNDLMDLTEDMLRNLAQTVLGDTKVVNTLPSKGDDEPETVTYDFAQPFTRLSVFNSILQYNPELKAENIDTLEAAREVAKNLGVQLKDSYGLGKVQIEIFEKTVEHRLIQPTFITEYPTEVSPLARRSDSNPFVTDRFEFFVGGREIANGFSELNDAEDQAQRFKEQVAEKDAGDDEAMHYDADYVRALEYGLPPTAGEGIGIDRLVMLLTDSPSIRDVLLFPHMRPE

SEQ ID NO: 32562 - DNA, 1497 bp, Pediococcus pentosaceus ATCC 25745
  CDS (1)..(1497)
atgggtgaaaagcaacaaccaagtatgaatgaccaactaagagttcgtcgcgaaaagatgcaagaacttcgtgataagggcatcgatccatttggtcatcgttttgagagaacacatttagcagcacaattacacgaaaagtacagtgatatgacaaaggaagagcttgatgaacagggcgtggtagctacgattgccggccgtatgatctctaagcgtggtaagggtaaggtcggttttgcagatcttaaagaccgttctggaaaaatgcaattgtacgttcgtaaggatgttttaggcgaagatgtatacaaagtctttaagcgttctgatattggtgatttcctcggtgtaactggggatgtcatgaaaaccgatatgggtgaattaacaattaaagtaacgggactaactttcttaagtaaagcgctccgtcctcttcccgacaagttccatggtttacaaaacgttgaacaaatttatcgtcaacgttatcttgatttaattgctaatgatgatagtatggatcgtttcagaaaacggactaagattgtttcagcagtaagaagatatcttgatggtaatgattttgccgaagttgaaacaccagtgctacatactcaagctggtggagctagtgcacgtccatttattacacaccataatgccctagatatcaatttatatttacggattgcgttggaacttcatttaaaacggctaattgttggtggaatggaacgagtatacgaaatcggtcgcgtattcagaaatgaagggattgatactcgtcataatcctgaattcactatgctcgaaacatacgcagcttactttgatttccatgacgtaatggatgaaactgaaggaatttttaaggcagcagttgcagcggtttcagatgatggtaagattacgtaccaaggaacagaacttgacttaggtcaagattttgaacgtctacacatggtcgatgcaatcaagaaatatgcgggagtggacttttggcctaagatgtcggttgaagatgcgaagaaacttgctgatgaaaatggtatccactacgagtcttggtggacagttggacacatcatcaatgaattctttgaagaaaaggttcaagaccaattgaaacaaccggtgtttatttacggacatccagtagaaatttctccactagctaagaagaacgccgaagatgatcgttttacagatcgatttgagttgtacatcttaggtaatgaatatggtaatgcctttactgaattaaatgatcctatcgaccaacgggcacgttttgaagctcaagttgcagaacgtgaagcaggtaacgatgaagctgaaggtattgacgaagattatatcgaagcacttgaatatggtatgccaccaacagggggacttggaattgggattgatcgtttagtgatgttgctaactgatgctccttcaattcgtgatgtactattgttcccaacgatgaaacccatcgattaa

SEQ ID NO: 32563 - protein, 498 aa, Pediococcus pentosaceus ATCC 25745
MGEKQQPSMNDQLRVRREKMQELRDKGIDPFGHRFERTHLAAQLHEKYSDMTKEELDEQGVVATIAGRMISKRGKGKVGFADLKDRSGKMQLYVRKDVLGEDVYKVFKRSDIGDFLGVTGDVMKTDMGELTIKVTGLTFLSKALRPLPDKFHGLQNVEQIYRQRYLDLIANDDSMDRFRKRTKIVSAVRRYLDGNDFAEVETPVLHTQAGGASARPFITHHNALDINLYLRIALELHLKRLIVGGMERVYEIGRVFRNEGIDTRHNPEFTMLETYAAYFDFHDVMDETEGIFKAAVAAVSDDGKITYQGTELDLGQDFERLHMVDAIKKYAGVDFWPKMSVEDAKKLADENGIHYESWWTVGHIINEFFEEKVQDQLKQPVFIYGHPVEISPLAKKNAEDDRFTDRFELYILGNEYGNAFTELNDPIDQRARFEAQVAEREAGNDEAEGIDEDYIEALEYGMPPTGGLGIGIDRLVMLLTDAPSIRDVLLFPTMKPID

SEQ ID NO: 32564 - DNA, 1569 bp, Trichodesmium erythraeum IMS101
  CDS (1)..(1569)
atggctaaaagcgaaaccaggaatgaagtagaagttcgttcacaaaaagttgatgaattacgcgcccaaggaatagacccctatcctagtcaagccatagagcgatcgcataccactaagcaagtaatagatctattttctccaccagcaaaggaattagaacctggagaaacagaccccaatgaaaaattcttaaaggtttgcggtcgtattacttctaagcgagatagtggtagtattggttttattaacctaacagatgaaactggaaaaattcaacttaaaattgagaaaaaattagtaaagggcgaccctggtttaagctttaaacaagttcaaaaattattagatgtaggagattttgttagtgcggaaggaataggttgtcgtactaatagaggtgagttatcaattcaggtaaataaattggatgtgctctccaaagctattattccttttcctgactcttattatggtgtaaatgacccagaaatttgtcgccgtcaccgggaaatggatttggctggaaatgctgaagctttacagcgttttagagtgcggagcaaaattatgcaaagtattcgaacatatctttgggatgctaatttttatgaaatagaaacaccaattttacagtcaatttatggtggtgctgcagctcgaccttttgttactcatcataatgctttagatgtagatttatatttacgaattgctacagaattatttctcaaacgggcaatttgtggaggttttgaacgggtatttgaattaggaagagtatttagaaatgaaggaattgatagtactcataatcctgagtttacttccctagaagtttatcaggcttatgcagattattttgaaattctgggcttggtagaggatgttatttgttatagtttaaccaatattttgggggatttaaaacagatagaatatcaagggcaaactattagtttagaacgtcaatatgactatagtcaaaaatatcctaatttcacaggaaaacattggcaagtaaaaacaatggtggaagcagttaaggatgaaacaggactagattttgataacctagagttgccagaagctattcgagcagcagaaaaattaaacctgaaattatccaaattagaaactcaaagtttaggttatcttttatatgcagtttttgatcaaaaagtagagtcaactttaattcaacctacttttgtgattgattttccggttgaggttagcccgttagcaaaaagacatcatagtaaaccaggttttgtggaaagatttgagttgtttattcacggcacagaatattctaatggtttctccgagttaaatgatccacaagaccagcgccaacgttttgaggaacagatcgctcaaagagaggcaggggatgatgaagcgcacccaatggatgaagattttattcaagcgttatcactggggatgcctaactgtggtggaatgggtattggagtagaccgtctggtgatgttgctgacaaatactcaaagtattagggatgtcattatgtttccaactatgcgttcgactttaaaggattaa

SEQ ID NO: 32565 - protein, 522 aa, Trichodesmium erythraeum IMS101
MAKSETRNEVEVRSQKVDELRAQGIDPYPSQAIERSHTTKQVIDLFSPPAKELEPGETDPNEKFLKVCGRITSKRDSGSIGFINLTDETGKIQLKIEKKLVKGDPGLSFKQVQKLLDVGDFVSAEGIGCRTNRGELSIQVNKLDVLSKAIIPFPDSYYGVNDPEICRRHREMDLAGNAEALQRFRVRSKIMQSIRTYLWDANFYEIETPILQSIYGGAAARPFVTHHNALDVDLYLRIATELFLKRAICGGFERVFELGRVFRNEGIDSTHNPEFTSLEVYQAYADYFEILGLVEDVICYSLTNILGDLKQIEYQGQTISLERQYDYSQKYPNFTGKHWQVKTMVEAVKDETGLDFDNLELPEAIRAAEKLNLKLSKLETQSLGYLLYAVFDQKVESTLIQPTFVIDFPVEVSPLAKRHHSKPGFVERFELFIHGTEYSNGFSELNDPQDQRQRFEEQIAQREAGDDEAHPMDEDFIQALSLGMPNCGGMGIGVDRLVMLLTNTQSIRDVIMFPTMRSTLKD

SEQ ID NO: 32566 - DNA, 1491 bp, Streptococcus suis 89/1591
  CDS (1)..(1491)
atgtcaactgaacattttgaagaattaaatgaccaacagattgtccgtcgtgagaaaatgacggctcttgctgaacaaggcattgacccatttggaaaacgttttgagcgttctgccaattcagctgaattgaaggcccagtacgaagataaatcgaaagaagaattagaagaattgggacaaacagcaatcattgcaggtcgtattatgaccaagcgtggtaagggtaaggcaggtttcgcgcacattcaagaccgcgaaggccagattcaaatctacgttcgtaaggatgatgttggcgaagaaaactatgaaatcttcaaaaaagcagaccttggtgactttatcggtgtcgagggagatgtcttcaagacaaacgttggtgagttgtctatccatgctcgcaagttgactcacttgtctaaagcgctccgcccattgccagaaaaattccacggtttgacagacatcgagacccgctaccgcaaacgttatttggacttgattactaaccgcgagagctttgatcgctttgtgacccgctcaaaaattatctcagaaatccgccgttaccttgacggacttggtttcttggaagtggaaacacctgtccttcacaatgaagctggtggtgctgcagctcgtccattcatcacccaccacaatgcccaaaacattgacatggtccttcgtatcgcgacagaactccacctcaaacgcttgattgtcggtggtatggaacgcgtttatgaaatcggacgtatcttccgtaacgagggtatggatgcgactcacaaccctgagttcacgtcaatcgaggtctaccaagcttatgcagattacttggacatcatggacttgaccgaaggtattatacagcacactgccaaggctgttgtcggcgatggtcctgttacttatcaaggcactgaaattgctatccacgagccattcaagcgtatccacatggttgatgccattaaggaacaaactggcgtggacttctggcaagagatgagcttcgaggaagcaaaagcccttgcagctgagcacaaggtccctgtggaaaaacaccatacagaagttggtcaaatcatcaacagcttctttgaagaatacgttgaagcaactcttatccaaccaaccttcgtctatggtcacccagtagccgtatccccactggctaagaaaaacgatgaagacccacgcttcacagatcgcttcgagctcttcatcatgaccaaggaatacggaaatgcctttacagaattgaacgacccaatcgaccaattggaacgcttcgaagcccaagccaaagctaaagaactcggtgacgacgaagcgacaggcgttgactacgactacatcgaagccctcgaatacggtatgccaccaacaggtggacttggaatcggtatcgaccgcctctgcatgctcttaacagacacaacaactattcgggatgtactcctatttccgactatgaagtaa

SEQ ID NO: 32567 - protein, 496 aa, Streptococcus suis 89/1591
MSTEHFEELNDQQIVRREKMTALAEQGIDPFGKRFERSANSAELKAQYEDKSKEELEELGQTAIIAGRIMTKRGKGKAGFAHIQDREGQIQIYVRKDDVGEENYEIFKKADLGDFIGVEGDVFKTNVGELSIHARKLTHLSKALRPLPEKFHGLTDIETRYRKRYLDLITNRESFDRFVTRSKIISEIRRYLDGLGFLEVETPVLHNEAGGAAARPFITHHNAQNIDMVLRIATELHLKRLIVGGMERVYEIGRIFRNEGMDATHNPEFTSIEVYQAYADYLDIMDLTEGIIQHTAKAVVGDGPVTYQGTEIAIHEPFKRIHMVDAIKEQTGVDFWQEMSFEEAKALAAEHKVPVEKHHTEVGQIINSFFEEYVEATLIQPTFVYGHPVAVSPLAKKNDEDPRFTDRFELFIMTKEYGNAFTELNDPIDQLERFEAQAKAKELGDDEATGVDYDYIEALEYGMPPTGGLGIGIDRLCMLLTDTTTIRDVLLFPTMK

SEQ ID NO: 32568 - DNA, 1506 bp, Thiobacillus denitrificans ATCC 25259
  CDS (1)..(1506)
atgaccgaccccaccaacgcccccgccctcgacgaaaaccagatcatcgccgagcgccgcgccaagctcgccgcgatccgcgaggcgggcgtcgccttccccaacgacttcgagcgccgcgactacgccggcaggctcgcgcacgaacacggcgacaaatccaaggaagcgctcgaagccgaggccgtcgacgtgcagctggcgggccgcatgatgctcaagcgcgtgatgggcaaggcgagcttcgcgacgctgcaggacatgagcggccgcatccaggtctacgtctcgaacgacctgaccgggctcgacgcgcacgaggcgttcaagcgctgggacctcggcgacttcgtcggcgtgagcggcacgctgttcaagaccaacaagggcgaactgacgatccaggcaaaatcggtccgcttgctgtcgaaggcgctgcgtccgctgccggaaaaattccacgggctcgcggaccaggaacagaagtaccgccagcgctatctcgacctcatcaccaacgacgacgcgcggtcgaccttcgtgcgccgctcgaagatcatccaggcgatccgcgaattcatgaccggccacggctttctcgaagtcgagacgccgatgatgcacccgatccccggcggcgccgcggccaagcccttcgtcacccaccacaacgcgctcgacatggagctcttcctgcgcatcgcgcccgagctctatctcaagcggctcgtcgtcggcggcttcgagaaggtgttcgagatcaaccgcaacttccgcaacgagggcttgagcacgcgccacaaccccgagttcacgatgatggagttctacgaggcctaccgcgaatatcgctacctcatggacttcaccgaggcgctgatccgccacaccgcggtcgccgcgaccggctcgacgacgatttcctaccagggaagcacgatcgaactcggcacgcccttcgaccgcctgaccatcgtcgaggcggtgcgcaaataccaccccgagtacaccgtcgagcaactcaacgatcgcgactggctgaccgcgcaattcacggcgatgaaggccaagtaccgcgagcacgacgggctcggcggcctgcagctgaccttcttcgaggagacgaccgaggcgctgctcgtgcagccgaccttcattgtcgactacccggccgaagtctcgccgctggcgcgtcgctccgacacgcagcccgagatcaccgagcgcttcgaactcttcatcaccggccgtgaaatggcgaacggcttttccgaattgaacgacgccgaggaccaggccgaacgcttcatggagcaggtgcgcgccaaggaagccggcgacgaggaggcgatgcactacgacgccgacttcatccgcgcgctcgaacacggcctgccgccgaccggcggctgcggcatcggcatcgaccgcctcgtgatgctgctcaccgattcgccgtcgatccgcgacgtcatcctcttcccgcagatgcggcgcgaggcctga

SEQ ID NO: 32569 - protein, 501 aa, Thiobacillus denitrificans ATCC 25259
MTDPTNAPALDENQIIAERRAKLAAIREAGVAFPNDFERRDYAGRLAHEHGDKSKEALEAEAVDVQLAGRMMLKRVMGKASFATLQDMSGRIQVYVSNDLTGLDAHEAFKRWDLGDFVGVSGTLFKTNKGELTIQAKSVRLLSKALRPLPEKFHGLADQEQKYRQRYLDLITNDDARSTFVRRSKIIQAIREFMTGHGFLEVETPMMHPIPGGAAAKPFVTHHNALDMELFLRIAPELYLKRLVVGGFEKVFEINRNFRNEGLSTRHNPEFTMMEFYEAYREYRYLMDFTEALIRHTAVAATGSTTISYQGSTIELGTPFDRLTIVEAVRKYHPEYTVEQLNDRDWLTAQFTAMKAKYREHDGLGGLQLTFFEETTEALLVQPTFIVDYPAEVSPLARRSDTQPEITERFELFITGREMANGFSELNDAEDQAERFMEQVRAKEAGDEEAMHYDADFIRALEHGLPPTGGCGIGIDRLVMLLTDSPSIRDVILFPQMRREA

SEQ ID NO: 32570 - DNA, 1551 bp, Polaromonas sp. JS666
  CDS (1)..(1551)
atgtccatccaccccgctttgcccgcagccgacaatgcgattcccaccccgccagacgacaaccagctgatggtcgagcggcgcgaaaagctcaaggccctgcgcagcgccggcgtcgcttttccgaatgacgtccgacccgagcaccgggccgaggcactgtttgcgcagtacgacagcaagaccaaggaagagctgggacctttggccgtgaaggtgagcgtcgccggccgcatgatgctcaagcgggtgatgggaaaagccagctttgccaccctgcaggacgcttcgtttggtccgtcgggtgggcgcatccaggtgtacatcaacaacgagggcgtgggcgaagaagttcacaacgccttcaagcattgggacctgggcgacatcgtcgcggccaccggtacgctgttcaagaccaagaccggcgagctgtcgattcatgccaccagtatccggctggtcaccaaaagcctgcgccccctgcccgacaaattccacggcatggccgaccaggaagtcaaataccgccagcgctatgtggacctgatcatggacgagtccgcccgcaagcgcttcatggcgcgcagcaaggcggtgagtggccttcgcgaattcatggtggcccatgatttcctcgaggtggaaactcccatgctgcatccgattccgggtggcgccaatgccaggccgttcaagacgcatcacaacgcgctggaccaggaaatgttcctgcgtatcgcgcccgagctttacctgaaacgcctgatcgttggcggctttgaacgtgtgttcgagatcaaccgcagctaccgcaacgaaggcatcagcgtgcggcacaaccccgagttcaccatgatggagttctacgcggcctggtggaattattcggacctgatgaccttcaccgaagccctgattcgggacgcggcccagaaggtgacgggctccctgcaattgagctatggcggcaaggcggttgacctgagccagccctttgagcgtctcaccattcgcgaagccattctgaagcacaccgaagccggcgagcacgttgacgacatggtgtggctgaccaacgccctgaagaaactcggtgcaaccgaagccaaggaccgcttgtccacacgctcgctggccagcctgcaggtcctgtattttgaggaaacggtcgaggaaaaactctggcagccaaccttcatcatggagcacccgaccgaaatctcgccgctggcgcgcgccaacgatgcgcgccccgaggtcacggaacgctttgagctctacatcaccggccgcgaattcggcaatggtttttccgagctgaacgatgccgaggagcaggcggcccgcttcaacgcgcaggtggctgccaaggacgacggcgacgacgaagccatgttctacgaccatgacttcatccgcgccctcgaatacggcatgccgccgaccggcggctgcggcgtgggcatagaccggctgatgatgctactgaccgacagccccagcattcgcgatgtgatcttgttccccgcgctacgccgcgaagcgtaa

SEQ ID NO: 32571 - protein, 516 aa, Polaromonas sp. JS666
MSIHPALPAADNAIPTPPDDNQLMVERREKLKALRSAGVAFPNDVRPEHRAEALFAQYDSKTKEELGPLAVKVSVAGRMMLKRVMGKASFATLQDASFGPSGGRIQVYINNEGVGEEVHNAFKHWDLGDIVAATGTLFKTKTGELSIHATSIRLVTKSLRPLPDKFHGMADQEVKYRQRYVDLIMDESARKRFMARSKAVSGLREFMVAHDFLEVETPMLHPIPGGANARPFKTHHNALDQEMFLRIAPELYLKRLIVGGFERVFEINRSYRNEGISVRHNPEFTMMEFYAAWWNYSDLMTFTEALIRDAAQKVTGSLQLSYGGKAVDLSQPFERLTIREAILKHTEAGEHVDDMVWLTNALKKLGATEAKDRLSTRSLASLQVLYFEETVEEKLWQPTFIMEHPTEISPLARANDARPEVTERFELYITGREFGNGFSELNDAEEQAARFNAQVAAKDDGDDEAMFYDHDFIRALEYGMPPTGGCGVGIDRLMMLLTDSPSIRDVILFPALRREA

SEQ ID NO: 32572 - DNA, 1734 bp, Brachydanio rerio
  CDS (1)..(1734)
atggcagacggagctgtggtggatggagacaaactcagcaaaaatgagctgaaaaggcgcatgaaagctgagaagaaagcagctgagaaggaagccaaggtcaaagagcagcaggaacagaaggagaccaatgacaagccacagcagaacgcatacggggcagatgaggaaacactggaccccaatcaatacttcaagatacgttcacaagccattcaagccttgaagggaacagccgaagatccttaccctcacaaatttcacgtggacttgtctcttactgagttcattgagcgctataaccaccttcagcctggagaccacttgacagatgttgtcctcaatttatcaggtcgtgttcatgctaagagggcttcaggcgccaagctgctgttctatgatctgcgaggagaaggagtcaagctgcaggtcatggccaactccagaaactacacatcagaagaagcgtttgtgcacatcaacaacaaactgaggcgtggagacatcatcggggtccgggggaaccctggcaagacaaagaagggcgagttgagcatcatcccagtggagatgaccctgctgtctccatgtcttcatatgcttccacatcttcactttggcctgaaagacaaggaaaccaggttcagacagcgatatctggacctgattcttaatgattttgtgagacagaagtttgttactcgttccaagattatcacgtatctccgcagctttcttgaccagcttggatttctggagattgaaaccccaatgatgaacctgatccctggtggcgcagtagcaaagccatttatcacctatcacaatgatctgaacatgaacctgtacatgagaattgctcctgagctttaccataagatgttggtagttggaggaatcgaccgcgtgtacgagattggccgtcagttccgtaatgaaggcatcgatctcactcacaacccagagttcaccacctgtgagttctacatggcctatgccgactatcacgacctgatggaaatcacagagaagcttctctcaggaatggtgaagcacattaccggagcttataaagtgacgtatcatcctgatggtccagagggacaggcctacgaaatagacttcacccctcccttcaggcgaatcagcatgacccaagagctggagaaggagttgggtgtgaagtttccacctcctgacacctatgacagtggcgaaatgcgcaagttcttagacgacctgtgtgttcagaaagaagttgaatgtcctcctcccaggacaactgctcgacttcttgataagttggtgggagacttcctggaggtgaagtgcatcaacccaacatacatctgcgatcatccacagataatgagtcctcttgctaaatggcacagatcacagaaaggtctaactgaacgttttgaactctttgtgatgaagaaggagatctgcaatgcctacacagagttgaacgatcccatcagacagcgagaactgtttgagcagcaggctaaggctaaggcagaaggtgacgacgaggccatgttcattgatgagaccttctgcgccgctttagagtacggtcttccccccacagcaggatggggaatgggcatcgaccgcctcaccatgttcctcacagactccaacaacatcaaggaggtgctgcttttccctgccatgaagccagaagacaataaaccagctggacctgcagagggcacatcagtctaa

SEQ ID NO: 32573 - protein, 577 aa, Brachydanio rerio
MADGAVVDGDKLSKNELKRRMKAEKKAAEKEAKVKEQQEQKETNDKPQQNAYGADEETLDPNQYFKIRSQAIQALKGTAEDPYPHKFHVDLSLTEFIERYNHLQPGDHLTDVVLNLSGRVHAKRASGAKLLFYDLRGEGVKLQVMANSRNYTSEEAFVHINNKLRRGDIIGVRGNPGKTKKGELSIIPVEMTLLSPCLHMLPHLHFGLKDKETRFRQRYLDLILNDFVRQKFVTRSKIITYLRSFLDQLGFLEIETPMMNLIPGGAVAKPFITYHNDLNMNLYMRIAPELYHKMLVVGGIDRVYEIGRQFRNEGIDLTHNPEFTTCEFYMAYADYHDLMEITEKLLSGMVKHITGAYKVTYHPDGPEGQAYEIDFTPPFRRISMTQELEKELGVKFPPPDTYDSGEMRKFLDDLCVQKEVECPPPRTTARLLDKLVGDFLEVKCINPTYICDHPQIMSPLAKWHRSQKGLTERFELFVMKKEICNAYTELNDPIRQRELFEQQAKAKAEGDDEAMFIDETFCAALEYGLPPTAGWGMGIDRLTMFLTDSNNIKEVLLFPAMKPEDNKPAGPAEGTSV

SEQ ID NO: 32574 - DNA, 1506 bp, uncultured bacterium 577
  CDS (1)..(1506)
atgagcgaacaagaacaaaagacaccacagaatacaaatcaaattattgcggagcgtcgcgctaaattagctactttgcgtgaggcaggggctgcttttccaaatgattttcgccgtaatcatcttgcctcagacctccataagaaatatggcgatcaatcaaacgatactctggagaaagacccaatatctgttgaggtagctgggcgcatgattctaaaacgtgtaatgggtaaagctagcttcgccactattcaagatatgagcggccatattcaactatacattagtaatgatattacaggtgagtctgcacatgccgcattcaagcattttgatttaggcgatattttaggtgtccatggaacactgtttataactaagtccggtgaacttacaatacgtgtaaaaagcttacgcctgctgactaagtcattacgccccttgccagaaaagtttcatggactgactgaccaggaacaaaaatatcgtcagcgttatcttgatctgatctctaatgaagatacacgtaaagtatttttaactcggtctagaattattcagtctattcgtactttttttgaagaacgaggttatctagaagtagaaaccccaatgatgcaccctattccaggtggtgcggcagctcgcccttttatcacacatcacaatgctttaaatatggatttctatttacgaatagcaccggaactatatttaaagcgtctagtagtaagcggtatggagaaggtctttgaaataaatcgcagtttcagaaatgaaggcatttctacacgccacaatcctgagttcaccatgctggaattttacgaagcttaccaggatcatatatatcttatgaatcttactgaaacgctaattcgagaattagcaataaaggttctaggtactaccgaaatttcttatcaaggatataaaattaatctttcaaacccatttctgcgattatctatcacccaagcgattcagaaatttcacccggaacatactgatgcgcaattaaacgaccgtgcatacctaattaaaaaactagaagctctcaatattagctataaacctgaagatggaataggtaaattacagctttctttatttgatgaaacaaccgaacatttattaatggacccgacttttattgttgattatccgtcagaagtttcaccgttagctcgtcgaaatgataagaatccaggggtgactgaccgctttgaactctatataaccgggcgtgaaatggctaatggattttcagagttaaatgatccggaagatcaggcggcccgtttccaagagcaagtacgtgctaaagaatctggtgataaagaagccatgcactatgatggtgactatatccgagcattagagcatggcctaccccctactgccggagaaggtataggtatagaccgtttaattatgttacttactgatagtcctagtattcgggacgtaattttatttcctcatttgcgtcgtgaagattaa

SEQ ID NO: 32575 - protein, 501 aa, uncultured bacterium 577
MSEQEQKTPQNTNQIIAERRAKLATLREAGAAFPNDFRRNHLASDLHKKYGDQSNDTLEKDPISVEVAGRMILKRVMGKASFATIQDMSGHIQLYISNDITGESAHAAFKHFDLGDILGVHGTLFITKSGELTIRVKSLRLLTKSLRPLPEKFHGLTDQEQKYRQRYLDLISNEDTRKVFLTRSRIIQSIRTFFEERGYLEVETPMMHPIPGGAAARPFITHHNALNMDFYLRIAPELYLKRLVVSGMEKVFEINRSFRNEGISTRHNPEFTMLEFYEAYQDHIYLMNLTETLIRELAIKVLGTTEISYQGYKINLSNPFLRLSITQAIQKFHPEHTDAQLNDRAYLIKKLEALNISYKPEDGIGKLQLSLFDETTEHLLMDPTFIVDYPSEVSPLARRNDKNPGVTDRFELYITGREMANGFSELNDPEDQAARFQEQVRAKESGDKEAMHYDGDYIRALEHGLPPTAGEGIGIDRLIMLLTDSPSIRDVILFPHLRRED

SEQ ID NO: 32576 - DNA, 1491 bp, Candidatus Portiera aleyrodidarum
  CDS (1)..(1491)
atgattataaaaaattatttaattaaagatcgtttaaataagttacaagtattgagtaaaaccgcgaataaagctggaaaaagtgcattttataataaatttcgtcgtactagtttagcaaaaagtttaaaaaaaaattttggagaaaagaataaaaaacaattggttaattttaagttaacaacagcagttgcaggacgtattatgcgtaaaagggggccttttatagttgttcaagatgtaagtagtaacattcagctttatatagataaaaaaacaatttctaatgaaattcataaagatataaaagattgggatattggagatataattggagcaataggtgacattgataaatcaaaaattggtgaactatatttattggttaaaaaagcttatattttaactaaaagcataagacatttaccaagtaaatttcacggaataaaagatcaagaaattagatataggcacagatatttagatttaattatgaataaagaggtacgtaaaacgtttaaaattcgcacacgtattatatctgcgcttagaaagtttttttatgaactttattttttagaagcagagactcctatattacattcaatgccagggggagcaatagcaaaaccttttgaaacttataattattcattaaatataaaattgtatttacgaatcgcccctgaactttatttaaaaaggttagttgttggtggttttgaacgtgtatttgaaataaataaaaactttcgtaatgaaggcatttcaacttggcataatcctgaatttactatgttagaattttattgggcttttgcgacttataaggatttgatggaaatcacagaacatatgataagatttgttgctaatgaagcgttaggtacaacaagtatttacatcggaaagattttaaacattgatttatcagaaccttttgattgtttaagtatgcgagactcgctcattaagtatggtaaaactttttcaattaataactctgatttttatgatctagaaaatttgctttttttatctaaacgaattggattgaccgtagctaactataacaattatggaaatttacttaataaactatttgaagtaattgtagaacgaaaattaattaaaccaacttttgtcacagactatccagtagaagttagtcctttagcaagaagtaaagatagtaacctgaatataacagaaagatttgaattgtttatagggggtagagaaatagctaatggtttttctgaattaaatgattatatagaacaatctaaccgattttatttgcaattgagaaacaaatatacttatgatttgagttattttgatatggactatatacgtgccttagaatatggaatgcctccaacggctggagaaggagtaggaatagatcgtcttgttatgatacttacaaataaagattcaattcgagatgtattactttttcctttgctgcgtagccggaaattttaa

SEQ ID NO: 32577 - protein, 496 aa, Candidatus Portiera aleyrodidarum
MIIKNYLIKDRLNKLQVLSKTANKAGKSAFYNKFRRTSLAKSLKKNFGEKNKKQLVNFKLTTAVAGRIMRKRGPFIVVQDVSSNIQLYIDKKTISNEIHKDIKDWDIGDIIGAIGDIDKSKIGELYLLVKKAYILTKSIRHLPSKFHGIKDQEIRYRHRYLDLIMNKEVRKTFKIRTRIISALRKFFYELYFLEAETPILHSMPGGAIAKPFETYNYSLNIKLYLRIAPELYLKRLVVGGFERVFEINKNFRNEGISTWHNPEFTMLEFYWAFATYKDLMEITEHMIRFVANEALGTTSIYIGKILNIDLSEPFDCLSMRDSLIKYGKTFSINNSDFYDLENLLFLSKRIGLTVANYNNYGNLLNKLFEVIVERKLIKPTFVTDYPVEVSPLARSKDSNLNITERFELFIGGREIANGFSELNDYIEQSNRFYLQLRNKYTYDLSYFDMDYIRALEYGMPPTAGEGVGIDRLVMILTNKDSIRDVLLFPLLRSRKF

SEQ ID NO: 32578 - DNA, 1518 bp, Citrobacter freundii
  CDS (1)..(1518)
atgtctgaacaacacgtacagggcgctgacgcgatagccgaccttaacaatgaactgaaaacgcgccgtgagaagctggcgagcctgcgcgagcaggggatccccttcccgaacgatttccgtcgcgatcatacctcagaccaactgcatgctgacttcgacgcgaaagaaaacgaagagctggaagcgctgaacattgaggtttccgttgctggccgtatgatgacccgccgtattatgggtaaagcatcattcgttacgctgcaggatgttggcggccgtattcagctgtacgttgctcgcgacgatctgccggaaggcgtctacaacgagcagttcaaaaaatgggatctgggcgatatcctcggcgcgaaaggtaagttgttcaagaccaagaccggtgagctgtctatccactgtaccgagctgcgtctgctgacgaaagcgttgcgcccattgcctgataaattccacggtctgcaggatcaggaagcgcgctatcgtcaacgctacctggacctcatctctaacgatgaatcccgcaatacctttaaagtgcgttcacagattatggctggtatccgccagttcatggttggtcgtggctttatggaagttgaaaccccgatgatgcaggtgatccctggcggggcggcagcgcgtccgtttatcacccatcataacgcgctggatctggacatgtacctgcgtatcgcgccggaactgtacctcaagcgcctggtggttggcggcttcgaacgcgtattcgaaattaaccgtaacttccgtaacgaaggcatctctgttcgccataatccagagttcaccatgatggaactctacatggcttatgcggactacaaagatctgatcgaactgaccgaatcgctgttccgtacgctggcgcagaacgttctgggaacgactgaagtgccttacggcgaagaagtctttgactttggtaagccgttcgaaaaactgacgatgcgcgaagcgattcagaaataccgtccggaaaccaacatggccgatctggataacttcgattctgcaaaagcgattgcggaatctatcggcatcaaagttgagaagagctggggtctgggtcgtatcgtgaccgagatctttgaagaagttgcagaagcgcacctgattcaaccgaccttcattaccgagtacccgacagaagtttctccgctggcgcgtcgtaatgatgaaaatccggaaatcaccgatcgcttcgaattcttcattggcggacgtgaaatcggtaacggcttcagcgagctgaacgatgcagaagatcaggcgcagcgtttccaggatcaggttaacgccaaagatgcaggtgacgacgaagcgatgttctacgacgaagactatgttaccgctctggaacatggtctgccgccgactgcgggcctgggcattggtatcgaccgtatggttatgctgttcacaaacagccatactatccgcgacgtaatcctgttcccggcaatgcgcccggttaagtaa

SEQ ID NO: 32579 - protein, 505 aa, Citrobacter freundii
MSEQHVQGADAIADLNNELKTRREKLASLREQGIPFPNDFRRDHTSDQLHADFDAKENEELEALNIEVSVAGRMMTRRIMGKASFVTLQDVGGRIQLYVARDDLPEGVYNEQFKKWDLGDILGAKGKLFKTKTGELSIHCTELRLLTKALRPLPDKFHGLQDQEARYRQRYLDLISNDESRNTFKVRSQIMAGIRQFMVGRGFMEVETPMMQVIPGGAAARPFITHHNALDLDMYLRIAPELYLKRLVVGGFERVFEINRNFRNEGISVRHNPEFTMMELYMAYADYKDLIELTESLFRTLAQNVLGTTEVPYGEEVFDFGKPFEKLTMREAIQKYRPETNMADLDNFDSAKAIAESIGIKVEKSWGLGRIVTEIFEEVAEAHLIQPTFITEYPTEVSPLARRNDENPEITDRFEFFIGGREIGNGFSELNDAEDQAQRFQDQVNAKDAGDDEAMFYDEDYVTALEHGLPPTAGLGIGIDRMVMLFTNSHTIRDVILFPAMRPVK

SEQ ID NO: 32580 - DNA, 1497 bp, Escherichia coli
  CDS (1)..(1497)
atgtcaacagataccaatgattcaacaaatgagttatatgtcagaaaacaaaagttaagacaacttcgcgcccgaacgcctgttgtatttcccaatgactttagacggcagcataattctgttgaattatctgaacagtatggattattgactcatgaagatttaactaaaaaagacattaatgtcattatggctggacgtataatgtccagacggataatgggtaaatccatatttatgcatatacaggataataaaggccgtatacaactttattgttccagtgatatactccccgaatcaacgttttctgatatcaaaaaacttgatacaggagatataattggtattaaaggtaaactgtttaaaacaaaaacaaatgaattgtctgttaattgttatgaaatttctctcttaacaaaatcattaagaccattaccagacaagttccatggtttgcttgaccaagaactcagataccgccaaagatatgtagatctgattgtcaatcatgatacatatcgtacatttgaaactcggtcacggatattgactgaaattcgtcgttacatggcggaacatgattttatggaagttgaaacgcctatgatgcagtctattcccggtggtgcatccgcacggccttttattactcatcataatgcacttgatcaggacatgtttttaagaatatctccggaactgtatttgaaaagactggttgttggaggatttgaacgtgttttcgagattaaccgtaacttcagaaacgaaggaatatctccgcgtcataatcctgaatttacaatgatggaactctatatagcttatgcagatttccatgacctgattaattttactgaagacttattcagaacagtagctcaaaatgttcttggtaccacgcttatagaatatggcgatgaattgtttgattttggtaagccatttaacaaactcaccatgcgtgaatcaatcattaaatatggaaacggaattacactgactgacattgatgatattcagagtgcttctctgacagcaagaaaattgggaattactgtggaaccatcatggggggtgggccgtctgcagtcagaaatatttgaagaagttgttgaacagcatcttattcagccaacatttatcactgaatacccggcagaaatatcaccattagctcgtcgtaatgataaaaatccattatatacagatcgatttgaattttttattggtaaacgtgaaattgggaacggtttttcagagttaaatgatgcggaagatcaggcggaacgattcaaagagcaggtaaaagccaaagaagcaggagacgaggaggcgatgtattatgacgaggactacgttactgcacttgaatatggcatgcctccgactgcaggtctgggaattggtattgatcgtatgataatgttatttacaaactgtcataccattcgcgatgttattatgtttcctgccatgagaacatcaaagtaa

SEQ ID NO: 32581 - protein, 498 aa, Escherichia coli
MSTDTNDSTNELYVRKQKLRQLRARTPVVFPNDFRRQHNSVELSEQYGLLTHEDLTKKDINVIMAGRIMSRRIMGKSIFMHIQDNKGRIQLYCSSDILPESTFSDIKKLDTGDIIGIKGKLFKTKTNELSVNCYEISLLTKSLRPLPDKFHGLLDQELRYRQRYVDLIVNHDTYRTFETRSRILTEIRRYMAEHDFMEVETPMMQSIPGGASARPFITHHNALDQDMFLRISPELYLKRLVVGGFERVFEINRNFRNEGISPRHNPEFTMMELYIAYADFHDLINFTEDLFRTVAQNVLGTTLIEYGDELFDFGKPFNKLTMRESIIKYGNGITLTDIDDIQSASLTARKLGITVEPSWGVGRLQSEIFEEVVEQHLIQPTFITEYPAEISPLARRNDKNPLYTDRFEFFIGKREIGNGFSELNDAEDQAERFKEQVKAKEAGDEEAMYYDEDYVTALEYGMPPTAGLGIGIDRMIMLFTNCHTIRDVIMFPAMRTSK

SEQ ID NO: 32582 - DNA, 1788 bp, Mus musculus
  CDS (1)..(1788)
atggccacgctgcaggagagtgaagtcaaagtggatggcgagcagaaactaagcaagaatgagctgaagaggcgtctgaaagctgagaagaaactggcagagaaggaggccaagcagaaagagctgagtgagaaacagctaaaccagactgcttccgctcccaaccacacggctgacaatggcgtgggtgctgaggaggagactctggacccaaatcaatactacaagatccgaagtcaagccgtccagcagctgaaggtcactggggaggatccgtacccacacaagttccacgtggacatctcactcactcagttcatccaagaatatagtcacctgcagcctggggaccacctgactgatgtcaccctcaaagtggcaggccgcatccacgccaagagggcctctggagggaagctcatcttctatgacctgcgaggagagggggtcaagttacaagtcatggccaactccaggaattacaaatcagaggaggaatttgttcatatcaataacaaactgcgccggggagacataattggagttgagggcaatcccgggaaaaccaagaagggcgagctgagcatcatcccccaggagatcacgctgctgtccccctgcttgcacatgctgcctcatcttcactttggcctcaaagacaaggaaacacggtatcgtcaaagatacttggacttgatcctgaacgactttgtgaggcagaaatttatcgtccgctctaagatcatcacatacataagaagtttcttggatgagctgggcttcctagagatcgaaactcccatgatgaacatcattcccgggggagctgaggccaagcctttcatcacctatcacaatgagctggacatgaacttgtatatgagaattgctccagaactctaccacaagatgctggtggttggtggcattgaccgggtttatgaaattgggcgccagttccggaacgaagggattgatttgactcacaatcctgagttcaccacctgtgagttctacatggcctatgcagactatcatgacctcatggagatcacagagaagatgctgtcagggatggtgaagagcattacaggcagttacaagatcacctaccacccagatgggccggaaggccaagcctacgaggtcgacttcaccccacccttccgaagaatcagcatggtagaagagcttgagaaagccctaggtgtgaagctgccagaaaccagtctctttgaaactgaagaaactcggaaaattcttgatgatatttgtgttgcaaaagctgttgaatgccccccacctcggaccacagccaggctccttgataagctcgttggcgagttcctcgaagtcacatgcatcagccctaccttcatctgtgatcacccacagatcatgagtcctttggccaaatggcaccgctccaaagggggtctcacggagcgctttgagctgtttgtcatgaagaaggagatatgcaatgcctatactgagctgaatgaccccgtgcggcagaggcagctgtttgaggagcaggccaaggccaaggctgccggtgatgacgaggccatgttcatagacgagaacttctgtactgccctggaatacgggctgcctcccacagcgggctggggcatgggcattgatcggctcaccatgtttctcaccgattccaacaatatcaaggaagtacttctgtttcctgccatgaagccagaggacaagaaggaaactgcagcgaccactgaaaccccagagagcacagaggccagcccctctgtctag

SEQ ID NO: 32583 - protein, 595 aa, Mus musculus
MATLQESEVKVDGEQKLSKNELKRRLKAEKKLAEKEAKQKELSEKQLNQTASAPNHTADNGVGAEEETLDPNQYYKIRSQAVQQLKVTGEDPYPHKFHVDISLTQFIQEYSHLQPGDHLTDVTLKVAGRIHAKRASGGKLIFYDLRGEGVKLQVMANSRNYKSEEEFVHINNKLRRGDIIGVEGNPGKTKKGELSIIPQEITLLSPCLHMLPHLHFGLKDKETRYRQRYLDLILNDFVRQKFIVRSKIITYIRSFLDELGFLEIETPMMNIIPGGAEAKPFITYHNELDMNLYMRIAPELYHKMLVVGGIDRVYEIGRQFRNEGIDLTHNPEFTTCEFYMAYADYHDLMEITEKMLSGMVKSITGSYKITYHPDGPEGQAYEVDFTPPFRRISMVEELEKALGVKLPETSLFETEETRKILDDICVAKAVECPPPRTTARLLDKLVGEFLEVTCISPTFICDHPQIMSPLAKWHRSKGGLTERFELFVMKKEICNAYTELNDPVRQRQLFEEQAKAKAAGDDEAMFIDENFCTALEYGLPPTAGWGMGIDRLTMFLTDSNNIKEVLLFPAMKPEDKKETAATTETPESTEASPSV

SEQ ID NO: 32584 - DNA, 1551 bp, Methanosarcina barkeri
  CDS (1)..(1551)
atgaccatggagattaacaacgaaaaaatgtcagatagccttgtaccgtctggcaatgaatctgacaataatgatatttcagatagcagggtctttgatgattctaaacttgcaaaactaaacggcatcagaagtcagggacttaatccatacccctataagtttgaaaagaatggggatatctgtgaaatccagaaaaagttcgaagactttgaaaagaatgaagggctaacggtcagaaccgcaggaaggctctacaatattcgcaggcttggaaaaatgatatttgctgaccttggagaccaggggggcagaattcagataactttaaggaaaggaaatcttcctgatgaggatttcaagacttttaaaaccctggtcgattcgggagatattgtaggcgttcagggcacacttttcaggacaaaaagaggtgaaaattccatcagtgtatccgaattttctcttctctcaaaatccctctgtgccctccccgaaaaattccacggcttaaaagacgttgaaaccaggtacagaaaaaggtatcttgaccttatagtcaatgctgataagcgagagattttcgttatgaggagcaaacttatatccgagatcagacgatacctttctgacagggaatttctggaatttgaaactccaatactccataatgtgtacggaggcgcaaatgcaaggcctttcacaactttccataactgtctcgggcagaactcttcccttagaattgctccggaactctaccttaagaggcttgttgttggtggatatgagaaagtctttgagatcaccaagaatttcaggaatgaagatattgacacaacccataaccctgagttcaccacgattgaagtctatgaagcttatagggactacaatgacatgatggacttaactgaaggcctcatttcagagcttatgttcaagctgactggcagctatgaagtcaaaataggcgaaaacacgctcaatctcagtactccctggaaacgtatttccatggaagacgccttaaaagagtatgccgggcttgatgtttttgctcactcgcttgaagagttgaagcaaatcgcaatcgagaacaaaatcgaggactacgaaaaggcaaatacttacggagagttccttgccctgctctttgagggtctggtagaagacaagctgataaacccgactttcatatacgattaccccgtggaaaattctccacttgccaaaaaccccacaggtcaaaagaagggtttgttgagagattcgagctatttcatgaatggctgggaactggcaaacggttattccgaactgaatgatcctattgaacagaaaaaaaggttcgaagaacaggacaagaaaagaaagttaggagaccttgaagcccagaccattgattacgatttcgtaaatgcccttggatacggaatgccacctacgggtggcatggggcttgggatcgacaggcttaccatgatacttgtgggcctggactctatcaaagaagtaatccttttcccgcagatgaagagagaagattga

SEQ ID NO: 32585 - protein, 516 aa, Methanosarcina barkeri
MTMEINNEKMSDSLVPSGNESDNNDISDSRVFDDSKLAKLNGIRSQGLNPYPYKFEKNGDICEIQKKFEDFEKNEGLTVRTAGRLYNIRRLGKMIFADLGDQGGRIQITLRKGNLPDEDFKTFKTLVDSGDIVGVQGTLFRTKRGENSISVSEFSLLSKSLCALPEKFHGLKDVETRYRKRYLDLIVNADKREIFVMRSKLISEIRRYLSDREFLEFETPILHNVYGGANARPFTTFHNCLGQNSSLRIAPELYLKRLVVGGYEKVFEITKNFRNEDIDTTHNPEFTTIEVYEAYRDYNDMMDLTEGLISELMFKLTGSYEVKIGENTLNLSTPWKRISMEDALKEYAGLDVFAHSLEELKQIAIENKIEDYEKANTYGEFLALLFEGLVEDKLINPTFIYDYPVENSPLAKNPTGQKKGLLRDSSYFMNGWELANGYSELNDPIEQKKRFEEQDKKRKLGDLEAQTIDYDFVNALGYGMPPTGGMGLGIDRLTMILVGLDSIKEVILFPQMKRED

SEQ ID NO: 32586 - DNA, 1878 bp, Homo sapiens
  CDS (1)..(1878)
atgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaggaagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcagttctgtctag

SEQ ID NO: 32587 - protein, 625 aa, Homo sapiens [sequence omitted]

SEQ ID NO: 32588 - DNA, 1536 bp, Methanosarcina acetivorans
  CDS (1)..(1536)
atgactatggaaattaacaatacggacccgtctgaaaatatgcctctgcctgatgatgttgatttatcgggctccagggcttttgatgactcaaaacttgcaaaattaaacggtatcataagccagggactcgatccctatccctacagattcgaaaagaacggggatatctgcgagatcctggtaaagttcgaggactttgaaaagaacgaaggcttatctgtccggactgcaggcaggctctacaatatcagaaagcacggaaaaatgatatttgccgatctaggggaccagaccggcaggattcaggttcttatcaggaaagggaacctccctgacgaggaattcgcgactttcaagaaccttatggattccggagatatcataggcattcagggcgagcttttcaggacaaaaagaggggaaaattcaatcagcgtatccgagttttctctgctctccaaatccctctgcgccctccccgagaagttccacggcttaaaagatgttgaaacaaggtacaggaagagataccttgacctcatagtcaatgccgaaaagagggagattttcgtaatgaggagcaagctcatctcggaaatcagaaggttccttgctgacagggaatttctggagtttgaaaccccaatcctccagaccgtgtacggaggagcaaatgcaaggcccttcaagactttccacaactgcctcgggcagaacctcttcctcaggatcgctccggaactttacctcaagaggcttgtcgtcggcggctacgagaaggtctttgagatttccaaaaacttcagaaacgaagacatcgacaccacccacaaccccgagttcacaatgatcgaggtctacgaggcttaccgggattataacgatatgatggatttaaccgaagccctgatctcggaactcgtgttcaggctgacaggcggctacgaagtcaaaatgggcgaaaacacaatcaacctccgctccccctggaagaggatttccatggaaggcgccttaaaagagtatgcgggtcttgacgtcttttcccattcgcttgaagaactgaagcaaatcgcaatccagaacaggatcgaggactacgaaaaggcaaagagtcatggggagttccttgccctgctttttgaaggtcttgtagaagacaagctcgtaaacccgactttcatctacgacttcccggttgaaaactcccctctcgctaaaaaccacagagaaaaagaaggttttgttgagcgtttcgaactcttcctcaacggctgggaactggcaaacggctattcagaattaaacgaccccctcgaacaggaaaagaggttcgaagaacaggacaagaaaagaaagctcggagaccttgaagcccagaccgttgattatgacttcataaacgccctcggatacggcctgcccccgaccggtggtatggggctcggaatcgaccgccttacaatgattcttgcgggccttgagtccatcaaggaagtaatccttttcccgcagatgaaaagggaggactga

SEQ ID NO: 32589 - protein, 511 aa, Methanosarcina acetivorans
MTMEINNTDPSENMPLPDDVDLSGSRAFDDSKLAKLNGIISQGLDPYPYRFEKNGDICEILVKFEDFEKNEGLSVRTAGRLYNIRKHGKMIFADLGDQTGRIQVLIRKGNLPDEEFATFKNLMDSGDIIGIQGELFRTKRGENSISVSEFSLLSKSLCALPEKFHGLKDVETRYRKRYLDLIVNAEKREIFVMRSKLISEIRRFLADREFLEFETPILQTVYGGANARPFKTFHNCLGQNLFLRIAPELYLKRLVVGGYEKVFEISKNFRNEDIDTTHNPEFTMIEVYEAYRDYNDMMDLTEALISELVFRLTGGYEVKMGENTINLRSPWKRISMEGALKEYAGLDVFSHSLEELKQIAIQNRIEDYEKAKSHGEFLALLFEGLVEDKLVNPTFIYDFPVENSPLAKNHREKEGFVERFELFLNGWELANGYSELNDPLEQEKRFEEQDKKRKLGDLEAQTVDYDFINALGYGLPPTGGMGLGIDRLTMILAGLESIKEVILFPQMKRED

SEQ ID NO: 32590 - DNA, 1536 bp, Methanosarcina mazei
  CDS (1)..(1536)
atgactatggaaattaacaacacggatccatttgaaaaaatgcccctccctgatgattccggtttatccggttcaggggcttttgatgactcaaaacttgcaaaattaaatggtgttataagccagggcctcaacccctatccctataaatttgaaaaagatgaagacatctgtgagatcctggaaaaatttgaggactttgaaaagaacgaaggattgactgtaagaactgctggaaggctctacaacatccgcaagcacggaaagatgatatttgccgatctgggtgaccaggcaggcagggtccaggtgctcgtaaggaaaggaaacctcccggacgaggaattcgagatttttaaaaatcttgtagattccggagatataattggtgttcagggtgatcttttcaggacaaagagaggggaaaactcgatcagcgtttcggaattctccctgctctcaaaatccctctgcgcccttccggaaaagttccacggcttaaaagatgttgaaacaaggtacaggaagaggtacctcgaccttatagtcaatgccgaaaaaagggaaatttttgttatgaggagcaagctcatatcggaaatcagaaggttccttactgacagggaattcctggagttcgagacccctatactccagaccgtgtacgggggagcaaatgcgaggcctttcacaactttccacaactgtctcgggcagaacctttttctgagaattgcccccgaactttacctcaagaggcttgttgtcggcgggtatgagaaggttttcgagatctgcaaaaatttcaggaacgaagacatagacacaactcacaaccctgagttcacgatgatcgaggtctatgaagcttacagggactataatgacatgatggacttaaccgaatccctggtctcggaacttgttttcaagcttacaggcagttatgaagtgcagatgggagagaaaactatcaacctccgttctccctggaagaggatttccatggaggatgctttaaaggaatatgccgggcttgacatctttgcccattctattgaagacctgaagaaaatcgccatcgaaaacaggatagaggactacgagaaagcaaagagccacggtgagttccttgccctgctctttgagggccttgtagaggacaagctgatagacccgactttcatatacgacttccccgtagaaaactccccgcttgccaaaaaccacagggagaaagcaggttttgtcgagcgttttgagcttttccttaacggctgggagctggcaaacggttactccgaattaaacgaccctcttgagcaggaaaagaggtttgaggaacaggacaagaaaaggaaactgggagaccttgaagcccagaccgtcgattatgacttcataaacgctctcggatatggcctgccccctaccggaggcatggggcttgggattgaccgccttaccatgatcctttccggtctcgaatccatcaaagaagtaatcctcttcccgcagatgaaaagggaagactga

SEQ ID NO: 32591 - protein, 511 aa, Methanosarcina mazei
MTMEINNTDPFEKMPLPDDSGLSGSGAFDDSKLAKLNGVISQGLNPYPYKFEKDEDICEILEKFEDFEKNEGLTVRTAGRLYNIRKHGKMIFADLGDQAGRVQVLVRKGNLPDEEFEIFKNLVDSGDIIGVQGDLFRTKRGENSISVSEFSLLSKSLCALPEKFHGLKDVETRYRKRYLDLIVNAEKREIFVMRSKLISEIRRFLTDREFLEFETPILQTVYGGANARPFTTFHNCLGQNLFLRIAPELYLKRLVVGGYEKVFEICKNFRNEDIDTTHNPEFTMIEVYEAYRDYNDMMDLTESLVSELVFKLTGSYEVQMGEKTINLRSPWKRISMEDALKEYAGLDIFAHSIEDLKKIAIENRIEDYEKAKSHGEFLALLFEGLVEDKLIDPTFIYDFPVENSPLAKNHREKAGFVERFELFLNGWELANGYSELNDPLEQEKRFEEQDKKRKLGDLEAQTVDYDFINALGYGLPPTGGMGLGIDRLTMILSGLESIKEVILFPQMKRED

SEQ ID NO: 32592 - DNA, 1779 bp, Saccharomyces cerevisiae
  CDS (1)..(1779)
atgataaacttcaatagcataatgtctcaacaagataatgtcaaagccgccgctgaaggtgttgctaacctacatctcgacgaagctaccggggaaatggtctccaagtctgaattgaagaagcgtatcaagcaaagacaagtcgaagctaaaaaggccgccaaaaaggctgccgctcaaccaaaaccggcttccaaaaaaaaaacagatttgttcgctgacctggatccatcgcaatatttcgaaacaagatctcgccaaattcaagaattgagaaagactcacgaaccaaatccatacccacacaagtttcacgtttctatatccaatcctgagttcttggccaaatatgcgcatttgaaaaaaggtgaaaccttacctgaagagaaggtttcaattgctggtagaattcatgccaaaagagaatctggctccaaattgaaattctatgttcttcacggtgatggtgttgaagttcaattgatgtcccaattgcaggactactgcgacccagactcttacgaaaaggatcacgaccttttgaaaaggggtgatatcgttggtgtcgagggttacgtcggaagaactcaaccaaagaaaggtggtgaaggtgaagtttccgtcttcgttagcagagtgcaattattgacaccatgtttgcacatgttacctgccgaccactttggtttcaaagaccaggaaaccagatacagaaagcgttatttggatttgatcatgaacaaagacgccagaaaccgttttattacccgttctgaaattatccgttacatcagaagatttttggaccaaagaaagtttattgaagtagaaactccaatgatgaacgttattgctggtggtgctaccgctaagccatttattacccaccataatgaccttgatatggacatgtacatgagaattgctccagaattgttcttgaaacaattggttgtcggtggtttggatcgtgtttacgaaattggtagacaattcagaaatgaaggtatcgatatgacacataatccagaattcaccacttgtgagttttatcaagcctacgctgatgtttatgatttgatggatatgactgaattgatgttttcagaaatggtcaaggagatcactggttcttatattatcaaataccatccggaccctgctgatccagccaaagaactagaattgaacttttctagaccatggaagagaatcaacatgattgaagaattagaaaaggtattcaacgttaagttcccatctggtgatcaattacatacagctgagactggtgaatttttgaaaaagattcttgtcgacaacaaattagaatgtccacctccactaactaatgctcgtatgttagataagcttgtcggtgaattagaagatacatgtatcaacccaactttcatttttggccaccctcaaatgatgtctccattagccaagtactcaagagatcaaccgggtctatgtgagcgtttcgaggtctttgtagctacaaaggaaatttgtaatgcctacactgaattgaacgatccatttgaccaaagggcacgtttcgaagaacaagctagacaaaaggatcaaggtgatgacgaagctcaattagtcgatgaaaccttctgtaatgctctagaatacggtttaccaccaactggtggttggggttgtggtattgatagactggccatgttcttgaccgactccaacaccattagagaagtcttattgttcccaactttgaagcctgatgttttgagagaggaagtctag

SEQ ID NO: 32593 - protein, 592 aa, Saccharomyces cerevisiae
MINFNSIMSQQDNVKAAAEGVANLHLDEATGEMVSKSELKKRIKQRQVEAKKAAKKAAAQPKPASKKKTDLFADLDPSQYFETRSRQIQELRKTHEPNPYPHKFHVSISNPEFLAKYAHLKKGETLPEEKVSIAGRIHAKRESGSKLKFYVLHGDGVEVQLMSQLQDYCDPDSYEKDHDLLKRGDIVGVEGYVGRTQPKKGGEGEVSVFVSRVQLLTPCLHMLPADHFGFKDQETRYRKRYLDLIMNKDARNRFITRSEIIRYIRRFLDQRKFIEVETPMMNVIAGGATAKPFITHHNDLDMDMYMRIAPELFLKQLVVGGLDRVYEIGRQFRNEGIDMTHNPEFTTCEFYQAYADVYDLMDMTELMFSEMVKEITGSYIIKYHPDPADPAKELELNFSRPWKRINMIEELEKVFNVKFPSGDQLHTAETGEFLKKILVDNKLECPPPLTNARMLDKLVGELEDTCINPTFIFGHPQMMSPLAKYSRDQPGLCERFEVFVATKEICNAYTELNDPFDQRARFEEQARQKDQGDDEAQLVDETFCNALEYGLPPTGGWGCGIDRLAMFLTDSNTIREVLLFPTLKPDVLREEV

SEQ ID NO: 32594 - DNA, 1731 bp, Saccharomyces cerevisiae
  CDS (1)..(1731)
atgaatgtgctgttaaaaagacgcagtttaacgtttgcaccgagatggctgtggtgcaagtgtcgaagtagcaggagcaggccgtattctctggcacacgcggtcgacacaagtaagatggaggcaaccaggaggaacggtcagattgtgaaggacctgggtagatactatccgtcaatgtcagaatcagcactccacgatctttgccaggagtataaagaagtcactatcgcagactttaatgagagattcttgggcaacccagccacattacaccatgaggataatcctaatttgttacttagtattaatggcaggattaaaagcattaggttttcaggccagaagattgtttttatagatctttacaacggcagtagcggattgaagaatgatacgcaactgcagttgatcgtaaactacaataaaattggtgggagtagtgaggataaggcgaatttctcagaatatatgaactttttgaagaaaggagattatattaaggcgctcggttatcccgggttttcccaatccagagtcaagatgctgtccttgatatgtaataagctacctatagtattgtctgtttcgcaactgccgttaccttccagactgaatgatgaaaccaagatcaaatctaatagagttgttgactaccaattaaacggcactcagacactgctagtaagggcgcgtatcatcaaacttttgaggaagtttctcgacgacagaaacttcgttgaggttgaaacgcctatactgtcatcaaagtccaacggtgccatggcgaagccctttataacgtcgtccaaggacttcgaccatttggagttgcgtattgcaccagaattatggctgaagaggcttataattagtggtttacaaaaagtatacgaaataggaaaggtctttcgaaacgaaggcattgattccacgcataatgctgagttttccactttagaattctatgaaacttacatgtcaatggacgatatagtcacaaggactgaagatttgttcaaatttttgattactaacttgcaaaagttctttcaagatacccgtctgcctgtccctaagacgtttagtgaattacatctggcactatccgagaataattggaagtttagaaaagtcgaattcctgcccactttgaacaaagagcttggcattgatctaatgaactctggattggatatcaataagccgagcgaacttttgaaggctttaccgaaagacattgcgaagaagtattttccttctgcagataacactgggcaattatcttcgctgcaaatcctaaataaactatcggacgtgttcctcgagcagcgccattgtcaatcaaccttgcctacggtaatataccatcaacctgcaatattatcgcccttagccaagacggatccgcaaaataagcaagtcacgaagagattcgaagtcttcatcaaaggtaaggaatacatcaatgcttacgaagaggaaaattgcccccaattacaactgcagaagtttctacaacaaaagcagattaacgaattgacaggaaacaaaactgagaccttatcgcctgttattgactaccagtatgttgagacgatgaaatacggtatgcctccagtaggtggctttggccttggcatagatagattgtgcatgctattttgcgacaagaagaggatagaagaggttctgccctttggctgtgtggatgatgtaaacaggcagtaa

SEQ ID NO: 32595 - protein, 576 aa, Saccharomyces cerevisiae
MNVLLKRRSLTFAPRWLWCKCRSSRSRPYSLAHAVDTSKMEATRRNGQIVKDLGRYYPSMSESALHDLCQEYKEVTIADFNERFLGNPATLHHEDNPNLLLSINGRIKSIRFSGQKIVFIDLYNGSSGLKNDTQLQLIVNYNKIGGSSEDKANFSEYMNFLKKGDYIKALGYPGFSQSRVKMLSLICNKLPIVLSVSQLPLPSRLNDETKIKSNRVVDYQLNGTQTLLVRARIIKLLRKFLDDRNFVEVETPILSSKSNGAMAKPFITSSKDFDHLELRIAPELWLKRLIISGLQKVYEIGKVFRNEGIDSTHNAEFSTLEFYETYMSMDDIVTRTEDLFKFLITNLQKFFQDTRLPVPKTFSELHLALSENNWKFRKVEFLPTLNKELGIDLMNSGLDINKPSELLKALPKDIAKKYFPSADNTGQLSSLQILNKLSDVFLEQRHCQSTLPTVIYHQPAILSPLAKTDPQNKQVTKRFEVFIKGKEYINAYEEENCPQLQLQKFLQQKQINELTGNKTETLSPVIDYQYVETMKYGMPPVGGFGLGIDRLCMLFCDKKRIEEVLPFGCVDDVNRQ

SEQ ID NO: 32596 - DNA, 1530 bp, Acinetobacter sp
  CDS (1)..(1530)
atggcgcaaccaaacgttcaatcgacttccgaacctattctttccgaaaacgatttaattgcacagcgtcatgccaaattaaaacaaattcaagacaaagccaaagaaactggcaaaagcgtttggccgaatacctttaaacgtgagcattatgctgctgacctgcaagagcagtttaaagatattgataaggcacagattgaaggttcagacaaaacctatgtaaaagttgctggtcgtgtcatgctcaatcgtggatcatttatggtgatccaggatatgacgggtcgtatccagctctacgttgaccgtaaaggcctaccagcagatactttagaaaccattaagagtcttgaccttggcgatattattgctgcggaaggttatattgggcgttcgggtaaaggtgatctatatgttcaccttgaaggttttgagttattaaccaagtctttgcgtccactaccagataagtttcatggtctgactgatacagaggcgaaatatcgcaagcgttatcttgatttgatcgtgaacgaagaaacacgtaaaacgtttgagattcgtgctcaagttgttgctggtattcgtgcatttttgaccaatcaacgttttatggaagttgaaacgccaatgatgcatgtgattccaggtggtgcatctgcacaaccatttgtgacacatcataatgctttggatatggagctgtatttacgtattgcaccagaactttatcttaagcgtttggttgtgggtggttttgagcgtgtctttgaaatcaaccgtaacttccgtaatgaaggggtttcaacacgtcataatcctgaatttaccatgattgagttttatcaggcatatgcagattataaagatttaatgcaactgactgaaaatatgcttgaaaaacttgcattagatattttgggaacaaccgatgttccttatggcgatgaagtgtatagctttaaagggccattcaaaaaaatctcgatgtttgatgcgattttggaacataacccagatttcacccctgaaaatgtcaatgatcgtgagtttttagccaaattcactcaagacgtgcttaaagagcaagttaaacctggttttggtttaggcaagttacaaacgattgtgtttgaagaaaccgttgaaactaaattgcgtcagcctacatttattaccgaatatccagcagaaacctcaccgctggcacgtcgtaatgatgataatcctcacatcacagaccgtttcgaattctttattggtggtcgtgaacttgcaaatggtttctcggagctgaatgatccgattgatcaggcagaacgttttcaggctcaagttgccgaaaaagatgcaggtgatgatgaagccatgcattatgatgcagactttattgaagcacttgaatacggtttaccgccaacagcgggtcagggtatcgggattgatcgtctggttatgatttttgccaatgcaccaagtattcgtgatgtactgttatttccgcatatgcgtcgtaaagatgtataa

SEQ ID NO: 32597 - protein, 509 aa, Acinetobacter sp
MAQPNVQSTSEPILSENDLIAQRHAKLKQIQDKAKETGKSVWPNTFKREHYAADLQEQFKDIDKAQIEGSDKTYVKVAGRVMLNRGSFMVIQDMTGRIQLYVDRKGLPADTLETIKSLDLGDIIAAEGYIGRSGKGDLYVHLEGFELLTKSLRPLPDKFHGLTDTEAKYRKRYLDLIVNEETRKTFEIRAQVVAGIRAFLTNQRFMEVETPMMHVIPGGASAQPFVTHHNALDMELYLRIAPELYLKRLVVGGFERVFEINRNFRNEGVSTRHNPEFTMIEFYQAYADYKDLMQLTENMLEKLALDILGTTDVPYGDEVYSFKGPFKKISMFDAILEHNPDFTPENVNDREFLAKFTQDVLKEQVKPGFGLGKLQTIVFEETVETKLRQPTFITEYPAETSPLARRNDDNPHITDRFEFFIGGRELANGFSELNDPIDQAERFQAQVAEKDAGDDEAMHYDADFIEALEYGLPPTAGQGIGIDRLVMIFANAPSIRDVLLFPHMRRKDV

SEQ ID NO: 32598 - DNA, 1500 bp, Agrobacterium tumefaciens
  CDS (1)..(1500)
atgaccgacaccaagaccgaaaccaccgccctctcctccgacgcgacagaagtgcgccgccagaaacttgcgctgctgcgcgagcagatcggcgacgtctatccggcgcatttccaccgcacgctgagcaatgccgagcttgcggaaaaatatgccgatatcgaagccgacgttgagaccggcgatacggtgacggtggcgggtcgcgtttattcctcgcgcaattccggcatgttcatggatatccatgacgcctcgggcaaggtgcagatcttctcccacaaggatacgacaccggaagcggcgcgcaacctgctgccgatgatcgatattggcgacatcatcggcgtgaccggcaaggtgcgccgcaccaagcgtggcgagctgacgatcaacgccgaagaaatcaccatgctgaccaagtcgctgctgcccatgccggaaaagtggcatggcgtctccgacatcgagctgcgttaccgcaagcgccatctcgatattctggcgaacgaagactccaagctgcgcttcctgcaacgctcgaaaatcctctccggtatccgccgtttcatggaggccgaaggcttcctcgaagtggaaacgccgatgctgcagaccgtttatggcggtgcgacggccgatccgttcaagaccttccacaacacgctgaagatggacatgtatctgcgcatcgcgccggaattgttcctgaagcgcacgctggtatcaggcctttccgacaaggtgttcgaaatcaaccgcaacttccgcaacgaaggcgtctccacaaggcacaatcctgaattcaccatgatggagtgctactgggcctatgccgattacgaagacatcatgggtctcgtggagcggctgttcgagacgctggcgattgctctgcacggcacgaccgaagtggaattccagggccagacgatctccttcaagggtccgttcaagcgcgtgccgatgcctgatgccgtgaaggaagcgaccggcatcgatttcctcgccatcaagaccgacgaagaggcccgcgctgccgccaaggccgccggttttgccgtcgagaaggactggacctggggcgaatgccttgccttcatcttcgaagagaaggtggaagccacgctgatccagccgagccacgtcacgcattttccgaaggacatctcgccgtttgccaaggaagtgccgggcgaaccgcgcctcgtcgagcgtttcgagagctattgcaacgcctgggaagtgggcaacgccttctcggaactcaacgatcccgaagaacagcgccgccgcatggtggaacagctggaacaggcgcacgcccgcggcgagaaggacaagcagctggacgacgagttcctcgacgccatcgaccagggcatgccacccgccggcggcctcggcatcggtgtcgatcgcctgatcatgctcttgaccaacgccccgtcgatccgcgacgtgatcctcttcccggcccgccgcaacaaggcggattga

SEQ ID NO: 32599 - protein, 499 aa, Agrobacterium tumefaciens
MTDTKTETTALSSDATEVRRQKLALLREQIGDVYPAHFHRTLSNAELAEKYADIEADVETGDTVTVAGRVYSSRNSGMFMDIHDASGKVQIFSHKDTTPEAARNLLPMIDIGDIIGVTGKVRRTKRGELTINAEEITMLTKSLLPMPEKWHGVSDIELRYRKRHLDILANEDSKLRFLQRSKILSGIRRFMEAEGFLEVETPMLQTVYGGATADPFKTFHNTLKMDMYLRIAPELFLKRTLVSGLSDKVFEINRNFRNEGVSTRHNPEFTMMECYWAYADYEDIMGLVERLFETLAIALHGTTEVEFQGQTISFKGPFKRVPMPDAVKEATGIDFLAIKTDEEARAAAKAAGFAVEKDWTWGECLAFIFEEKVEATLIQPSHVTHFPKDISPFAKEVPGEPRLVERFESYCNAWEVGNAFSELNDPEEQRRRMVEQLEQAHARGEKDKQLDDEFLDAIDQGMPPAGGLGIGVDRLIMLLTNAPSIRDVILFPARRNKAD

SEQ ID NO: 32600 - DNA, 1686 bp, Anabaena sp
  CDS (1)..(1686)
atgtcggaagaagatatccgtgccgctaggctggagaaagtagaacaactcaagcagctagggactaacccctatgcttaccgttgggagtctactcatcacgccgcccaattgcaagaaaaatttgctgatttaaccagtggtgaagaagtcgagacagaagttgccattgccggacgcattatggcgcgtcgcgttttcggtaaattggctttcttcaccttggaggatgaaacaggcactattcagctttatttagagaaaaatcgtatccaagaaagcatggcagaaattgatgccaatgcttttaatcatctcaaacaactcaccgatgtaggggatattctgggagccaagggaacaataaaacggactgaaaagggcgagttatcggtttacgtcaaagaatataccatcctcaccaaatccctactgccgctacccgacaagtggcatgggttaacggatgttgccaaacgctaccgtcaacgctacgttgatttgattgttaaccccgaagtccgccaaactttccgccgtcgcgcccaaatcacggccgggattcgccgctatttggaacaaagggattttctagagattgaaacccctgttttacaaagtgaagccggcggtgctgatgcgcgtcccttcgtcacttaccacaacaccttagaaatggagttgtatctacgaatagcaacagaactccacctcaagcggttgattgtcggtggttttgaaaaggtgtttgaattggggcgaattttccgtaatgaagggatttccaccagacacaaccctgaatttacctcaattgaagtttatcaagcctacgccgactacaacgatatgatggctctaacagaaggtattatcaccactgtggcccaagatgtactcggcacactgcaaattacctaccaaggcgaaacggtagatttgacaccaccttggcgacgggtgacaatgcacgatttagtaaaagaatatacaggattggatttccattctttccaaacactagaagaagcgaaatcagcaggtaaaaatgctgggattcctggtgtagatgaagcccaaactataggtaaaatcctgaatttagcatttgaagaaaaggtagaaacaaagttaattcagcctacctttgtaattgattatcctgtggaaatttcgccattagctaaacctcaccgttctcaacctgggttagtagaaagatttgaattattcatagtcgggcgggagactgcgaatagtttctcagaattaacagatcccatcgaccaaagagaacgcctagaagcccaagcagccaaaaaagccgccggtgacttagaagcccaaggtgtagatgaagacttcttgactgcgttggaatacgggatgccacctacaggaggtttaggtattgggattgatcggttagtcatgttattaactgattctgccagtattcgggatgtgattgctttccctttactcaaaccagaaggcagctttattaaggcatatcgctatgagccaacaactcaaacactgactcttgaatttgatagtggaagtatttacgaatatttcaaagtaccgcttactgttaaagaagaattagacaatgcaccgtctaagggtcaatatttccataagtttattaaagggcaattcaagtatgaacaattgagttga

SEQ ID NO: 32601 - protein, 561 aa, Anabaena sp
MSEEDIRAARLEKVEQLKQLGTNPYAYRWESTHHAAQLQEKFADLTSGEEVETEVAIAGRIMARRVFGKLAFFTLEDETGTIQLYLEKNRIQESMAEIDANAFNHLKQLTDVGDILGAKGTIKRTEKGELSVYVKEYTILTKSLLPLPDKWHGLTDVAKRYRQRYVDLIVNPEVRQTFRRRAQITAGIRRYLEQRDFLEIETPVLQSEAGGADARPFVTYHNTLEMELYLRIATELHLKRLIVGGFEKVFELGRIFRNEGISTRHNPEFTSIEVYQAYADYNDMMALTEGIITTVAQDVLGTLQITYQGETVDLTPPWRRVTMHDLVKEYTGLDFHSFQTLEEAKSAGKNAGIPGVDEAQTIGKILNLAFEEKVETKLIQPTFVIDYPVEISPLAKPHRSQPGLVERFELFIVGRETANSFSELTDPIDQRERLEAQAAKKAAGDLEAQGVDEDFLTALEYGMPPTGGLGIGIDRLVMLLTDSASIRDVIAFPLLKPEGSFIKAYRYEPTTQTLTLEFDSGSIYEYFKVPLTVKEELDNAPSKGQYFHKFIKGQFKYEQLS

SEQ ID NO: 32602 - DNA, 1794 bp, Aquifex aeolicus
  CDS (1)..(1794)
gtgctttccctcctttcctcagagatctttttttctgccatacaatataatttatcccttatggaagaggtaagactcaaaaagctccaggaactcagggaaaaaggaataaacccctacccctacaggtttgaagttacggactttataggaaacataaggaaacagtacgaggaagagcctcctgagaactacaaagttcgggttaaaggtgtggctaaaagggtttccagaacggaaaacggctacatggtaaggcttgcagacgagaaggggatagagatacttgtcttcacgaaggaggaagggttaaaaccaaaggaaagttatacttttgaagggattttaaaaagggttgaaggaaaactcagcctggtggaagccgttctcactgaggaagaaggggaagaagtttacaagataaaggaacagtttgattacgacccaaacttcagacccgtttccttggcgggaagactcgtttctatgagaagtatggggaaggctatattcggacacattcaggatctcacgggaaagatacagatatacctcaaaaaagacgtaataggcgaggaaaagctgaagttctttaacgattacatagacgtaggggatattgtaggagtaagggggaagctctttagaacgaacacgggagagctcaccgttgaagttgaagagtaccaactcctcgcaaagtccctgcacccacttccggaaaagtggcacgggctcaaggacgtggaagttcgctacaggcaaaggtaccttgaccttatcgctaaccccgaggcgagaaggatattcatgctgaggaccaaactcataacggaaatgcggaagttctttgagatgcacggatttatagaggtggaaactcccatactccagccaatagcgagcggtgcaaacgcaagacccttcgtgacttatcacaacttccttgaaacagagctttacctcaggatagccccggaactctacctcaagagattaatcgtaggaggctttccgagggtttacgagataggaaagaacttcaggaacgagagcgtggacaggacacacaacccagaatttactatggttgagttttacgccgcttactgggattaccacgaccttataaagtttacagaggatatgttcgtttatctccttgaaaaaaccttaggaactctgaaggtaaagtacggagagtgggagcttgatttttcaccgccttttaagaaggttcgctactttgacctcttaaaagagaagaccggaaaggataaggactttttcctgaaagaccttgaaggcttgaggaagctagccaaggaacttgaaattcccgatgtagagaggatgactcacgcaaagctccttgacaaagtttttgaaaaggttgcggaggaagatttaatccaacctacattcgtaatagactttccgaaaatcctctcacctcttgcgaaaacccacagggaggaccccgacctcgttgagagatttgagcttatcatcgcacgttacgaggtggcgaacgcatacaccgagctgaacgatccctttgaccaaaaggaaagatttttagagcagctcaaagaaaagcaaatgggtgacgaagaggctatggatatggatgaggactttataagggcacttgaatacggaatgcctcctaccgcaggtgaaggtataggaatagacagactagttatgatattggcaaatacggactctatcagagaggttattctcttccctcaattaaagccggaaaaaaagaagaaggaagccccttaa

SEQ ID NO: 32603 - protein, 597 aa, Aquifex aeolicus
MLSLLSSEIFFSAIQYNLSLMEEVRLKKLQELREKGINPYPYRFEVTDFIGNIRKQYEEEPPENYKVRVKGVAKRVSRTENGYMVRLADEKGIEILVFTKEEGLKPKESYTFEGILKRVEGKLSLVEAVLTEEEGEEVYKIKEQFDYDPNFRPVSLAGRLVSMRSMGKAIFGHIQDLTGKIQIYLKKDVIGEEKLKFFNDYIDVGDIVGVRGKLFRTNTGELTVEVEEYQLLAKSLHPLPEKWHGLKDVEVRYRQRYLDLIANPEARRIFMLRTKLITEMRKFFEMHGFIEVETPILQPIASGANARPFVTYHNFLETELYLRIAPELYLKRLIVGGFPRVYEIGKNFRNESVDRTHNPEFTMVEFYAAYWDYHDLIKFTEDMFVYLLEKTLGTLKVKYGEWELDFSPPFKKVRYFDLLKEKTGKDKDFFLKDLEGLRKLAKELEIPDVERMTHAKLLDKVFEKVAEEDLIQPTFVIDFPKILSPLAKTHREDPDLVERFELIIARYEVANAYTELNDPFDQKERFLEQLKEKQMGDEEAMDMDEDFIRALEYGMPPTAGEGIGIDRLVMILANTDSIREVILFPQLKPEKKKKEAP

SEQ ID NO: 32604 - DNA, 1881 bp, Arabidopsis thaliana
  CDS (1)..(1881)
atggaaggtgcggctgatcaaactacgaaagcgttatctgaattagccatggattcttctaccaccttgaatgctgctgagtctagcgctggtgatggagctggacctcggagtaaaaatgctttgaagaaggaacagaaaatgaagcagaaagaggaagagaagagacgaaaggacgaagagaaagctgaaaaggctaaacaagcacctaaagcaagctcccagaaggcagtggcagcagatgatgaagagatggatgcaacgcaatactatgagaacagattgaaatatcttgcggctgagaaggctaaaggggagaatccatatcctcacaagttcgctgtgtcaatgtcgattcctaaatacattgagacgtatggtagtttgaacaatggagatcatgttgaaaacgctgaggagtctttagctgggcggataatgagcaagcgatcttcctcttccaagctcttcttctatgatctacacggtgatgatttcaaggtccaagtcatggctgatgcaagtaagtcaggattggatgaagctgagttcttaaagctccattcgaatgctaagcgtggtgatattgttggagtcattgggtttccaggaaaaactaagaggggagaattgagtatctttccccgatcatttattcttctgtcccattgcctccacatgatgccgagaaaggctgataatgttaatgcaaagaaacctgaaatctgggttccaggtcaaacgagaaatcctgaagcatatgttctgaaagaccaggaatcaagatatcgtcagcgtcatcttgatatgattttgaacgtggaggttcgtcagatattcaggactagagctaaaatcatctcctatgtccgcagattcctcgacaacaaaaatttcttggaggtcgagacacctatgatgaacatgattgctggtggagcagctgctagaccttttgtgacacatcacaatgatctagatatgaggctgtacatgcgaatcgcacctgaactctatctcaagcaacttattgttggtggcttggaacgtgtttacgagataggaaagcaattcagaaacgagggtatagacctgacccacaatccggagttcaccacttgcgagttctatatggcttttgcagactacaatgacctgatggaaatgactgaggttatgttgagtggcatggttaaggaattaacaggtggttataaaatcaagtataatgctaatgggtatgacaaggatccaattgaaatcgactttactccaccattcaggaggattgagatgataggagagttagagaaggttgctaagctcaatataccaaaagacttggctagcgaagaagctaacaagtatctgattgatgcatgtgcgaggtttgatgtcaaatgccctcctcctcagacaacagctcgtctgttagataaacttgttggagaatttctggaaccgacatgtgtgaacccaactttcatcatcaaccagcccgagatcatgagtcctttggctaaatggcacagatcgaagagtggattgacagagagattcgagctgttcatcaacaaacatgaactctgcaatgcctacacggagctaaacgatcctgtggtacagcgccagcgttttgctgatcagctcaaggatcgacagtctggagacgatgaagcgatggctttagatgaaacattttgtaatgctttagaatatgggttggctcctacaggtggctggggattaggaatagacagactctctatgcttttgaccgactcactgaacatcaaggaggttcttttcttcccggcaatgaggccaccacaggaggagtcagcagccgctcaagctcctttaacagaagagaagaaataa

SEQ ID NO: 32605 - protein, 626 aa, Arabidopsis thaliana
MEGAADQTTKALSELAMDSSTTLNAAESSAGDGAGPRSKNALKKEQKMKQKEEEKRRKDEEKAEKAKQAPKASSQKAVAADDEEMDATQYYENRLKYLAAEKAKGENPYPHKFAVSMSIPKYIETYGSLNNGDHVENAEESLAGRIMSKRSSSSKLFFYDLHGDDFKVQVMADASKSGLDEAEFLKLHSNAKRGDIVGVIGFPGKTKRGELSIFPRSFILLSHCLHMMPRKADNVNAKKPEIWVPGQTRNPEAYVLKDQESRYRQRHLDMILNVEVRQIFRTRAKIISYVRRFLDNKNFLEVETPMMNMIAGGAAARPFVTHHNDLDMRLYMRIAPELYLKQLIVGGLERVYEIGKQFRNEGIDLTHNPEFTTCEFYMAFADYNDLMEMTEVMLSGMVKELTGGYKIKYNANGYDKDPIEIDFTPPFRRIEMIGELEKVAKLNIPKDLASEEANKYLIDACARFDVKCPPPQTTARLLDKLVGEFLEPTCVNPTFIINQPEIMSPLAKWHRSKSGLTERFELFINKHELCNAYTELNDPVVQRQRFADQLKDRQSGDDEAMALDETFCNALEYGLAPTGGWGLGIDRLSMLLTDSLNIKEVLFFPAMRPPQEESAAAQAPLTEEKK

SEQ ID NO: 32606 - DNA, 1485 bp, Bacillus stearothermophilus
  CDS (1)..(1485)
atgagccatgaagaattgaacgaccaattgcgcgtccgcagggaaaagctgaaaaaaattgaggaattgggtgtcgatccgtttggcaaacggttcgagcgcacgcataaagcggaagagctgtttgaactgtatggagatttgtcaaaagaggaactcgaagagcaacaaatcgaagtcgccgtcgccggccgcatcatgacaaagagaggcatgggaaaagcgggctttgctcacatccaggacgtgacgggacaaattcaaatttacgtccgccaagacgatgttggcgaacagcaatacgagctgtttaaaatctccgacctcggcgacatcgtcggcgtgcgcggcacgatgtttaaaacaaaggtcggcgaactttcgatcaaagtatcgtcgtatgaatttttaacaaaagcgctgcgtccgctgccggaaaaataccacggcttaaaagatatcgagcagcgctaccgccaacgctacctcgatttaattatgaatccggagagcaaaaagacgttcatcacccgcagtctcattattcaatcgatgcgccgctatcttgacagccatggctacttggaagtcgaaacaccgatgatgcacgccgtagcaggcggtgcggcggcgcgcccgttcattacgcatcataatgcgctcgatatgacgctgtatatgcggatcgccatcgagctgcatttgaaacggctcatcgtcggcggcttggaaaaagtgtatgaaatcgggcgcgttttccggaatgaaggcatttccacccgccataacccggagtttacgatgctcgaattgtacgaggcgtatgccgacttccgcgatatcatgaaattaacggagaacttgatcgctcatattgccacggaagtgcttggcacaacaaaaattcagtacggcgaacatcttgtcgacttgacgcctgaatggcggcgcctccatatggtcgatgcgatcaaggaatatgtcggcgtcgatttctggcggcagatgagcgacgaagaggcgcgggagctggccaaagaacacggtgtcgaagtcgcgccgcacatgacgttcggccatatcgtcaatgaattttttgaacaaaaagtagaggataaactgatccagccgacgttcatttacggccacccggtcgaaatctcgccattagccaagaaaaacccagacgacccgcgctttaccgatcggtttgagctgttcatcgtcgggcgcgaacatgcgaacgcctttacggaactaaacgacccgatcgatcagcgtcaacggtttgaggagcagctgaaggagcgcgaacaaggaaacgatgaagcgcatgaaatggacgaagatttcctcgaagcgctcgaatacggcatgccgccgacgggcggactcgggatcggggtcgacaggttagtcatgcttttgaccaattcaccgtctattcgcgatgtattgctcttcccgcaaatgcgccataaataa

SEQ ID NO: 32607 - protein, 494 aa, Bacillus stearothermophilus
MSHEELNDQLRVRREKLKKIEELGVDPFGKRFERTHKAEELFELYGDLSKEELEEQQIEVAVAGRIMTKRGMGKAGFAHIQDVTGQIQIYVRQDDVGEQQYELFKISDLGDIVGVRGTMFKTKVGELSIKVSSYEFLTKALRPLPEKYHGLKDIEQRYRQRYLDLIMNPESKKTFITRSLIIQSMRRYLDSHGYLEVETPMMHAVAGGAAARPFITHHNALDMTLYMRIAIELHLKRLIVGGLEKVYEIGRVFRNEGISTRHNPEFTMLELYEAYADFRDIMKLTENLIAHIATEVLGTTKIQYGEHLVDLTPEWRRLHMVDAIKEYVGVDFWRQMSDEEARELAKEHGVEVAPHMTFGHIVNEFFEQKVEDKLIQPTFIYGHPVEISPLAKKNPDDPRFTDRFELFIVGREHANAFTELNDPIDQRQRFEEQLKEREQGNDEAHEMDEDFLEALEYGMPPTGGLGIGVDRLVMLLTNSPSIRDVLLFPQMRHK

SEQ ID NO: 32608 - DNA, 1500 bp, Bacillus subtilis
  CDS (1)..(1500)
atgagtcaagaagagcataaccatgaagaattgaatgatcagctgcaagtcagacgcgataaaatgaatcagctgagagataacggcatcgatccattcggcgcacgttttgaaagaactcatcagtctcaagaagttatttcggcatatcaagatctaaccaaagaagagttagaagaaaaagcgattgaagttacaatcgcaggccgcatgatgacaaaacgcggcaaaggaaaagccggctttgcccatcttcaggatttagaaggccaaatccaaatctacgtaagaaaagacagtgtcggtgacgaccaatatgaaatcttcaagtcttctgacctcggtgatcttatcggcgtaaccggaaaagtcttcaaaacaaatgtaggcgaattgtctgttaaagcaacttcctttgaattgctgacaaaagcgcttcgtccgcttcctgacaaataccatggtttaaaagacgttgagcagcgctaccgtcagcgctatctggatcttatcgtaaacccagacagcaaacatacgttcattacacgaagcaagatcattcaagctatgagaaggtaccttgatgatcatggatacttagaagtagaaacacctacaatgcacagcattcctgggggagcttctgcacgtccgtttatcactcaccacaacgcgttagacattccactctatatgcgtattgctatcgaactgcacctaaaacgtctaattgtcggcggtttagaaaaagtatatgaaatcggccgtgttttccgtaacgaaggtgtctctacacgccataaccctgaatttacaatgattgagttatatgaagcatatgcggactataaagatatcatgagcttaactgaaaaccttgtcgctcatatcgcccaagaagtgcttggcacaactacgattcaatacggggaagagcaaatcgaccttaaaccggagtggaaaagaatccatatggttgacgcagtcaaagaagcgaccggcgttgatttctgggaagaggttactgttgagcaggcgcgtgaatatgcaaaagaacatgaagtagaaattaaagactctatgacagtaggccatatcatcaacgaattcttcgaacaaaaaattgaagaaacgcttattcagccaacgtttatttacgggcatcctgtagaaatttctcctcttgctaagaaaaaccctgaggacccgcgttttacagaccgttttgagctgtttatcgttggccgtgaacatgccaacgcgtttacagagctgaatgatcctattgatcaaagagaacgctttgaagcgcaattaaaagagcgtgaagccggtaatgatgaagctcatttaatggatgaagactttgttgaagctctggaatacggtatgccgccaacaggaggtttaggcatcggtatcgaccgtctggttatgctgctgacgaatgccccttctattcgcgatgtgctgttattcccgcaaatgagacaacgctaa

SEQ ID NO: 32609 - protein, 499 aa, Bacillus subtilis
MSQEEHNHEELNDQLQVRRDKMNQLRDNGIDPFGARFERTHQSQEVISAYQDLTKEELEEKAIEVTIAGRMMTKRGKGKAGFAHLQDLEGQIQIYVRKDSVGDDQYEIFKSSDLGDLIGVTGKVFKTNVGELSVKATSFELLTKALRPLPDKYHGLKDVEQRYRQRYLDLIVNPDSKHTFITRSKIIQAMRRYLDDHGYLEVETPTMHSIPGGASARPFITHHNALDIPLYMRIAIELHLKRLIVGGLEKVYEIGRVFRNEGVSTRHNPEFTMIELYEAYADYKDIMSLTENLVAHIAQEVLGTTTIQYGEEQIDLKPEWKRIHMVDAVKEATGVDFWEEVTVEQAREYAKEHEVEIKDSMTVGHIINEFFEQKIEETLIQPTFIYGHPVEISPLAKKNPEDPRFTDRFELFIVGREHANAFTELNDPIDQRERFEAQLKEREAGNDEAHLMDEDFVEALEYGMPPTGGLGIGIDRLVMLLTNAPSIRDVLLFPQMRQR

SEQ ID NO: 32610 - DNA, 1731 bp, Bacteroides thetaiotaomicron
  CDS (1)..(1731)
atgaatatattagaactaagtgaacaggaaattattcggcgcaatagtctgaatgagcttcgtgcaatgggtatcgatccgtaccccgctgcagagtatgtaaccaatgctttctctactgatataaaagcagaattcaaagatgaagacgaaccgcgtcaagtttctgtagcgggccgtattatgagccgccgcgtgatgggcaaggcttcgttcatcgaactgcaggactctaaaggtcgtatacaggtatacatcacacgtgatgacatctgtccgggagaagacaaggaattgtacaactctgtattcaaacgcctgctcgacttaggtgacttcgtaggtatcgaaggtttcgtgttccgtacacaaatgggcgaaatcagtatccatgccaagaaactgaccgtacttgccaagtctatcaaaccgctgcctatcgtaaaatataaagacggcgtagcttacgactcttttgaagatcccgaactccgttatcgccaacgttatgtggacctggtagtaaacgaaggcatcaaagagacattcgaaaagcgtgccaccgtagtgagaacactgcgcaacgccctcgacgaagccggatatacggaagtagaaacaccgatcctgcaatccatcgcaggcggagcaagcgcacgtccgttcatcactcaccacaactcgctggatatagacctctacctgcgcatcgcaacggaactttatctgaaacgactcatcgtaggtggttttgaaggtgtatacgaaataggaaagaacttccgtaacgagggaatggacagaacccacaaccccgaattcacttgtatggaactttatgtacagtacaaggattacaactggatgatgagcttcaccgaaaagttgctggaacgcatctgtatcgccgtaaacggaagcaccgaaaccgttgtagacggaaagacaatcagctttaaagctccttaccgccgtctgcctatcctcgacgccatcaaagaaaagacaggatatgacctcaacggcaagagcgaagaagaaatccgtcagatctgcaaagaactgaagatggaagaaatcgacgacaccatgggcaaaggcaaactgattgatgaaatcttcggtgaattctgtgaaggcagctacatccagccgactttcatcaccgattatccggtggaaatgtcgcctctgacaaagatgcaccgttccaaacctggactgaccgaacgtttcgaactgatggtaaacggcaaggaactggccaatgcctactcggaattgaacgatccgctggatcaggaagaacgcttcaaagaacagatgcgtcttgccgacaagggtgacgacgaggcaatgattatcgaccaggatttcctgcgtgctttgcaatatggtatgcctcctacatccggcatcggtatcggtatcgaccgtctggtgatgctgatgacaggacagaccaccattcaggaagtactgttcttcccgcaaatgcgtccggagaaagtaatcaagaaagaccctgccgccaaatacatggaactgggtattgcagaagactgggtgccggtcatccagaaagccggctacaacacagtagctgatatgcaggatgttaatccgcaaaagttgcaccaggacatctgcggaatcaataagaaatacaaattagaactgaccaatccaagcgtgaacgacgtgaccgagtggataaataaacttaaataa

SEQ ID NO: 32611 - protein, 576 aa, Bacteroides thetaiotaomicron
MNILELSEQEIIRRNSLNELRAMGIDPYPAAEYVTNAFSTDIKAEFKDEDEPRQVSVAGRIMSRRVMGKASFIELQDSKGRIQVYITRDDICPGEDKELYNSVFKRLLDLGDFVGIEGFVFRTQMGEISIHAKKLTVLAKSIKPLPIVKYKDGVAYDSFEDPELRYRQRYVDLVVNEGIKETFEKRATVVRTLRNALDEAGYTEVETPILQSIAGGASARPFITHHNSLDIDLYLRIATELYLKRLIVGGFEGVYEIGKNFRNEGMDRTHNPEFTCMELYVQYKDYNWMMSFTEKLLERICIAVNGSTETVVDGKTISFKAPYRRLPILDAIKEKTGYDLNGKSEEEIRQICKELKMEEIDDTMGKGKLIDEIFGEFCEGSYIQPTFITDYPVEMSPLTKMHRSKPGLTERFELMVNGKELANAYSELNDPLDQEERFKEQMRLADKGDDEAMIIDQDFLRALQYGMPPTSGIGIGIDRLVMLMTGQTTIQEVLFFPQMRPEKVIKKDPAAKYMELGIAEDWVPVIQKAGYNTVADMQDVNPQKLHQDICGINKKYKLELTNPSVNDVTEWINKLK

SEQ ID NO: 32612 - DNA, 1521 bp, Buchnera aphidicola
  CDS (1)..(1521)
atgtctgaaatagaaaaaagaaatcatggtgattgtaatattttatacaaagaaataaaaaaaagagaacaaaaacttgttaatatgaaaaaagaaggattttctttcccgaatagttttaaaaaaaatactacttcaagaaaaatttatcaaaaataccaaacaaaaaatagaaatgaactcatatcattaaatattgaagtttccattgctggtcgtatggtgcaaagacgtattatgggaaaagcttctttttttaccttgcaagatatagaaggaaaaatacaaatttatataaatgaaaaaaaaatatcatctgatttttatcgctttcactttaaaaagtgggatatcggagatattttgggtgtgataggaacattatttaaaactaaaacaggtgaattatctatttattgtaaaaatgtaacaatacttaataaatcattaaaacctttaccagacaagtttcatggtttatctaatcaagaaatacgttatcggaaaagatatctagatttaattagtaataataaattatatagtatttttaaaaatcgttctaatattatcacagcgattcgtaatttcatgatagaaaatgattttttagaagtcgaaactccaatgctacaaaatattcctggaggagctaatgctcgtccttttattacttatcataatgaaattgattctcaaatgtatttaagaatagctcctgaattatatttaaaaaaactaattattgggggctttgaacgtatttttgaactgaatagaaactttcgtaacgaaggagtatcagctcgtcataatccagaatttactatgatggaagcatacattgcatattctaactatgaagatatgatggaattaacagaaaatctttttaaaagtattacaaagtttctttttcaagataataaaattatattcaacaacaataattttgatttcagtcaaccatttcgtagattaactatgacagattctattcttgaatttaattcaactattacctcatccgatttaaaagatttttataaaatcagagaatttgcaaaatctataggaataaaagtagaaaaaaaatggggttgcggccagatagaaactgaaatatttgaaaagacagtagaaaaaaaattaattcaaccaacttttattacacaatacccagtagaagtttctccattggcaagacgtaatgacataaatttaaatataactgatagatttgaactttttattggtggatatgaaataggaaatggattttcagaactaaatgatgtagaagatcaaaaaacacgatttttaaatcaaattcaaaaatcaaataaggaagataataaaaatctattttacgataaagagtatatagaagcgttaaaatatggtttacctccaacatctggattaggaataggaatagatcgtttaattatgatattaactaatcaaatcagcattcgtgatgtaattttatttccaacacttcgtccatttaaaaaatag

SEQ ID NO: 32613 - protein, 506 aa, Buchnera aphidicola
MSEIEKRNHGDCNILYKEIKKREQKLVNMKKEGFSFPNSFKKNTTSRKIYQKYQTKNRNELISLNIEVSIAGRMVQRRIMGKASFFTLQDIEGKIQIYINEKKISSDFYRFHFKKWDIGDILGVIGTLFKTKTGELSIYCKNVTILNKSLKPLPDKFHGLSNQEIRYRKRYLDLISNNKLYSIFKNRSNIITAIRNFMIENDFLEVETPMLQNIPGGANARPFITYHNEIDSQMYLRIAPELYLKKLIIGGFERIFELNRNFRNEGVSARHNPEFTMMEAYIAYSNYEDMMELTENLFKSITKFLFQDNKIIFNNNNFDFSQPFRRLTMTDSILEFNSTITSSDLKDFYKIREFAKSIGIKVEKKWGCGQIETEIFEKTVEKKLIQPTFITQYPVEVSPLARRNDINLNITDRFELFIGGYEIGNGFSELNDVEDQKTRFLNQIQKSNKEDNKNLFYDKEYIEALKYGLPPTSGLGIGIDRLIMILTNQISIRDVILFPTLRPFKK

SEQ ID NO: 32614 - DNA, 1512 bp, Buchnera aphidicola
  CDS (1)..(1512)
atgattaaaaaaacagatttaaataataatatttttcaaaaagaaaaacaaataagaaaagaaaaactgattaatatgaaaaaaaacggattttcttttccaaatagtttcaaaaaaaacactaactctatcaaaatacatcaagaatatgaaaataaaacaattaatgaacttaaagttttaaatgttgaagttacgattgcaggtcgtatgatacaacgaagaattatgggaaaagcatctttttttacattacaagatatggaaggaaaaatacaaatttatacaagagaaaaagagattacatcagatttttacaacaatcattttaaaaaatgggatattggagatattctaggaatagaaggaatattgtttaaaacaaaaacaggagaattatctattttttctaaaaaattaaaaatattaactaaatctttaagacccttacctgataaatttcacggattatctaaccaagaaaaacgttatagaaaaagatacttagatttaattagtaataatcaattatttaatatttttaaaaatcgttctaaaataatcaggttcattcgaaattttatgatagaaaacaattttttagaagtagaaactcctatgttacataatattcctggtggagcaaatgctcgaccttttattacttatcataatgaaattaatgaagaaatgtacttaagaatagcacctgaattatatttaaaacaactaattgtgggtggttttgaacgtatttttgaactcaatcgaaattttcgtaatgaaggagtttctgctcgacataatccagaatttactatgatggaagcatatatagcttattctaattatgaagatatgatgaattttactgaaaatttactaaaaaatataatcaaatcaatttgtggaaaaagtgaaataaaatataataagtattacttaaattttaatattccgtttaaaaaattaacgatgaaagaatctattttgcaatttaattcaaatatttgtttatcagatttaaaaaatttacaaaaaattaaaaaaattgcaaataatattggtatcgaaataaaagacaattggaatataggttatatagaaaatgaaatttttgaaaaaacagtagaaaaaaaccttattcaacctacttttattactgaatatccagtggaagtttctcccctagctagacgtaacgattttaattctaatgtaacagatagatttgaactttttattgctggatatgaaattggaaatggattttctgaattaaacgattcagaagatcaaaaaaatagatttttaaatcaaatgaaaatagcagaaaaagaaaaaaataaagatatgttgtatgatgaaaattacatagaggcattaaaatacggtttacctcctacttcaggtttaggaattggaattgatcgtctgattatgatattaactaatcaaataagcattcgggacgttattttatttccaacattacgttcatttaaaaaataa

SEQ ID NO: 32615 - protein, 503 aa, Buchnera aphidicola
MIKKTDLNNNIFQKEKQIRKEKLINMKKNGFSFPNSFKKNTNSIKIHQEYENKTINELKVLNVEVTIAGRMIQRRIMGKASFFTLQDMEGKIQIYTREKEITSDFYNNHFKKWDIGDILGIEGILFKTKTGELSIFSKKLKILTKSLRPLPDKFHGLSNQEKRYRKRYLDLISNNQLFNIFKNRSKIIRFIRNFMIENNFLEVETPMLHNIPGGANARPFITYHNEINEEMYLRIAPELYLKQLIVGGFERIFELNRNFRNEGVSARHNPEFTMMEAYIAYSNYEDMMNFTENLLKNIIKSICGKSEIKYNKYYLNFNIPFKKLTMKESILQFNSNICLSDLKNLQKIKKIANNIGIEIKDNWNIGYIENEIFEKTVEKNLIQPTFITEYPVEVSPLARRNDFNSNVTDRFELFIAGYEIGNGFSELNDSEDQKNRFLNQMKIAEKEKNKDMLYDENYIEALKYGLPPTSGLGIGIDRLIMILTNQISIRDVILFPTLRSFKK

SEQ ID NO: 32616 - DNA, 1719 bp, Caenorhabditis elegans
  CDS (1)..(1719)
atgagcgagccagaggccaaattgagtaagaatgagcagaagaggctcgccaagcaagccaagaaggaacaagaacgtctggagaaggatgctgctaagctgaatgttgccgtcgctgatgctccaaaagttgtgcgagaggcggatccttctgacccccaagagtatttcaacatgagagttaggatgattgaggcccgtagagctgctggtgataatccattcccacacaagttcaacgttacaatttcattgacggatttcattactaagtacactccacttgagaaagaacaagtcgttgaagaaattgtatctgttgctggacgtattcattcgaaaagagagtctggatcgaagcttgtcttttacgacattcacggcgaaggaactcatatccagattatggcaaacgccaagttccacaccggagacgttgacttcgttacactgcacgatcgtatcaagcgtggtgatattgttggattcactggtcgcgcaacacgtaccaaggcaggagagttgtccttgattccaaacgagattttacaactcacaccttgcctccacatgcttcctcattctcacttcggacttaaagacaaagaattgagattccgtaaacgttatttggaccttattctgaatccccgcgtcaaggataactttgttattcgcagtaaaatcattactttccttcgtcggtaccttgacaacttgggattccttgaggtcgagactccaatcatgaaccaaatcgctggaggagccactgctaagccattcattacccaccacaacgacttggacatgaacctcttccttcgtgtagctcctgagttataccataagatgctcgttgtcggaggtattgatcgtgtgtacgaagttggacgtcttttccgtaacgaaggaatcgacttgactcacaaccctgagttcaccacttgtgaattctacatggcatatgctgattatgaagacgtcattcaactcaccgaagatcttctcagcagcatggtcatgtctatcaagggaacctacaaaatcgaataccatccgaatggtccaaacaccgaaccggtttatgaagtcgactttacaccaccattcaagagagttcatatgtacgatggactcgcagagaaactcggagctactctcccagatccatctactttgcacacggaagaagctcgtgaagttttcgacaagctgtgccgtgacaacaatgtggattgctctgccccacgtacaacggctcgccttcttgacaaactcgttggagagtacctcgagagcacatttatctcgccaaccttcctcatcggacatccacaaatcatgtcaccactcgccaagtggcatcgttccatccctggacttaccgagcgcttcgagttgtttgcggtgactcgcgaaatcgccaacgcgtacactgagttgaatgatcctattactcaacgtcaacgcttcgaacaacaagccaaggacaaggatgctggagatgatgaggctcaaatgatcgatgaaacattctgcaacgctttggaatacggacttccaccaactggaggatggggaatgggaatcgatcgtctctccatgatccttactgataacaacaacatcaaggaagtccttcttttcccagcaatgcgaccggaagatggtactgagaagaagaccgatttcgatgctccaacaacacttgcttaa

SEQ ID NO: 32617 - protein, 572 aa, Caenorhabditis elegans
MSEPEAKLSKNEQKRLAKQAKKEQERLEKDAAKLNVAVADAPKVVREADPSDPQEYFNMRVRMIEARRAAGDNPFPHKFNVTISLTDFITKYTPLEKEQVVEEIVSVAGRIHSKRESGSKLVFYDIHGEGTHIQIMANAKFHTGDVDFVTLHDRIKRGDIVGFTGRATRTKAGELSLIPNEILQLTPCLHMLPHSHFGLKDKELRFRKRYLDLILNPRVKDNFVIRSKIITFLRRYLDNLGFLEVETPIMNQIAGGATAKPFITHHNDLDMNLFLRVAPELYHKMLVVGGIDRVYEVGRLFRNEGIDLTHNPEFTTCEFYMAYADYEDVIQLTEDLLSSMVMSIKGTYKIEYHPNGPNTEPVYEVDFTPPFKRVHMYDGLAEKLGATLPDPSTLHTEEAREVFDKLCRDNNVDCSAPRTTARLLDKLVGEYLESTFISPTFLIGHPQIMSPLAKWHRSIPGLTERFELFAVTREIANAYTELNDPITQRQRFEQQAKDKDAGDDEAQMIDETFCNALEYGLPPTGGWGMGIDRLSMILTDNNNIKEVLLFPAMRPEDGTEKKTDFDAPTTLA

SEQ ID NO: 32618 - DNA, 1506 bp, Campylobacter jejuni
  CDS (1)..(1506)
atgtttgataatattttagagcagcaaagaatagaaaaagctaaggaattaaaaaatttagggatcaatccttatcctcattttttagaaaaagaaatgtctttaaagacttttaaggataaattttcttatattttagagcaagttgaaaaaagagatgaaagtgtcaatgctgttgttgcaggacgtttgaaacttttgcgtatagctgggaaatcgatttttgcaaacattgaagatgaggatacaaatttacaaatttattttagtaaagatagcgtaggcgaagagctttatacgattttaaaaaagaatttagaggtgggtgatattgttttggttaaaggttttccttttgtaactaaaacaggtgagtttagtttacatgcaagtgaagtaaaactcgctacaaaagctattgttcctttacctgaaaaatatcatggattaacagatattgagcaaagatatcgtaaacgttatgttgatatgataatgaatgtcgaagttagaaaagattttttagtgcgttctaaagtggtgagtttaatccgtcatttttttgaaaataaaggctttttagaagtagaaactcctatgatgcatccgattgcaggtggagcaaacgctaagccttttgtaacttttcataattctttaggcgtagaaagatttttaagaattgctccagaactttatcttaaaagacttatagtaggtggttttgaggcggtttttgaaatcaatcgttgttttagaaacgaaggtatggatttaactcataatcccgaatttacaactatagaattttattgggcctatcataattataaagatttaatggatttaaccgaagaactttttgctttacttttggataaacttaatttaggaaaaacaatagaatttgatggaaaaatgataaatttttctaaaccttttgaaagaataacctataaagacgcactttgtaagtatggtggtttagatagggatttaatcgaagataaggaaaaaattcttactaaattaaaagcagatggttttgaagcgaatgaaaagcttgaacttggacatttgcaagctgaactttttgacaattatgtggaagaaaaattgatcaatcctacttttgtgattgattttcctatttccataagtcctttatcaagacgtagcgatgaggattctcagattgctgagagatttgagttgtttatttgcggaagagaattggcaaatggttttaatgagcttaatgatcctcttgatcaatatgagagatttttaaaacaaattgaagctaaaaatgcaggcgatgaagaggcttgtgaaatggatgaagattttgtaaatgctttgggttatggaatgcctccaacggcagggcagggcataggtatagatagacttgttatgcttttgacaaataaaaaatccattcgtgatgtgatattgtttcctgcaatgcgtccattaaaatcagaactaaaggagaaagaatga

SEQ ID NO: 32619 - protein, 501 aa, Campylobacter jejuni
MFDNILEQQRIEKAKELKNLGINPYPHFLEKEMSLKTFKDKFSYILEQVEKRDESVNAVVAGRLKLLRIAGKSIFANIEDEDTNLQIYFSKDSVGEELYTILKKNLEVGDIVLVKGFPFVTKTGEFSLHASEVKLATKAIVPLPEKYHGLTDIEQRYRKRYVDMIMNVEVRKDFLVRSKVVSLIRHFFENKGFLEVETPMMHPIAGGANAKPFVTFHNSLGVERFLRIAPELYLKRLIVGGFEAVFEINRCFRNEGMDLTHNPEFTTIEFYWAYHNYKDLMDLTEELFALLLDKLNLGKTIEFDGKMINFSKPFERITYKDALCKYGGLDRDLIEDKEKILTKLKADGFEANEKLELGHLQAELFDNYVEEKLINPTFVIDFPISISPLSRRSDEDSQIAERFELFICGRELANGFNELNDPLDQYERFLKQIEAKNAGDEEACEMDEDFVNALGYGMPPTAGQGIGIDRLVMLLTNKKSIRDVILFPAMRPLKSELKEKE

SEQ ID NO: 32620 - DNA, 1458 bp, Candidatus Blochmannia floridanus
  CDS (1)..(1458)
atgagtaaatttgaaaaagaacaaattgcttttcctaatgattttcggcgtaattatatttctgatcaattacatcaaaaatatgatcataaaactaatacagaattgattcatcttaatgtaaaagttagtgtcgcaggtcgtataatgactcgtcggattatgggaaaatcatcttttatgacattacgtgatggaggaggttgtattcagttatattttactattcatgatatgaaatcacagacgatgtattttaaggttataaaaacatgggatataggagatttaattggagtgaaaggagtattatttaaaactcgtactggagaattatcaatacattgcaaggaaatggttttattaactaaatcgttgagatcattaccagataaatttcatggattacgtaatatagaaacgaaatatcgtcaaaggtatttagatttaatagttaatgaagaatctatgaaaacatttaaaatacgttctttaattatatctgaaatacgtcgttttatgcatcaacatcattttatagaagtagaaactcctatgatgcatcatattcctggaggtgcattagctcgaccttttgttacatatcataataaattaaacatgaatatgtatcttcgtattgctccagaattatatttaaaaaaattaataattggaggttttgaaaaaatatttgaaataaatcgtaattttcgtaatgaaagtatatctccatatcataatcctgaatttactatgatggaaatttatgaagcgtatgttgattataataatatgataatttttgttcaggaattatttcgaacattaacagaacggattctcaggaagagtgttattgaatatggtgattatagtttagattttgaaaaaccttttattaaaatgagtataaaagaagctattatgtattatttaccagatattcgaacaaaaaatatcgatgatatattagttgtttttgatatcttaaaattttttaaagtacccagtgataatcaatggacattagaaaagttgcatatggttctttttgaagagatagtatcaaaaaaaattattcaaccaacttgtattactcattatccaatagaagtatccccattagctcgttgcagtaatgataatgcaaaaattgctgatcgatttgagttatttattgctggtcatgaaataggaaatggattttcggagttaaatgatccggatgatcaacgtaatcgatttttaaagcaagcaacagaaaaaatgattaataatgatattgatcaagatgaatcaaatatgccttatgataaggattatatagttgcattagagtatggtttaccgccaacagcaggtgtcggtataggtattgatcgtttagtaatgttgttaactaataaacataatattcgggatgtaattttatttccaactttacgatcaaagtaa

SEQ ID NO: 32621 - protein, 485 aa, Candidatus Blochmannia floridanus
MSKFEKEQIAFPNDFRRNYISDQLHQKYDHKTNTELIHLNVKVSVAGRIMTRRIMGKSSFMTLRDGGGCIQLYFTIHDMKSQTMYFKVIKTWDIGDLIGVKGVLFKTRTGELSIHCKEMVLLTKSLRSLPDKFHGLRNIETKYRQRYLDLIVNEESMKTFKIRSLIISEIRRFMHQHHFIEVETPMMHHIPGGALARPFVTYHNKLNMNMYLRIAPELYLKKLIIGGFEKIFEINRNFRNESISPYHNPEFTMMEIYEAYVDYNNMIIFVQELFRTLTERILRKSVIEYGDYSLDFEKPFIKMSIKEAIMYYLPDIRTKNIDDILVVFDILKFFKVPSDNQWTLEKLHMVLFEEIVSKKIIQPTCITHYPIEVSPLARCSNDNAKIADRFELFIAGHEIGNGFSELNDPDDQRNRFLKQATEKMINNDIDQDESNMPYDKDYIVALEYGLPPTAGVGIGIDRLVMLLTNKHNIRDVILFPTLRSK

SEQ ID NO: 32622 - DNA, 1578 bp, Chlamydophila caviae
  CDS (1)..(1578)
atgtcagaagctgaatacctaacacaagaagattttctccaaagaagtaacaagctccaggaaatatctgatctaggtattaatccttatccttatgaattcccaggaacaagtagtgttgaggaaatcaaacaagaatatgcttcacagactcttggtaatagcgaagacgccacgaataagaaaactcctaaggtaaaaatctcaggacgtatggtgcttttccgttctatgggaaagaacgcttttgctcaaatcttggataatgatcaaaaaatccaagtcatgtttaacagggatttttcttcagtggcaggtcttcctgaagatgcagaaatttctccgataaaatttatagagaagaagcttgatcttggagatattttaggaatagaagggtacctatttttcacacattcaggagaactaactatccttgtagagaccgttaccctgctatgtaaagctttgatctccctccccgataaacatgcaggattaagtgataaagaaatccgttatagaaaacgttggctagacctgatttcttcggatgaagtgcgtcagactttttttaaaagaagtcgtattatcaaattaatccgtcagtatatggatgctcagggatttatggaggtagaaactcctatattacaaaatatatatggtggtgctgaagcaacaccctttgtcactactttgaatgctttgcactcagaagtgttcttaaggatttctctagagattgctttaaagaaaattcttgttggcggaacctcacgtgtctatgaaatcggaaaagtattcaggaatgaggggatcgataggacgcataatcctgaatttaccatgattgaagcctacgctgctaacgtggattatcatagtgttatgacttatgtggaaaaccttgttgaatacctagtgtgtgcattaaatgatggcagcactgttttgacctactcacatttgaaacaagggccgcaaactgttgattttaaagctccttggattcgcatgacgatgaaagatagtattaagacatacggagatgtggatgtcgatcttcatgcagatcatgaattgcgcaatattttaaaagagcgtacctcgttacctgaggaatcttacgcaacggcacccagaggtttattaatcacagcgctgtttgatgagttagtctgtgataagctaatcgcccctcaccatattacagatcatcctatagagacgacacctttatgtaagtctttacgttctggagatgcagattttgtagaacgttttgaaagtttttgcttaggaaaagaactctgcaatgcttattcagagttgaatgatccactacatcaaagaatgcttttagaaaagcaaatggagaaaaaagctttagaccccgatagtgaataccaccctattgatgaggagtttttagaagccctatgtcaaggaatgcctcctgcaggagggtttggaatcgggatcgatcgtttggtgatgattcttactgatgcggcttctatccgagatgttttgtattttccagctatgcgtcgtttagaatcagaaaataattaa

SEQ ID NO: 32623 - protein, 525 aa, Chlamydophila caviae
MSEAEYLTQEDFLQRSNKLQEISDLGINPYPYEFPGTSSVEEIKQEYASQTLGNSEDATNKKTPKVKISGRMVLFRSMGKNAFAQILDNDQKIQVMFNRDFSSVAGLPEDAEISPIKFIEKKLDLGDILGIEGYLFFTHSGELTILVETVTLLCKALISLPDKHAGLSDKEIRYRKRWLDLISSDEVRQTFFKRSRIIKLIRQYMDAQGFMEVETPILQNIYGGAEATPFVTTLNALHSEVFLRISLEIALKKILVGGTSRVYEIGKVFRNEGIDRTHNPEFTMIEAYAANVDYHSVMTYVENLVEYLVCALNDGSTVLTYSHLKQGPQTVDFKAPWIRMTMKDSIKTYGDVDVDLHADHELRNILKERTSLPEESYATAPRGLLITALFDELVCDKLIAPHHITDHPIETTPLCKSLRSGDADFVERFESFCLGKELCNAYSELNDPLHQRMLLEKQMEKKALDPDSEYHPIDEEFLEALCQGMPPAGGFGIGIDRLVMILTDAASIRDVLYFPAMRRLESENN

SEQ ID NO: 32624 - DNA, 1536 bp, Chlorobium tepidum
  CDS (1)..(1536)
atgtccaacgcaccagaacagaagaatccgcagaacgatccgtcacccgcagtttcgctcaacgaccagatgaagcgccgcttcgaggagcgcacgcaccttgccgaagcaggcatcaatccctatccctataaattcgacgttacaaccacctcgaaagcgatcatcgacagcttcagcgatgaaaatcccgcagatgtttcggtggccggacgcatcatggccatccgcaggatgggcaaggcgtcgttcctgcatattcaggactccgagggtcgcatccagatttacctcaaaaaggacgacgtcggcgaggcttcgtacaacaccttcaagctgctcgacatcggcgacatcgtgggcgtcagcggtttcacgttcaagacgaaaaccggtgaaatctcggtacacgccaggcaattcgagctgcttgccaagtcgctccgcccgattccgattgccaaagagaaagaggttgacggccagaaggtgatttacgatgctttcagcgaccgcgagttgcgctaccgccagcgctatgtcgatctgatcgtcaacccggaggtgcgcggcaccttcatcaagcggacgaagatcgtcgccctgatgcgcaactacttcgcctcgaacggctggctcgaagtggaaacgccgattctccagccgatctacggcggcgcggcggcccgccccttcacgacgcaccacaacgcgctcgatatgcagctctacctgcgcatcgccaacgaattgtacctcaagcggctcatcgtcggcggcttcgacggcgtgttcgagttcgccaaggacttccgcaacgagggcatcgaccgcttccacaacccggaattcacccaggtcgagctctatgtcgcctacaaggattacatctggatgatggagctggtcgaagatttactgcacaaggcttgcgtagaagtgaacggcaaggattcgacgatgttcctcggcaacgaaatcaacctcaagccacccttccgccgcctcaccatcgccgactcgatcagggagtacaccggcatggagattcgcggcaaatcggaagcgcagctccgcgacattgcgaaagatttgggactcgaactcgatcccaagatcagcagcggcaagatcatcgatgaaattttcggcgaattcgtcgagccgaagctcatccagccgaccttcatcaccgactacccggaggagatgtcgccgctcgccaagaagcaccgctcggagcctggactcgtcgagcgcttcgagctgatcgtcggcggcaaggaggtgtgcaactccttctccgagctgaacgacccggtcatccagcgcgaacgcctcgaagagcaggcccgcctacgccagcgcggcgacgacgaagcgatgatcgttgacgaggatttccttcgcgcgctggaatacggcatgccaccctgcgccggcctcggcattggcatcgaccgcatggtgatgctgctgaccggccaggactccatccgcgacgtcatcttcttcccgcacatgaagcccgaatga

SEQ ID NO: 32625 - protein, 511 aa, Chlorobium tepidum
MSNAPEQKNPQNDPSPAVSLNDQMKRRFEERTHLAEAGINPYPYKFDVTTTSKAIIDSFSDENPADVSVAGRIMAIRRMGKASFLHIQDSEGRIQIYLKKDDVGEASYNTFKLLDIGDIVGVSGFTFKTKTGEISVHARQFELLAKSLRPIPIAKEKEVDGQKVIYDAFSDRELRYRQRYVDLIVNPEVRGTFIKRTKIVALMRNYFASNGWLEVETPILQPIYGGAAARPFTTHHNALDMQLYLRIANELYLKRLIVGGFDGVFEFAKDFRNEGIDRFHNPEFTQVELYVAYKDYIWMMELVEDLLHKACVEVNGKDSTMFLGNEINLKPPFRRLTIADSIREYTGMEIRGKSEAQLRDIAKDLGLELDPKISSGKIIDEIFGEFVEPKLIQPTFITDYPEEMSPLAKKHRSEPGLVERFELIVGGKEVCNSFSELNDPVIQRERLEEQARLRQRGDDEAMIVDEDFLRALEYGMPPCAGLGIGIDRMVMLLTGQDSIRDVIFFPHMKPE

SEQ ID NO: 32626 - DNA, 1581 bp, Chlamydia trachomatis
  CDS (1)..(1581)
atgtctgtagaagttgaatacttgcaacacgaagattatttgtatagaacaagcaagctaaaggaaatcagagatttgggcataaatccttacccttatcaatacactgattgtcttgaagtacaggaaattcgtaatcagtttgtagataacgaattaggagatagcgaagcggcttttcgtaaagagacacctaaggtgcgttttgccggacgacttgttcttttccgttctatggggaaaaattcttttgggcagatcctcgataatgatgcaaagattcaagtgatgtttaatcgagatttttctgcagtggcagggttagccgcggatgctgggatttctccgattaaatttattgagaagaaacttgatctaggagacatcttgggtctcgaagggtatcttttctttactcactcaggagaattaacggttctcgttgaaacggtaacgttgttatgtaaatccttaatttctttgcctgataagcatgcaggattagcagataaagaaattcgctatcgcaaacgttgggcagatctgatttcctcagaggatgtgcgtaagactttcttaacaagaagccggattcttaagttgattcgtgagtacatggatcagcagagctttttagaggtggaaactcctatcctgcaaaccatctacggaggagcagaagcaactccttttgttaccacgctgcaagcgctacatgcagaaatgttcctaagaatttctctagagattgctttgaaaaaactccttgttggaggaatgtcccgagtttatgaaatcggcaaagttttccgtaacgaaggaatcgatagaacgcataatccagagtttaccatgatagaggcttatgcggcttattgggattacaatgatgtaatgaaatgtgtggaaaaccttgttgagtatatcgtacgtgctttgaataacggggaaactcaggttcagtattcacatttaaaatcaggacctcaggttgttgattttaaagctccatggatccgtatgacgatgaaagaaagtatctctgtctatggcggcgtcgatgtagacttacatgcagatcatgaattacgtaaaattttagaaacacaaacatctcttccagagaaaacgtatgttcatgcctcacgaggagagctgatcgctttgctatttgatgagctggtttgtgataagctcatcgctccgcatcacattacagatcatccattagaaacaacgccactttgtaaaacattgcgttctggggatgaaactctggtagaacgatttgagagtttttgtttaggaaaagagttgtgtaatgcttattcggaactcaatgatcctttacaacaacgaaaattgttggaagagcaaatgcgtaaaaaggctttaaatcctgacagcgaataccatcctatagatgaagaatttctagaagctctttgccaaggaatgcctcctgcaggaggatttggaataggtatcgatcgattggttatgatgttgacagacgccgcatccattcgggatgtcctgtttttccctgttatgcggcgtatagaagcaaaaaaagattaa

SEQ ID NO: 32627 - protein, 526 aa, Chlamydia trachomatis
MSVEVEYLQHEDYLYRTSKLKEIRDLGINPYPYQYTDCLEVQEIRNQFVDNELGDSEAAFRKETPKVRFAGRLVLFRSMGKNSFGQILDNDAKIQVMFNRDFSAVAGLAADAGISPIKFIEKKLDLGDILGLEGYLFFTHSGELTVLVETVTLLCKSLISLPDKHAGLADKEIRYRKRWADLISSEDVRKTFLTRSRILKLIREYMDQQSFLEVETPILQTIYGGAEATPFVTTLQALHAEMFLRISLEIALKKLLVGGMSRVYEIGKVFRNEGIDRTHNPEFTMIEAYAAYWDYNDVMKCVENLVEYIVRALNNGETQVQYSHLKSGPQVVDFKAPWIRMTMKESISVYGGVDVDLHADHELRKILETQTSLPEKTYVHASRGELIALLFDELVCDKLIAPHHITDHPLETTPLCKTLRSGDETLVERFESFCLGKELCNAYSELNDPLQQRKLLEEQMRKKALNPDSEYHPIDEEFLEALCQGMPPAGGFGIGIDRLVMMLTDAASIRDVLFFPVMRRIEAKKD

SEQ ID NO: 32628 - DNA, 1509 bp, Chromobacterium violaceum
  CDS (1)..(1509)
atgtctgatcacgaacaagcacaggcgcaaagccaagacgaaaaccagatcatggcggaacgccgccagaaactgcaggcgatccgcgaaaaaggcatcgcctaccccaacgacttcaaacgcagccacttcgccaaaccgctgcaggacgaccacgccgccaaagaggcagaggcgctggaagccgagaaaatcgaagtcgccgtcgccggccgcatgatgcttaaacgtgtgatgggcaaagccagcttcgccaccctgcaggacgtcagcggccgcatccaggccttcatctcccgcgacaacgtgggcgaagacgtctacgccgacttcaagcgctgggacctgggcgacatcgtcgccgtcaagggcatgctgttcaagaccaagaccggcgaactgacggtgcaggcgaccgaagtgcgcatgctgtccaagaacatccgtccgctgccggagaaattccacggcatcgccgaccaggaaacaaagtaccgccagcgctacgccgacctgatcatgagcgaggaaagccgcgaaaccttcatcaagcgctccaagatcgtgcagaaggtgcgcgacgtgatggtgggcgaaggctacctggaagtggaaaccccgatgatgcacccgatcccgggcggcgcgtcggccaaacccttcgtcacccaccacaacgcgctggacatgccgctctacctgcgcatcgccccggagctgtacctgaagcgcctggtggtcggcggcctggaacgcgtgttcgagatcaaccgcaacttccgcaacgaggggatgagcacgcgccacaaccccgagttcaccatgatcgagttctacgaagcatatagcgactaccagcgcatgatggagatgaccgaaaccatcatccgcgagtgcgcgctggttgcctgcggctccaccaccgtgacctaccaaggcaaggaagtggacctgggcaagccgttcgaccgcttcaccatcgtgcaggcgatcaagcactacaacccgcaatacaccgacgcgcaactgtccgacgccgcctgggtggccagcgagatcaagcgcctgggcggcaagctgcccccggccccgggcctgggcagcctgcagctggcgctgttcgaggaatgcgccgaatcgctgctgtggaacccgaccttcatcatcgactacccggtggaagtgtccccgctggcgcgcggctccgacacccagccgggcctgaccgagcgtttcgaactgttcatcgtcggccgcgagcacgccaacggctactcggagttgaacgatccggaagaccaggccgcgcgcttccaggcgcaagtcgcccagaaggacgccggcgacgacgaggcgatgcactacgacgccgactacatccgcgcgatggaatacggcctgccgccgaccggcggttgcggcatcggcatcgaccgcttggtgatgttgttgacggatgcgccttctatccgggatgtgatcttgttcccgcatatgcgtccggagtaa

SEQ ID NO: 32629 - protein, 502 aa, Chromobacterium violaceum
MSDHEQAQAQSQDENQIMAERRQKLQAIREKGIAYPNDFKRSHFAKPLQDDHAAKEAEALEAEKIEVAVAGRMMLKRVMGKASFATLQDVSGRIQAFISRDNVGEDVYADFKRWDLGDIVAVKGMLFKTKTGELTVQATEVRMLSKNIRPLPEKFHGIADQETKYRQRYADLIMSEESRETFIKRSKIVQKVRDVMVGEGYLEVETPMMHPIPGGASAKPFVTHHNALDMPLYLRIAPELYLKRLVVGGLERVFEINRNFRNEGMSTRHNPEFTMIEFYEAYSDYQRMMEMTETIIRECALVACGSTTVTYQGKEVDLGKPFDRFTIVQAIKHYNPQYTDAQLSDAAWVASEIKRLGGKLPPAPGLGSLQLALFEECAESLLWNPTFIIDYPVEVSPLARGSDTQPGLTERFELFIVGREHANGYSELNDPEDQAARFQAQVAQKDAGDDEAMHYDADYIRAMEYGLPPTGGCGIGIDRLVMLLTDAPSIRDVILFPHMRPE

SEQ ID NO: 32630 - DNA, 1506 bp, Clostridium perfringens
  CDS (1)..(1506)
atgtcaaatgaggaaataaatattcacgaagcagaagaacaattaagtgaacaagagatgttaagaagacaaaagcttgttgaattacaagaagctggtaaggacccatttgatgtatacaaggtagagagaacacactcttctgctgatgtaaaagataattttgaagagttagaaggtaaagaagtaaaagttgctggaagacttatgtcaaaaagaggtcaaggtaaagtagtattcgctgatttagcagatttaccaggaaaaattcaattatttattaagattgataacgttggagaggaagctttaaaggaatttaaaactttcgatttaggtgactgggttgctgcaactggagaagtatttaaaacaaaaatgggtgaagtttcagtaaaagtaacttcatttgaattaatctgtaaatctttaaaaccattaccagaaaaatggcatggtttaaaagacccagacttaagatacagacaaagagaagttgatataataacaaacccagaagttaaagatacttttattaagagatcacaaatagtaaaagcaataagagaattcttagataatagaggattcttagaggttgacacaccaattctttcaccaatagctggtggagctgctgctagacctttcataactcaccacaatgctttagatatagatatgtatttaagaattgctactgagttatacttaaagagattaatagttgctggatttgaaaaagtttatgaaatgggtaaaaacttcagaaatgaaggggtttcagtaagacataatccagaattcactgctatagagttatatgaagcatatgctgattacaatgacatgatggaaatcatggaaaacatgattgcttatgtttgtgaaaaagtaaatggatcaactaaagttacttatgaaggaactgaaatagacttcacaccaccatggagaagaatcactatggttgatgcagttaaagaatttgctggtatagatttcaacgaaattaagagtgatgaagaagctcaagctatagctaaagagaaaaacttagaattccctaaaccattagataaggttactaaaggtgaagttctaaatatgttatttgaagaatatggtgaagataaattaatccaacctacattcttaatagattatccagtagagatatcacctcttactaaaaagaaaagaggaaatgaaatgtttactgagagatttgaaggatttgtatatggtagagaagtatgtaacgcatactcagagcttaacgatccaatagttcaaagagaaagatttgaacaacaagctagagaaagagaatacggagatgatgaagcatacatgttagatgaagaattcatgagtgctttagaaactggtatgcctccaactggtggattaggaataggaatagacagaatgataatgttcttaactgactcttcatcaataagagacgttatattattcccaacaatgaaaccacaaaaatag

SEQ ID NO: 32631 - protein, 501 aa, Clostridium perfringens
MSNEEINIHEAEEQLSEQEMLRRQKLVELQEAGKDPFDVYKVERTHSSADVKDNFEELEGKEVKVAGRLMSKRGQGKVVFADLADLPGKIQLFIKIDNVGEEALKEFKTFDLGDWVAATGEVFKTKMGEVSVKVTSFELICKSLKPLPEKWHGLKDPDLRYRQREVDIITNPEVKDTFIKRSQIVKAIREFLDNRGFLEVDTPILSPIAGGAAARPFITHHNALDIDMYLRIATELYLKRLIVAGFEKVYEMGKNFRNEGVSVRHNPEFTAIELYEAYADYNDMMEIMENMIAYVCEKVNGSTKVTYEGTEIDFTPPWRRITMVDAVKEFAGIDFNEIKSDEEAQAIAKEKNLEFPKPLDKVTKGEVLNMLFEEYGEDKLIQPTFLIDYPVEISPLTKKKRGNEMFTERFEGFVYGREVCNAYSELNDPIVQRERFEQQAREREYGDDEAYMLDEEFMSALETGMPPTGGLGIGIDRMIMFLTDSSSIRDVILFPTMKPQK

SEQ ID NO: 32632 - DNA, 1509 bp, Clostridium tetani
  CDS (1)..(1509)
atgtcaaatgaagaaaagaatttaatgaatgaagaacaagaatttaatcagcttattcaagaaagaagacagaagttttttgatcttcaggctgaaggaaaagatccttttgaagtaacaaaagtagaaagaactcatacttccgaagaaataaaaagtaattttgaagaactagaagataaagaggttactgtagctggaagactaatgtctaaaagagtacatggtaaagctggtttttccgatattcatgatagatatgggaaaattcaactttatattaaaataaatgatgtaggagaagaaagattaaaagaatataaatcttttgatataggagattttgttactattacaggaacggtatttaaaacgagaacgggagaagtttctatacacataacagactttaagcttatagcaaagtctttaaagccattaccagaaaaatggcatggactaaaagatccggatttaagatatagacaaagatatgtagatttaattgtaaacgaagatgtaagagatactttcatgaaaagaactaaaataataaaatatatgagagaatttctagatgctaaagattacatagaagtagaaacacctgtactatcaccaatagcagggggagcagcagctagaccttttacaacacatcacaatgcattagatatagatatgtatttaagaattgctactgaactttatttgaaaagattaatagttggtggatttgaaaaagtatatgaaataggtaaaaactttagaaatgaaggaatagatattagacataaccctgagtttacaatgattgaattatatgaagcatatgcagattataatgatatgatggaaataacagaaaatatggtagcttatatagcggaaaaggtttgtggaaatacaaaagtaaaatatgaagaaacagaaatagaatttagacctccgtggaagagaatcacaatggtagactctgttaaagaatattctggagtagatttcaacgaaataaaaacagatgaagaagcaagagagcttgttaaaggaaaagactttgaattaaagaaaaaattagaagactgtacaaaagcagatattttaaatcttttctttgaagaatatgttgaaaagaatttaattcaacctacttttgtatgtgattatccagttgaaatatctcctttaagtaagaaaaagaatgataaccctgagtatacagaaagatttgaaggatttgtgtacggaagagaattatgtaatgcatatactgagttaaatgatcctatagtacaaaaagagagatttattcaacaattaaaagaaagagaattaggtgatgacgaagcatttatgatggacgaagactttattaatgctttagaaataggtatgcctccgacaggtggcttagggataggagtagacagattagttatgttcttaacagattctcattcaataagagatgtaattctattcccaactatgaagccaacacataattaa

SEQ ID NO: 32633 - protein, 502 aa, Clostridium tetani
MSNEEKNLMNEEQEFNQLIQERRQKFFDLQAEGKDPFEVTKVERTHTSEEIKSNFEELEDKEVTVAGRLMSKRVHGKAGFSDIHDRYGKIQLYIKINDVGEERLKEYKSFDIGDFVTITGTVFKTRTGEVSIHITDFKLIAKSLKPLPEKWHGLKDPDLRYRQRYVDLIVNEDVRDTFMKRTKIIKYMREFLDAKDYIEVETPVLSPIAGGAAARPFTTHHNALDIDMYLRIATELYLKRLIVGGFEKVYEIGKNFRNEGIDIRHNPEFTMIELYEAYADYNDMMEITENMVAYIAEKVCGNTKVKYEETEIEFRPPWKRITMVDSVKEYSGVDFNEIKTDEEARELVKGKDFELKKKLEDCTKADILNLFFEEYVEKNLIQPTFVCDYPVEISPLSKKKNDNPEYTERFEGFVYGRELCNAYTELNDPIVQKERFIQQLKERELGDDEAFMMDEDFINALEIGMPPTGGLGIGVDRLVMFLTDSHSIRDVILFPTMKPTHN

SEQ ID NO: 32634 - DNA, 1497 bp, Coxiella burnetii
  CDS (1)..(1497)
atggaattaaaagaccaaatcaaagaagaaaatgaacaaatcgcgcagcgtaaattaaaattaaagaagcggcgtgaagagggtcaagcttaccctaatgattttaagcgcgatagtttagcggctgatttacatgctgtttacgatcaattcgacagtggtgcattaaccgcaaaggctatccgcgttaaaatggcgggccggatgatgacccggcggattatgggaaaagccagtttcgcccatatccaagacatgaaaggccgtatgcaaatttatgttacgcgcgatagtctgccccaaggcgtctactcagactttaaatcctgggatttgggagacatcgttggtattgaaggagagctttttaaaacaaaaacagaggagttgtcggttaaagtcgatcagattcgtttattgacaaaagcgctgcgaccaatgcctgataagtttcacggacttcatgatcaagaacagcggtttcgtcagcgctaccttgatttaattgtcaacgaatcatcccgtcatttatttcaaactcgctcgcaagttatcgcgcaaatccgccgctttcttgatgatcgcggctacattgaagttgaaacgccgatgatgcatccattaccgggaggcgctgctgcgcgcccctttgaaacgcaccacaacgcgatgaatatggatttatttttgcgaattgcgcctgaactttatttaaaaagattagtcgtcggtggctttgaaaaggtgtacgaaattaaccgtaattttcgcaatgaaggtatttcaacacggcataatcccgaattcacgatgctcgagttttatcaagcgtacgcgacttatgaagatatgatgatgcttaccgaatcgatgattcgccacctcgctgaaaaaatttttggcgttatggaaataaaataccagggggtgaggattgatttaaataaaccttttccgcgtttatctctgcgcgatgcgattttacaatttaatcctggaataacgcccgatcaaattgatcaccttgaaacggcgcgcgaattagcgcataaatatgaaattgctacccccgctcattacggattagggaaaatccaaacggaattgtttgaaaaactcgtagaagaaaagttgcaacaaccaatttttataactcattttccaaaagaagtgtcgcccttatcccgagcgaatgaagaaaatgactttatcactgatcgttttgagttttatgtgggcggccgcgaaatcgctaacggcttttcggaattaaatgatcccgaagatcaagccgctcgctttcgcgagcaattaaaagcacgaaatgctggggatttagaagcaatgagtttcgatgaagattatatcaccgcactagaatatggacttcccccgacagcaggagaaggcattggcatcgatcgtttagtgatgctttttaccgataacgcctccatccgcgatgtcattttgttccccttattgcgctcgaaatga

SEQ ID NO: 32635 - protein, 498 aa, Coxiella burnetii
MELKDQIKEENEQIAQRKLKLKKRREEGQAYPNDFKRDSLAADLHAVYDQFDSGALTAKAIRVKMAGRMMTRRIMGKASFAHIQDMKGRMQIYVTRDSLPQGVYSDFKSWDLGDIVGIEGELFKTKTEELSVKVDQIRLLTKALRPMPDKFHGLHDQEQRFRQRYLDLIVNESSRHLFQTRSQVIAQIRRFLDDRGYIEVETPMMHPLPGGAAARPFETHHNAMNMDLFLRIAPELYLKRLVVGGFEKVYEINRNFRNEGISTRHNPEFTMLEFYQAYATYEDMMMLTESMIRHLAEKIFGVMEIKYQGVRIDLNKPFPRLSLRDAILQFNPGITPDQIDHLETARELAHKYEIATPAHYGLGKIQTELFEKLVEEKLQQPIFITHFPKEVSPLSRANEENDFITDRFEFYVGGREIANGFSELNDPEDQAARFREQLKARNAGDLEAMSFDEDYITALEYGLPPTAGEGIGIDRLVMLFTDNASIRDVILFPLLRSK

SEQ ID NO: 32636 - DNA, 1794 bp, Cricetulus longicaudatus
  CDS (1)..(1794)
atggccacgctgcaggagtgtaaagtaaaagtggatggcgagccgaaactaagtaagaatgaactaaagagacgtctaaaagctgagaagaaattggcagagaaagaggccaagcagaaagagctcattgagaaacaactaagccaagctgctgctgctgctgccaccaaccacactgctgataatggcgtgggtgttgaggaggagactctggacccaaaccaatactacaagatccgtagtcaagcaatccaccagctgaaggtcagtggggaagacccttacccacacaagttccatgtggacatctcactcactcagttcatccaagaatacagtcaactgcaacctggggaccacctgactgacatcaccttaaaagtggcaggtcggatccatgctaagagagcgtctgggggaaagcttatcttctatgaccttcgaggagagggggtcaagttacaagttatggctaactcaaggaattataaatcagaggaagaatttgttcgtatcaataacaagctgcggcggggagatataattggagttcaagggaaccctgggaaaaccaagaagggtgagctgagcatcatcccctatgaaatcacgctcctgtctccctgcttgcatatgttgcctcatcttcactttggcctcaaagacaaggagacaaggtatcgtcagaggtacttggacttgatattgaatgactttgtgaggcagaaatttattgtccgagctaagatcatcacatatataagaagtttcttggatgagctgggatttctagagattgaaactcccatgatgaacatcattccaggaggagctgtggccaagcctttcatcacctatcacaatgagttggacatgaacttatatatgagaattgctccagaactctaccataagatgctggtggttggtggcattgaccgagtttatgaaattggacgccagttccggaacgaaggaattgatttgactcacaaccctgagttcaccacctgtgagttctacatggcttatgcagactatcacgacctcatggagatcacagagaagatgctgtcaggaatggtgaaaagcattacaggtagttacaagatcacctaccacccagatgggccagaaggtgaagcctatgagattgatttcaccccacctttccgaagaatcagcatggtagaagagcttgagaaagcactgggtgtgaagctgccagagaccagcctctttgaaactgaagaaactcgaaaaattcttgatgatatttgtgttgcaaaagctgttgaatgccccccacctcggaccacagccaggctccttgataagcttgttggtgagttcctcgaagtgacatgcatcaatcctacattcatctgcgatcacccacagattatgagccctctggccaaatggcaccgctccaaagagggtctaactgaacgctttgagctgtttgtcatgaagaaggaaatctgcaatgcctacactgagctgaatgatcccatgcggcagcgacagctgtttgaagaacaggccaaggccaaggctgctggtgatgatgaagccatgttcatagatgagaacttctgtactgccctggaatatggactgcccccaacagctggctggggcatgggtatcgaccgagtcaccatgtttctcacagattccaacaatatcaaggaagtacttctgtttcctgccatgaagcctgaagacaagaaggaaactgcagcagccactgaaacactagaaagcacaacagccggcccctctgtctag

SEQ ID NO: 32637 - protein, 597 aa, Cricetulus longicaudatus
MATLQECKVKVDGEPKLSKNELKRRLKAEKKLAEKEAKQKELIEKQLSQAAAAAATNHTADNGVGVEEETLDPNQYYKIRSQAIHQLKVSGEDPYPHKFHVDISLTQFIQEYSQLQPGDHLTDITLKVAGRIHAKRASGGKLIFYDLRGEGVKLQVMANSRNYKSEEEFVRINNKLRRGDIIGVQGNPGKTKKGELSIIPYEITLLSPCLHMLPHLHFGLKDKETRYRQRYLDLILNDFVRQKFIVRAKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMLSGMVKSITGSYKITYHPDGPEGEAYEIDFTPPFRRISMVEELEKALGVKLPETSLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEQAKAKAAGDDEAMFIDENFCTALEYGLPPTAGWGMGIDRVTMFLTDSNNIKEVLLFPAMKPEDKKETAAATETLESTTAGPSV

SEQ ID NO: 32638 - DNA, 1578 bp, Deinococcus radiodurans
  CDS (1)..(1578)
atgcccgatgctcctcgccccccccgcccggaagggctgcacgaacagaccatcgcccgcctgaataacctggacgcgcaggttgacgccggcttcgaggcctatccctacagttacccccagacccaccacgcccgcgacgtgttcgccgctcaccctgccagagaagagggcacaggggaagggggaacgctggaacccggccagaagtgggaagaagaaagctactcgctcgcgggccgcgtgaccctgatgcgccacatgggcaaggccgcctttgccgacctgagcgacgaggacggcaaaatccagctgtttttctccaagcaggacaccgccggcttcgacgccaccaagaaaatcgacctcggtgacattatcggcgtgaagggtcaccccttcgtgaccaagaccgggcaactgaccctgcatgtgaccgagtggcagccgctcgtcaagagcctgcacccgctgccgagcaagtttcacggcctgcaagacgaggaactgcgcgcccggcgccgctacgtagacctgatggtgaccgagggcgcccgcgagaagttccaggcccgcagccgcatgattcggtacatccgcaacgaactggacgaacgcggcttcatggaagtggaggggcccacccttcaggtcacggcgggcggcgccgaggcccggcccttcatgacgcaccacaacgcgctctcgtacgatttcaagttgcgcatcagcctggaactgtacctcaagcggctgctcgtcggcggcttcgagcgggtgtacgagatcgggcgggtctaccgcaacgagggcatcgaccgcacccacaaccccgaattcaccatgctggaactgtactgggcctacgcggactacagcgacatcgccaagttggtcgaagacctgctgagcgggctggcaaaggaagtgcacggctcttatcagttcgagtaccagggcaagacgctggactttaccccgccgtttgcccgtgtggattacctcggcggcctgcgcgagcacgtgccgggcctcgacttcgacccgctggacctagaccggctgcgcgctttctgtgacgagcgctttccgcagtggaagggcgtgccgagctacaagctgctggacaaactgttcggtgagttcgtggagccgctgctgagcaatccgacgttcgtgatggaccaccccgccgtgatttcgccgctcgccaagaagcaccgttcccgccccgaggccgtcaccgagcgtttcgaggtgttctgctcgggcttcgaactggcgaatgcgttctccgaactcaacgacgccttcgaccagcgcgaacgctttgaggcgcagactgcccgccaggccgccggagacgacgaggcgcacccgcaggacgaggacttcctgctcgcgctggaatacgggatgccgcccgccgggggcctgggcatcggcatagaccggctggcgatgctgctcaccgactcggattccatccgcgacgtgctgctgttcccgctgctgcggcccgaaggcggcgaggcggaagaagctgacgacaccgcgcaggaaaacaccgccggctga

SEQ ID NO: 32639 - protein, 525 aa, Deinococcus radiodurans
MPDAPRPPRPEGLHEQTIARLNNLDAQVDAGFEAYPYSYPQTHHARDVFAAHPAREEGTGEGGTLEPGQKWEEESYSLAGRVTLMRHMGKAAFADLSDEDGKIQLFFSKQDTAGFDATKKIDLGDIIGVKGHPFVTKTGQLTLHVTEWQPLVKSLHPLPSKFHGLQDEELRARRRYVDLMVTEGAREKFQARSRMIRYIRNELDERGFMEVEGPTLQVTAGGAEARPFMTHHNALSYDFKLRISLELYLKRLLVGGFERVYEIGRVYRNEGIDRTHNPEFTMLELYWAYADYSDIAKLVEDLLSGLAKEVHGSYQFEYQGKTLDFTPPFARVDYLGGLREHVPGLDFDPLDLDRLRAFCDERFPQWKGVPSYKLLDKLFGEFVEPLLSNPTFVMDHPAVISPLAKKHRSRPEAVTERFEVFCSGFELANAFSELNDAFDQRERFEAQTARQAAGDDEAHPQDEDFLLALEYGMPPAGGLGIGIDRLAMLLTDSDSIRDVLLFPLLRPEGGEAEEADDTAQENTAG

SEQ ID NO: 32640 - DNA, 1497 bp, Enterococcus faecalis
  CDS (1)..(1497)
gtggcagaagaacaacaagcgcatttagaggatttaaatgatcaaatgctcgtgcgccgcgaaaaaatggaagctttacgtgaagaagggattgatcctttcggtaaacgtttcgatcgcactcataattcagcagaacttcatgaacaatatgataatcatacaaaagaagaacttagtgaaatgaatacagaagtcagcgttgctggacgtatgatgacaaaacgtggtaaaggaaaagctggtttcgcccatttgcaagaccgtgaaggccaaattcaaatttatgttcggaaggaccaagttggagacgaagcctatgaactatttaaacatgctgacttaggcgacttctttggtgtgacaggtcaagtaatgaaaaccaatacgggggaagttactgttaaagctcaaacaattacgttattaactaaagctttgcgtccattgccagataaataccatggattaacgaatgtggaacaacgctatcgtcaacgctatttggatttaatcagtaacaaagaaagctttgatcgtttcatgaaacgcagtcaaattattagcgaaatccgtcgttatctagatggcaatggctatgtcgaagtagaaacgcctgtcttgcataacgaagcaggaggagctgctgctcgtccatttatcacacaccataatgcgttagatatggacttatacttacgcattgccctagagttacatttaaaacgtttaattgtcggtggcatggaaaaagtatatgaaattggtcgtgtcttccgtaatgaaggaatcgataccactcataacccagaatttacaatgctagaagcttatactgcttatactgattatcaagatgtgatggatttaacagagggaattattcgtaatgctgcggaaaaagtcttaggaactactgatatcacgtacgatggtcaagcggttgacttaggaagtcctttcaaacgtctacacatggtagatgcggtcaaagaacaaacgggcgtagatttttggcaagagatgacgatagaagaagcccgtgcgttggctaaagaacataatgttgaaattacagatgccatgacagtcggtcatatcattaatgaatttttcgaaacatttgtagaagatacgttgcaacaaccaacatttatttatggtcacccagtcgctgtttcaccattagcgaagaaaaatccagaagatggtcgtttcactgaccgctttgaactatttattatcggaaaagagtttgctaatgcatttacagaattaaatgatccaattgaccaacgtgaacgttttgaagaacaagaaaaagaacgggaacaaggaaatgatgaagcacacggagtagatgaagatttcatcgaagccttagaatatggcttgccaccaaccggaggattaggtattgggattgatcgactagttatgttattaaccgatgcacaatcaattcgtgatgtcttgctattcccaacaatgagataa

SEQ ID NO: 32641 - protein, 498 aa, Enterococcus faecalis
MAEEQQAHLEDLNDQMLVRREKMEALREEGIDPFGKRFDRTHNSAELHEQYDNHTKEELSEMNTEVSVAGRMMTKRGKGKAGFAHLQDREGQIQIYVRKDQVGDEAYELFKHADLGDFFGVTGQVMKTNTGEVTVKAQTITLLTKALRPLPDKYHGLTNVEQRYRQRYLDLISNKESFDRFMKRSQIISEIRRYLDGNGYVEVETPVLHNEAGGAAARPFITHHNALDMDLYLRIALELHLKRLIVGGMEKVYEIGRVFRNEGIDTTHNPEFTMLEAYTAYTDYQDVMDLTEGIIRNAAEKVLGTTDITYDGQAVDLGSPFKRLHMVDAVKEQTGVDFWQEMTIEEARALAKEHNVEITDAMTVGHIINEFFETFVEDTLQQPTFIYGHPVAVSPLAKKNPEDGRFTDRFELFIIGKEFANAFTELNDPIDQRERFEEQEKEREQGNDEAHGVDEDFIEALEYGLPPTGGLGIGIDRLVMLLTDAQSIRDVLLFPTMR

SEQ ID NO: 32642 - DNA, 1482 bp, Fusobacterium nucleatum
  CDS (1)..(1482)
atggagaaatattttgacagattagagaaagaacctctaattgctgaaagatggaaaaaaattgaagagttggaaagctatggtataaagccatttggaaaaaaatatgataaacaaataatgataggagatattttaaaacataagccagaagaaaatttaaagtttaaaactgctggaagaataatgtctttaaggggaaaaggaaaagtatattttgctcatatagaagaccaatctggtaaaatccaaatttatataaagaaagatgaattaggagaagaacaatttgaccatattgttaaaatgttaaatgttggagatataatcggacttgaaggagaattatttataactcacacagaagaattaactttaagagttaaaagtattgctcttttaacaaaaaatgtaaggtctcttcctgaaaaatatcatggacttactgatgttgaaatcagatatagaaaaagatatgttgacttaataatgaacccagaagttagagaaacttttattaaaagaactaaaataataaaagcaattagaaaatacttagatgatagaggatttttagaagtagaaactcctataatgcacccaattttaggaggagctgctgcaaaaccttttataactcatcataatactttaaatattgatttatttttaagaatagctcctgaattatatttaaagaaattaatagttggtggttttgaaagagtatatgacttgaatagaaattttagaaatgaaggaatatctacaagacataatcctgaatttacaatggttgaattatatcaagctcatgcagattttaatgatatgatggatttatgtgaaggtataatttcatcagtatgtcaagaaattaatggaacaactgatattgaatatgatggagttcaattatcacttaaaaactttaatagagtgcatatggttgatatgataaaagaagttacaggagttgatttctggaaggaaatgacttttgaagaagctaaaaaattagctaaggaacatcatgttgaagttgcagaccatatgaatagtgttggacacattataaatgaattctttgaacaaaagtgtgaagaaaaagttatacaaccaacatttgtatatggacatcctgttgaaatatctccacttgcaaaaagaaatgaagataatccaaatttcacagatagattcgaactatttatcaataaaagagaatacgcaaatgctttcactgaattaaatgacccagcagatcaaagaggaagatttgaagcacaagttgaagaagcaatgcgtggaaatgaagaagcaacaccagaaatagatgaaagttttgttgaagctcttgaatatggtttaccacctactggtggaatgggaataggaatagatagacttgtaatgttacttacaggtgcaccatctataagagatgtaattcttttcccacaaatgaaaccaagagattaa

SEQ ID NO: 32643 - protein, 493 aa, Fusobacterium nucleatum
MEKYFDRLEKEPLIAERWKKIEELESYGIKPFGKKYDKQIMIGDILKHKPEENLKFKTAGRIMSLRGKGKVYFAHIEDQSGKIQIYIKKDELGEEQFDHIVKMLNVGDIIGLEGELFITHTEELTLRVKSIALLTKNVRSLPEKYHGLTDVEIRYRKRYVDLIMNPEVRETFIKRTKIIKAIRKYLDDRGFLEVETPIMHPILGGAAAKPFITHHNTLNIDLFLRIAPELYLKKLIVGGFERVYDLNRNFRNEGISTRHNPEFTMVELYQAHADFNDMMDLCEGIISSVCQEINGTTDIEYDGVQLSLKNFNRVHMVDMIKEVTGVDFWKEMTFEEAKKLAKEHHVEVADHMNSVGHIINEFFEQKCEEKVIQPTFVYGHPVEISPLAKRNEDNPNFTDRFELFINKREYANAFTELNDPADQRGRFEAQVEEAMRGNEEATPEIDESFVEALEYGLPPTGGMGIGIDRLVMLLTGAPSIRDVILFPQMKPRD

SEQ ID NO: 32644 - DNA, 1494 bp, Gloeobacter violaceus
  CDS (1)..(1494)
atggccgaggaagatttgcgccgcacgcgcctggagaaggccgagcagtggcgcgtccacaaccaaaacccctacccgtaccgctacgagcgcacgcacatggcaggggatttgcaggcgaaatacaaagatctcgaaaacggccaggaagtcgaagatgccgtctcggtggcgggccgcatcgtcgcccggcgcgtgctgggcagcgtcgccttttttggcctccaggacgattcgggtaccatccagctttatttcgacaaaaagcgcatccgcgagagcatgggagccgacgccttcaagtggctcgacaagctcaccgacaccggcgattttatcggggcgcacggtaccatccgccgcaccgagcgcggcgaactgtcggtctacgtccacgagtacgagctgttgtgcaagtcgattttgcccttgccctctgagtactacggcctcaccgacgtccagaagcgctaccgtcagcgctatctcgatctgatcgccaaccccggcgtgcgtgagaccttccgcaagcgcgccctgattgtgcgggaaattcgccgctttctcgatgagcggggctttcttgaaatcgagacccccgtgctgcagaccgaggccgggggcgcggcggcgcggccctttaccacccaccacaacgccctgggcctcgatatgttcttgcgcatcgccaccgaattgcacctgaagcggctggtggtgggcgggttcgaaaaggtctacgaactggggcggatctttcgcaacgagggcatctcgacgcgccacaacccggaatttaccaccgtcgaaatctacgaagcctacagcgattacttcgacatcatggatctggtggaaaccctgctgcgcgcggtggcccacattgtcctcggctccaccgaactggtctgcgagggcaatacgatcgacctgggcgccccgtttcggcggatcaccatgttcgatctggtcgcacagatgaccggggtggccctggccggattgcgcgacggcgagaaggcggcccgccttgccgaagcagtcggtgtcgaggtaaccgcgggagcctcggtcggccagattctctaccagctattcgaagaaaagtgcgaggcgaagctcacccaacctaccttcgtgctcgactatccggtcgaaatttcgccgcttgccaaggcccaccgctcggtgccgaacatggtcgagcgcttcgagctatatatcaacggtcgtgagaccgccgacggtttttcagaactcaacgacccggtcgatcagcgcgcccgcctggaggcccaggccaaagcgaaggcggcgggagacctggaggcgcaccccttcgacgaggattttctgaccgccatcgagcacggcctgcctcccaccggcggcgtcggcatcggcatcgaccggctggtgatgctgctcaccgacagcccgagcatccgcgatgtgatcgcctttccgaccctccggccggaggcgggggaatag

SEQ ID NO: 32645 - protein, 497 aa, Gloeobacter violaceus
MAEEDLRRTRLEKAEQWRVHNQNPYPYRYERTHMAGDLQAKYKDLENGQEVEDAVSVAGRIVARRVLGSVAFFGLQDDSGTIQLYFDKKRIRESMGADAFKWLDKLTDTGDFIGAHGTIRRTERGELSVYVHEYELLCKSILPLPSEYYGLTDVQKRYRQRYLDLIANPGVRETFRKRALIVREIRRFLDERGFLEIETPVLQTEAGGAAARPFTTHHNALGLDMFLRIATELHLKRLVVGGFEKVYELGRIFRNEGISTRHNPEFTTVEIYEAYSDYFDIMDLVETLLRAVAHIVLGSTELVCEGNTIDLGAPFRRITMFDLVAQMTGVALAGLRDGEKAARLAEAVGVEVTAGASVGQILYQLFEEKCEAKLTQPTFVLDYPVEISPLAKAHRSVPNMVERFELYINGRETADGFSELNDPVDQRARLEAQAKAKAAGDLEAHPFDEDFLTAIEHGLPPTGGVGIGIDRLVMLLTDSPSIRDVIAFPTLRPEAGE

SEQ ID NO: 32646 - DNA, 1497 bp, Haemophilus ducreyi
  CDS (1)..(1497)
atgtctgaagaacaagaattagatcttaacggcgagatgttagcgcgccgtgagaagttagccaaaattcgtgcgatggggaatccgtttccgaaccgttttcgtcgtgatgcttatgcttatgcgttgcaggctgagtatgcggaaatggcaggagatgcattaaaagatgcggatgtgcaggtgaaggttgttggccgtattatgctaaaaagggtgatgggtaaggcatctttctttactattcaagatgttagcggtcagattcagctttatgttgcacgagataatttagccgagggggtttatgtagataatgtcggtttgtgggatttaggcgatattgttggcgtgtgtggtactttatttaaaactaaaaccggtgagttgacggttcgttgtgcggacgttgagttgttgacgaagtcattgcggccgttgccaaataaacaccaaggattggttgatcaagaaatgcgttatcgtcagcgttatttggatttaattgcaaatgagcagtcgcgccgtacttttgtgatccgttcgcaagtggtgtcgggcattcgtcaattctttttagaacgaggctttatggaagtggaaacgccgatgttgcaggtgattccgggcggtgcggcggctaagccgtttgtaacgcatcataatgcgttggacgtggatatgtatttgcgtattgcacccgagctttatttaaagcggttagtggtgggcggttttgagcgggtgtttgagttgaaccgtaatttccgtaatgagggcgtttcggtgcgccataatccagaatttacgatgattgaatattatcaagcctatgcggattatcacgatttaatggataatacggagcagttgttgcgtaagttggcgttggatattcttggcacaacggcggtgccttatggtgaatatcaatttgattttggtcagccgtttgagcggatcacgatgcacgatgcgattgttaaatatggcaatggtattgcacgagaagatttagatgatattgagaaagcggtcgaaattgctaaaaaattaggcattgaggtgcagaaatcgtggggcttgggcgctgtggttaatgctatttttgaggaagtggcagagcatcaattgattcagccgactttcttaatggcgcaccctgcggaaatttcaccgcttgctcgccgtaatgatgagaatcctgaagtaaccgatcggtttgagctgtttattggcgggcgtgagatcggtaatggtttttctgagttgaatgatgctgaagatcaagcggcacgttttgatgctcaagtggcggctaaagatgccggcgatgatgaggcgatgtttaaagatgatgattttgttgtggcgttagagcatggcttgccacccactgcgggcgaggggttaggcatcgatcgtttagttatgatttttgccaatgcgccatctattcgtgatgtgattttgttccctgcaatgcgccataaataa

SEQ ID NO: 32647 - protein, 498 aa, Haemophilus ducreyi
MSEEQELDLNGEMLARREKLAKIRAMGNPFPNRFRRDAYAYALQAEYAEMAGDALKDADVQVKVVGRIMLKRVMGKASFFTIQDVSGQIQLYVARDNLAEGVYVDNVGLWDLGDIVGVCGTLFKTKTGELTVRCADVELLTKSLRPLPNKHQGLVDQEMRYRQRYLDLIANEQSRRTFVIRSQVVSGIRQFFLERGFMEVETPMLQVIPGGAAAKPFVTHHNALDVDMYLRIAPELYLKRLVVGGFERVFELNRNFRNEGVSVRHNPEFTMIEYYQAYADYHDLMDNTEQLLRKLALDILGTTAVPYGEYQFDFGQPFERITMHDAIVKYGNGIAREDLDDIEKAVEIAKKLGIEVQKSWGLGAVVNAIFEEVAEHQLIQPTFLMAHPAEISPLARRNDENPEVTDRFELFIGGREIGNGFSELNDAEDQAARFDAQVAAKDAGDDEAMFKDDDFVVALEHGLPPTAGEGLGIDRLVMIFANAPSIRDVILFPAMRHK

SEQ ID NO: 32648 - DNA, 1557 bp, Helicobacter hepaticus
  CDS (1)..(1557)
atgttttcaaatttttatgttcaacaacgtataaaaaaaatggaacttatgcgacaagaaggctttaatccttatgctaataaaactacacgcactatcagtaattacaattttttaaataaatataatcatctcaaaatgcaatcttcagatgatacgcaagattgtacgcaaaataaagagattgaaagcattgtaggacgtgtgcgttttatccgtctaatgggaaaagcgtgctttattaagattcaagatgaaagtggtatccttcaagcttatgtatcaaaaaatgatattggagaagactttttattgattaaaaaagtgcttgaagttggggatattatcaatgtaagtggttatgcttttgtaaccaaaaccggtgaattaagtatccacacacttacattgcaaatacttaccaaaagtatcgtcccactcccagaaaaatttcacggactaaatgatattgagctacgttatcgccaacgttatgtagatttaatcgttaataacaaagttaaagaaacttttaaactgcgtagccaaattgtctcgtgcatacgacaattttttgagcaaaaaggattcttagaagtggaaacacctatgctccattctattcctggcggagcaaatgcgcgccctttcatcactcatcataatgcacttgatgtagatagatatctacgaattgcgcccgaactttatctcaaacgtcttattgtagggggatttgaagctatttttgaactcaatcgtaattttcgcaatgaaggtatggatcattcacataatccagaatttagtatgattgaattttattgggcatataagacttatgaagacctcattacacttacccaagaactttttgctttcttatttaaaaaactcaacttaccgcatagtttgatacacgatgagttagaaattgatttctcacaatggcacattataggctacaaagaagcattaattaaaattggtggtttagataaaaatatcattgataatcaagacgcactccttagcttccttatgagcaaacatcttaaggtagataagagtatgtcttatggcaaacttttaggcgaagcttttgatgaatttgttgaacataaactcatcaatccgacttttatcacgcaatatcccattgaaattagccctttagctcggcgtaatgatgagaatccaaatgttgctgatagatttgagttattcatcggtggtaaggaaattgccaatggttttagtgagcttaatgacccaatcgaccaatttgagagattcaaagagcaagccaaggcaaaagatgcgggagatgaagaagcgcagtatatggacgaagattatgtatgggcacttgcgcacggtatgccacctactgctggagaaggcataggtattgatagattagtaatgcttttaagcaatgcaaaaacaattaaagatgtaattttatttcctgcattaaagccaactaaatcaaattttgatataatactttctcaagacgcattatctaatgctcaaataatcaaggagaactaa

SEQ ID NO: 32649 - protein, 518 aa, Helicobacter hepaticus
MFSNFYVQQRIKKMELMRQEGFNPYANKTTRTISNYNFLNKYNHLKMQSSDDTQDCTQNKEIESIVGRVRFIRLMGKACFIKIQDESGILQAYVSKNDIGEDFLLIKKVLEVGDIINVSGYAFVTKTGELSIHTLTLQILTKSIVPLPEKFHGLNDIELRYRQRYVDLIVNNKVKETFKLRSQIVSCIRQFFEQKGFLEVETPMLHSIPGGANARPFITHHNALDVDRYLRIAPELYLKRLIVGGFEAIFELNRNFRNEGMDHSHNPEFSMIEFYWAYKTYEDLITLTQELFAFLFKKLNLPHSLIHDELEIDFSQWHIIGYKEALIKIGGLDKNIIDNQDALLSFLMSKHLKVDKSMSYGKLLGEAFDEFVEHKLINPTFITQYPIEISPLARRNDENPNVADRFELFIGGKEIANGFSELNDPIDQFERFKEQAKAKDAGDEEAQYMDEDYVWALAHGMPPTAGEGIGIDRLVMLLSNAKTIKDVILFPALKPTKSNFDIILSQDALSNAQIIKEN

SEQ ID NO: 32650 - DNA, 1485 bp, Lactococcus lactis
  CDS (1)..(1485)
ttggctgaaatcgaagaacttaatgaccaaatgaaagtccgccgtgaaaaaatggaaaacctgcgcgaagcgggaattgacccatttggacataaatttacacgtacgcacaactcacaagaactacacgaagcttatgacgaaaagacgaaagaagaattgcatgaacttgcgctttcaggaattgtcgctggtcgtttgatgactaaacgtggtaaaggtaaagtcggtttcgcccatcttcaagaccgcgaaggccaaattcaactttatgttcgtaaagatgaagtcggcgaagaaaattatgaaattttcaaaaaagctgacctcggagatttccttggtgttgaaggcgaaatcatgaaaactgacatgggtgaattgtcaattaaagcaaaaaaattgactttcctctcaaaagcgcttcgtcctttgcctgaaaaattccatggtttgactgacactgaaacacgttatcgtaaacgttatttggatttgatttcaaataaagaaagcttcaatcgttttgtcactcgttctaaaattatcagtgaaatccgtcgttatatggatggtcgtggatatcttgaagttgaaactccagtacttaacaatgaagccggtggtgctgctgctcgtccattctacacacatcataacagtcttgatattgatatggcgcttcgtattgcaactgaattacacttgaaacgtttgattgttggtggaatggaaaaagtttatgaacttggccgtgtcttccgtaacgaaggaatggatatgactcataatccagaattcacaacaatggaatcttatgaagcttatgctgattttgaagatatcatggatttgacagaaggaatcttccaacatgttgctaaaacagtggttggtcaagatgttcttgaatacgatggtaaagaaattaatgttggcggaaaattcaaacgtgttcacatggttgatgccatcaaggaagttgctggagttgatttctggcctgagatgacttttgaagaagcaacagctcttgcaaaagaacatgatattcatgttgaaaaacatttcacttctgttggtcatatcattaacgaattctttgaaaaatatgttgaagaaactttgattcaacctactttcgtttttggtcatccaaaagaaatttcaccacttgctaaaatgaatgaaaaagacccacgttttactgaccgttttgaacttttcatcaacggtaaagaatacgccaatgctttcagcgaattgaatgacccaattgaccaattggaacgttttgaagctcaagctaaagctaaagaacttggagatgatgaagcaactggtgtcgattacgattatgttgaagcactcgaacacggtatgccaccaacaggtggactcggtatcgggattgatcgcttagtgatgctctttactggcacaacttcaatccgtgacgttttgcttttcccaactatgaaataa

SEQ ID NO: 32651 - protein, 494 aa, Lactococcus lactis
MAEIEELNDQMKVRREKMENLREAGIDPFGHKFTRTHNSQELHEAYDEKTKEELHELALSGIVAGRLMTKRGKGKVGFAHLQDREGQIQLYVRKDEVGEENYEIFKKADLGDFLGVEGEIMKTDMGELSIKAKKLTFLSKALRPLPEKFHGLTDTETRYRKRYLDLISNKESFNRFVTRSKIISEIRRYMDGRGYLEVETPVLNNEAGGAAARPFYTHHNSLDIDMALRIATELHLKRLIVGGMEKVYELGRVFRNEGMDMTHNPEFTTMESYEAYADFEDIMDLTEGIFQHVAKTVVGQDVLEYDGKEINVGGKFKRVHMVDAIKEVAGVDFWPEMTFEEATALAKEHDIHVEKHFTSVGHIINEFFEKYVEETLIQPTFVFGHPKEISPLAKMNEKDPRFTDRFELFINGKEYANAFSELNDPIDQLERFEAQAKAKELGDDEATGVDYDYVEALEHGMPPTGGLGIGIDRLVMLFTGTTSIRDVLLFPTMK

SEQ ID NO: 32652 - DNA, 1500 bp, Lactobacillus plantarum
  CDS (1)..(1500)
gtggcacgacaagaacagacgatgaacgaccaactgaaggttcgtcgcgaaaaaatggatgaactgcgtgaagaggggattgatccctttggtcaccggttcgaacggactgatttagcccaggacttgcaagacaagtatggggatatggataaggacgagctagacgctaaacaagtggtggcaaccattgctggacggatgctagctaagcgtggtaagggtaaagtcggttttgctgatatctgggatcgctcaggtaagatgcagttatacattcgtaaagatgtagtcggcgaagatacttaccatatcttcaagcgttctgatattggtgatttccttggaattaccggccaagtttttaagacggactttggcgaattaacgattaaagtaactggtttaacgttcttatcaaaggcgttacgaccattgccagataagttccatgggttacagaatgtggaacagatctatcgccaacggtatttggacttgatctctaaccgcgatagctttgatcgtttcttgaagcggacgaagatcatttcagcgattcggcatcatttagacgatcaaggcttcacagaagttgagacgccaatgttgcataatcaagctggtggtgcggcagcacggccatttgtgactcaccacaatgcgttgaacattgatctctacttacgaattgcgttggaattacatttgaagcgcctgatcgttggtggcatggaaaaggtttatgagattggtcgggttttccgtaatgaagggatggaccgtgaacataatcctgaatttaccatgatggaaacttatgtcgcctatttcgacttccatgatgtaatggctgagacggaaggtatttttaaagccgcagcgcaagccgtaactgacgatggcattgtcacttatcatgatcaaaaagttgatttcaatcaaccatttaagcaaattcacatggtcgatgcgattaaagaaaagactgggattgatttctggcaaccaatgtcaattgaagatgcacaaaaattggcggatgaacatcacgtgaagtatgaaccatactggaaagttggtcatatcattaatgcgttctttgaagaatttgttgaagacacgttgaatgagccaacctttgtttatggtcatccagttgaaatttcgccattagctaagaagaatgaagaagatccacggtttactgatcgttttgaactcttcatcttaggtaatgaatacgccaatgcgttcagtgaattgaatgatccaattgaccaacggcaacgtttcgaagctcaggctgcggaacggactgctggtaacgacgaagctgaacatattgatgaagactttgtcgaggcgttggaatacgggatgccgcctactggtgggttaggtatcgggattgatcggttggttatgttaatgacggatgcggattcgattcgtgatgtcttacttttcccaacgatgcgtccagaagaagataaataa

SEQ ID NO: 32653 - protein, 499 aa, Lactobacillus plantarum
MARQEQTMNDQLKVRREKMDELREEGIDPFGHRFERTDLAQDLQDKYGDMDKDELDAKQVVATIAGRMLAKRGKGKVGFADIWDRSGKMQLYIRKDVVGEDTYHIFKRSDIGDFLGITGQVFKTDFGELTIKVTGLTFLSKALRPLPDKFHGLQNVEQIYRQRYLDLISNRDSFDRFLKRTKIISAIRHHLDDQGFTEVETPMLHNQAGGAAARPFVTHHNALNIDLYLRIALELHLKRLIVGGMEKVYEIGRVFRNEGMDREHNPEFTMMETYVAYFDFHDVMAETEGIFKAAAQAVTDDGIVTYHDQKVDFNQPFKQIHMVDAIKEKTGIDFWQPMSIEDAQKLADEHHVKYEPYWKVGHIINAFFEEFVEDTLNEPTFVYGHPVEISPLAKKNEEDPRFTDRFELFILGNEYANAFSELNDPIDQRQRFEAQAAERTAGNDEAEHIDEDFVEALEYGMPPTGGLGIGIDRLVMLMTDADSIRDVLLFPTMRPEEDK

SEQ ID NO: 32654 - DNA, 1497 bp, Listeria monocytogenes
  CDS (1)..(1497)
atgagtaacgagaatcatgaagaactaaatgaccaactcatcgtccgtcgtgaaaaagtggacacattgcgcgaagaaggcatagatccttttggcgaaaaattcatccgttccatcagcccggaagaaatcgaaacaaaattcgctgataaatcaaaagaagaacttgaagaagctgctattgaagtttctgtagcaggtcgtattatgacaaagcgtgtaaagggtaaggtaggtttcacacatattcaagaccgtttccatcaattacaaatctatatccgtaaagatgcgattggcgaagatgcttacgcagtcttcaaattagcagatctaggtgacattattggtataaaaggaactattttccgtactaatacaggtgaactttctgttaaagcaacggaattcactttgctttccaaatcgttacgtccacttcctgataaatatcatggtttaaaagacgtagaacaacgctatcgtcaacgctatttagacttaatcacaaacgaagaaagtcaaaatcgctttgtgatgcgcagtaaaatcttgaaatacactcgtgattatatggataaccaaggattcttagaagtagaaactccggtgcttcatacaattgctggtggtgctgctgcaaaaccatttatcacgcaccataatgcgcttgatatggaattatacttgcgaatcgctttagaactacacttaaaacgtctaatcgttggtgggatggataaagtgtacgaaattggccgtgttttccgtaatgaaggaacatccacgcgtcataacccagaatttacaatgctagaatcctatgcagcatacgaagattatgaagatgttatggatctggtagaaggtttagtatccacggtatgtaaacaagtaaatggaacaacagaaataacatacggtgaatacaaagtagatttaactcctaactggcgccgtatccacatggcagatgctgtaaaagaatacgtaggagtggatttttggaacgtaacttccgatgaagaagcgcgtgaactagcaaaaaaacatgatgtgccagtaacggaacacatgacatacgggcacattcttaatgagtttttcgaaacatacgtagaagaaaagctcattcaaccaacctttgtttacgggcatccggtggaaatttccccattagcgaagaaaaacaaagaagatgaacgttttactgaccgttttgaattatttatcgttggtcgtgaacatgcaaatgcattctcagaattaaacgatccaattgatcaaagagaacgctttgaagcgcaaatgaaagaacgtgagcaaggtaatgatgaagcacacggaatggatgcagatttccttgaagctttagaatacggtctaccgccaactggtggacttggaataggtattgatcgtctagtaatgctattaacagatgccccgtctattcgtgatatcctattattcccaactatgaaacaccgcgactaa

SEQ ID NO: 32655 - protein, 498 aa, Listeria monocytogenes
MSNENHEELNDQLIVRREKVDTLREEGIDPFGEKFIRSISPEEIETKFADKSKEELEEAAIEVSVAGRIMTKRVKGKVGFTHIQDRFHQLQIYIRKDAIGEDAYAVFKLADLGDIIGIKGTIFRTNTGELSVKATEFTLLSKSLRPLPDKYHGLKDVEQRYRQRYLDLITNEESQNRFVMRSKILKYTRDYMDNQGFLEVETPVLHTIAGGAAAKPFITHHNALDMELYLRIALELHLKRLIVGGMDKVYEIGRVFRNEGTSTRHNPEFTMLESYAAYEDYEDVMDLVEGLVSTVCKQVNGTTEITYGEYKVDLTPNWRRIHMADAVKEYVGVDFWNVTSDEEARELAKKHDVPVTEHMTYGHILNEFFETYVEEKLIQPTFVYGHPVEISPLAKKNKEDERFTDRFELFIVGREHANAFSELNDPIDQRERFEAQMKEREQGNDEAHGMDADFLEALEYGLPPTGGLGIGIDRLVMLLTDAPSIRDILLFPTMKHRD

SEQ ID NO: 32656 - DNA, 1767 bp, Lycopersicon esculentum
  CDS (1)..(1767)
atggattcatctgtttcaacagagccactaagcaagaatgctcttaagagagaaaagaaggcaaaggaaaaggagcaacttgaacaggaaaagaaggcagcagcagtagctaaaaggcaaatggagcaacacaatttacctgagaatgatgatttggatcctactcaatacttggcgaacagattgaggaacattgagtcgttgagagaatctggaatcaatccatatccacataagttcttcattacaatgtctattcctgaatttattagcagatatgctcatctaaatactggagagtttcctgaagacattgatatgtccttagcagggagagtgataagcaagcgagcatcatcgtcaaaactctatttctatgaactgcttggtggtggggcgagagtacaagtactggctagtgcaagggattctgatgtggatgctgttcagttttctaattatcagtctggagtgaagcgaggtgacatcattggtgtccgcggatatcctggaaagagtaagagaggagagctaagtatctttgcaaaaccttttatagttctagccccttgcctacacatgttaccgaggcggctgacctcctctatcgtagatgaaactcggacacagaatttccaaggaataacagcttatgatacttggactccaggagatctgagaaaccccgagtcttatgtgttaagggatcaggaaactcggtatcgtcaaaggtacttagatctaatgatgaatccagaagttcgagctttgtttaggactcgcgccagaatcatttcttacatcaggagtttcctcgataatcttgagtttctggaggtggagacaccttctatgaatttgacagctggaggagcttcagccagaccatttatcactcaccataacgagttggacacagaactcctcatacgtgtttcccccgagctttatcttaagaagttagttgttggtggattcgaccgtgtttatgagctggggaagcatttcaggaatgaaggaatggatttaactcactctcctgagttcacaatgtgtgaactttatatggcttacgctgattacaacgatttgatggatttgacagagcagctactatcaggtatggtgaaggacctaaccggaagctataaaataaggtaccatgctaatggcttggataatgaaccgatagaaattgatttcactcctccattcagaaagattgatatgttgtcggagttggagaaagtggctaacatcagtatacctagagatctatcgagtgaaagtgctaacaagcacttggtagatgtatgtgagaagttcgatgtcaaatgccctccacctcataccacaacacgattactcgataagctagttggtcattttattgaagtaaactgcataaatcccacttttattatcaaccatcctgagatcatgagcccactggctaaatcacgcagatcagaacctggtttgactgagcgcttcaacttattcgttaacagaagagagctatgtgatgcctatactgaactaaatgatcctacagcacagagagaacgctttgctgaacaattaaaggacagacaattaggagacgacgaggcaatggatttggatgaatcctttataactgcattggagtatggattaccccctactggtggactaggcatggggattgatagacttacaatgttgcttacagattcacaaaatgtcaaggaagttatcctctttccagccatgagattacaatga

SEQ ID NO: 32657 - protein, 588 aa, Lycopersicon esculentum
MDSSVSTEPLSKNALKREKKAKEKEQLEQEKKAAAVAKRQMEQHNLPENDDLDPTQYLANRLRNIESLRESGINPYPHKFFITMSIPEFISRYAHLNTGEFPEDIDMSLAGRVISKRASSSKLYFYELLGGGARVQVLASARDSDVDAVQFSNYQSGVKRGDIIGVRGYPGKSKRGELSIFAKPFIVLAPCLHMLPRRLTSSIVDETRTQNFQGITAYDTWTPGDLRNPESYVLRDQETRYRQRYLDLMMNPEVRALFRTRARIISYIRSFLDNLEFLEVETPSMNLTAGGASARPFITHHNELDTELLIRVSPELYLKKLVVGGFDRVYELGKHFRNEGMDLTHSPEFTMCELYMAYADYNDLMDLTEQLLSGMVKDLTGSYKIRYHANGLDNEPIEIDFTPPFRKIDMLSELEKVANISIPRDLSSESANKHLVDVCEKFDVKCPPPHTTTRLLDKLVGHFIEVNCINPTFIINHPEIMSPLAKSRRSEPGLTERFNLFVNRRELCDAYTELNDPTAQRERFAEQLKDRQLGDDEAMDLDESFITALEYGLPPTGGLGMGIDRLTMLLTDSQNVKEVILFPAMRLQ

SEQ ID NO: 32658 - DNA, 1512 bp, Neisseria meningitidis
  CDS (1)..(1512)
atgagcgaacaaaaccatccgcaaaccgagccgcagttggacgaaaaccaaatcatcgccctgcgccgcgaaaaactgcacaacatccgccaacagcgcaacgcctatcccaacgacttcaaacgcgacagcttcgccgccgatttgcacgcccaatacggcgaaatcggcaaagaagaactcgatccgcaaggcattcccgtcaaagtggccggccgcatgatgctgaagcgtcaaatgggcaaggcgagctttgccaccattcaagacgtgtccgggcaaatccagctttatctgaacaacaaaggcgtgagtcaagaagttttggacgacttcaaccattgggatttgggcgacatcgtcggcgcggaaggcactttgttcaaaaccaaccacggcgaactgaccgtacgcgtgtccggcatccgcctgctgtccaaatccctgcgccctctgccggacaaacataaaggcttgagcgatcaggaaaccaaataccgtcaacgctacgtcgatttgattgccaacgaagaatcgcgcaataccttcatcaaacgcagccaaatcatccaatccgtgcgtaattttatggtgggcgagcattatctcgaagtcgaaaccccgatgatgcacccgattcccggcggcgcgacggcaaaacccttcgttacccatcacaatgccttagatattccgctttatttgcgaatcgcccccgagctgtatctgaaacgcctggttgtcggtggtttggaacgcgtgtttgaaatcaaccgcagcttccgcaacgaaggcatgtccgtgcgccacaaccccgaattcaccatgatcgaattctacgaagccttctccgactacgaacgcatgatgcagatggcggaagacatcatccgcaacgcatcgcacacggtaaacggcacggcaaacatcacttacaacggcaaagaagtcgatttggaaagcccgtttgaacgcctgaccattctcgaagccatcaaaaaatacaatccgcactacaccgacgagcagttgaacgatgcggaatggctgaaaaaagaaatcgtcaaacacggcgaaagcctgccgccgtccccgggcatcggcagcctgcaactcgcgctgtttgaaggttgcgccgagggcaagctgtggaatccgaccttcatcgtcgattacccggtcgaagtttccccgttggcgcgcgcttcggataccaaacaaggtctgaccgaacgtttcgaattgttcgttgtcgggcgcgaactggcaaacggctattccgagttgaacgaccccgaagaccaagccgaacgcttcaaagcgcaagtggcgcaaaaagacgcgggcgacgacgaagcgatgcactacgatgccgactacatccgcgcgatggagttcggtctgccgccgaccggcggttgcggtatcggcatcgaccgcttggtaatgttgctgaccgattcgcaaaccatccgtgacgtgattctgttcccgcagatgcgccccgagtaa

SEQ ID NO: 32659 - protein, 503 aa, Neisseria meningitidis
MSEQNHPQTEPQLDENQIIALRREKLHNIRQQRNAYPNDFKRDSFAADLHAQYGEIGKEELDPQGIPVKVAGRMMLKRQMGKASFATIQDVSGQIQLYLNNKGVSQEVLDDFNHWDLGDIVGAEGTLFKTNHGELTVRVSGIRLLSKSLRPLPDKHKGLSDQETKYRQRYVDLIANEESRNTFIKRSQIIQSVRNFMVGEHYLEVETPMMHPIPGGATAKPFVTHHNALDIPLYLRIAPELYLKRLVVGGLERVFEINRSFRNEGMSVRHNPEFTMIEFYEAFSDYERMMQMAEDIIRNASHTVNGTANITYNGKEVDLESPFERLTILEAIKKYNPHYTDEQLNDAEWLKKEIVKHGESLPPSPGIGSLQLALFEGCAEGKLWNPTFIVDYPVEVSPLARASDTKQGLTERFELFVVGRELANGYSELNDPEDQAERFKAQVAQKDAGDDEAMHYDADYIRAMEFGLPPTGGCGIGIDRLVMLLTDSQTIRDVILFPQMRPE

SEQ ID NO: 32660 - DNA, 1509 bp, Nitrosomonas europaea
  CDS (1)..(1509)
atgacccaggaagagatatccggtatttcccaggatgaaaacaacctcattgcagaacgtcgttcgaaactgactgcattgcgccagaccggcaatgcgttcccgaacgattatcgccgggataacctggctcgtatcctgcacgaaaaatatgacagctgctccagagaggagctggaaagcagccaggtaacggtaaaagttgccggacgcatgttgttcaagcgcgtaatggggaaggcgagttttgcaacgattcaggatatgagcgggcggatacagctctatatctctaatgatcatactggtgaaaccgctcatgaagcattcagacattatgatctgggtgacattctcggggcggaaggggttttgttcaaaaccaggacggatgaattgtcgttacgagtgacacagcttcatcttctgaccaaatctttgcggcccttaccggaaaaattccacgggctggccgatcaggaacagaaataccggcgccggtatctcgatctgatcacgaatgaagatacacgcagggtgtttgcgattcgttcgaagatcattcaggcgatccgtgagttcctcgtcgatcgggattatctcgaagttgaaacaccgatgatgcattccattcccggcggtgccactgcgcgtccttttgtaactcatcataatgcgctggatatgtccctgtatctgcgcattgccccggaactttacctgaagcggctggtggtgggcggtatggaaaaggtttttgaaatcaaccggaatttcaggaatgaagggatatctacccgccacaatcctgaatttaccatgctggagttttatgaagcttatcaggatcacaattatctgatggatctgacggaatccatgctgcgtgaagtcgcgttgaaagtatcgggaacaactcgcatcgtttatcagcagcgcgaaatggatctggcacaacctttcgcccggctgaccattgcgcaggcgatcctgaaatatcatcccgaatattctgatgcacagctcaatgatcgggattttcttactaaagcgctacaggcaaaaggggttactgtaaaccctgatagtggaattggcgggctgcaactggctcttttcgatgaaacgaccgagcacttgctgtttgagccggtatttatcgttgattatccggctgaggtttctccgctggcacgttgtaacgatgccaatccggaaattaccgatcgtttcgagctttatatcgccgggcgggaaattgcgaacgggttttccgagttgaatgaccctgaagatcaggccaaccgcttccttgagcaggccagagcgaaagaggctggtgatctggaagccatgcactatgatgctgattatattcaggcattggaatatgggctgccgccaaccgcgggagaaggaatcgggatcgatcgactggtgatgttgctgactgattcccccagcattcgtgatgtgattctgttcccgcagttgcgcaaggaagattga

SEQ ID NO: 32661 - protein, 502 aa, Nitrosomonas europaea
MTQEEISGISQDENNLIAERRSKLTALRQTGNAFPNDYRRDNLARILHEKYDSCSREELESSQVTVKVAGRMLFKRVMGKASFATIQDMSGRIQLYISNDHTGETAHEAFRHYDLGDILGAEGVLFKTRTDELSLRVTQLHLLTKSLRPLPEKFHGLADQEQKYRRRYLDLITNEDTRRVFAIRSKIIQAIREFLVDRDYLEVETPMMHSIPGGATARPFVTHHNALDMSLYLRIAPELYLKRLVVGGMEKVFEINRNFRNEGISTRHNPEFTMLEFYEAYQDHNYLMDLTESMLREVALKVSGTTRIVYQQREMDLAQPFARLTIAQAILKYHPEYSDAQLNDRDFLTKALQAKGVTVNPDSGIGGLQLALFDETTEHLLFEPVFIVDYPAEVSPLARCNDANPEITDRFELYIAGREIANGFSELNDPEDQANRFLEQARAKEAGDLEAMHYDADYIQALEYGLPPTAGEGIGIDRLVMLLTDSPSIRDVILFPQLRKED

SEQ ID NO: 32662 - DNA, 1482 bp, Oceanobacillus iheyensis
  CDS (1)..(1482)
atgtcagaagagttaaatgaacatatgcaggttcgaagagataaattggcagaacacatggaaaaagggttggatccatttggtggtaaattcgaacgtagccatcaggctacagatcttattgaaaaatatgattcctattcaaaagaagaattagaggaaactacagatgaagttaccattgctggacgattaatgacaaagcgtggaaaaggaaaagctggatttgctcatattcaagatttaagtggacaaattcaattatatgtacgaaaagatatgatcggtgacgatgcttatgaagtgtttaagtcggcagatttaggagatatcgtcggcgttactggtgttatgtttaaaacaaatgtaggagaaatatctgttaaagcaaaacaatttcaactattaacgaaatccttacgacctttaccagaaaagtatcatggattaaaggatattgaacagcgttatcgtcaacgttatctggacttaattacaaatcctgatagtagaggaacttttgtatctcgtagtaaaatcattcagtcgatgagagagtatttaaacggacaaggctttttagaagttgaaacaccgatgatgcatagtattcctggtggagcttctgcccgtccatttattacacatcataacgctttagatatagaattgtatatgcgaatagctattgaattacacctaaaacgtttaatggttggcggactagaaaaagtgtatgaaatagggcgcgttttccgaaatgaaggagtatctacaaggcacaaccctgaattcacgatgattgagctatatgaagcgtacgctgattatcatgacattatggaacttacagagaatctcgtagctcatattgcaaaacaagtccatggttcaacaacaattacttatggagaacatgaaattaatctagagccaaaatggacaagactgcatatcgtagatgctgttaaagatgctacaggtgtggatttttggaaagaagtttcagatgaggaagctcgagcacttgctaaagagcatggtgtgcaagtaactgaatctatgagttatggacatgtggttaatgaattttttgaacaaaaagtagaagagactcttattcaacctacatttatacacggacatccagtggaaatttctccacttgcaaagaaaaataaagaagatgagcgattcacagatcgttttgagttgtttattgtaggaagagaacatgcgaatgcgtttagtgaattgaatgatccaattgaccaacgcgctcgttttgaggctcaagtaaaagaaagagcagaaggaaacgatgaagcacattatatggatgaggatttcttagaagcacttgaatatggaatgccaccaactggaggactcggtattggtgttgaccgcttagtaatgttattaacaaactcaccatccattcgtgacgtattacttttcccgcaaatgcgtacaaagtaa

SEQ ID NO: 32663 - protein, 493 aa, Oceanobacillus iheyensis
MSEELNEHMQVRRDKLAEHMEKGLDPFGGKFERSHQATDLIEKYDSYSKEELEETTDEVTIAGRLMTKRGKGKAGFAHIQDLSGQIQLYVRKDMIGDDAYEVFKSADLGDIVGVTGVMFKTNVGEISVKAKQFQLLTKSLRPLPEKYHGLKDIEQRYRQRYLDLITNPDSRGTFVSRSKIIQSMREYLNGQGFLEVETPMMHSIPGGASARPFITHHNALDIELYMRIAIELHLKRLMVGGLEKVYEIGRVFRNEGVSTRHNPEFTMIELYEAYADYHDIMELTENLVAHIAKQVHGSTTITYGEHEINLEPKWTRLHIVDAVKDATGVDFWKEVSDEEARALAKEHGVQVTESMSYGHVVNEFFEQKVEETLIQPTFIHGHPVEISPLAKKNKEDERFTDRFELFIVGREHANAFSELNDPIDQRARFEAQVKERAEGNDEAHYMDEDFLEALEYGMPPTGGLGIGVDRLVMLLTNSPSIRDVLLFPQMRTK

SEQ ID NO: 32664 - DNA, 1809 bp, Oryza sativa
  CDS (1)..(1809)
atggcggagtcgggctcgtcgggcctggaggagaagctggcgggtctctccgcgggctgcggcgaggagccgcagcagctctcgaagaatgccaagaagagggaggagaaaaggaagaagcaggaggaggagcgccggttgaaggaggaagagaagaagaagaaggccgctgcaacagcagctgctagtggagagcccccgaaggaatctgccgccgacgatgaggaaatggatcccactcaatattatgagaatcgcctcaaggcacttgattcactcaaggccacgggtgtaaacccctatccccataagttcctggctaatattaccgtagccgattatattgagaaatacaagagcatgaatgttggggataagcttgttgacgtcaccgagtgcctagcagggaggatcatgaccaagagagcgcaatcttccaagctcttattttatgatctttatggtggtggtgagaaagttcaagtttttgctgatgccaggacctcagagttggaagataatgaattcattaagtttcactctactctgaaacgaggtgatattgttggtgtatgtggttatccaggaaagagcaagagaggggagctcagtatattcccaaagaaaattgttgtgctctccccatgccttcatatgatgcctcgacagaagagtgagggaagtgctgttcccactccatgggctccaggaatgggtaggaacatcgaaaagtatgttttgagggaccaggaaacccgatatcgtcaacgatatcttgatctcatggtaaaccatgaagtgaggcatattttcaagacaagatcaaaagttgtctcttttattcggaaatttcttgatggtcttgactttttagaggtggagactccaatgatgaacatgattgcaggtggagcagctgcaaggccttttgtcacacatcataatgagttaaacatgaggctttatatgcgtattgctcctgagctctatctgaaggaattggttgttggggggctggatcgtgtttatgaaattgggaagcagttcaggaatgaaggaattgacctgacgcacaatcctgaattcacaacatgtgaattttatatggcatatgcagattacaatgacttgatagagcttactgaaaccatgttatctggtatggttaaggagttgacaggtggctacaagattaaatatcatgctaacggagttgagaaaccaccaatagagattgatttcacacctcccttcagaaagatagacatgattgaagaattagaggctatggctaaactcaatatacctaaagatctctcaagtgatgaagcaaacaagtatttgatagatgcctgtgccaaatatgatgtcaaatgcccacctccccagactacaacacggttgcttgataagctagttggccatttcttggaggagacatgtgtgaatcccacgtttattatcaaccatccagagataatgagtccattggcaaagtggcataggtctcgacctggattgactgagaggtttgagctctttgttaacaagcatgaggtgtgcaatgcatatacagagttaaatgatcctgttgttcagaggcaacggtttgaggaacaactaaaggatcgtcaatctggtgatgatgaagctatggcattggatgaaacattctgcacagcccttgagtatggcctaccaccgactggtggttggggattgggaattgatcgccttacaatgttgctgactgattctcagaatatcaaggaagttcttctattcccggctatgaagcctcaagattag

SEQ ID NO: 32665 - protein, 602 aa, Oryza sativa
MAESGSSGLEEKLAGLSAGCGEEPQQLSKNAKKREEKRKKQEEERRLKEEEKKKKAAATAAASGEPPKESAADDEEMDPTQYYENRLKALDSLKATGVNPYPHKFLANITVADYIEKYKSMNVGDKLVDVTECLAGRIMTKRAQSSKLLFYDLYGGGEKVQVFADARTSELEDNEFIKFHSTLKRGDIVGVCGYPGKSKRGELSIFPKKIVVLSPCLHMMPRQKSEGSAVPTPWAPGMGRNIEKYVLRDQETRYRQRYLDLMVNHEVRHIFKTRSKVVSFIRKFLDGLDFLEVETPMMNMIAGGAAARPFVTHHNELNMRLYMRIAPELYLKELVVGGLDRVYEIGKQFRNEGIDLTHNPEFTTCEFYMAYADYNDLIELTETMLSGMVKELTGGYKIKYHANGVEKPPIEIDFTPPFRKIDMIEELEAMAKLNIPKDLSSDEANKYLIDACAKYDVKCPPPQTTTRLLDKLVGHFLEETCVNPTFIINHPEIMSPLAKWHRSRPGLTERFELFVNKHEVCNAYTELNDPVVQRQRFEEQLKDRQSGDDEAMALDETFCTALEYGLPPTGGWGLGIDRLTMLLTDSQNIKEVLLFPAMKPQD

SEQ ID NO: 32666 - DNA, 1506 bp, Pasteurella multocida
  CDS (1)..(1506)
atgtcagaacaaactcaagaacttgatcttaatggcgagatgttagtccgccgtgaaaaattagccgcgttgcgcgctaaaggtaacccatttccaaatacatttcgtcgtgatgcgcttgcacaagatttacacgcaaactacgatgcacttgaaggcgaagcattaaaagcacaagaagtcgaagtaaaagtcgctggacgtattatgacgcgtcgtgcaatgggtaaggcgacttttatcaccttgcaagatatgtctggtcgtattcaactctatgtcgcacgtgataatttgccagaaggtatttatgctgacgatgtgggacagtgggatttaggcgatatcattggcgtaaaaggcaccttatttaaaaccaaaaccaatgaattaaccgtacgttgtactgaagtgcagttattaaccaaagcattacgcccattaccagataaattccatggtctaagcgatcaagaaacacgctatcgtcaacgttatttagatttaattgcaaacgaagactcacgtcgtactttcattattcgttctaaagtgattgcgggtattcgtgaatattttctgtcaaaaggctttatggaagtagaaaccccgatgttacaaattattccgggtggggcttctgcacgtccatttgtaacacatcataatgcattagatgtggatatgtatttacgtattgcgcctgagctttatttaaaacgcttagtggttggtggctttgaacgtgtctttgaattaaaccgcaacttccgtaacgaaggagtgtctgttcgccataacccagaatttaccatgctcgaatactaccaagcctatgcggattaccatgatttaatggataatactgaagaattgttacgtaaactggcaatggacattttaggcacgacgattgtcccttatggtgagcttgaatttgattttggcaaaccatttgaacgtatcacgatgcatgatgccattttgaaatacggcgcagaaaaaggtatcgtcaaagaggatctatatgactttgatcgtgctgttgccgttgcgaaaaaattaggtattgaagtacaaaaatcgtgggggttaggcagtctagtcaatgtaatttttgaagaggtggcggagcatcacttaattcagccaacgttcttaatggcacaccctgccgaaatttcgccattagcgcgtcgtaatgatgaaaatccagaagtcactgaccgttttgaattattcatcggtggacgtgaaattggtaacggtttctctgagttaaacgatgccgaagatcaaaacgaacgctttgacgcacaagttgcggcgaaagaagcgggggatgatgaagcgatgtttaaagacgaagatttcgtgactgctcttgaacatggcttaccaccaacagcaggcgaagggttaggtatcgaccgcttagcgatgctattcgcgaatgcggcctccattcgagatgtgatactcttcccagcaatgaagcagaaataa

SEQ ID NO: 32667 - protein, 501 aa, Pasteurella multocida
MSEQTQELDLNGEMLVRREKLAALRAKGNPFPNTFRRDALAQDLHANYDALEGEALKAQEVEVKVAGRIMTRRAMGKATFITLQDMSGRIQLYVARDNLPEGIYADDVGQWDLGDIIGVKGTLFKTKTNELTVRCTEVQLLTKALRPLPDKFHGLSDQETRYRQRYLDLIANEDSRRTFIIRSKVIAGIREYFLSKGFMEVETPMLQIIPGGASARPFVTHHNALDVDMYLRIAPELYLKRLVVGGFERVFELNRNFRNEGVSVRHNPEFTMLEYYQAYADYHDLMDNTEELLRKLAMDILGTTIVPYGELEFDFGKPFERITMHDAILKYGAEKGIVKEDLYDFDRAVAVAKKLGIEVQKSWGLGSLVNVIFEEVAEHHLIQPTFLMAHPAEISPLARRNDENPEVTDRFELFIGGREIGNGFSELNDAEDQNERFDAQVAAKEAGDDEAMFKDEDFVTALEHGLPPTAGEGLGIDRLAMLFANAASIRDVILFPAMKQK

SEQ ID NO: 32668 - DNA, 1737 bp, Porphyromonas gingivalis
  CDS (1)..(1737)
atgaacatactcgaactttcggaacaagaagtcgtacgccgtaacagcttagagcaactgcgtaatttggggatcgatccatatcctgcagcggaatataccgtcaatgcctattccgccgagatcaaaaggaatttcaatggcgatgagaatgtcgccaaacgtcaagtaagcattgccggacgtattatgagccgccgtatcatggggaaagctacattcatggagctgcaagatgctgaggggcgtatccagatctatattactcgggacgatatttgtccgggtgaggataaggagttctacaatacggtggtcaagaagtgtacggatataggtgattttatcggagtgaaagggtacgtattccgcactcagatgggagaaatatcggtgcatgtgcaggagatgactttcttgtcgaaagctatccgcccccttcctgtggtaaaagaaaaagatggggaggtcttcgatggcttcacggatccggagcagcgttatcgtcagcgatacgtggatctggtcgtcaatagtcatgtcaaagacattttcctcaagcgtacgatggtattcaattcgatgcgcagtttcttcaatgagtgcggatacatcgaagtggatacacctgtactccaatcgatcccgggaggtgcagctgcgcgtccttttatcacgcatcataacgctctggacattccgctctatctgagaatcgctaacgaattgtatctgaagcgtctgatcgtgggcggtttcgatggtgtgtatgaattcagccgcaatttccgaaatgaggggatggaccgcacgcataatcctgagttcacggccatggagatctatgtggcgtataaggattacaactggatgatgaactttacggagcagatgctcgaacgcatctgtatggatgtgctgggtactactcagatgaaggtgggcgggaaattgatcgacttcaaggccccctacaagcgagtgaccatgatcgaagccatccatgagcatacgggtatcgacatcagcggaatgaacgaggccgagctgcgtcaggtatgcgacaagctgggcgtagagcacaatgaaacgatgggcaaaggcaagctcatcgatgagatcttcggcgagaagtgcgagaagaactatatccagcctactttcatcacagactatccgaaagaaatgtcgcctctgacgaaggagcaccgcaccaatccggagctgacagagcgattcgagctgatggtcaatggcaaggagttggccaacgcctactcggagctgaacgacccgattgatcagagagaacgtttcgaagaacaactcaagctgtccgagaaaggcgatgacgaagccatgtacatcgacaacgacttcatccgtgcccttgaatacggtatgccgccgaccagcggtatgggtatcggtatggaccgtttggtcatgctattgacagggcaggagagtattcaggaggtgctcctcttcccacagatgaagcccgagaaggtggctccacgagatacgaaagagaagttcgccgtttgtggcgttcccgaagagtgggtacctgtactgcataaggccggctatcttaccgtacagtcgatgcgagaggataaaccgggcaaggtgatgcagcagctgatggacatcaataagaaatataagttggggcttgccggtttgaatctggaaaccgtttcggcttggcaggaagccccatatgagtaa

SEQ ID NO: 32669 - protein, 578 aa, Porphyromonas gingivalis
MNILELSEQEVVRRNSLEQLRNLGIDPYPAAEYTVNAYSAEIKRNFNGDENVAKRQVSIAGRIMSRRIMGKATFMELQDAEGRIQIYITRDDICPGEDKEFYNTVVKKCTDIGDFIGVKGYVFRTQMGEISVHVQEMTFLSKAIRPLPVVKEKDGEVFDGFTDPEQRYRQRYVDLVVNSHVKDIFLKRTMVFNSMRSFFNECGYIEVDTPVLQSIPGGAAARPFITHHNALDIPLYLRIANELYLKRLIVGGFDGVYEFSRNFRNEGMDRTHNPEFTAMEIYVAYKDYNWMMNFTEQMLERICMDVLGTTQMKVGGKLIDFKAPYKRVTMIEAIHEHTGIDISGMNEAELRQVCDKLGVEHNETMGKGKLIDEIFGEKCEKNYIQPTFITDYPKEMSPLTKEHRTNPELTERFELMVNGKELANAYSELNDPIDQRERFEEQLKLSEKGDDEAMYIDNDFIRALEYGMPPTSGMGIGMDRLVMLLTGQESIQEVLLFPQMKPEKVAPRDTKEKFAVCGVPEEWVPVLHKAGYLTVQSMREDKPGKVMQQLMDINKKYKLGLAGLNLETVSAWQEAPYE

SEQ ID NO: 32670 - DNA, 1506 bp, Pseudomonas aeruginosa
  CDS (1)..(1506)
atgagcgaccaacaactcgaccagcacgaactgcaacaggaagaaaacaagctgatcgcccagcgcaaggaaaaacttgccgccgtgcgcgaagcccgggccatcgccttccccaacgacttccgccgcgacgcctacttcgcggacctgcagaaacagtacgccgacaagaccaaggaagagctggaagccgcagcgatcccggtcaaggtggccggtcggatcatgctcaaccgcggttccttcatcgtcctccaggacagcagcgagcgcctgcaggtctacgtcaaccgcaagaccctgccggaagaaaccctggccgagatcaagacctgggacctgggcgacatcatcggcgccgaaggcgtgctggcccgctcgggcaagggcgacctgtacgtcgacatgaccagcgtgcgcctgctgaccaagtcgctgcgtccgctgccggacaagcaccatggcctgaccgacaccgagcagcgctaccgccagcgctacgtcgacctgatggtcaacgaggaaacccgccacaccttccgcgtgcgttcccaggtcatcgcccacatccgccgtttcctcagcgagcgcggtttcctcgaagtggagaccccgatgctgcagaccatccccggcggcgccgcggccaagccgttcgagacccatcacaacgcgctggacatggccatgttcctgcgcatcgccccggagctgtacctcaagcgcctggtggtcggcggtttcgagaaggtcttcgagatcaaccgcaacttccgtaacgaaggcgtctcgacccggcacaaccccgagttcaccatgctcgagttctaccaggcctacgccgactacgaagacaacatggacctgaccgaggaactgttccgcgaactggcccagtcggtactcggtaccaccgacgtgccctacggcgacaaggtcttccacttcggcgagccgttcgtgcgcctgtcggtgttcgattcgatcctcaagtacaacccggagatcaccgccgccgacctcaacgacgtcgagaaggcgcgggccatcgccaagaaggccggcgccaaggtcctcggccacgaaggcctgggcaagctgcaggtgatgattttcgaggaactggtggagcacaagctggagcagccgcacttcatcacccgctaccccttcgaggtttcgccgctggcccgccgcaacgacgaagacccgagcgtcaccgaccgcttcgagctgttcatcggcggccgcgagatcgccaatgcctattccgagctgaacgacgccgaggaccaggccgagcgcttcatgttgcaggtcaaggagaaggacgccggcgacgacgaggcgatgcactacgacgccgacttcatcaatgccctggaatacggcatgccgccgaccgccggcgaaggcatcggcatcgaccgcctggtgatgctgctgaccaactcgccgtcgatccgcgacgtgatcctgttcccgcacatgcgcccgcaggcctga

SEQ ID NO: 32671 - protein, 501 aa, Pseudomonas aeruginosa
MSDQQLDQHELQQEENKLIAQRKEKLAAVREARAIAFPNDFRRDAYFADLQKQYADKTKEELEAAAIPVKVAGRIMLNRGSFIVLQDSSERLQVYVNRKTLPEETLAEIKTWDLGDIIGAEGVLARSGKGDLYVDMTSVRLLTKSLRPLPDKHHGLTDTEQRYRQRYVDLMVNEETRHTFRVRSQVIAHIRRFLSERGFLEVETPMLQTIPGGAAAKPFETHHNALDMAMFLRIAPELYLKRLVVGGFEKVFEINRNFRNEGVSTRHNPEFTMLEFYQAYADYEDNMDLTEELFRELAQSVLGTTDVPYGDKVFHFGEPFVRLSVFDSILKYNPEITAADLNDVEKARAIAKKAGAKVLGHEGLGKLQVMIFEELVEHKLEQPHFITRYPFEVSPLARRNDEDPSVTDRFELFIGGREIANAYSELNDAEDQAERFMLQVKEKDAGDDEAMHYDADFINALEYGMPPTAGEGIGIDRLVMLLTNSPSIRDVILFPHMRPQA

SEQ ID NO: 32672 - DNA, 1503 bp, Pseudomonas syringae
  CDS (1)..(1503)
atgagcgaccaacaactcgacccgcaagccctgcaacaggaagaaaacaccctgatcgccctgcgcaaggaaaagcttgctgccggccgtgccaagggtcaggccttccccaacgacttccgccgcgacagctactgcaatgacctgcagaaacagtacgtcgacaagaccaaggaagaactggcagaggcagcgatcccggtcaaggttgccggtcgcatcatgcttaaccgtggttcgttcatggtcatccaggacatgaccgggcgcatccaggtctatgtcaatcgcaaaaccctgcctgaagaaaccctggccgaggtgaaaacctgggacctgggcgacatcatcgcggccgaaggtacgctggcacgctccggcaagggcgacctgtacgtcgaaatgaccagcgtgcgcctgctgaccaagtcgctgcgcccgctgcccgacaagcaccacggcctgaccgataccgagcagcgctaccgccagcgttacgttgacctgatcgtcaacgaagacgtgcgcgaaaccttccgtgtgcgctcgcaggtcatcgctcacatccgcagcttcctgatgcagcgtgacttccttgaagttgaaacgccgatgttgcagaccattcctggcggtgcggcagccaagccgtttgaaacccaccacaatgcactggacctggaaatgttcctgcgtattgcaccggagctgtacctcaagcgtctggtggtcggcggtttcgagaaagtcttcgagatcaaccgcaacttccgtaacgaaggtgtttcgacccggcataaccccgagttcaccatgctcgagttctaccaggcctacgctgactacgaagacaacatggacctcaccgaagaactgttccgcgagctggcgcagctggtgctgggcagcaccgacgtgccttacggcgacaaggtgttccacttcggcgaaccgttcgtgcgcctgtcggtgttcgattcgatcctcaagtacaaccctgagctgaccgctgccgatctgcaggatgtggacaaagcgcgcgccatcgccaagaaggcgggtgcgaaagtgctcggcttcgaaggattgggcaaactgcaggtgatgattttcgaagaactggtcgagcacaagctggaacagccccacttcatcacccagtacccgttcgaagtgtcgccgctggcccgtcgcaacgatgacaacccgaacgtcaccgaccgtttcgagctgttcatcggcggccgcgagatcgccaacgcctactccgagctcaatgacgctgaagatcaggccgaacgcttccaggcccaggtggccgacaaggacgccggtgacgacgaagccatgcactacgacgccgactttgttcgtgcgctggaatacggcatgccgcccacggcgggtgaggggatcggtatcgaccggttggtgatgctgctcaccgactcgccgtcgatccgggacgtgatcctgttcccgcacatgcgcccccaggcgtaa

SEQ ID NO: 32673 - protein, 500 aa, Pseudomonas syringae
MSDQQLDPQALQQEENTLIALRKEKLAAGRAKGQAFPNDFRRDSYCNDLQKQYVDKTKEELAEAAIPVKVAGRIMLNRGSFMVIQDMTGRIQVYVNRKTLPEETLAEVKTWDLGDIIAAEGTLARSGKGDLYVEMTSVRLLTKSLRPLPDKHHGLTDTEQRYRQRYVDLIVNEDVRETFRVRSQVIAHIRSFLMQRDFLEVETPMLQTIPGGAAAKPFETHHNALDLEMFLRIAPELYLKRLVVGGFEKVFEINRNFRNEGVSTRHNPEFTMLEFYQAYADYEDNMDLTEELFRELAQLVLGSTDVPYGDKVFHFGEPFVRLSVFDSILKYNPELTAADLQDVDKARAIAKKAGAKVLGFEGLGKLQVMIFEELVEHKLEQPHFITQYPFEVSPLARRNDDNPNVTDRFELFIGGREIANAYSELNDAEDQAERFQAQVADKDAGDDEAMHYDADFVRALEYGMPPTAGEGIGIDRLVMLLTDSPSIRDVILFPHMRPQA

SEQ ID NO: 32674 - DNA, 1533 bp, Ralstonia solanacearum
  CDS (1)..(1533)
atgaccgaaccgaacaccccggccgcacccactggacaggcgcaagacgacaaccagatcatggccgagcgccgcgagaagctcgccgcgctgcgccagcagggcgtcgcctatcccaacgatttctgcccgacccaccacgcggccgacctgcacacccgctacagcgagaccgaccagcccgcgctggaagcggccaatgtcgaggtcgccctcgccgggcgcatgatgctcaagcgcgtgatgggcaaggccagcttcgccaccgtgcaggacggcagcggccagatccagttctacatcacgcgcgaccgcgtgggcgaagacgtctacgccgccttcaagcattgggacctcggcgacatcgtcgccgcgcgcggcgtgctgttccgcaccaacaagggcgagctgtcggtgcaggtgcaggagctgcgcctgctgtcgaagtcgctgcgtccgctgccggacaagttccacggcctggccgaccaggaaatgaagtaccgccagcgctacgttgacctgatcgtctcgcccgagacgcgcaacaccttccgcgcccgcaccaaggccatcgcctcgctgcgccaccacatgagcgatgccggcttcatggaagtggaaacgccgatgctgcacccgattccgggcggcgcggcggccaagcccttcatcacgcaccacaacgcgctggacatgcagatgttcctgcgcatcgccccggagctgtacctcaagcgcctgatcgtcggcggcttcgagcgcgtgtacgagatcaaccgcaacttccgcaacgagggcgtgtcgccacggcacaaccccgagttcacgatgatggagttctatgcagcctacacggactaccgctggctgatggactacaccgagaacctgatccgccaggccgccatcgatgccaccggcagcgccgccctcaactaccagggtcgcgagctggacctgtccaagcccttccaccgcctgaccatctgccaggccatccagaagtacgcgccgcagtacaccgacgcgcaactggccgacgccaacttcctgcgtgccgagctcaagaagttcaagatcgacaccaacgcgccgcagttcctgaacgccggcgtgggcacgctgcagctcgtcctgttcgaagagacggccgagtcgcaactgtgggagccgaccttcatcgtcgactacccggtcgaggtgtcgccgctggcacgcggctcggacacgctgcccggcatcaccgagcgcttcgagctgttcatcaccggccgcgagatcgccaacggcttctccgagctgaacgaccccgaagaccaggccgaacgcttccgcaagcaggtcgaacagaaggacgccggcgacgaggaagccatgttctacgatgccgactacatccgcgcgctggaatacggcatgcccccgaccggcggctgcggcatcggcatcgaccgcctggtgatgctgctgaccgacagccccaacatccgcgacgtgatcctcttcccgcacctgcgccgcgaagactga

SEQ ID NO: 32675 - protein, 510 aa, Ralstonia solanacearum
MTEPNTPAAPTGQAQDDNQIMAERREKLAALRQQGVAYPNDFCPTHHAADLHTRYSETDQPALEAANVEVALAGRMMLKRVMGKASFATVQDGSGQIQFYITRDRVGEDVYAAFKHWDLGDIVAARGVLFRTNKGELSVQVQELRLLSKSLRPLPDKFHGLADQEMKYRQRYVDLIVSPETRNTFRARTKAIASLRHHMSDAGFMEVETPMLHPIPGGAAAKPFITHHNALDMQMFLRIAPELYLKRLIVGGFERVYEINRNFRNEGVSPRHNPEFTMMEFYAAYTDYRWLMDYTENLIRQAAIDATGSAALNYQGRELDLSKPFHRLTICQAIQKYAPQYTDAQLADANFLRAELKKFKIDTNAPQFLNAGVGTLQLVLFEETAESQLWEPTFIVDYPVEVSPLARGSDTLPGITERFELFITGREIANGFSELNDPEDQAERFRKQVEQKDAGDEEAMFYDADYIRALEYGMPPTGGCGIGIDRLVMLLTDSPNIRDVILFPHLRRED

SEQ ID NO: 32676 - DNA, 1497 bp, Rhizobium meliloti
  CDS (1)..(1497)
atgaccgacaagacacaggcagccggcctctcctccgacgcgacggaagtgcgctcccagaagctcgacctgctgcgccagcagatcggcgacgtctatcccgcgcatttccaccgtacgctcaccaatgcggaactcgcggagaaatatgccgggctggagcccgataccgaaagcggcgaaacggtaaccgttgccggccgcgttttctcctcgcgcaattccggcatgttcatggatcttcatgacgcctccggcaagatccagatcttttcgcacaaggatacggcaccggaagaggcgcgcgcgcttctgccgatgatcgatctcggcgacatcatcggggtcaccggagaggtgcgccgcaccaagcgcggcgaactgaccgtcaacgccaaagagatcaccatgctctgcaagtcgctcctgccgatgccggagaagtatcacgggcttgccgatatcgagacgcgctaccgcaagcgctacctcgacatcatggtcaacgaggaatcgaagctgcgcttccagcagcgaagccgcatcgtgtcgagcctgcgccgattcctcgaggacgaaggcttcatggaagtggagacgccgatgctgcagccgatctacggcggcgcgacggccgagcccttcaagacgcatcacaacacgctgaagctcgacatgtatctgcgcatcgcgcccgagctttacctgaagcgcattctcgtttccggcctgacggacaaggtcttcgagatcaaccgcaacttccgcaacgaaggcgtctcgacccggcacaatcctgaattcaccatgatggagtgctactgggcctatgctgactacgaggacgtgatgggtctcgtggagcgcatgttcgagaccctggcgcttgcggttcacggcaagacggaattcgagttcggcgacaagcagctctccttcaaggggccgttcccgcgcgtctctatgccggcggccgtcaaggacgcgaccggaatcgatttccttgccctcaagagcgacgaggaggcccggcaggcggctcgcgacgccggtgtcgagatcgagaaggacgcgacctggggcgaagtgctcgccttcctcttcgaggagaaggtcgaagcgaccttgatccagcctgctcatgtcatccacttcccgaaggacatctcgcccttcgccaaggaggtgccgggcgagccgcggctcgtcgagcgcttcgagacctattgcaacggctgggagatcggcaacgccttttccgagctcaacgacccggtcgagcagcgcgcccgcatggtcgagcagatggaacaggcgcatgcccgcggcgagaaggaaaagacgctggacgaggacttcctcgatgccatggaccagggcatgccgcccgccggggggttggggatcggtgtcgaccggctgatcatgctgctcaccaactcgccgtcgatccgcgacatcatcctcttcccggcccgccgccagaaggccgattga

SEQ ID NO: 32677 - protein, 498 aa, Rhizobium meliloti
MTDKTQAAGLSSDATEVRSQKLDLLRQQIGDVYPAHFHRTLTNAELAEKYAGLEPDTESGETVTVAGRVFSSRNSGMFMDLHDASGKIQIFSHKDTAPEEARALLPMIDLGDIIGVTGEVRRTKRGELTVNAKEITMLCKSLLPMPEKYHGLADIETRYRKRYLDIMVNEESKLRFQQRSRIVSSLRRFLEDEGFMEVETPMLQPIYGGATAEPFKTHHNTLKLDMYLRIAPELYLKRILVSGLTDKVFEINRNFRNEGVSTRHNPEFTMMECYWAYADYEDVMGLVERMFETLALAVHGKTEFEFGDKQLSFKGPFPRVSMPAAVKDATGIDFLALKSDEEARQAARDAGVEIEKDATWGEVLAFLFEEKVEATLIQPAHVIHFPKDISPFAKEVPGEPRLVERFETYCNGWEIGNAFSELNDPVEQRARMVEQMEQAHARGEKEKTLDEDFLDAMDQGMPPAGGLGIGVDRLIMLLTNSPSIRDIILFPARRQKAD

SEQ ID NO: 32678 - DNA, 1503 bp, Shewanella oneidensis
  CDS (1)..(1503)
atgactgaacaagtacaagatgaaaacaaactgattgccgagcgtcgtgccaagctagacagcattcgcccgaactgcagcgcgaatgctcaccctaatacgttccgtcgcacccataaagcggcagagttgcaggaaaaatacggtcaaaatactaaggaagaactcgaagccttaggttttagaaccagcatcgctggccgtatcatggcaaaacgtggcccattcctagtgatccaagacgtgtctggtcgtatccaagcttacgctgaaaagggcgttcaagcggatctgaaagatcgttaccaaggtttggatatcggtgacatcatcggcgtgactggtcagttgcacttgtctggtaaaggcgatctgtacgtcaacatggaagagtaccaactgctgactaaagcactacgtcctctgccagaaaaattccacggcttaacagatcaagaaacccgttaccgccaacgttatgttgacttaatcgttaacgaagaatctcgtcaagccttcgtaatgcgttcaaaagtggttgcagctatccgtaacttcatgatcaaaaaagagttcatggaagttgaaaccccaatgatgcacgtgatcccaggcggcgcttctgcccgtccatttatcacgcaccacaatgcgctggacatgcctatgtacctgcgtatcgcgccagagttatacctcaagcgtttagtggtgggtggttttgagcgtgtgttcgaaatcaatcgtaacttccgtaacgaaggtctgtcaccacgtcataacccagaattcactatgatggaattctatatggcctatgctgactaccaagatctgatggacttaaccgaagaattgttaagctcaattgcaatcgaactcttaggtagcgcgcaaatgccatatggcgagcatactgttgatttcggtggtccttatgcccgtttaagcatgctagaagcgattcagaagtacaatcctgataacgcgactatccaggccatgacctacgagcaagtgaaagatcttgaatttatgcgtgaactggctatcagccttggcatcaagattgagaagttctggacctgtggtcagctattagaagaaatcttcggtgaaaccgctgaatggcagttaatgcaaccgactttcatcactggctacccagcggacatttcgccactggcacgtcgtaacgatgacaaccactttattaccgaccgttttgaattcttcatcggtggccgtgaagtagctaacggcttcagcgagttaaatgatgcgcaggatcaagacagccgctttaaagcgcaggttgatgccaaagacgcgggtgacgatgaagccatgttctacgatgcggactacatcactgcactggaacacggtttaccaccaacagcaggtcaaggtatcggtatcgaccgtttagtgatgctattcactaacactcacactatccgtgatgtgatcctattcccagcgatgcgcccacaggcttaa

SEQ ID NO: 32679 - protein, 500 aa, Shewanella oneidensis
MTEQVQDENKLIAERRAKLDSIRPNCSANAHPNTFRRTHKAAELQEKYGQNTKEELEALGFRTSIAGRIMAKRGPFLVIQDVSGRIQAYAEKGVQADLKDRYQGLDIGDIIGVTGQLHLSGKGDLYVNMEEYQLLTKALRPLPEKFHGLTDQETRYRQRYVDLIVNEESRQAFVMRSKVVAAIRNFMIKKEFMEVETPMMHVIPGGASARPFITHHNALDMPMYLRIAPELYLKRLVVGGFERVFEINRNFRNEGLSPRHNPEFTMMEFYMAYADYQDLMDLTEELLSSIAIELLGSAQMPYGEHTVDFGGPYARLSMLEAIQKYNPDNATIQAMTYEQVKDLEFMRELAISLGIKIEKFWTCGQLLEEIFGETAEWQLMQPTFITGYPADISPLARRNDDNHFITDRFEFFIGGREVANGFSELNDAQDQDSRFKAQVDAKDAGDDEAMFYDADYITALEHGLPPTAGQGIGIDRLVMLFTNTHTIRDVILFPAMRPQA

SEQ ID NO: 32680 - DNA, 1488 bp, Staphylococcus aureus
  CDS (1)..(1488)
atgtcagaagaaatgaatgaccaaatgttggttcgacgtcaaaaattacaagaattatatgatcttggtatagacccgtttggttctaaatttgaccgttcaggtttatctagtgatttgaaagaagagtgggaccagtattctaaagaagaattggtagaaaaagaagcggatagtcatgtcgctatagctggacgattaatgactaagcgtggtaaaggtaaagcaggatttgcacacgttcaggacttagctggacaaattcaaatttacgttcgtaaagatcaagttggcgatgacgaatttgatttatggaaaaatgctgatttaggcgatatcgttggtgttgaaggtgtaatgttcaaaacaaatactggcgaattatcggttaaagcgaagaaattcacgctactaactaaatcattgcgaccattaccggataaattccacggtttacaggatattgaacagagatatcgtcaaagatatttagatttaattacgaacgaagatagcactcgtacatttattaatcgtagtaaaatcattcaagaaatgcgtaattatttaaataataaaggtttcttggaagtagaaacacctatgatgcaccaaattgctggtggcgcagctgctagaccatttgtaacacatcataatgcattagatgcaacgttatacatgcgtattgctattgagttgcatttaaaacgtttaattgtcggtggacttgaaaaagtatatgaaattggtagagtattccgtaatgaaggtgtatcaactagacataaccctgaattcacaatgattgaattatatgaagcatatgcagattatcatgacattatggatttaacagaatctatggtgagacatattgccaatgaagtattaggttctgcaaaagtacaatacaatggggaaacgattgatttagaatctgcttggactcgtttgcatattgttgatgctgtaaaagaagctactggtgtggatttttatgaagttaaaagtgatgaagaagctaaagctttagctaaagaacatggtattgaaattaaagatacaatgaaatatggtcatattttaaatgaattctttgagcaaaaagttgaagaaacacttattcagccaacgtttatctatggtcatccgactgaaatttcacctttagcgaagaaaaatcctgaagatcctagatttactgatcgtttcgaattgttcattgtaggtagagagcatgcaaatgcatttactgaattaaatgatcctattgatcaaaaaggtcgttttgaagcgcaacttgttgaaaaggcgcaaggtaatgatgaagcgcatgaaatggatgaagattacattgaagcgttagaatatggtatgcctccgacaggtggtcttggtatcggtattgacagattggttatgttattaactgattctccatcaatcagagacgtgttattattcccttatatgagacaaaaataa

SEQ ID NO: 32681 - protein, 495 aa, Staphylococcus aureus
MSEEMNDQMLVRRQKLQELYDLGIDPFGSKFDRSGLSSDLKEEWDQYSKEELVEKEADSHVAIAGRLMTKRGKGKAGFAHVQDLAGQIQIYVRKDQVGDDEFDLWKNADLGDIVGVEGVMFKTNTGELSVKAKKFTLLTKSLRPLPDKFHGLQDIEQRYRQRYLDLITNEDSTRTFINRSKIIQEMRNYLNNKGFLEVETPMMHQIAGGAAARPFVTHHNALDATLYMRIAIELHLKRLIVGGLEKVYEIGRVFRNEGVSTRHNPEFTMIELYEAYADYHDIMDLTESMVRHIANEVLGSAKVQYNGETIDLESAWTRLHIVDAVKEATGVDFYEVKSDEEAKALAKEHGIEIKDTMKYGHILNEFFEQKVEETLIQPTFIYGHPTEISPLAKKNPEDPRFTDRFELFIVGREHANAFTELNDPIDQKGRFEAQLVEKAQGNDEAHEMDEDYIEALEYGMPPTGGLGIGIDRLVMLLTDSPSIRDVLLFPYMRQK

SEQ ID NO: 32682 - DNA, 1485 bp, Sulfolobus solfataricus
  CDS (1)..(1485)
ttgttgatgaattgggacgaaagaagagtaaaaatcgttgaagaattaagaaaaaatggcattgagccatatcctcataaatacgaagtaactcatctgattaaagatattaagctaattgccaaatcacaaggtaataaatcccatgagccgttcatgtttaacatatctacagcaggacgcgtcgctaatataagaaggcatggaaaggcatcctttgtagatatatttgatgaaggtgagaaattgcaattatatatgagagttgacgaacttaaagaaaaatatgataaattctttatatatgttggaagaggggatataataggtgtaaaaggtgatttgttttatacgatgaaaggtgagttaagcctccttgtaaaggattaccaactactatcgaaagcccttatagaacctccagattggtcaaagctttccccagaatttagatatgcgcatagatatgtggatttcctctataacgataatgcgaggaaggctatggaaataaggtatacaattataagagaaattagggagtttctttattccaaaggctttattgaagttgaaacgccaatagttcaaccagtatatggtggggcattagcgaaaccttttaaaacacatgtaaattacttaaatgaagattggtacttaagaatagcattagaattatacctaaaaaggtatataataggtggatttaacaaagttttcgagataggtaaggtatttagaaatgaagatatcgatgtaactcataatcctgagtttactctcttagagctctattgggcatacgccgattacaacgatataatgaatttaactgaagatctacttaagagtgtagtcaagaaggttacaaatagtacaaaaatagtatatggaaagtacgaaatagactttgaaggtccgttcaagagaattagtatgtatgattctttatctgaaattttaggtaaggatgttgaaagtatgagtgacaatgagcttaaggagttaatgaaaaaatacaatctaactccaagaggaaaccagtatgttagagggttgatgatagagaaattgttcgataaactagtcacacccaccttaactaacccaaccttcattactgattacccaatagagactacaccactttgtaaaccacataggaataaaccgggactagtcgaaagatttgagatgttcatagctggtatggaggttgcaaacgcatacacggagttgaacgaccctatattgcaagataaattatttagagaagaacaagagatgttcagaagaggagacgaggaggctcatccttacgataaggattttgtaagagccttaagttatggaatgccacccactggaggtttaggtattggtatagacagaatagttatgttagtaacaaataattacagtatcaaagaagttattcctttccccatgataagtagtaaggttatcctagaggacgattag

SEQ ID NO: 32683 - protein, 494 aa, Sulfolobus solfataricus
MLMNWDERRVKIVEELRKNGIEPYPHKYEVTHLIKDIKLIAKSQGNKSHEPFMFNISTAGRVANIRRHGKASFVDIFDEGEKLQLYMRVDELKEKYDKFFIYVGRGDIIGVKGDLFYTMKGELSLLVKDYQLLSKALIEPPDWSKLSPEFRYAHRYVDFLYNDNARKAMEIRYTIIREIREFLYSKGFIEVETPIVQPVYGGALAKPFKTHVNYLNEDWYLRIALELYLKRYIIGGFNKVFEIGKVFRNEDIDVTHNPEFTLLELYWAYADYNDIMNLTEDLLKSVVKKVTNSTKIVYGKYEIDFEGPFKRISMYDSLSEILGKDVESMSDNELKELMKKYNLTPRGNQYVRGLMIEKLFDKLVTPTLTNPTFITDYPIETTPLCKPHRNKPGLVERFEMFIAGMEVANAYTELNDPILQDKLFREEQEMFRRGDEEAHPYDKDFVRALSYGMPPTGGLGIGIDRIVMLVTNNYSIKEVIPFPMISSKVILEDD

SEQ ID NO: 32684 - DNA, 1521 bp, Synechococcus elongatus
  CDS (1)..(1521)
atggctgacgtgggggcaacgggagccgaaattcgggccacacggattgagaaagcaaaaacattgcaagcacagggaatgagcccctatgcctatcgttgggagcgcacccatactgcagcattgctgcaagacaaatatgcccacttggccgctggcgaagcggtgggcgatcgcgtgagtgtggccggtcgcattatggcgcggcgcatctttggcaagctggccttttttacgcttcaggatgacagcggcacgattcagctttacctcgataagcaaaccattagccaaaccatgggggaagccgcctttgctgatttgaaacaccttactgatgtcggcgatatccttggtgcggtgggcaccctcaagcgcactgagaagggcgaactgtcggttgtggtggaatcctacaccatgctgacaaaatcattgttgcccctaccggacaaatggcacggcctcacagatgtggaaaagcgctatcgtcagcgctatgtggatctcatcgtcaacccccaagtgcgtgacacattccgcaagcgagcactgatcaccgccgccattcgccgctacctcaatgagcagggctttattgaaattgaaacacctgttctccaggtggaagctgggggtgccgaggcacgtccttttattacctaccacaacaccttggagatgcagctttatttgcgcattgccaccgaactccacctgaagcgcctcattgtcggtgggtttgagaaggtgtatgaactggggcgcatctttcgcaatgagggcatctcaaccaagcacaaccctgaatttacgtccattgaggtctatcaggcctacgccgactataacgatatgatgacgctgacggaggcgattattaccacaggggcgatggaggtgttgggcaccctcaaaatcacctatcaaggggaaacaattgatctgacacccccatggcgacgggtgacaatgcacgatgcggtgttggcagctactggaattgactttcgccaattgggggatctgaccgcggctaaaatagccgctcaaaaggtaggagtaaaagacttagacacctgtgacacgattggccgagtgctcaatgaagtgtttgagcaaatcgttgaacctacattgattcagcccacctttgttctcgactaccctgtggagatttctcccttggccaagccccaccgcagtcaaccgggactggtggagcgatttgaattatttatcgtcggccgcgagcatgccaatagtttttcggagttaacggatcctttggatcaacggcagcgcttggaggaacaagcgcggcgcaaagcggctggggatttggcagcccatagtgttgatgaagattttctcaccgccttagaacatggaatgccacccacaggaggtctaggaattggcattgaccgcttggtcatgctgctaacggactcgccaagtattcgtgatgtgattgctttcccgctgttacgtcctgaatcggcgggtggtcaggtttga

SEQ ID NO: 32685 - protein, 506 aa, Synechococcus elongatus
MADVGATGAEIRATRIEKAKTLQAQGMSPYAYRWERTHTAALLQDKYAHLAAGEAVGDRVSVAGRIMARRIFGKLAFFTLQDDSGTIQLYLDKQTISQTMGEAAFADLKHLTDVGDILGAVGTLKRTEKGELSVVVESYTMLTKSLLPLPDKWHGLTDVEKRYRQRYVDLIVNPQVRDTFRKRALITAAIRRYLNEQGFIEIETPVLQVEAGGAEARPFITYHNTLEMQLYLRIATELHLKRLIVGGFEKVYELGRIFRNEGISTKHNPEFTSIEVYQAYADYNDMMTLTEAIITTGAMEVLGTLKITYQGETIDLTPPWRRVTMHDAVLAATGIDFRQLGDLTAAKIAAQKVGVKDLDTCDTIGRVLNEVFEQIVEPTLIQPTFVLDYPVEISPLAKPHRSQPGLVERFELFIVGREHANSFSELTDPLDQRQRLEEQARRKAAGDLAAHSVDEDFLTALEHGMPPTGGLGIGIDRLVMLLTDSPSIRDVIAFPLLRPESAGGQV

SEQ ID NO: 32686 - DNA, 1509 bp, Synechococcus sp
  CDS (1)..(1509)
gtgtctgagctgcgcgacacccgtttggagaagtgccaggcactgtctgatctgggccagggtccctacgccctcaactttgagccgacccatcgcatggcggccttgcatgaggcccatgccgacctccccaatggcgaggaacgtgaggtgacggtgtccgtcgccgggcgggtgatgacccggcgggtgatgggcaagctcgcctttttcaccctggcggatgagaccggcaccattcagctgtttctggagaaagcgggcctggaggcgcagcaggagggctggttcaagcagatcaccggtctggtcgatggcggcgactggcttggggtgagcggcacgctgcgccgcaccgatcgcggtgagttgtcggtgaaggtgagcgattggcgcatgctcaccaaggcgctgcaaccgctgccggataagtggcacggcctggccgatgtggagaagcgctaccgccagcgctatctcgacctcatcgtgtcgccggacagccgggagactttccgccgccgggcacggttggtgagcggcatccgccgctggctggatcaacgtgattttctcgaaattgagactccggtgctgcagagcgaaccgggcggtgccgatgctcggcccttcgagacccaccacaacgctcttgatcttcccctcaccctgcgcatcgccaccgaactgcatctcaaacgcctggtggtgggtggcttcgagcgggtgtacgagctgggccggatctttcgcaatgaaggggtcagcacccgccacaacccggaattcacctcggtggagatctatcaggcctactccgattacatcggaatgatggagctcactgagcagatggtcagcgccgtttgccaggaggtgtgcggcagttgccagatcacgtaccaggacaccgagattgatctcagccccccctggcgacgggccaccatgcatgagctagtggaggaagccaccggtcttgatttcaatagcttcagcagtcgggaggcggcggctgtagcgatgaccggcaagggcctgcatgcacctgaactggccgattccgtggggcgtctgctgaatgaagcgttcgagcaggcggtggagacaacgctgattcaacccacctttgtgaccgattacccggtggagatttcaccgttggcccggcctcaccgcagcaaacccggcctggtggaacgttttgagctgttcatcgttggccgcgagcatgccaatgccttcagtgagctcaccgatccggtggatcagcggcagcgcctggaggcccagcaggcccgtaaggctgccggggatctcgaagcgcaggggttggatgaagacttcgtcacggccctcgaggtgggcatgcctcccaccggtgggttgggtattggtatcgatcgtttggtgatgctgctcacggatagcccatcgatccgtgatgtcattgccttcccgcttctgcggccggagcccagggcggcggatgcccccgcaatgggataa

SEQ ID NO: 32687 - protein, 502 aa, Synechococcus sp
MSELRDTRLEKCQALSDLGQGPYALNFEPTHRMAALHEAHADLPNGEEREVTVSVAGRVMTRRVMGKLAFFTLADETGTIQLFLEKAGLEAQQEGWFKQITGLVDGGDWLGVSGTLRRTDRGELSVKVSDWRMLTKALQPLPDKWHGLADVEKRYRQRYLDLIVSPDSRETFRRRARLVSGIRRWLDQRDFLEIETPVLQSEPGGADARPFETHHNALDLPLTLRIATELHLKRLVVGGFERVYELGRIFRNEGVSTRHNPEFTSVEIYQAYSDYIGMMELTEQMVSAVCQEVCGSCQITYQDTEIDLSPPWRRATMHELVEEATGLDFNSFSSREAAAVAMTGKGLHAPELADSVGRLLNEAFEQAVETTLIQPTFVTDYPVEISPLARPHRSKPGLVERFELFIVGREHANAFSELTDPVDQRQRLEAQQARKAAGDLEAQGLDEDFVTALEVGMPPTGGLGIGIDRLVMLLTDSPSIRDVIAFPLLRPEPRAADAPAMG

SEQ ID NO: 32688 - DNA, 1509 bp, Thermotoga maritima
  CDS (1)..(1509)
gtgctgaaagagttcaaagaacaacgactcaaagagatacaggaacttcgttctatgggtatagagccatatccttacaaattcgaaaaggaactcacggccagagaaataagggaaaagtacgactatcttcaagctggagaagttcttgaatctgaaaagctctctttcgcagggagagtcatgtcgatacgtcaccacggaaagacggccttctttcacatgaaagatgacacgggccggatccaggcttacataaaagcagattctgttgggaaggaaaagatggatctcttcaaaagacacgtcaaaataggtgactttgtaggagtaagaggctttccgttcaaaagcaaaaccggagagttgaccatttacgttcaagaatacacgcttctgagcaaggctctgcggcctctgcccgagaagtggcacggcataaaagataaggaaatcatatacaggcagaggtacctcgaactcatcgtgaacgacgaggctattgagaggttcaaaaagcgattcaaggccgtccgtgtgatacgggaatttctcaacagcaggggattcatcgaagtggaaacacctattcttcattacgtcacgggtggtgcggaagcgaggccttttgtgacccatctcaacgtttttgatatcgatatgtatttgagaatcgcaccggagctttacctgaaaaggttgatcgtcggcggttttgaaaagatatacgagataggaaagaacttcagaaacgaaggaatatcttacaaacacagtcccgagttcaccagcatagagatctaccaggcttacgcggattacaacgatatgatggatctcactgaagagttgatagtggaagttgtgaaaagaacatgtggcaccttgaaaatctcctaccaaggcaaggagatagacttcacaccaccctggaaaagagtgagaatgagagactttctcaaagaaaaactcggggtggacatcctcgaagatcccgatgaagtgttgttgaagaagctcgaagaacatggggtagaactggaaataaagaacagagcacacctcatagacaaactcagagatctggtggaagaagagctggtgaaccccaccttcataatcgatcatcctgtggtgatttcccctcttgccaaaagacaccgagaggatcctagactcacggaaaggttcgaactcatcatattcggaagagagatcgcgaacgcgttcagtgagctgaacgatcccgttgatcaataccagagatttctcgaacaggcgaaaatgagagaagagggagatgaagaagcacacatgatggatctcgattttgtgagggccctcgagtatggtatgcctcccacgggaggactgggaatcggtcttgacaggctcttcatgttcatcacggattcccccacaataagggatgtgattcccttcccaattgtgaaacccaaaaagttcgaggaagaagaggcggaattcgaaggagggtttgaagaatga

SEQ ID NO: 32689 - protein, 502 aa, Thermotoga maritima
MLKEFKEQRLKEIQELRSMGIEPYPYKFEKELTAREIREKYDYLQAGEVLESEKLSFAGRVMSIRHHGKTAFFHMKDDTGRIQAYIKADSVGKEKMDLFKRHVKIGDFVGVRGFPFKSKTGELTIYVQEYTLLSKALRPLPEKWHGIKDKEIIYRQRYLELIVNDEAIERFKKRFKAVRVIREFLNSRGFIEVETPILHYVTGGAEARPFVTHLNVFDIDMYLRIAPELYLKRLIVGGFEKIYEIGKNFRNEGISYKHSPEFTSIEIYQAYADYNDMMDLTEELIVEVVKRTCGTLKISYQGKEIDFTPPWKRVRMRDFLKEKLGVDILEDPDEVLLKKLEEHGVELEIKNRAHLIDKLRDLVEEELVNPTFIIDHPVVISPLAKRHREDPRLTERFELIIFGREIANAFSELNDPVDQYQRFLEQAKMREEGDEEAHMMDLDFVRALEYGMPPTGGLGIGLDRLFMFITDSPTIRDVIPFPIVKPKKFEEEEAEFEGGFEE

SEQ ID NO: 32690 - DNA, 1479 bp, Thermus thermophilus
  CDS (1)..(1479)
atgaacgaccagacccgccagcgcctgctcaacctggaagccttggtggaggcggggtttgccccctacccttaccgcttccccaagacccacagcgccgaggccatcctcaaggccaagcggggcgccccccctgagtccgagtggccggaggaggaggtggccgtggccgggcgcctcgtggccttgaggcgcatgggcaaggtgaccttcgcccacctcctggacgagacggggaggatccagctctacttccagagggacctcacgcccaaatatgagctcctcaagaagctggacgtgggggacatcctgggggtgagggggcaccccttcaccaccaagacgggggaggtgacggtcaaggtcctggactggacgcccctggtcaagagcctccaccccctccccgacaagtggcacggcctccgggacaaggaggtccgctaccgccagcgctatctggacctcatcgtcaaccccgaggtgcgggaggtcttccgccgccgctcggagatcgtccgctacatccggcgcttttttgaggccaaggggtttttggaggtggagacccccatcctccagcccaccacgggcggggcggaggccaggcccttcaagacctaccacaacgccctagaccacgagttctacctccgcatctccttggagctctacctcaagcgcctcctcgtcggggggtacgagaaggtctttgagatcgggcgcaacttccgcaacgagggcattgaccacaaccacaatcccgagttcaccatgctggaggcctactgggcctacgccgactaccaggacatggcgggcctggtggaggagctcctttcgggcctcgtcctccaccttttcgggagccacgaggtcccctaccaggggcgggtgctgaacttcaagccgcccttcaggcgcatctccttcgtggaggccctgaaggagaaggcgggccttccctttgaccccctggacctggagcgcctcaggctctgggccgacgcccaccaccccgagctttcccaggtgccgaactataagcttctggacaagcttttcggcatctacgtggagcccgagctccaggatcccacctttgtctttgacttccccctggccatcagccccctggccaagcggcaccgggagaagccgggcctcgtggagcgctgggacctctacgccggggggatggagcttgccccctgttactccgagctcaacgaccctttggaccagagggagcgcttcctggagcaggcgaggcgccgcaaggagggggacgaggaggcccccgagcccgacgaggacttcctcctggccctggagtacgggatgcccccggcggcgggcctgggcctcgggatagaccgcctcgccatgctcctcaccgaccagccctctctaagggacgtcctcctcttccccctcctcaagcccaagaaggaggcggtggaagaaggggtctaa

SEQ ID NO: 32691 - protein, 492 aa, Thermus thermophilus
MNDQTRQRLLNLEALVEAGFAPYPYRFPKTHSAEAILKAKRGAPPESEWPEEEVAVAGRLVALRRMGKVTFAHLLDETGRIQLYFQRDLTPKYELLKKLDVGDILGVRGHPFTTKTGEVTVKVLDWTPLVKSLHPLPDKWHGLRDKEVRYRQRYLDLIVNPEVREVFRRRSEIVRYIRRFFEAKGFLEVETPILQPTTGGAEARPFKTYHNALDHEFYLRISLELYLKRLLVGGYEKVFEIGRNFRNEGIDHNHNPEFTMLEAYWAYADYQDMAGLVEELLSGLVLHLFGSHEVPYQGRVLNFKPPFRRISFVEALKEKAGLPFDPLDLERLRLWADAHHPELSQVPNYKLLDKLFGIYVEPELQDPTFVFDFPLAISPLAKRHREKPGLVERWDLYAGGMELAPCYSELNDPLDQRERFLEQARRRKEGDEEAPEPDEDFLLALEYGMPPAAGLGLGIDRLAMLLTDQPSLRDVLLFPLLKPKKEAVEEGV

SEQ ID NO: 32692 - DNA, 1500 bp, Thermoanaerobacter tengcongensis
  CDS (1)..(1500)
atgagtaattctaatgagaacattttgaatgaccttgagaatttgaatgaacttttaagggtgagaagagagaaactcaatatcttaaggagcatggggatagagccctatggcatagataggtttgaaagaactaatctttcctcagacattaaaaacgattacgaaaattttgaagggaaaactgtaactctagcaggaaggataatgaccaagaggagccacggaaaagcttcttttgcagatatacaggacagggacggaagaattcaaatttatgtgagatatgataatgtcggaggaaaaaactacgaaatctttaagctccttgacataggtgatattataggggttacaggagaagtctttaagacaaagaccggagaaattactataaacgtgaaagactttaagcttttatgcaagtcactgcaagttctccctgaaaagtggcatggtttaaaagacccggatttaaggtataggcaaagatacgtagacctaataataaatccaagcgtaagggaagtattcttaaaaaggaccaagataataaaagcaataagagaatttttagacaatagaggatttctggaagttgaaactccagttttgcacacaatcgcaggtggagcagcggcaaggccctttatcacccatcacaacgctttagacatagacatgtatttacgaattgcgctggagcttcacttgaagaggttaattgtcgggggatttgaaaaggtctatgaaataggcagagtctttagaaatgagggaatggatataaggcacaatccggagtttacactcctggaactttatgaagcttatacggattatcacggtatgatggaacttactgaacagctttttgcgtatgtggctgaaaaagtaaatggcagcacaaaaataatctatcagggcactgaaatagatttgacgccgccgtggaagagaatcaccatggtggatgctataaaagaatatgtggggattgactttgaaaaagttgctacagatgaagaagcgagaaaaatagcaaaggatttaaatctggagttgaaaaagcctgatatgaaaaaaggagaagtaatagcacttgtttttgacgaactggtagaaaagcaccttatacagcctacttttgtcatggactatccagtggaggtttctcctttggctaaaagaaagcgcgacaaccctgcttttacttccaggtttgaagctttcatttacggcagagaagttgcaaacgcattttcagagctaaatgacccgattgaccagaaagagagatttttggaacagttaaggcagagagaagcgggagatgaagaagctcacatgatggatgaggactttataaatgcccttgaggtaggtatgccacctacaggaggtttgggtataggtgtagacaggcttgtcatgtttatgacagattcttattctataagggatgtaatactcttccctacaatgaaacccaaagattaa

SEQ ID NO: 32693 - protein, 499 aa, Thermoanaerobacter tengcongensis
MSNSNENILNDLENLNELLRVRREKLNILRSMGIEPYGIDRFERTNLSSDIKNDYENFEGKTVTLAGRIMTKRSHGKASFADIQDRDGRIQIYVRYDNVGGKNYEIFKLLDIGDIIGVTGEVFKTKTGEITINVKDFKLLCKSLQVLPEKWHGLKDPDLRYRQRYVDLIINPSVREVFLKRTKIIKAIREFLDNRGFLEVETPVLHTIAGGAAARPFITHHNALDIDMYLRIALELHLKRLIVGGFEKVYEIGRVFRNEGMDIRHNPEFTLLELYEAYTDYHGMMELTEQLFAYVAEKVNGSTKIIYQGTEIDLTPPWKRITMVDAIKEYVGIDFEKVATDEEARKIAKDLNLELKKPDMKKGEVIALVFDELVEKHLIQPTFVMDYPVEVSPLAKRKRDNPAFTSRFEAFIYGREVANAFSELNDPIDQKERFLEQLRQREAGDEEAHMMDEDFINALEVGMPPTGGLGIGVDRLVMFMTDSYSIRDVILFPTMKPKD

SEQ ID NO: 32694 - DNA, 1482 bp, Ureaplasma parvum
  CDS (1)..(1482)
atggaaagaaaatttagtgatcaagaattaatccgtcgtacacacttacaagaattaaaaaaccaaaataaaaatccttttttaataacaaaagttgatagaagtatgtttttaaaagactttgctgaaaaatataaaaattttagcaaagaagaattacataatatggatttagagaaattgacacttgctggtcgtttaatcggaatacgtcaaacctttgggattattcaagatttttcagcaaagttacaaatttatattaataaaaaaaatgttgctccagaggttttttcaacttttaaatcattagatattggtgatattattgaattagaaggtgtagcaatgaaaactaatagtgatgaaattactttaaatgttacaaacattcgattagttgctaaaagtctaaaagttctccctgaaaagtatcatggattggttgatgaagaaattaaagcacgtcaacgttatttagatttaattgttaacgatgagacaaaaaatacttttataaaacgatctttaattatacgtgaaatgcgtaattggttagataataaaggtttttttgaagttgaaacgcctgttttgcaagatattttaagtggtgctgctgctcgtccttttattacacatcataacactttaaataaagaatattatttaagaattgctactgaaattgctttaaaaaagtgtattattgggggttttgaaaaagtatatgaaataggtagaatttttcgaaatgagggaatggatagtactcataatcctgaatttacttcagttgaattatatattgcatatgttgatttatgatatattatgcaactaactgaagatttaattcgtcatattgctactaaattaaacttattaaatcctacatttagaggttttagtattgatttaaataaaccttttaaaaaagctcatatggttgatttaattaatgaatatgttggtgttaatttttttgaagttaaaagcgatgaacaagcaattgaattagcaaaaaaacaccatgttaaattattagatcatcaaaaaaactttggtcatatcgttaatgctttttttgaaacttttgttgaagaaaaattagttgaaccaacatttgtatatggtcatccgttacaagtttctccacttactaaaaagaatcagagtgatcctcgttttgtagatcgttttgaattatttatttgtcaaaaagaatttgctaatgcttatagtgaaattaatgatccaattgatcaatatgaacgttttatcgcacagttagaagaagctaaattaggaaatgacgaagcaagtgaattagatatggaatttattgaggccttagaatatggtatgcctccaacaggtggtttgggaatcggtgttgatcgtttagtaatgctgttaacaagtaatgatagtattcgtaatgttttattatttcctcacatgaaagataaaacaaaataa

SEQ ID NO: 32695 - protein, 493 aa, Ureaplasma parvum
MERKFSDQELIRRTHLQELKNQNKNPFLITKVDRSMFLKDFAEKYKNFSKEELHNMDLEKLTLAGRLIGIRQTFGIIQDFSAKLQIYINKKNVAPEVFSTFKSLDIGDIIELEGVAMKTNSDEITLNVTNIRLVAKSLKVLPEKYHGLVDEEIKARQRYLDLIVNDETKNTFIKRSLIIREMRNWLDNKGFFEVETPVLQDILSGAAARPFITHHNTLNKEYYLRIATEIALKKCIIGGFEKVYEIGRIFRNEGMDSTHNPEFTSVELYIAYVDLWYIMQLTEDLIRHIATKLNLLNPTFRGFSIDLNKPFKKAHMVDLINEYVGVNFFEVKSDEQAIELAKKHHVKLLDHQKNFGHIVNAFFETFVEEKLVEPTFVYGHPLQVSPLTKKNQSDPRFVDRFELFICQKEFANAYSEINDPIDQYERFIAQLEEAKLGNDEASELDMEFIEALEYGMPPTGGLGIGVDRLVMLLTSNDSIRNVLLFPHMKDKTK

SEQ ID NO: 32696 - DNA, 1518 bp, Vibrio parahaemolyticus
  CDS (1)..(1518)
atgactgatgctgttcaaaacgaaactgtacaagaagaaaacaagctgattgctgagcgccgcgctaaactggacgaaatccgaaagagctgcaaagcaaacggccacccaaacgacttccgtcgtgacgcactagcgggcgaccttcaaaaagagttcggtgaaaagactaaggaagagctagaagagcttaaccacgtagtagcgatcgctggtcgtattatggcaaaacgtggtccattcctagtaattcaagaaacatctggccgtatccaagcttacgcagacaaagaagttcaaaaagaactgaaagagaaataccaaggtcttgatatcggtgacatcatcggtgttaaaggtgcgctacacaaatctggtaaaggcgacctatacgtgaacatggaagagtacgagttgctaacaaaagcacttcgtccacttcctgagaagttccacggtctgactgaccaagaaatgcgttaccgtcagcgttacgtagacctaatcgttaacgaagattctcgtaatgcattcgttgtacgttctaaagttatgtctgcaattcgtaacttcatgatctctaaacagttcatggaagttgaaacgccaatgatgcacgtgatccctggtggtgcaagtgcacgtccatttatcacgcatcacaacgcgctagacatgccaatgtacctgcgtattgcgcctgagctatacctgaagcgtctagttgttggtggctttgatcgcgtattcgaaatcaaccgtaacttccgtaacgaaggtctttctccacgtcacaaccctgaattcacaatgatggaattctacatggcgtacgcggattacaaagatctaatggacttcactgaagaactactaagctctgtagcactagaagttctaggttcaacatcaatgccttacggtgaagatactgttgagtttggcggtaagtacgctcgcatgagcatgtttgaagcaatcaaacactacaacccagaccacgctcaaatccaagcgctaacggaagaagatctacaaaaccgcgaactaatggtttctatcgcgaaatctgttcacgttgaagtagaacctttctggacttgtggtcagcttcttgaagagatcttcggtgaaactgcagaacctaaactaatgcagcctacgttcatcactggctacccagcggatatttctccactggcacgtcgtagcgatgacaacccattcttcacagaccgctttgagttcttcatcggtggccgtgaagtagcaaacggcttctcagagcttaacgatgcagaagaccaagacgcgcgctttaaagcacaggttgaagcaaaagaatctggtgatgacgaagcgatgttctacgatgcagactacatcactgcactagaacacggtctaccaccaacagcaggtcaaggtatcggtatcgaccgcctagttatgctgctaactaacacgcacaccatccgtgacgtgatcttgttccctgcaatgcgcccacaagcgtaa

SEQ ID NO: 32697 - protein, 505 aa, Vibrio parahaemolyticus
MTDAVQNETVQEENKLIAERRAKLDEIRKSCKANGHPNDFRRDALAGDLQKEFGEKTKEELEELNHVVAIAGRIMAKRGPFLVIQETSGRIQAYADKEVQKELKEKYQGLDIGDIIGVKGALHKSGKGDLYVNMEEYELLTKALRPLPEKFHGLTDQEMRYRQRYVDLIVNEDSRNAFVVRSKVMSAIRNFMISKQFMEVETPMMHVIPGGASARPFITHHNALDMPMYLRIAPELYLKRLVVGGFDRVFEINRNFRNEGLSPRHNPEFTMMEFYMAYADYKDLMDFTEELLSSVALEVLGSTSMPYGEDTVEFGGKYARMSMFEAIKHYNPDHAQIQALTEEDLQNRELMVSIAKSVHVEVEPFWTCGQLLEEIFGETAEPKLMQPTFITGYPADISPLARRSDDNPFFTDRFEFFIGGREVANGFSELNDAEDQDARFKAQVEAKESGDDEAMFYDADYITALEHGLPPTAGQGIGIDRLVMLLTNTHTIRDVILFPAMRPQA

SEQ ID NO: 32698 - DNA, 1533 bp, Vibrio vulnificus
  CDS (1)..(1533)
atgactgatgctgttcaaaacgaaactgtacaagaagcctctgcacaagaagagaataagctcattgctgaacgccgcgcaaaattggatcaaatccgaaagagctgcaaagcaaatggccacccaaacgacttccgtcgtgacagcctagctggcgaccttcaaaaagagttcggtgaaaagagtaaggaagagctagaagcacttaaccacgttgttgctattgcgggtcgtgttatggcgaaacgtggtccattcttggtgatccaagaaacttctggtcgtatccaggcttacgcggacaaagatgtacaaaaagtattgaaagacaaataccaaggtcttgatatcggtgacatcatcggtgtgaaaggtgcgctgcacaaatctggcaaaggcgacctatacgtaaacatggaagagtacgagttgctaactaaagcacttcgtccactgccagagaagttccacggtctcactgaccaagaaatgcgttaccgtcagcgttatgttgacctcatcgtgaatgaagattctcgtaatgcgtttgtagtacgttcaaaagtgatgtcggcaatccgtaatttcatgatctctaaacagttcatggaagttgaaacgccaatgatgcacgtgatccctggcggtgcgagtgcgcgtccattcatcacgcatcacaatgcgttagacatgccaatgtacctacgtattgcgccagagctatacctgaagcgtctagttgttggtggttttgatcgcgtattcgaaatcaaccgtaacttccgtaacgaaggtctttctccacgtcacaaccctgaattcactatgatggaattctacatggcgtacgcagactataaagatctgatggacctaactgaagagctactaagctcggtggctttagaagttctaggttcaacgtcaatgccttacggtgagcatactgttgagtttggtggcacatacactcgcatgagcatgtttgaagcaatcaagcactacaacccagaccacgcgcaaatccaagcgctaacggaagaagacattcaaaaccgtgacctaatggtttctatcgcgaaatcggttcacgtagaagtcgaacctttctggacatgtggtcagcttcttgaagagatctttggtgaaacagcagaacctaagctaatgcagccaacgttcatcactggctacccagcagatatctctccactggctcgtcgtagcgatgacaacccgttcttcacagaccgctttgagttcttcatcggtggccgtgaagtggcgaacggtttctctgagcttaacgatgcagaagaccaagacgcacgtttcaaagcacaggttgaagcgaaagagtcgggtgatgacgaagccatgttctacgatgcagactacatcacagcactagagcacggcctaccaccgactgctggtcaaggtatcggcatcgaccgtctagtgatgctactgaccaacacgcacacgattcgtgacgttattctattcccagcgatgcgtcctcaggcgtaa

SEQ ID NO: 32699 - protein, 510 aa, Vibrio vulnificus
MTDAVQNETVQEASAQEENKLIAERRAKLDQIRKSCKANGHPNDFRRDSLAGDLQKEFGEKSKEELEALNHVVAIAGRVMAKRGPFLVIQETSGRIQAYADKDVQKVLKDKYQGLDIGDIIGVKGALHKSGKGDLYVNMEEYELLTKALRPLPEKFHGLTDQEMRYRQRYVDLIVNEDSRNAFVVRSKVMSAIRNFMISKQFMEVETPMMHVIPGGASARPFITHHNALDMPMYLRIAPELYLKRLVVGGFDRVFEINRNFRNEGLSPRHNPEFTMMEFYMAYADYKDLMDLTEELLSSVALEVLGSTSMPYGEHTVEFGGTYTRMSMFEAIKHYNPDHAQIQALTEEDIQNRDLMVSIAKSVHVEVEPFWTCGQLLEEIFGETAEPKLMQPTFITGYPADISPLARRSDDNPFFTDRFEFFIGGREVANGFSELNDAEDQDARFKAQVEAKESGDDEAMFYDADYITALEHGLPPTAGQGIGIDRLVMLLTNTHTIRDVILFPAMRPQA

SEQ ID NO: 32700 - DNA, 1482 bp, Wigglesworthia glossinidia brevipalpis
  CDS (1)..(1482)
atgaaaaacaaaaaagaaatttactatcgtaaaaaaaaattagaagaaatgaggaaaaatgaaaatatatttcctaataattttcgtcaaaatactactataaaaaatataaaaaaaaattataaaaaaaatgataaagaatattttaaaaacaataaaataataattagtattgctggaagaataatatctatcagagtaatgggaaaatcttctttcttagaaattagaaacatagaatctaaaatacaaatatatatttcagaaaataatatatcaaaaaataaatataaaaaaataataaaacaattagatataggagatataattggagttttaggtgttttatttaaaacaaacactgaagaactatctgtaaaatgcaaaaaactatatgtattaactaaatccgttaaacctttcccaaataaattccaaggattattaaatcaagaaatatgttatagaaaaagatatttggatttaattacaaataaaaaatcaagaaatacatttaaaactagatcaattattataaataatataagaaaatttatgataaaagaaaattttgtagaagtagaaactcctatgatgcataatataccaggaggaggtttatctaaaccatttattactcatcacagctctttaaatattgatttatatttaagaattgctcctgagttgtatttaaaacagttgattgttggaggattcgaaaaaatatttgaaattaatagaaattttagaaatgaaggattatcgtctaatcataatccagaatttactatgatggagttttatgttgcatatattgattatgaagatttaatgaaaatagtagaaaatttattaaattatattgttgataaaatttttaataaaaacaaaataaattataataattttatgataaattttgaaaaaccttttaaaaaaattagcatgcaggactctatttgcgaatattgtaaaaatgtaacacaatcagatatttctgacattaaaattatcactgatatagctaaatcttttaatattacggtcgaaaaaaattggggagtgggaaaattgcaagaaaaaattttttcagaaaaagtagaaaaaaatttaattcaaccaacttttgttatagattatccaacagagatttcaccactggctcgtgcaaaaaaaaataataaacttataacggatagatttgaattatttgtatgtggtaatgaaattggaaatggattttcagaattgaatgatccaaaagaacaaaaaaatagatttttagaacagttaaaaaataaaaccttagaagaacaaaacattttctatgacaaagattatataacatctttagagtatggattacctcctacagctggatgtggtattggaattgacagattagttatgatattaactaataattacagcattaaagacgtaatacttttcccaacattacgtaatgctaataaataa

SEQ ID NO: 32701 - protein, 493 aa, Wigglesworthia glossinidia brevipalpis
MKNKKEIYYRKKKLEEMRKNENIFPNNFRQNTTIKNIKKNYKKNDKEYFKNNKIIISIAGRIISIRVMGKSSFLEIRNIESKIQIYISENNISKNKYKKIIKQLDIGDIIGVLGVLFKTNTEELSVKCKKLYVLTKSVKPFPNKFQGLLNQEICYRKRYLDLITNKKSRNTFKTRSIIINNIRKFMIKENFVEVETPMMHNIPGGGLSKPFITHHSSLNIDLYLRIAPELYLKQLIVGGFEKIFEINRNFRNEGLSSNHNPEFTMMEFYVAYIDYEDLMKIVENLLNYIVDKIFNKNKINYNNFMINFEKPFKKISMQDSICEYCKNVTQSDISDIKIITDIAKSFNITVEKNWGVGKLQEKIFSEKVEKNLIQPTFVIDYPTEISPLARAKKNNKLITDRFELFVCGNEIGNGFSELNDPKEQKNRFLEQLKNKTLEEQNIFYDKDYITSLEYGLPPTAGCGIGIDRLVMILTNNYSIKDVILFPTLRNANK

SEQ ID NO: 32702 - DNA, 1524 bp, Wolinella succinogenes
  CDS (1)..(1524)
ttgtttttttctaatcagtatatcaagcagagaatccaaaaaggggaggagctaagggagcttggacgcaacccctatgataatcaactcatgcgcactctcacccatgcgcaatttttgcaaaagtttgaggcgcttaagagcttagagagtgaagagaagcgcgatgaaagcgccaaagagagcatcgcgggtcggattaaatttcttcgtcatatgggaaaggcggcctttgctaaaattgaggatgagagcggaatccttcagatttacttctcccaaaatgagcttggcgaagattttaagatgctcaaaaagctggccgaggtgggtgatattgtggcggtgagtggctttccttttgtcaccaaaacgggcgaattgagcctccatgcgttggagatgaagattctcaccaaagccatcgttcctctgcctgagaagtatcatgggctcgtggatgtagagcttcgctatcgtcagcgctatcttgacctcattatgaaccctgaggtcaaagagaccttcaagctccgcagtcaagtcgtctctagtgtgcgaagattctttgaggagaggggattcttggaggtggagactcccatgatgcaccccattcctggtggcgccaatgccaagcccttcatcacgcaccacaacgccctaggggttgataggtatctaagaatcgctccagagctctaccttaaacgccttgtcgtgggggggtttgaggcggtttttgagatcaatcgaaacttccgtaatgaggggatggatcactctcataaccctgaattcactatgattgaattctattgggcctacaaaacctatcacgagttgatgagcctcaccgaggagctttttggctacctctttgagcgcttgggcttgcccaagattcttccccatggtgaggagatgatcgacttctcccttccctttaggaggattccctacaagaaagcgcttcatgagatcggaggggtgcctttggaggtgatcgaggagaaggagaagcttcgagcctatttgatcgaaaaaggggtgaggctagagggcgagatgggaattggaaagcttcaggcggaggcgtttgatgcctttgttgaggagaagcttatcaaccccactttcatcactgaattccccatcgagatcagtccactagctagaagaagtgatgagaatccccaaattgctgatcgttttgagcttttcatcggcaaaaaagagatcagtaatggctttagcgagcttaatgatccccttgatcagcttgagcgtttcaaggcgcaggtggcggccaagaatgcgggtgatgaagaggctcaacatatggatgaagactatgtttgggctctaggacatggactgcctcccacggcgggagaggggatcgggatcgatcgccttgtgatgttgctcaccaataaccgctccattaaggatgtaatcctattccctgcgctcaaagttcaaaagagcgactacaccattttgaaggaagaagaagcatga

SEQ ID NO: 32703 - protein, 507 aa, Wolinella succinogenes
MFFSNQYIKQRIQKGEELRELGRNPYDNQLMRTLTHAQFLQKFEALKSLESEEKRDESAKESIAGRIKFLRHMGKAAFAKIEDESGILQIYFSQNELGEDFKMLKKLAEVGDIVAVSGFPFVTKTGELSLHALEMKILTKAIVPLPEKYHGLVDVELRYRQRYLDLIMNPEVKETFKLRSQVVSSVRRFFEERGFLEVETPMMHPIPGGANAKPFITHHNALGVDRYLRIAPELYLKRLVVGGFEAVFEINRNFRNEGMDHSHNPEFTMIEFYWAYKTYHELMSLTEELFGYLFERLGLPKILPHGEEMIDFSLPFRRIPYKKALHEIGGVPLEVIEEKEKLRAYLIEKGVRLEGEMGIGKLQAEAFDAFVEEKLINPTFITEFPIEISPLARRSDENPQIADRFELFIGKKEISNGFSELNDPLDQLERFKAQVAAKNAGDEEAQHMDEDYVWALGHGLPPTAGEGIGIDRLVMLLTNNRSIKDVILFPALKVQKSDYTILKEEEA

SEQ ID NO: 32704 - DNA, 1518 bp, Xanthomonas campestris
  CDS (1)..(1518)
atgaccgaacagacccccacgccgcagctccccgccgacgagaacagcctcatcgccgagcggcgcgcgaaactgggcgcgttgcgcggccagggcatcgcctatccgaacgatttcgtgcgcacccactttgccggcgatctgcaggccgagttcgccgaggccgaaacctggactgccgaagcgctggaagcagccgaccgcagcgtcaagctggcgggccggttgatggccaagcgggtgatgggcaaggccagcttcgcgcagatccaggacgagtccgggcgcgtgcagttgttcctgcagggcaatgtgctgggcgatgcctacaccgccttcaagggctgggacgtgggcgacatcgtggcggtggagggcgggctgacccgcaccaagaccggcgagctgtcggtcaaggccactgcgctgcgtttgctgaccaagtcgctgcgtccgctgccggacaagtggcacggcctgtcggacgtggagcagcgctatcgccagcgctatgtggacctgatcgtcaccccggaagcgcgcgaggtcttcatcaagcgctccaagatcatccgcgccatccgcgcctggctggacgcgcgccgcttcctggaagttgaaacgccgatgatgcattacatccccggcggcgccactgccaagccgttcaccacccaccacaacgcactggatctggacctgtacctgcgcgtggccccggagctgtacctcaagcggctggtggtcggtgggctggagcgcgtctacgagatcaaccgcaatttccgcaacgaaggcgtgtcgacccggcacaaccccgagttcaccatgctcgagctctacgaggcctatgccacgtaccacgagatcatggacctgaccgagcaggtgatccgcgacaccgcccagggcgtgctcggcaccacccaggtcagctgggacggtgccgacattgatttggcgccggctttccgacgctggcgcatggatgaggcagtgcgccaccacaacccggagatcagcgcggccgattgcaccgaccgcgccgcgctgctgcgccattgcgagcggctcaagatcaaggtcaagccgtcctacggctggggcaagctgctgctggaaatcttcgagtccaccgtcgaacacacgctggtgcagccgactttcatcaccgaccacccggtcgaggtgtcgccgctggcacgcgccagcgacaccgagccggggtataccgaccgcttcgagctcttcatcaatggcaaggagctggccaacgggttctcggagctcaacgacccggaagaccaggcggcgcgtttccaggcccaggtgcaggcgaaggacggcggcgacgacgaagcgatgcattacgacgccgattacatccgtgccctggagtacggaatggcgccgaccggtgggctgggcatcggtatcgatcggctggtgatgctgctgaccggcagtacctccattcgcgacgtgctgctgttcccctacatgcgcccggaagcctga

SEQ ID NO: 32705 - protein, 505 aa, Xanthomonas campestris
MTEQTPTPQLPADENSLIAERRAKLGALRGQGIAYPNDFVRTHFAGDLQAEFAEAETWTAEALEAADRSVKLAGRLMAKRVMGKASFAQIQDESGRVQLFLQGNVLGDAYTAFKGWDVGDIVAVEGGLTRTKTGELSVKATALRLLTKSLRPLPDKWHGLSDVEQRYRQRYVDLIVTPEAREVFIKRSKIIRAIRAWLDARRFLEVETPMMHYIPGGATAKPFTTHHNALDLDLYLRVAPELYLKRLVVGGLERVYEINRNFRNEGVSTRHNPEFTMLELYEAYATYHEIMDLTEQVIRDTAQGVLGTTQVSWDGADIDLAPAFRRWRMDEAVRHHNPEISAADCTDRAALLRHCERLKIKVKPSYGWGKLLLEIFESTVEHTLVQPTFITDHPVEVSPLARASDTEPGYTDRFELFINGKELANGFSELNDPEDQAARFQAQVQAKDGGDDEAMHYDADYIRALEYGMAPTGGLGIGIDRLVMLLTGSTSIRDVLLFPYMRPEA

SEQ ID NO: 32706 - DNA, 1521 bp, Xylella fastidiosa
  CDS (1)..(1521)
atgactgagcatctccctacgtcgcaggtgtcctttgacgagaacgcgctgattgccgagcgccgtgcaaaacttttagcactacgtgcgcaaggcgtggcttatccgaatgatgtcaaacgcgagcattatgctgctgatgtgcaggtagcatttgccaacgtcgagacatggactgctgaggccctggaagcgtccggcgatcgcgtccgtatggctggtcgactgatggctaagcgtctcatgggcaaggccagctttgctcagattcaggacgagtctggccgcatccagctgttaatacagagtaacgtgcttggcgaggacagctatgccgcattcaaggtgttggatgttggcgacatcattgctgttgaaggaggattgacccgcaccagaacgggcgagctgtcggtcaaggtgaatgtcttgcgacttttgaccaaggcgttacgtccattgcctgacaagtggcacgggctaactgatgtggagcagcgctaccgccagcgctatgttgatcttattgtgactccagaatcgcgtgagattttcatcaaacgctccaagatcattcgtgcgctgcgtacttggctggatgcgcgtcttttcttggaagtagagacgccgatgatgcattacatcccaggaggtgctgcggctaagccgtttgtgacctaccacaatgccttggatttagagttatatctgcgcgtggccccagagttgtatctcaagcgtttggtcgtaggtgggctggaacgggtttacgagattaaccgcaacttccgtaacgagggggtgtcgacccggcacaaccccgaatttacgatgcttgagttatacgaggcctattccacctaccatgaggtcatggatctggctgagacgatgatccgtgatactgcacagtctgtgctgggcacgacccaggtgatttgggacggtgctcagattgatctgggtccgatattccggcgttggcgcatggatgaggcagtttgccatcataatcctgagatcagcgttgccgaatgtaccgatcgtgatgcattgctccttcactgtgagcgactcaagatcaaggttaaatcgtcctacggttggggtcgattgctgttgagtatttttgaggcgactgtcgagcatacgttgatccagccgaccttcattacggatcatccggttgaaatctctcctttagcgcgcgaaagcgacatcgaaccagggtataccgatcgcttcgaactgttcatcaatgggaaggaaatcgctaacggtttctcggaattgaacgatccggaggagcaggcgatgcgcttccagaagcaagttgaagccaaagaagggggggatgatgaggccatgtactacgatgccgactatattcgcgctttggagtatgggatggcgccaaccggagggttagggattggtgttgatcgactggtgatgctgctgaccggtagcacctcgatccgcgatgtgctgttattcccttatatgcgtccagaacgttaa

SEQ ID NO: 32707 - protein, 506 aa, Xylella fastidiosa
MTEHLPTSQVSFDENALIAERRAKLLALRAQGVAYPNDVKREHYAADVQVAFANVETWTAEALEASGDRVRMAGRLMAKRLMGKASFAQIQDESGRIQLLIQSNVLGEDSYAAFKVLDVGDIIAVEGGLTRTRTGELSVKVNVLRLLTKALRPLPDKWHGLTDVEQRYRQRYVDLIVTPESREIFIKRSKIIRALRTWLDARLFLEVETPMMHYIPGGAAAKPFVTYHNALDLELYLRVAPELYLKRLVVGGLERVYEINRNFRNEGVSTRHNPEFTMLELYEAYSTYHEVMDLAETMIRDTAQSVLGTTQVIWDGAQIDLGPIFRRWRMDEAVCHHNPEISVAECTDRDALLLHCERLKIKVKSSYGWGRLLLSIFEATVEHTLIQPTFITDHPVEISPLARESDIEPGYTDRFELFINGKEIANGFSELNDPEEQAMRFQKQVEAKEGGDDEAMYYDADYIRALEYGMAPTGGLGIGVDRLVMLLTGSTSIRDVLLFPYMRPER

SEQ ID NO: 32708 - DNA, 1518 bp, Yersinia pestis
  CDS (1)..(1518)
atgtcagagcaaaaaccacaagtcgctgagcaagcgcaagaactcaatagtgagttacaagcccgtcgagaaaaactggctgtcttacggggaaagggaattgcattccctaatgatttccgccgtgagaacctttccgaccagttgcatgccgagtttgacagtaaagagaatgaagagttagaagcactgaatatcgacgtaaccgttgctggccgtatgatgacccgccgtatcatgggtaaagcatcatttgtgactctgcaagatgttggtggccgtatccagttgtacgtttcccgtgatgacctaccggaaggcgtttataacgaagaattcaaaaagtgggacctgggcgatatcctgggtgcgcgcggtaaactgtttaaaaccaaaaccggtgagctgtcgatccactgtagcgaactgcgtctgttgaccaaggctctgcgtccattgccagataaattccatggcttagctgaccaggaaacccgttaccgccagcgttatttggatctgattgctaacgacgagtctcgtcatactttcaaagtccgttcgcaagtgatgtccggtatccgtagcttcatggttgaaaaaggcttcatggaagtcgaaacgccaatgatgcaagtgatccctggcggcgcttccgcacgtccgtttgtcacgcatcacaatgcgttggatatcgatatgtatttgcgtatcgcgccagagctgtatctgaaacgtctggtcgtggggggcttcgaacgtgtgttcgaaatcaaccgtaacttccgcaacgaaggggtttcgccacgtcataacccagagttcaccatgatggaactctatatggcttatgcggactataaagacctgatcgtcttgacggaagagctattccgcactctgaccgaaaccatattggggagcagtgtggtgcaatatggcgaacagacttttgatttcggtaagccttttgccaaattgaccatgaaagaagctatttgtaaatatcgtcctgaaaccaatgtcgcggatttagacgatatggataaagccgtcgcaattgccgaatcattgggtatcaaggttgagaagagctggggcctgggtcgtattcaatgtgaaatctttgaagagaccgcagaaagtcatcttatccagccaacgttcatcacagaatatccagccgaggtttctccgctagcacgccgtaatgacgataatccatttatcactgaccgctttgaattcttcatcggtggccgtgaaattggtaatggcttctctgagttgaacgatgccgaagaccaggcgcagcgtttcgccgatcaggtaagtgctaaagaagctggcgatgatgaagcgatgttctacgatgaagactatatcactgcattggaacatggcttaccaccaaccgcagggctaggtattggtattgaccgtatggttatgttgtttaccaatagccataccatccgtgatgtcattttattcccagcgatgcgcccggtaaaataa

SEQ ID NO: 32709 - protein, 505 aa, Yersinia pestis
MSEQKPQVAEQAQELNSELQARREKLAVLRGKGIAFPNDFRRENLSDQLHAEFDSKENEELEALNIDVTVAGRMMTRRIMGKASFVTLQDVGGRIQLYVSRDDLPEGVYNEEFKKWDLGDILGARGKLFKTKTGELSIHCSELRLLTKALRPLPDKFHGLADQETRYRQRYLDLIANDESRHTFKVRSQVMSGIRSFMVEKGFMEVETPMMQVIPGGASARPFVTHHNALDIDMYLRIAPELYLKRLVVGGFERVFEINRNFRNEGVSPRHNPEFTMMELYMAYADYKDLIVLTEELFRTLTETILGSSVVQYGEQTFDFGKPFAKLTMKEAICKYRPETNVADLDDMDKAVAIAESLGIKVEKSWGLGRIQCEIFEETAESHLIQPTFITEYPAEVSPLARRNDDNPFITDRFEFFIGGREIGNGFSELNDAEDQAQRFADQVSAKEAGDDEAMFYDEDYITALEHGLPPTAGLGIGIDRMVMLFTNSHTIRDVILFPAMRPVK

SEQ ID NO: 32710 - DNA, 23 bp, Primer
atgtctgaacaagaaacacgggg

SEQ ID NO: 32711 - DNA, 22 bp, Primer
ttatttctgtgggcgcatcgcc

SEQ ID NO: 32712 - protein, 561 aa, consensus
  MISC_FEATURE (1)..(561): consensus for the disclosure of xaa see table XV
AGRXXXXRXXXXXXXFXXXXXXXXXXXXXXXXQXXXXXXXXXXXXXXXXXXXXXXXXXXXXXXXXXXGDXXGXXGXXXXXXXXXXXXXXXXGELXXXXXXXXXXLXKXLXXLPXXXXXXXXXXXXXXXXXXXXXXXXXXXXXXXXXXXXGXXDXEXXYRXRYXDLIXNXXXXXXFXXRXXXXXXXRXXXXXXXFXEVETPXXXXXXGGAXAXPFXTXHXNXXLXXXXXXRIAXELXLKXLXVGGXXXXVXEXXRXFRNEGXXXXHNPEFTXXEXYXAYXDXXXXMXXXEXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXPTFXXXXPXXXSPLAXXXXXXXXXXXXXXXXRFEXFXXXXEXXNXXXELNDXXXQXXRFXXQXXXXXXGXXEAXXXXXXXXXXXXXXXXXXXXXXXDXXXXXALEXGXPPTXGXGXGIDRLXMXXTXXXXIXXVXXFP

SEQ ID NO: 32713 - protein, 34 aa, consensus
  MISC_FEATURE (1)..(34): consensus for the disclosure of xaa see table XV
XXGRXXXXRXXXXXXXFXXXXXXXXXXXXXXXXQ

SEQ ID NO: 32714 - protein, 46 aa, consensus
  MISC_FEATURE (1)..(46): consensus for the disclosure of xaa see table XV
GDXXXXXGXXXXXXXXXXXXXXXXXXXXXXXXXXXXXXXXXXXXXP

SEQ ID NO: 32715 - protein, 135 aa, consensus
  MISC_FEATURE (1)..(135): consensus for the disclosure of xaa see table XV
XXXXXXRXXDXXXXXXXXXXXXXRXXXXXXXXXXXXXXXXXEXXXPXXXXXXXGXXAXPFXTXXXXXXXXXXXXXRXXXEXXXKXXXXXGXXXXXXXXXXXXRNEXXXXXHXXEFXXXEXYXXXXXXXXXXXXXX

SEQ ID NO: 32716 - protein, 62 aa, consensus
  MISC_FEATURE (1)..(62): consensus for the disclosure of xaa see table XV
PXXXXXXPXXXXPXXXXXXXXXXXXXXXXXXXXXXXXXXXEXXXXXXEXXXXXXQXXXXXXX

SEQ ID NO: 32717 - protein, 45 aa, consensus
  MISC_FEATURE (1)..(45): consensus for the disclosure of xaa see table XV
DXXXXXXXXXXXXPXXGXGXGXDRXXMXXXXXXXIXXXXXFXXXX

SEQ ID NO: 32718 - DNA, 1656 bp, Escherichia coli
  CDS (1)..(1656)
atgactcatcttccccactggtggcaaaacggcgttatctaccagatttatccaaagagttttcaggacaccacgggtagcggtaccggcgatttacgtggcgttatccaacacctggactatctgcataaactgggcgttgatgccatctggctaacccccttttatgtctctccccaggtcgataacggttacgacgtagcgaactatacggcgattgatcccacctacggcacgctggacgattttgacgaactggtgacgcaggcaaaatcgcgcgggattcgtatcattctcgatatggtgtttaaccatacctctacccaacatgcctggtttcgcgaggcgctgaacaaagaaagcccttaccgccagttttatatctggcgcgatggagaaccagaaacgccaccgaacaactggcgttcaaaatttggcggtagtgcgtggcgctggcatgcggaaagcgaacagtactatttgcatctctttgcaccagaacaggcggatctcaactgggagaatccagcggtacgcgcagagctgaaaaaagtctgtgagttctgggccgatcgtggggtcgacgggttgcgcctggatgtggtgaatctgatctccaaagacccgcgtttccctgaagacctggacggcgacgggcgtcgcttctacaccgacgggccacgagcacacgagtttttgcacgagatgaaccgcgatgtgtttacgccacgcgggttaatgaccgtaggtgaaatgtcctccaccagccttgagcattgccagcgatacgcggctctgacaggcagtgaattgtcgatgacctttaattttcatcacctgaaggtcgattatcccggtggtgaaaaatggacgctggctaaacctgactttgtggcgttgaaaacattgttccgccactggcaacaaggaatgcacaacgtagcatggaatgccttgttctggtgtaaccacgatcagccgcgcattgtttctcgctttggtgatgaaggtgaataccgcgtgcctgcggcaaaaatgctggcgatggtgctgcatggcatgcagggaacgccgtatatctaccagggcgaagagattggcatgaccaacccgcatttcacgcgcattactgactatcgcgacgtagagagcctcaatatgtttgccgagctgcgcaacgatgggcgtgatgccgacgagttattggcaatcctcgccagtaaatcccgtgacaacagtcgcacgcccatgcaatggagcaacggcgataatgccgggtttacggctggcgaaccgtggattggcctgggcgataactatcaacaaatcaacgtagaagccgcgctggccgatgattcctcggtgttttacacctaccaaaagttaatcgcactgcgtaagcaggaagccatcctgacatggggcaattaccaggatctgctgccaaacagccctgtattgtggtgctatcgccgtgaatggaaggggcaaaccttgctggtcattgccaaccttagccgtgagatccaaccctggcaggcagggcaaatgcgcggcaactggcagcttgtgatgcataactacgaagaagcctcaccacaaccctgtgccatgaatttacggccttttgaggctgtctggtggttacagaagtaa

SEQ ID NO: 32719 - protein, 551 aa, Escherichia coli
MTHLPHWWQNGVIYQIYPKSFQDTTGSGTGDLRGVIQHLDYLHKLGVDAIWLTPFYVSPQVDNGYDVANYTAIDPTYGTLDDFDELVTQAKSRGIRIILDMVFNHTSTQHAWFREALNKESPYRQFYIWRDGEPETPPNNWRSKFGGSAWRWHAESEQYYLHLFAPEQADLNWENPAVRAELKKVCEFWADRGVDGLRLDVVNLISKDPRFPEDLDGDGRRFYTDGPRAHEFLHEMNRDVFTPRGLMTVGEMSSTSLEHCQRYAALTGSELSMTFNFHHLKVDYPGGEKWTLAKPDFVALKTLFRHWQQGMHNVAWNALFWCNHDQPRIVSRFGDEGEYRVPAAKMLAMVLHGMQGTPYIYQGEEIGMTNPHFTRITDYRDVESLNMFAELRNDGRDADELLAILASKSRDNSRTPMQWSNGDNAGFTAGEPWIGLGDNYQQINVEAALADDSSVFYTYQKLIALRKQEAILTWGNYQDLLPNSPVLWCYRREWKGQTLLVIANLSREIQPWQAGQMRGNWQLVMHNYEEASPQPCAMNLRPFEAVWWLQK

SEQ ID NO: 32720 - DNA, 1665 bp, Mesorhizobium loti MAFF303099
  CDS (1)..(1665)
atgcaatccgctttgaaagccagttcgaaccccgacctcgccatcgatcgcgactggtggcgaggtgctgtcatctaccagatctacccgcgcagctaccaggattcgaacggcgacggcatcggcgacctcaagggcatcatcgaacggctgccctacatcgcagcgctcggtgcggacgccatctggatctcgcccttcttcaaatcgccgatgaaggatttcggctacgacgtctcggactattgcgacgtcgacccgatgttcggcacgctggccgatttcgacgcgctgacggcggaggcgcaccggctgggtctcaaggtgatgatcgacgaagtgctgtcgcacacggccgacatccatccctggttcaaggaaagccggtcgagccgcagcaatcccaaggccgactggtatgtctgggcggacgcccggcccgacggcaccccgcccaacaactggctgtcgatcttcggcgggtccgcctggcagtgggacaccagccgccagcaatattacctgcacaatttcctggccgagcagcccgacctcaacttccacaaccgcgaagtccaggacgcgctgctcgacgtcacccgcttctggctggaacgcggcgtcgacggcttccgcctcgacacgatcaatttctactttcacagccagggcctggaaaacaatccgccgctgccgccggaagaacgcaacgaccagaccgcgccggcggtcaatccctacaactaccaggaccatctctacgacaagagccgtccggaaaacctcggcttcctcgaacgcttccgcgctttgctcgacgaatatccggcaaccgccgctgtcggcgaggtcggcgattcgcagcgtgggctggaagtcgtggcagcctacactgccggcggcaagcgcgtgcatatgtgttattccttcgacttcctggcgccggaaaagatcagcgccgccaaggtgcgttcggtgctggaggccttcggcaaggtcgccagcgacggctggtcgtgctgggcgttttccaatcatgacgtgatgcgtccggcctcgcgctgggccgccggcgaagccgaccctgtcgcctatctcaaggtcatctcggccttgctgatgtcgctgcgcggctcggtctgcatctaccagggcgaggaactcgggctgggcgaggccgaattgcgcttcgaggatctgcaggatccctatggcatccgcttctggccggaattcaagggccgcgacggctgccgcacgcccatggtgtgggatggcgacgccaagaatggcggcttctcccaggccaagccctggctgccggtgccggccaagcatctggcgcaagcggtcaatgtccagcagggtgaccaggcttcactgctcgagcactatcggcgcttcctcagcttccgccgcgcccatccggcgctggccaagggcgacatcaccttcatcgaaagcgagggcgacaccgtcgccttcacgcgccgcgccggcaacgagcaggttgtctgcgtcttcaacctcggcgccaagccggccaaggttgaccttggcagccgatccctgcaacctttgccgggacacgggttttccgggcaggcgaggcccggttcgatcgagcttggcggttacggcgcctggttcgggcgcatcgactga

SEQ ID NO: 32721 - protein, 554 aa, Mesorhizobium loti MAFF303099
MQSALKASSNPDLAIDRDWWRGAVIYQIYPRSYQDSNGDGIGDLKGIIERLPYIAALGADAIWISPFFKSPMKDFGYDVSDYCDVDPMFGTLADFDALTAEAHRLGLKVMIDEVLSHTADIHPWFKESRSSRSNPKADWYVWADARPDGTPPNNWLSIFGGSAWQWDTSRQQYYLHNFLAEQPDLNFHNREVQDALLDVTRFWLERGVDGFRLDTINFYFHSQGLENNPPLPPEERNDQTAPAVNPYNYQDHLYDKSRPENLGFLERFRALLDEYPATAAVGEVGDSQRGLEVVAAYTAGGKRVHMCYSFDFLAPEKISAAKVRSVLEAFGKVASDGWSCWAFSNHDVMRPASRWAAGEADPVAYLKVISALLMSLRGSVCIYQGEELGLGEAELRFEDLQDPYGIRFWPEFKGRDGCRTPMVWDGDAKNGGFSQAKPWLPVPAKHLAQAVNVQQGDQASLLEHYRRFLSFRRAHPALAKGDITFIESEGDTVAFTRRAGNEQVVCVFNLGAKPAKVDLGSRSLQPLPGHGFSGQARPGSIELGGYGAWFGRID

SEQ ID NO: 32722 - DNA, 1635 bp, Mesorhizobium loti MAFF303099
  CDS (1)..(1635)
gtgatggccgacgacaatgcggggcagggggccgactggtggcgcggctgcgtcatctaccaagtctatccgcgttccttccaggacacgaccggcgacggcagcggcgatcttaggggtatcaccacgcggcttggccacatcgcttcgctcggcgtcgatgccgtctggctgtcgcccttcttcaagtcgccaatggccgacatgggctatgacgtttcggattatcgcgacgtcgatccgatgttcggttcacttgaggatttcgacgctctggtcaccgaggcgcaccggttgggcctgaaggtcgtcatcgaccaggtcttgtcgcactcatccgacaagcacgaatggttcgtccaaagccgcgccagccgcgacaatcccaaggctgactggtacgtctgggccgatacgaaacccgacggcaacgcgcccaacaactggctgtccgtcttcggcggcccggcctgggagtgggattcgacccgccggcaatattacatgcacaatttcctcgcctcgcagcccgatctgaatttccacaatccagaggtccaggatgcgctgctggacacggtgcgcttctggctggagcgtggcgtcgacggttttcggctcgatacggtcaactactatgtccacgaccgctggctgcgcagcaatccgccgctggcgtcgagcgtcgccggcaccaatggcgagaccaacacctacctctaccaggagcatctgttcgacaagacgcagccggaaaacctggctttcctcaggcgtttccgggggttgctagacgaatatcccgaccgcgccgccgtcggcgaaatcggcgatgagggccgctcgctgcagacgctggctgcctacacctccggcggcgacaagctgcagatgtgctacaccttcgacctgctcggcccgcagttttcggcggcgcatgtgcgcggctgcgtcgaggccttcgaacaagcggttaccgacggctgggtctgctgggcgttttccaaccatgacgtggtgcgccatgtcagccgctggactgggccggacggcgatgccgatgcggtagccagattctcgatcatgctgctcgcctgcctgcgcggctcgatatgcctctatcagggcgaggagctcggcctggaggaggcggagcttgcctatgaggatctgcgcgatcccgtcggcatccgcttctggcccggcatgaagggcagggatggctgccgcacgccgatggtctgggaagccggcgccgacaatgcgggtttctcgacggccaggccctggctgccggtcccggccagccatcgcgcccgcgccaccgacgtgcagaacggcagcgagcaatcggtgctgtccgcctaccgctcgacgcttgccttgcgcaggcggcatccggcgctggtcagcggctcgatccgctttctcgacgccgaaggcgatgtgctggccttcatccgcgaaggcgacgggcagaggctgctctgcgtcttcaatttcgccggggagccggggaattggcccttgccaccggatattggcgtcgctgctgtcctggctggcgccgctgttgtcgaggaagaagcgctctcgctgccggctctcggttgcttccttggccggctcgactga

SEQ ID NO: 32723 - protein, 544 aa, Mesorhizobium loti MAFF303099
MMADDNAGQGADWWRGCVIYQVYPRSFQDTTGDGSGDLRGITTRLGHIASLGVDAVWLSPFFKSPMADMGYDVSDYRDVDPMFGSLEDFDALVTEAHRLGLKVVIDQVLSHSSDKHEWFVQSRASRDNPKADWYVWADTKPDGNAPNNWLSVFGGPAWEWDSTRRQYYMHNFLASQPDLNFHNPEVQDALLDTVRFWLERGVDGFRLDTVNYYVHDRWLRSNPPLASSVAGTNGETNTYLYQEHLFDKTQPENLAFLRRFRGLLDEYPDRAAVGEIGDEGRSLQTLAAYTSGGDKLQMCYTFDLLGPQFSAAHVRGCVEAFEQAVTDGWVCWAFSNHDVVRHVSRWTGPDGDADAVARFSIMLLACLRGSICLYQGEELGLEEAELAYEDLRDPVGIRFWPGMKGRDGCRTPMVWEAGADNAGFSTARPWLPVPASHRARATDVQNGSEQSVLSAYRSTLALRRRHPALVSGSIRFLDAEGDVLAFIREGDGQRLLCVFNFAGEPGNWPLPPDIGVAAVLAGAAVVEEEALSLPALGCFLGRLD

SEQ ID NO: 32724 - DNA, 1671 bp, Thermotoga maritima MSB8
  CDS (1)..(1671)
gtgaaggttgtgaagaagccttttttactgcttgcttttgtgtttttactcttcctcacctcctgctttcaaacgtctatgagtcaatccctcgtttcaagtaatccacattcaaacagcacaaacacagatggtactagctccaaccttgaagaagtaaaataccccgtcgtctacgaaattttcattcgctctttttacgacagagacgggaacggagtgggagatttaaacggtgtttctcagaaagttgattatctgaaggaactcggcgttgacgctgtgtggtttatgcccttcaacgaggctgtttcataccatggatacgacataacagactactacaacgtcgagaaagactacggcaccatggaagatctcgaaaacatgatccaggtgctccatgagaacggaataaaggtaataatggatctcgtgatcaaccacacatccgatgagcatccctggttcaaagacgccgtggaaaacacgaccagctctccgtactgggactactacataatgagtcttgaagatcattctggtcaggatcactggcactggaagatcaactcaaagggtcaaaaagtctggtatttcggactttttggctataacatgccggatctgaaccacgacagtcagaaagtgagagaagaagtaaagaaaatcgtggatttctggatttccaaaggtgttgatggattcagaatagatgctgcaaagcacatatatggctggtcctgggacgatgggatacaggagtcggccgaatattttgaatggttcagagattatgtgctttccaaaaagcccgatgccatacttgtgggagaggtgttcagcggaaacacgtacgatctttctctatatccaattcccgttttcaatttcgccctcatgtacagtataaggaactacccagaagggcaggatggaatgatagaaaacaactgggttgaggagtctttcctgtttcttgagaatcacgatctccacaggttcttctcccatcttcaagaacattacaaaaagttctccgagtccgactacgagttcatcaaaaaacgtgctgctctctggtattttctgatattcacactgaaaggatctcctgttatctactacggcggtgaaattggaacgagaggtttcaagtggcacggtcctgtatatgacgagccggtgagagagccgatgcagtggtacgcaagcggtacaggagaaggtcaaaccttctggacaaaggaagtctacaaaaacgcggggataacctttggaaacgctgatgttgacggatgtatctatgacgatccttacgatggcttttctgtcgaagaacaggaaagcgatccgaagagtcttttgaatttcatcagattcattctcaacttcagaaaagatcacgacgccattttgaatggagatcaaacgatcttcagggactggaaaaacctcatagcgttctacagagaatcctccaacgaaaagctgttggtggtcttgaatccggatccagtctggcaaaacagcttcacttttgaagaaaacatgacgatgattctcgaggtagattttgaaaacttcatctggaacgagtcaaacgtgtctttttcagcgggtgaatccttcactgtggatcccatgaaagcgtacattttcaaaaagtga

SEQ ID NO: 32725 - protein, 556 aa, Thermotoga maritima MSB8
MKVVKKPFLLLAFVFLLFLTSCFQTSMSQSLVSSNPHSNSTNTDGTSSNLEEVKYPVVYEIFIRSFYDRDGNGVGDLNGVSQKVDYLKELGVDAVWFMPFNEAVSYHGYDITDYYNVEKDYGTMEDLENMIQVLHENGIKVIMDLVINHTSDEHPWFKDAVENTTSSPYWDYYIMSLEDHSGQDHWHWKINSKGQKVWYFGLFGYNMPDLNHDSQKVREEVKKIVDFWISKGVDGFRIDAAKHIYGWSWDDGIQESAEYFEWFRDYVLSKKPDAILVGEVFSGNTYDLSLYPIPVFNFALMYSIRNYPEGQDGMIENNWVEESFLFLENHDLHRFFSHLQEHYKKFSESDYEFIKKRAALWYFLIFTLKGSPVIYYGGEIGTRGFKWHGPVYDEPVREPMQWYASGTGEGQTFWTKEVYKNAGITFGNADVDGCIYDDPYDGFSVEEQESDPKSLLNFIRFILNFRKDHDAILNGDQTIFRDWKNLIAFYRESSNEKLLVVLNPDPVWQNSFTFEENMTMILEVDFENFIWNESNVSFSAGESFTVDPMKAYIFKK

SEQ ID NO: 32726 - DNA, 1689 bp, Vibrio cholerae O1 biovar eltor str. N16961
  CDS (1)..(1689)
atgagtagctcaacccaatccatgccttggtggaaaaccgctgcaatttatcaaatttatccgaaaagtttttgcgatagtggcgcgaagggcgtgggcgatctgcaaggcattatcagcaagctcgattatttgcaaaagcttgggattgaagcgatttggctgacgccgatttatcaatcgcctatggtcgataatgggtatgacattgccgattattacgcgattaatccagactttggcacgatgcaagatttcgaacaactgctgaaagaagcccatcgtcgtggtatgcgcatcatcatggatatcgtggttaaccacacctcaaccgaacacgcttggttccaatctgcattgggcgatcgcaatagcccttaccgtgattactatatttggcgtaagccggttaacggtggtgtgccgaacaactggcaatccaaatttggcgggagtgcgtgggcgctggatgaagcgaccggtgagtattatttgcatctgtttgccaaagagcaggccgatttgaactgggaaaatccgcaagttcgagaagaagtaaaaaacatcatcggattttgggctgaaaaaggtgtcgatggcttccgacttgacgtgattaacctcatttccaagcaacaagattttaccaatgatgacatcggtgatggtcgtcgtttttacaccgatggcccaagagtgcatgagtatctgcaagagatcagccgtgatgttttccagcgttatggcagcgtaaccgtcggcgaaatgtcttcaaccaccttagaacattgccaacaatattctgcgctcgatggtcgagagctttctatggtgtttaatttccatcatttgaaagtcgattatccgaatggcgaaaagtggacgaaagcgccgtttgattttctgcaactcaagcaaattttcaatcattggcaaacggggctgaatggcaaaggatggggcgcgctgttttggtgtaaccatgatcagccgcgaattgtgagccgtttaggtgatgatcagcagtaccgagttgagtcagccaaaatgctggcggccaccattcacctaatgcaaggcacaccttatatctaccaaggtgaagagattggaatgaccaaccctggctttacgtcgatcaagcagtatcgcgatgtggaaagcatcaacattcaccaaatcatggtgcagcaacaaggtgtctctgaaagtgacatgctggcgattttggcgcaaaaatctcgtgataattcacgcacgccaatgcagtgggatgccagtctcaacgctggatttactcgtggagaaccttggattgaagtggcgcataactatcctgaaatcaatgcacaggccgcgttagaagacccgcattcggtgttctatttctaccgtcgtttgctatcgctacgtaagaaagtggcggtgattacggacggtgattacaccgacttgttgcctgagcataaagagatttttgcttatcagcgtcgtaatcagaaacaagtgttgatctgtttgaataactattacggtcacgaagccgaatgcgttctgccagaattaccgctcgatgatgcgctctacttgctaggcaactatccgggtattgaattacagcgcgtgttggcgcaccaagtgttacgtccatacgaaacacgcatcatcctgattgagtcacccctatag

SEQ ID NO: 32727 - protein, 562 aa, Vibrio cholerae O1 biovar eltor str. N16961
MSSSTQSMPWWKTAAIYQIYPKSFCDSGAKGVGDLQGIISKLDYLQKLGIEAIWLTPIYQSPMVDNGYDIADYYAINPDFGTMQDFEQLLKEAHRRGMRIIMDIVVNHTSTEHAWFQSALGDRNSPYRDYYIWRKPVNGGVPNNWQSKFGGSAWALDEATGEYYLHLFAKEQADLNWENPQVREEVKNIIGFWAEKGVDGFRLDVINLISKQQDFTNDDIGDGRRFYTDGPRVHEYLQEISRDVFQRYGSVTVGEMSSTTLEHCQQYSALDGRELSMVFNFHHLKVDYPNGEKWTKAPFDFLQLKQIFNHWQTGLNGKGWGALFWCNHDQPRIVSRLGDDQQYRVESAKMLAATIHLMQGTPYIYQGEEIGMTNPGFTSIKQYRDVESINIHQIMVQQQGVSESDMLAILAQKSRDNSRTPMQWDASLNAGFTRGEPWIEVAHNYPEINAQAALEDPHSVFYFYRRLLSLRKKVAVITDGDYTDLLPEHKEIFAYQRRNQKQVLICLNNYYGHEAECVLPELPLDDALYLLGNYPGIELQRVLAHQVLRPYETRIILIESPL

SEQ ID NO: 32728 - DNA, 1680 bp, Bacillus halodurans C-125
  CDS (1)..(1680)
atgtatcaagaatggtggaggaaagcagttgtttatcaaatttatccgaaaagcttcaatgatacgacagggaacggtgtcggtgatttggagggcataattcagaagcttgattatttgaaaacacttggagttgatgtcatctggctgactccgatttatgcttcaccacaaaaggataacggctacgatattagcgactactattcgattcatccagaatatgggacaatggaagactttgaacgattgctcactgaggttcatgatcgaaaaatgaaggtaattatggatatcgtcgttaatcatacatcgacagagcacgaatggtttaaacaatcggcacaatcaaaggataacccgtaccgtgatttttacatttggaaagacccggtgtatggtcttgaaccgaacaactggcaatcaaaatttggcggttccgcctggaagtttgattcgaaaacagaccagtattatttgcatctgtttgacgtatcgcaggctgatctaaactgggaaaatgaagaagtacgcaaccgagtgtatgagatgatggatttttggtttacaaaaggtgtggatggctttcgtcttgatgttattaacctcatttcgaaggatcaagcctttccaaacgatgacggctctgttcctccgggagacggtagacgcttttacacggatggcccacgtgcccatgaatttatgaacgagatgaatcgcaaagtcttttcgaaatacgatgcgatgacggtcggagaaatgtcatcaacgactttagagcattgtattcaatatacgagacctgaaaacaaagagctgagcatgacgtttaactttcaccatttgaaggtcgattatccgaatggtgaaaaatgggcgatcggtgacatggacttttttgccctgaaagaaattttatctaagtggcaagttggtatgcataaaggcggcggttggaacgcgctgttttggtgtaatcacgatcaaccacgagtcgtgagccgttacggaaatgacgggaagtaccatgaaaaatcggcgaaaatgttagcaacaacgattcacatgatgcagggaactccttatatttatcaaggagaagagtttggaatgaccgatccgaaatttgatcggattgatcagtaccgtgatgtagaaacgctcaactattatgacattttaaaagaacaaggactatcagaagaagaggtcatggagatcattaaacgaaaatcccgtgacaattctcggacacctgttcaatgggatgatagtccacatgccgggttcacgtcaggaaccccatggattgatgtggcgtctaactatcgatcaatcaatgcgaaaaaggcattggcggataaacaatcgatcttttatcattataaaaaactgattgagcttaggaagacatatgacattgtaacgtatggggactatgaattactcttacctgaggacccgcgtgtgtttgcgtatgttcggcgctatcaggacgaaaccttactcgtcgtcaatcatttttttgctggagaagtaacgattcaggttccagaggatgtgacggccgagaagcatcaggtcgatgtccttctggccaattatcatgacccttctcgtgagtttcagcagttagtcttgcgtccgtatgagtctgttgtttattatatgaaatag

SEQ ID NO: 32729 - protein, 559 aa, Bacillus halodurans C-125
MYQEWWRKAVVYQIYPKSFNDTTGNGVGDLEGIIQKLDYLKTLGVDVIWLTPIYASPQKDNGYDISDYYSIHPEYGTMEDFERLLTEVHDRKMKVIMDIVVNHTSTEHEWFKQSAQSKDNPYRDFYIWKDPVYGLEPNNWQSKFGGSAWKFDSKTDQYYLHLFDVSQADLNWENEEVRNRVYEMMDFWFTKGVDGFRLDVINLISKDQAFPNDDGSVPPGDGRRFYTDGPRAHEFMNEMNRKVFSKYDAMTVGEMSSTTLEHCIQYTRPENKELSMTFNFHHLKVDYPNGEKWAIGDMDFFALKEILSKWQVGMHKGGGWNALFWCNHDQPRVVSRYGNDGKYHEKSAKMLATTIHMMQGTPYIYQGEEFGMTDPKFDRIDQYRDVETLNYYDILKEQGLSEEEVMEIIKRKSRDNSRTPVQWDDSPHAGFTSGTPWIDVASNYRSINAKKALADKQSIFYHYKKLIELRKTYDIVTYGDYELLLPEDPRVFAYVRRYQDETLLVVNHFFAGEVTIQVPEDVTAEKHQVDVLLANYHDPSREFQQLVLRPYESVVYYMK

SEQ ID NO: 32730 - DNA, 1662 bp, Bacillus halodurans C-125
  CDS (1)..(1662)
ttgaacagacaatggtggaaggaagcggttgcttaccaaatttacccgagaagtttttgtgactctaacggggacggaattggtgatcttcaaggagttattgaaaaattagattatgtaaaagacctagggatcgatgtgatttggatctgtccgatgtatcgatcaccaaatgatgataacggttacgatattagcgactatcaagatattatggatgagtttgggacaatggaagattttgatcaattattacatgaggttcatcgccgaggtatgaagctcattatcgaccttgtcattaaccatacatcggatgaacatccgtggtttattgaatcaagatcgtccaaggttaacccgaaaagggattggtatatatggcgtgacccgaaagaggacggttctgaaccaaataactgggagtctattttcaacggttccgcttgggagtatgatcaggctacaggccaatattacatgcatattttctcgagaaaacaacctgatttaaattgggaaaacagggacgtgcgtaaagcgttatatcaaatgattaattggtggctcgaaaaaggaatcgacggatttcgtgtggatgccatttctcatattaaaaaagtaaaagggttaccagatttaccgaatccaaaagggctcgattatgttccttcttttgaggggcatatgaaccgtgaaggtattcatgaatacttgcaagagttgaaacgggagacgttcgatcactttaatattatgaccgtaggcgaagcaaatggggtaactgtggaacaagcggacgattgggttggagaagatcatggtgcctttaatatgatctttcagtttgaacatttaggattgtgggataaaggagtaaatggcacggttgaccttgctgaactcaagagcatctttacgacatggcagaaaggacttgaaggaaaagggtggaatgcgttatttcttgaaaatcatgaccaaccaagaagcgtatccacatggggaaatgataagggatattggaaagaaagtgcaaaagcattggggacgcttttcttctttatgcagggtactccgtttatttaccaagggcaggagattgggatgacgaatgtccgttttccttcaatagaggactacgatgatgtagggatgaaaaacttttatcgaattgaaacagaaaaaggacgctctcatgaagaaattatggagatcatttggcaaaagggcagagataattcccgtacgccgatgcaatggaacgatcaaaagcatgcaggcttctcaacagcaacggaaacatggatgggggtcaacccaaattataaacaaatcaatgtagagaagcagctaaaagaagaggattctgttctatcttattataagaagatgattgaattaaggaagtcatcggacctttttgtctatggcagttacgatcttgtcttgcctgagcataaacagatttttgcctataagcgtacactagagaaagagagcgcgctcattctggtgaatatgtttgctgatgaggtatcgttccaattcccactcaagttaattggggagaaggaacgtgtgcttggtaactacaaaacacaaggggcgaaagataagctacgtccttatgaagcaagggtataccgctggcaatcttaa

SEQ ID NO: 32731 - protein, 553 aa, Bacillus halodurans C-125
MNRQWWKEAVAYQIYPRSFCDSNGDGIGDLQGVIEKLDYVKDLGIDVIWICPMYRSPNDDNGYDISDYQDIMDEFGTMEDFDQLLHEVHRRGMKLIIDLVINHTSDEHPWFIESRSSKVNPKRDWYIWRDPKEDGSEPNNWESIFNGSAWEYDQATGQYYMHIFSRKQPDLNWENRDVRKALYQMINWWLEKGIDGFRVDAISHIKKVKGLPDLPNPKGLDYVPSFEGHMNREGIHEYLQELKRETFDHFNIMTVGEANGVTVEQADDWVGEDHGAFNMIFQFEHLGLWDKGVNGTVDLAELKSIFTTWQKGLEGKGWNALFLENHDQPRSVSTWGNDKGYWKESAKALGTLFFFMQGTPFIYQGQEIGMTNVRFPSIEDYDDVGMKNFYRIETEKGRSHEEIMEIIWQKGRDNSRTPMQWNDQKHAGFSTATETWMGVNPNYKQINVEKQLKEEDSVLSYYKKMIELRKSSDLFVYGSYDLVLPEHKQIFAYKRTLEKESALILVNMFADEVSFQFPLKLIGEKERVLGNYKTQGAKDKLRPYEARVYRWQS

SEQ ID NO: 32732 - DNA, 1695 bp, Deinococcus radiodurans R1
  CDS (1)..(1695)
ttgaatcccgtgtcttctatttcatataaaaaatattttccggcgtcgcaattctcatctgaaacgattcagtccaccctaaacttgagcatgacttccctgcaaggcgagctgaaatggtggcaaagcggcatcatttaccagatttacccacgttcctatcaggacagcaacggcgacggcgtgggcgacctgcccggtatcacggcgcggctgccgtatgtcgcgagtctgggggtgcaggcggtgtggctctcccccattttcaaaagcccgatgcgcgatttcggatacgacgtggcggattactgcgacattgacccggtgttcggcacgctggagcagttcgatgcgttggtggccgaggcgcaccggctggggctgaaggtcatgctcgactacgtgcccaaccacaccagcagcgaccacgcctggttccaagaggcgctcacgggcaaggccagcgccaaacgcgactggtacgtatggcgcgaccctgccccggacggcgggctgccgaacaactggaaatccttcttcggcggcccggcatggacgctggacgaggcgagcgggcagtattacctgcaccagtttttgccctcacagccggacctcaactggcgcaatcccgacgtgcgggcggcgatgtttgatgtgctgcggttctggatgcgccggggcgtggacggcttccgggtggacgtcatctggctgctggccgaggacgagcggtttctggacgagccggaaaaccccgacgccgaccgcgaagtcgttggcgggcagatcgaacacagtacgctgctgcacatctacacgcaggaccagcccgagacgcacgactatgtgcgcgagatgcgccgggtgatcgacgagttcgacgaccggatgatggtcggtgaaatctacctgccgctcgacaaactgctgccctactccggcacgcccgaggcgccgatggtgcatctgccgttcaactttcacctgattctgctgccgtgggacgcgcaaaccatccggcagttcgccgacgagtacgacgcagcgagcaacgcggcgggggcgtggcccaattgggtgcttggcaaccacgaccagcaccgcttcaagacgcgggtgggcgcggcgcagtaccgggtcgcgcaaacgctgctgctcacgctgcgcggcacgccgacggtgtactacggcgacgagatcggtatggaaaatgtgcccgttcccccggagaagatggtggacccctccggcctgcaacagcccgacagcccggacgccgggcgcgaccccgagcgcaccccgatgcagtgggaggcggcgccgggcgcaggatttacggcggcaggcaccgagccctggctgccgctcaccgacaacttcgcgcaggtgaacgtgcaagttcaggagcaggactcgcagagcgacctgaactacttccgcgccctgacccgcctgcgccaggagcagccggccctggtgggcggcagctaccgcagcctggacagcgggcacgccgacgtatttgccttcgagcgtgaactgaacggcgagcggttgacggtgtggctgaatttccgcggtgaggaacgcgcggtggccgccacggggcaaacgcttctgagcagccgtggcgatcagcccgccgcccaatcgccgctgcgcgggcacgaggcgcgggtggtgctgggttga

SEQ ID NO: 32733 - protein, 564 aa, Deinococcus radiodurans R1
MNPVSSISYKKYFPASQFSSETIQSTLNLSMTSLQGELKWWQSGIIYQIYPRSYQDSNGDGVGDLPGITARLPYVASLGVQAVWLSPIFKSPMRDFGYDVADYCDIDPVFGTLEQFDALVAEAHRLGLKVMLDYVPNHTSSDHAWFQEALTGKASAKRDWYVWRDPAPDGGLPNNWKSFFGGPAWTLDEASGQYYLHQFLPSQPDLNWRNPDVRAAMFDVLRFWMRRGVDGFRVDVIWLLAEDERFLDEPENPDADREVVGGQIEHSTLLHIYTQDQPETHDYVREMRRVIDEFDDRMMVGEIYLPLDKLLPYSGTPEAPMVHLPFNFHLILLPWDAQTIRQFADEYDAASNAAGAWPNWVLGNHDQHRFKTRVGAAQYRVAQTLLLTLRGTPTVYYGDEIGMENVPVPPEKMVDPSGLQQPDSPDAGRDPERTPMQWEAAPGAGFTAAGTEPWLPLTDNFAQVNVQVQEQDSQSDLNYFRALTRLRQEQPALVGGSYRSLDSGHADVFAFERELNGERLTVWLNFRGEERAVAATGQTLLSSRGDQPAAQSPLRGHEARVVLG

SEQ ID NO: 32734 - DNA, 1659 bp, Deinococcus radiodurans R1
  CDS (1)..(1659)
atgacccaggcacacccggagtggtacaagagcgctgtcttctacgaactgtccgtgcggacctttcaggacggcaacggcgacggcaagggcgattttcccggcctgacctcgcggctggactacctgaaaaacctcggcgtggactgcctgtggttgctgccctggtttcccagcccactgcgcgacgacgggtacgacgtggccgactaccgggggattcaccctgacctcggcacgctcgacgacttcaaggtctttctgcgcgaagcccacgcccggggcctgcgggtcatcggcgacctggtgaccaaccacacgtccagcgaccacccctggtttcaggcggcgcggcgcggcccgaccctgcccgacggctcgcccaacgagtaccacgactactacgtctggagcgacgagggcaaggaatacgccgacacccgcatcatcttcaccgacaccgaggtcagcaactggacgctcgacgagcaggcaggcaagtattactggcaccgctttttcgccagccagccggacctgaactacgacaacccgaaagtggtggaagaacttcacggcgccgcccgcttctggctcgacctcggcctcgacgggttccgggtggacgccgtgccctacctcatcgagcgcgagggcacgagctgcgagaatctgcccgaaacacacgagattctcaagggcttccgggcgatggtggaccgcgagtatccggggcggctgctgcttgccgaggcgaaccagtggcccgaggaagtcgtcgagtacttcggcaccgaagccgagcccgagttccacatgtgcttcaacttcccggtgatgccccggctgtacatgagcctgaaaagggaggacacctccagcatccgcgagatcatgggccgcctgccgaaaatcccgagtttcggccagtggtgcaccttcctgcgcaaccacgacgaactgacgctggaaatggtcaccgacgacgagcgcgccttcatgtatgccgcctacgcgcccgacgcccgcatgaaaatcaacgtgggcatccgccgtcgcctcgcgccgctgctcgacaacgaccggcgccgcatcgagctgctgaacactgtgctcctcgccctgcccggcagccccatcctgtactacggcgacgaaatcggcatgggcgacgacctcggcctgcccgaccgcaacggcgtgcgcaccccgatgcagtggaacgcgggcaccagcggcggtttttccactgcgcagccctccgactgctttttcccgccgattcaggacccggtgtacggcttcgggcgcgtcaacgtgcagagccagctccaagaccccagcagcctgctgaagtggaccgcccggcaactcgaactgcgccgcgcccaccccgcctttgcgcacggcgacctcaccttcatcgaaaccggcaaccccgccatcctcgcctttacccgccagtacgacggcgaaacgctgctcatcgtcagcaacttcgcgggcaacgcccaggccgggctgctcgatctcgcgcccttcgtgggccgcgccccggtcacactttccggggccagcccgctgccggtggtcactggaaacggccagtacccggtggtgatgggcaagtacgactattactggctgcggttgaattga

SEQ ID NO: 32735 - protein, 552 aa, Deinococcus radiodurans R1
MTQAHPEWYKSAVFYELSVRTFQDGNGDGKGDFPGLTSRLDYLKNLGVDCLWLLPWFPSPLRDDGYDVADYRGIHPDLGTLDDFKVFLREAHARGLRVIGDLVTNHTSSDHPWFQAARRGPTLPDGSPNEYHDYYVWSDEGKEYADTRIIFTDTEVSNWTLDEQAGKYYWHRFFASQPDLNYDNPKVVEELHGAARFWLDLGLDGFRVDAVPYLIEREGTSCENLPETHEILKGFRAMVDREYPGRLLLAEANQWPEEVVEYFGTEAEPEFHMCFNFPVMPRLYMSLKREDTSSIREIMGRLPKIPSFGQWCTFLRNHDELTLEMVTDDERAFMYAAYAPDARMKINVGIRRRLAPLLDNDRRRIELLNTVLLALPGSPILYYGDEIGMGDDLGLPDRNGVRTPMQWNAGTSGGFSTAQPSDCFFPPIQDPVYGFGRVNVQSQLQDPSSLLKWTARQLELRRAHPAFAHGDLTFIETGNPAILAFTRQYDGETLLIVSNFAGNAQAGLLDLAPFVGRAPVTLSGASPLPVVTGNGQYPVVMGKYDYYWLRLN

SEQ ID NO: 32736 - DNA, 1635 bp, Mycoplasma pulmonis UAB CTIP
  CDS (1)..(1635)
ttgaaaaataaagaattatgatgaagaacaggctcgatttatcaagtttatgtgcgttcatttaaagattcaaacaatgatggaaatggtgacattaatggattaatttctaagctagattatcttcattgattaggtataaaagcaatatgaattaacccaatagcaaaatcaccaatggtagacaatggctatgatgtctcagattacaaagacattgatcctttgtttgggactatgagtgattttgaaaatttaattgaaaaagctcatagtaaaaatatcaaaataatttgagattttccattaaatcacacatcaagtgaacacccttgatttaaacaagctcttaaaggaaatccaaaatatttaaaatattattattttacaaaaacatacaaattaaatagagattctgtttttggtggatctttttgaacaaagacttcaaatggttattactatgctcatgtttttgcaaaagagcaaccatgtctaaattgatttaatcaagatgtagttgatgaatttgttgaaataattaacttttgattagataaaggagtagatggttttcgttttgatgcctttgatgaaataggtaagcccactgatctttttacaagagaaaacttctatgaacatgacaaaaaatttgttatagaaaagtttaaagagcttcgtcaaaaaacatgaaaagatgataatgaaattatgagtgtttctgaatcatgggcgatgaattccaaagatgtaaatgaaaatacaaacttagaaaacaaagcttatagtttaacttttaattttgatcatatgattagtgaatttgaatatgtcgatggtaaaaaaacatgaaaaggctttgattttattaagttcaaaaaaatcatcgcacaatgacaaaaagatgtaagcaatggttgaaatagtctttattttaataaccatgatcaaccaagagctatttcaagatttttacatgatcaagttgattttcttgatcaaaaagccaaagcttttgcccttacattacatggactaaaaggcactccttttatctatcaaggtgaagaaataggaatggataattcagatcatacaaatgacatttctaaaatcaatgatgtcaatgatcttagaacttatgagtatcatgttcttaagcaaaaaataatgactcataatgattttatgaagcttagttccatcttttcaagagacaatgcaagaactccaattccttgaaattcaaaaggaggctttaatgactcaggcaagtcttgacttccatataacaaaagctttaaaacaataaatgttgaagatcaaattgatcaagaaaattcagttttaagttgatataaaaaagttattgatcttagaaataatccaaaaataagatcaacaattattcaaggtgattttgaattaattgccgatgaagatcctaacatttttgcatacaaaagaaaagatgattttcaggaacttgtctttgtaattaactgatctcaaaagttaattgacaataatttaaatttaaaaaattatgaagtatttttaaataattatccaacttatcaaagttcaaaattacttccatgacaagctttgattttaataagaaagagctag

SEQ ID NO: 32737 - protein, 544 aa, Mycoplasma pulmonis UAB CTIP
MKNKELWWRTGSIYQVYVRSFKDSNNDGNGDINGLISKLDYLHWLGIKAIWINPIAKSPMVDNGYDVSDYKDIDPLFGTMSDFENLIEKAHSKNIKIIWDFPLNHTSSEHPWFKQALKGNPKYLKYYYFTKTYKLNRDSVFGGSFWTKTSNGYYYAHVFAKEQPCLNWFNQDVVDEFVEIINFWLDKGVDGFRFDAFDEIGKPTDLFTRENFYEHDKKFVIEKFKELRQKTWKDDNEIMSVSESWAMNSKDVNENTNLENKAYSLTFNFDHMISEFEYVDGKKTWKGFDFIKFKKIIAQWQKDVSNGWNSLYFNNHDQPRAISRFLHDQVDFLDQKAKAFALTLHGLKGTPFIYQGEEIGMDNSDHTNDISKINDVNDLRTYEYHVLKQKIMTHNDFMKLSSIFSRDNARTPIPWNSKGGFNDSGKSWLPYNKSFKTINVEDQIDQENSVLSWYKKVIDLRNNPKIRSTIIQGDFELIADEDPNIFAYKRKDDFQELVFVINWSQKLIDNNLNLKNYEVFLNNYPTYQSSKLLPWQALILIRKS

SEQ ID NO: 32738 - DNA, 1806 bp, Mycobacterium tuberculosis CDC1551
  CDS (1)..(1806)
atgaacgaggcagaacacagcgtcgagcaccctcccgtgcagggcagtcacgtcgaaggcggtgtggtcgagcatccggatgccaaggacttcggcagcgccgccgccctgcccgccgatccgacctggtttaagcacgccgtcttctacgaggtgctggtccgggcgttcttcgacgccagcgcggacggttccggcgatctgcgtggactcatcgatcgcctcgactacctgcagtggcttggcatcgactgcatctggttgccgccgttctacgactcgccgctgcgcgacggcggttacgacattcgcgacttctacaaggtgctgcccgaattcggcaccgtcgacgatttcgtcgccctggtcgacgccgctcaccggcgaggtatccgcatcatcaccgacctggtgatgaatcacacctcggagtcgcacccctggtttcaggagtcccgccgcgacccagacggaccgtacggtgactattacgtgtggagcgacaccagcgagcgctacaccgacgcccggatcatcttcgtcgacaccgaagagtcgaactggtcattcgatcctgtccgccgacagttctactggcaccgattcttctcccaccaaccggatctgaactacgacaaccccgccgtgcaagaggcgatgatcgacgtcatccgcttttggctcggcttgggcatcgacgggtttcggttggacgcggtgccctatctctttgaacgtgagggcaccaactgcgagaacctgccggaaacacacgcttttctcaagcgagtccgcaaggtggtggacgacgaattccccggccgggtgctgctagccgaagccaatcagtggccgggcgatgtcgtcgaatatttcggtgatcccaacaccggtggcgacgagtgccacatggcctttcacttcccgctgatgccgcgcatcttcatggccgtgcgccgggagtcccgttttccgatctcggagatcatcgcccagaccccaccaatccctgacatggcgcaatgggggatatttctgcgcaaccacgacgagctgacgttagaaatggtcaccgacgaagagcgcgactacatgtacgccgagtacgccaaggatccacggatgaaggcgaatgtcggaatccgtcgtcggcttgcgccgctgctcgacaacgaccgcaaccagatcgagctgttcaccgcgctgctgctgtcgctgcccggctcgccggtcctctactacggcgacgagatcgggatgggcgacgtgatctggttgggtgatcgcgacggcgtgcgcatcccgatgcagtggacaccggaccgcaacgcgggtttctccaccgccaacccgggtcggctgtacctgccgcccagccaggacccggtttacgggtatcaggccgtcaacgtcgaggcgcaacgcgacacctcgacgtcgctgctcaacttcactcgcaccatgctggccgtgcgtcgccgacaccccgcgtttgcggtcggcgcattccaggaattgggcgggtccaacccgtcggtgctggcctacgtgcgtcaggtggccggcgatgacggcgacaccgtgctctgtgtcaacaacctgtcgcgattcccgcagcccatcgaattggacttgcagcaatggaccaactacacgccggtcgagctgaccgggcacgtggagtttccacgcatcggccaggtgccctatctgctgacgctgccaggacacgggttctactggttccagttgaccacacatgaggtgggggcacctcccacttgcgggggagagcggcgcctatga

SEQ ID NO: 32739 - protein, 601 aa, Mycobacterium tuberculosis CDC1551
MNEAEHSVEHPPVQGSHVEGGVVEHPDAKDFGSAAALPADPTWFKHAVFYEVLVRAFFDASADGSGDLRGLIDRLDYLQWLGIDCIWLPPFYDSPLRDGGYDIRDFYKVLPEFGTVDDFVALVDAAHRRGIRIITDLVMNHTSESHPWFQESRRDPDGPYGDYYVWSDTSERYTDARIIFVDTEESNWSFDPVRRQFYWHRFFSHQPDLNYDNPAVQEAMIDVIRFWLGLGIDGFRLDAVPYLFEREGTNCENLPETHAFLKRVRKVVDDEFPGRVLLAEANQWPGDVVEYFGDPNTGGDECHMAFHFPLMPRIFMAVRRESRFPISEIIAQTPPIPDMAQWGIFLRNHDELTLEMVTDEERDYMYAEYAKDPRMKANVGIRRRLAPLLDNDRNQIELFTALLLSLPGSPVLYYGDEIGMGDVIWLGDRDGVRIPMQWTPDRNAGFSTANPGRLYLPPSQDPVYGYQAVNVEAQRDTSTSLLNFTRTMLAVRRRHPAFAVGAFQELGGSNPSVLAYVRQVAGDDGDTVLCVNNLSRFPQPIELDLQQWTNYTPVELTGHVEFPRIGQVPYLLTLPGHGFYWFQLTTHEVGAPPTCGGERRL

SEQ ID NO: 32740 - DNA, 1641 bp, Mycobacterium tuberculosis CDC1551
  CDS (1)..(1641)
atggaccaacaccagcgaccggatccaatgggccccggctctcctcgcgccagcgctcgtcgaccggagccagatccgatgggcgagccgtggtggtcgcgagccgtgttctaccaggtctatccccgatcgttcgccgacagcaacggcgacggggtgggcgacctggacgggttggcgagccggcttgaccacctgcaacagctcggtgtcgacgcgatctggatcaacccggtcaccgtctcgccgatggcagaccacggatacgacgtcgccgatccccgcgacatcgacccactcttcggcgggatgccggcgttcgaacggttggtcgctgcggcacaccggcagggcatcaaagtcaccacggacgtggtgcccaaccacaccagttcggcgcacccatggtttcaggccgcgctggctgacctcccgggtagcccggcgcgggatcgctatttctttcgcgacgggcggggccccgacgggtcgctgccgccgaacaactgggagtcggtgttcggcgggccggcctggacccgagtgcgcgaaccggacggcaacccgggccagtggtacctgcaccttttcgacaccgaacagccggacctgaactgggacaacccggaaatccttgacgacttcgagaaaacactgcgcttctggctggaccgcggcgtggatggcttccgcatcgacgtggcgcacggcatggccaagcccccgggcctgccggactcaccggacctgggcatcgaggtgctgcaccaccgcgatgacgacccgcgcttcaaccacccgaatgtgcacgcgattcaccgcgacatccgcacggtgatcgacgagtaccccggagcggtaaccgtcggcgaggtgtgggtacacgacaacgcccgctgggcggagtatctgcggcccgacgaactgcatctcggcttcaatttccggctggcgcgaaccgagttcgacgccgccgagatccgcgacgcggtggcgaactccctggccgccgcggcgctgcagaacgcgaccccaacctggacgctggccaatcacgatgtgggacgggaggttagccgctacggcggcggcgagatcgggctgcgccgggccaaggcgatggcggtggtgatgctcgccctgccgggcgtggtcttcctctacaacggccaggaactgggtttgcccgacgtggacctgcccgacgaggtgctgcaggatccgacgtgggaacgctcgggacgcaccgaacgcggtcgcgatggctgccgggtgccgattccctggtcgggcaacattcccccgttcgggttctcgacgtgtccagacacctggttgccgatgccgccggaatgggcggcgctgaccgccgaaaaacaacgcgctgatgccggctcgaccttgtcgttttttcgacttgcactcagattacgtagggaacgaaatgaattcgacggcgacgtcgactggctggccgcgcccgacgatgcgctgatattccggcgtcacggcgggggtttggtgtgcgcgctcaacgccgctgagcgtccgctggcgctgccggcaggtgaacccatcctggccagcgcaccgttgaccgacgccacgttgccacccaatgccgcggcctggctggtgtag

SEQ ID NO: 32741 - protein, 546 aa, Mycobacterium tuberculosis CDC1551
MDQHQRPDPMGPGSPRASARRPEPDPMGEPWWSRAVFYQVYPRSFADSNGDGVGDLDGLASRLDHLQQLGVDAIWINPVTVSPMADHGYDVADPRDIDPLFGGMPAFERLVAAAHRQGIKVTTDVVPNHTSSAHPWFQAALADLPGSPARDRYFFRDGRGPDGSLPPNNWESVFGGPAWTRVREPDGNPGQWYLHLFDTEQPDLNWDNPEILDDFEKTLRFWLDRGVDGFRIDVAHGMAKPPGLPDSPDLGIEVLHHRDDDPRFNHPNVHAIHRDIRTVIDEYPGAVTVGEVWVHDNARWAEYLRPDELHLGFNFRLARTEFDAAEIRDAVANSLAAAALQNATPTWTLANHDVGREVSRYGGGEIGLRRAKAMAVVMLALPGVVFLYNGQELGLPDVDLPDEVLQDPTWERSGRTERGRDGCRVPIPWSGNIPPFGFSTCPDTWLPMPPEWAALTAEKQRADAGSTLSFFRLALRLRRERNEFDGDVDWLAAPDDALIFRRHGGGLVCALNAAERPLALPAGEPILASAPLTDATLPPNAAAWLV

SEQ ID NO: 32742 - DNA, 1743 bp, Agrobacterium tumefaciens str. C58
  CDS (1)..(1743)
gtgcatgtgcgaagttccggtttacgcgggcgcaagggctttatattctcccggcgtgacaccctcaggagatcgccgatgacgctaccccatgccccggtccacaaacctcaagcgcaatcggactggtggaaaggagcggtgatctatcaggtctatccgcgctcgtttcaggatacgaccggcgacggatatggcgatctggccggggtgacgaaacgtctgccctatatcgcctcactcggtgtcgatgccatctggctctcacccttcttcacctcgcccatggccgatatgggttatgacgtttccgattattgcaatgtcgatccaatgttcggcacgctcgccgatttcgacgccctgatggccgaggcgcaccggctggggctgaaagtcatcatcgatcaggtgatttcgcatacgtctgacaaacatccgtggttcgtggacagccgcgcgagccgtatcaacagcaaggcggactggtatgtctgggccaatcccaaaccggatggcacggcacccaccaactggctttccgtgttcggcgggccggcctgggagtgggacggggtgcggaagcaatattatatgcacagcttcctcgcctcgcagccggacctgaatttccacaatcccgaggttcaggatgcggtgctggaaaccgtgcgtttctggctcgatcgtggcgtggacggttttcggctcgataccgtcaaccactatttccatgacaagcttttgcgcgacaacccgccgcttgttgacgacgaaagttttggcctcgatgcgtccgacgtcaatccctatggcatgcaggaccatctctacgacaagacacggccggaaaacgtggctttcctcaagcgctttcgtgcgctgctcgacgactatgagggccgcgccacggtgggtgaggtgggggatggggctcgctccctgaaaacggtcgcggcctatacatccggcaatgacaaactcaacatgtgttacacattcgatctgctgggaccggatttcagtgcaaaacacctgcgcggctcggtcgagacattcggcaaggtggtgacggatggctgggtgtgctgggccttttccaaccatgatgtggtgcgccatctcagccggttttccgaaggccccgaggagcagacgcgcgttgcgaaactcgccatctgtgttctcgccagcctgcgtggctccatatgtctctatcagggcgaggagctggggctgacagaggccgaacttgccttcgaggatctgcgtgatccctatggcattcgtttctggcccgccttcaaggggcgcgacggatgccgcacaccgatggtgtgggaaacgggcaagccgaatgccgggttctcaactgccgaaaagccttggctgccggtgccctacgtgcatgccatgcaggccgtggatgcgcaggagcgcaagccggattcggttctcaaccattatcgggccgtcctgtccttccgcaaaacccatggtgcgctgcgcgacggcgacatgcatttcatcaagaccaatctcgatgtgctggccttcacccggcagaggggtgatgaaaaactgctgttcgttttcaacctgacccgtgagccggtggaatttcccgtgccaaaggccatgagtgttacggatatcctgcagatgccgggttttgcgccgctctatgatgctggcatcgtgaagctcgaggggctggatgtattttgcgggatcgttgcatga

SEQ ID NO: 32743 - protein, 580 aa, Agrobacterium tumefaciens str. C58
MHVRSSGLRGRKGFIFSRRDTLRRSPMTLPHAPVHKPQAQSDWWKGAVIYQVYPRSFQDTTGDGYGDLAGVTKRLPYIASLGVDAIWLSPFFTSPMADMGYDVSDYCNVDPMFGTLADFDALMAEAHRLGLKVIIDQVISHTSDKHPWFVDSRASRINSKADWYVWANPKPDGTAPTNWLSVFGGPAWEWDGVRKQYYMHSFLASQPDLNFHNPEVQDAVLETVRFWLDRGVDGFRLDTVNHYFHDKLLRDNPPLVDDESFGLDASDVNPYGMQDHLYDKTRPENVAFLKRFRALLDDYEGRATVGEVGDGARSLKTVAAYTSGNDKLNMCYTFDLLGPDFSAKHLRGSVETFGKVVTDGWVCWAFSNHDVVRHLSRFSEGPEEQTRVAKLAICVLASLRGSICLYQGEELGLTEAELAFEDLRDPYGIRFWPAFKGRDGCRTPMVWETGKPNAGFSTAEKPWLPVPYVHAMQAVDAQERKPDSVLNHYRAVLSFRKTHGALRDGDMHFIKTNLDVLAFTRQRGDEKLLFVFNLTREPVEFPVPKAMSVTDILQMPGFAPLYDAGIVKLEGLDVFCGIVA

SEQ ID NO: 32744 - DNA, 1641 bp, Staphylococcus aureus subsp. aureus Mu50
  CDS (1)..(1641)
gtgtcgaaagaaatagattggagaaaatccgttgtatatcaaatttatcctaagtcgtttaatgatacgacggggaatggtataggagatatcaacggaattatagaaaaattggattatatcaagttattgggtgttgattatatttggttaacaccagtgtatgaatcacctatgaatgataatggctatgatatcagcaattatttagaaatcaatgaagcctttggaacgatggatgattttgaaaagttaatcaaagttgctcatcaaaaagacttgaaagtgatgttagatattgttattaatcatacgtcgacggagcatgaatggtttaaagaagcccgtaaatctaaagataacccttatagagattattactttttcagatcatctgaagacgggccgccaacaaattggcattctaaattcggtggtaatgcatggaagtatgattctgagacagatgaatattatttacatttatttgatgtcagtcaagctgatttaaattgggataatccggaagtacgtcaatcgttatatcgcatagtcaatcattggatagacttcggcgttgatggttttcgatttgatgtcattaacttaatttctaaaggtgaatttaaggactctgacaaaataggtaaagaattttatacggatggtcctagagtgcatgagtttctgcatgaattaaatcgtcaaacgtttggtaacactgacatgatgactgtaggagaaatgtcttcgacgacgattgaaaattgtattaagtatacacaaccagaacgccaagaattgaatagtgtttttaattttcatcatctaaaggttgattatgttgatggtgaaaagtggacaaatgcgaagcttgattttcataagttaaaggaaattctgatgcaatggcaacgaggtatttatgacggtggcggatggaacgcgattttctggtgtaatcatgatcagccacgggtagtgtctagatttggtgatgatacgtcggaagagatgaggatacaaagtgctaaaatgttagctatcgcactgcatatgttgcaagggacgccatatatttaccaaggtgaagaaattggtatgacggacccacattttacatcaatagcacaatatcgtgatgttgaatcgattaatgcctaccatcagttgctaagtgaagggcatgctgaagcggatgtattagcgattttaggacagaagtcacgagacaattcgagaacgcctatgcaatggagtgatgatgttaatgctggatttacagctggtaagccttggattgatatttcggaaaattatcatcaggtcaacgttagacaagcacttcagaataaagagtctattttctatacgtatcaaaaattaatacaattaagacatacgcatgatattattacgtatggagacattgtgccacgttttatggatcatgatcatttatttgtttatgaacgtcattataagaatcaacaatggctagtaattgcgaatttctcagcatcggctgttgatttgccagaaggattggctagagaaggttgtgttgtgattcaaacaggcacagtggaaaataatacgataagcgggtttggtgcaattgtaatcgaaacaaacgcgtaa

SEQ ID NO: 32745 - protein, 546 aa, Staphylococcus aureus subsp. aureus Mu50
MSKEIDWRKSVVYQIYPKSFNDTTGNGIGDINGIIEKLDYIKLLGVDYIWLTPVYESPMNDNGYDISNYLEINEAFGTMDDFEKLIKVAHQKDLKVMLDIVINHTSTEHEWFKEARKSKDNPYRDYYFFRSSEDGPPTNWHSKFGGNAWKYDSETDEYYLHLFDVSQADLNWDNPEVRQSLYRIVNHWIDFGVDGFRFDVINLISKGEFKDSDKIGKEFYTDGPRVHEFLHELNRQTFGNTDMMTVGEMSSTTIENCIKYTQPERQELNSVFNFHHLKVDYVDGEKWTNAKLDFHKLKEILMQWQRGIYDGGGWNAIFWCNHDQPRVVSRFGDDTSEEMRIQSAKMLAIALHMLQGTPYIYQGEEIGMTDPHFTSIAQYRDVESINAYHQLLSEGHAEADVLAILGQKSRDNSRTPMQWSDDVNAGFTAGKPWIDISENYHQVNVRQALQNKESIFYTYQKLIQLRHTHDIITYGDIVPRFMDHDHLFVYERHYKNQQWLVIANFSASAVDLPEGLAREGCVVIQTGTVENNTISGFGAIVIETNA

SEQ ID NO: 32746 - DNA, 1644 bp, Sinorhizobium meliloti 1021
  CDS (1)..(1644)
atgccggcggcatcgggatctgacgaaaactggtggcgcggagcggtgatctatcaggtctatccgcgatccttccaggacacggacggcgacggaatgggcgaccttcgcggcgtcacccgccggcttccccatatcgcctcgctcggggtcgatgccatctggctttcgcccttcttcacctcgccccaggcggatatgggctatgacgtttcggattattgcgacgtcgatcccatgttcggcacgctcgccgatttcgacgagatgctggcggaagcccatcggctggggctcaaggtgatcatcgaccaagtgatctcgcatacatccgaccggcatccctggttcgtcgaaagccgctcgagcaggaccaatgccaaggcggattggtatgtgtgggccgacccgaagccggacggaacggcgccgaacaactggctttcgatcttcggcggtccgggctgggaatgggacggggtgcgccggcagtactacctgcacaatttcctctcctcgcagccggacctcaacttccacaacccggaggttcaggaggcggtgctcgcgacggtccgcttctggctcgaccgcggcgtcgacggtttcaggctcgatacggcgaatttctatttccacgaccggcttctgcgggacaacccgccgctggtgccggatccggacgcgacgagccgcgatgcgccggaggtcaatccgtacggaatgcaggaccacctatatgacaagacgcagccggaaaacctcgatttcctgcgccggtttcgggcggtgctcgatgaatatggcggccgcgcgacagtgggggaggtcggggacgggtcacgctcgctgcagacggttgccgcctatacgagcggcggcgacaagctgcatatgtgctataccttcgacctgctcggaccggaattcaccgcgcgccacttccgccgctgcgtcgagaatttccagtcgacggtgacggacggctgggtctgctgggccttttccaatcacgacgtgatgcgtcatgtcagccgcttcgcgctgcgcgaggccgaccgggagcgcgtggcgaagcttgcgatttcgctgcttgccagcctgcggggcaccatctgcctttatcagggagaggagctcggcctgccggaggcggagcttgccttcgaagaattgcgcgacccatacggcatccgcttctggccggccttcgccggacgtgacgggtgccggacgccgatggtctgggaaagagaactgtcgaatgccggcttttccgccggaaccccctggctgccggttcgcgatgggcaccggatgctggcggtggacgcgcaggagggcgtggaaggggcggtgctcgagcactatcgccagacccttgggttccgtcgggcgcagtccgcgctggtcgacggagacatggtcttcctgggcaccaaccaggaccttctggtcttcacgcgggaaaaggacgatgagcggctgctgttcgtcttcaatctgacccaggagccgcagacgtttcacctcccggcgacgctcgtcgccgagccgcatccgatgcccggttttgcaccggttttcgctgacaatgcgataaagctcgccgcgctcgacgttttctgcgggaggttgcgttag

SEQ ID NO: 32747 - protein, 547 aa, Sinorhizobium meliloti 1021
MPAASGSDENWWRGAVIYQVYPRSFQDTDGDGMGDLRGVTRRLPHIASLGVDAIWLSPFFTSPQADMGYDVSDYCDVDPMFGTLADFDEMLAEAHRLGLKVIIDQVISHTSDRHPWFVESRSSRTNAKADWYVWADPKPDGTAPNNWLSIFGGPGWEWDGVRRQYYLHNFLSSQPDLNFHNPEVQEAVLATVRFWLDRGVDGFRLDTANFYFHDRLLRDNPPLVPDPDATSRDAPEVNPYGMQDHLYDKTQPENLDFLRRFRAVLDEYGGRATVGEVGDGSRSLQTVAAYTSGGDKLHMCYTFDLLGPEFTARHFRRCVENFQSTVTDGWVCWAFSNHDVMRHVSRFALREADRERVAKLAISLLASLRGTICLYQGEELGLPEAELAFEELRDPYGIRFWPAFAGRDGCRTPMVWERELSNAGFSAGTPWLPVRDGHRMLAVDAQEGVEGAVLEHYRQTLGFRRAQSALVDGDMVFLGTNQDLLVFTREKDDERLLFVFNLTQEPQTFHLPATLVAEPHPMPGFAPVFADNAIKLAALDVFCGRLR

SEQ ID NO: 32748 - DNA, 1686 bp, Bacillus subtilis subsp. subtilis str. 168
  CDS (1)..(1686)
atgaaaacagactggtggaaggatgcagtggtgtaccaaatttacccgagaagctttcaggacagcaatggagacggaattggggacttgcgggggattatttcccgtcttgactacataaaggagctcggggcagatgtgatttggatttgcccgatctatccttctccgaatgttgattacggctatgatgtgacaaaccataaggcgattatggattcttacggaacaatggacgattttcacgagctgctggaccaggtgcatcagcggggattaaagctggtgatggactttgtgttaaatcacacctcggtcgagcatccgtggtttaaagaagcggagctggacaaaaacagcaaataccgtagctattattattggcgtcccggcacaaagaacggcccgccgacggactggctctcaaactatggatgcccggtctggcaatacgaagagcacaccggagaatactatctccatatgaatgccgtcaaacaagctgatttaaactgggaaaatcccgaagttcgccaggcggtgtatgacatgatgaaattttggctcgataaaggggtcgacggtttgcgaattgatcagctccatctcatttctaagaaagaatatcttccttcgtatgaggactatatcaatcagcaggcagagccgaagccctttcagccaaatggcgaacgaatccatgactatttaaaagaaatcacagatgaagtgttttctcattatgatgtcatgtctgtcggagaggtcggcagtgtcacaccggaagaaggcctgaaatatacgggaacagataagcatgagctgaatatgatttttcactttcagcatatggagcttgatcagcagcccggaaaagaacattgggatttgaagccccttgagctttctgatttaaaatcggttttgacaaaatggcaaaagaagcttgaacatcaaggctggaatacattgttttggtgcaaccacgaccagccccggattgtgtccagattcggagacgatggggaataccgcaaagcatcagcgaaaatgctggcagccgtaatttattttatgaagggcacgccgtatatttatcagggagaagaaatcgggatgacaaacgcgccgttcacccggattgaagactacaaagatatccaaacgatcaatatgtatcataaacgggtgtttgaaaaaggctatgatccaaatgatgtgatgagatcgatcttagccaaaagccgggatcacgcccggaccccgatgcagtggaacagcggcaaaaatgccggatttactgacggcacgccttggctgaaggtcaatccgaacttcaccgcaatcaatgtggaggaagcgcagggagatcctgattctgtcttaaactattacaaaaagctgatcagcctgagaaagcagtacgctgacctcatgaaagggagctttgatcttttgcttccggacgatccgcagttgtttgtatacatgagagaaaacagtaaacaacagcttttgtcggtcaataatttttcaaaagagcaggctgtttttcagtggcctaagaactgcggcaaagctcaggcctcactgcttctcagcaattataacaacgatgatcttgatgacgaaatggtgttccggccttatgagagcagggtctatcttctggacaaaacaaactaa

SEQ ID NO: 32749 - protein, 561 aa, Bacillus subtilis subsp. subtilis str. 168
MKTDWWKDAVVYQIYPRSFQDSNGDGIGDLRGIISRLDYIKELGADVIWICPIYPSPNVDYGYDVTNHKAIMDSYGTMDDFHELLDQVHQRGLKLVMDFVLNHTSVEHPWFKEAELDKNSKYRSYYYWRPGTKNGPPTDWLSNYGCPVWQYEEHTGEYYLHMNAVKQADLNWENPEVRQAVYDMMKFWLDKGVDGLRIDQLHLISKKEYLPSYEDYINQQAEPKPFQPNGERIHDYLKEITDEVFSHYDVMSVGEVGSVTPEEGLKYTGTDKHELNMIFHFQHMELDQQPGKEHWDLKPLELSDLKSVLTKWQKKLEHQGWNTLFWCNHDQPRIVSRFGDDGEYRKASAKMLAAVIYFMKGTPYIYQGEEIGMTNAPFTRIEDYKDIQTINMYHKRVFEKGYDPNDVMRSILAKSRDHARTPMQWNSGKNAGFTDGTPWLKVNPNFTAINVEEAQGDPDSVLNYYKKLISLRKQYADLMKGSFDLLLPDDPQLFVYMRENSKQQLLSVNNFSKEQAVFQWPKNCGKAQASLLLSNYNNDDLDDEMVFRPYESRVYLLDKTN

SEQ ID NO: 32750 - DNA, 1665 bp, Bacillus subtilis subsp. subtilis str. 168
  CDS (1)..(1665)
atgaaaaaggcttggtggaaggaagccgtagtttaccaaatttacccccgcagttttaaagattcaaatggcgacggaatcggggatattcaaggaatcagaaccaagctttcttacataaaagagctgggcgctgacgtcatatggatttgcccgctgtatgattcaccgaatgccgataatggctatgatatcagggattatcaaaacatattaagcgagtttggcacgatggaagattttgatgagctgcttggtgacattcatgatctggatatgaagctgattatggatctcgttgtgaaccacacaagcgacgaacatccatggttcatagaatcccgttcatccatacactcggaaaagcgcgactggtatatttggaaagacggcaaaaacggaaaaacgcccaacaattgggaaagcattttcggcgggccggcttgggagtatgatcaaaagacaagccagtattatctgcacctttttgataaaaaacagcctgatttgaattgggaaaatgaaaaggtgaggaatgccgtttatgacatgatcaattggtggcttgataaaggaattgacggatttcgggtggatgccattacgcatattaagaaaaaagaagggtttcctgacatgccgaatccaaagggactggactatgtcccttcctttccttatcatatgaatgctgacggcattatggatttgttaacagagctgaaggaaaacacattttcccgctatccgattatgacagttggtgaagcaaacggcgtcgctccaaaagaagcagctgattgggctggagaaaaaaacggcatattcagcatgatttttcaatttgagcatctcggcctgtgggatgtagagatcaatgaaagtattgatatcgttgcatttaaacgaattttaactgactggcaggacagtctggaagggatcggctggaatgctttgtttatggagaatcacgaccagccccgttcagtttctgtgtggggagacgacggagtgtacctgaaagaaagtgcaaaagcgctttccgctgtttattttctcatgaaaggcacaccgtttatttatcagggacaggaactcgggatgacgaacgtggcttttccatctattgaggactatgatgatgtcgcattgaaacgcctgtatgaaacaaaaacagcgaaaggcacatcacacgaggatgtgatgaagattgtctggaaaaagggaagagacaattcgcgaacgccgatgcaatggaatgctggtccatacgccggattttctgaggccaaaccgtggatcggaatcaatgagaattacaaatggctgaatgccgaggcgcaaaaaaacgataaaacatccgtttaccatttttacaaaagcttgatcaagctgcgccaaacatatgatgtttttattaacgggacatacgagctcattttaccggaagatcagcaaatctttgcatatcttcggaaaaacgagagccatactgcactgattgcggccaatctgacaggaacaccggcgttgttcaggcactctggattgccattgtcatcagatgcactcgtcttgtcaaatattgaaacagagccgcacaagcatatgacatcagtactcttaaagccgtatgaagcaagaatatatctatggtgctaa

SEQ ID NO: 32751 - protein, 554 aa, Bacillus subtilis subsp. subtilis str. 168
MKKAWWKEAVVYQIYPRSFKDSNGDGIGDIQGIRTKLSYIKELGADVIWICPLYDSPNADNGYDIRDYQNILSEFGTMEDFDELLGDIHDLDMKLIMDLVVNHTSDEHPWFIESRSSIHSEKRDWYIWKDGKNGKTPNNWESIFGGPAWEYDQKTSQYYLHLFDKKQPDLNWENEKVRNAVYDMINWWLDKGIDGFRVDAITHIKKKEGFPDMPNPKGLDYVPSFPYHMNADGIMDLLTELKENTFSRYPIMTVGEANGVAPKEAADWAGEKNGIFSMIFQFEHLGLWDVEINESIDIVAFKRILTDWQDSLEGIGWNALFMENHDQPRSVSVWGDDGVYLKESAKALSAVYFLMKGTPFIYQGQELGMTNVAFPSIEDYDDVALKRLYETKTAKGTSHEDVMKIVWKKGRDNSRTPMQWNAGPYAGFSEAKPWIGINENYKWLNAEAQKNDKTSVYHFYKSLIKLRQTYDVFINGTYELILPEDQQIFAYLRKNESHTALIAANLTGTPALFRHSGLPLSSDALVLSNIETEPHKHMTSVLLKPYEARIYLWC

SEQ ID NO: 32752 - DNA, 1581 bp, Caulobacter crescentus CB15
  CDS (1)..(1581)
atgaacgccgaatggtggcgtggcgccgtcatctatcaggtctatccgcgcagcttcgccgactcgaacggcgacggcgtcggcgacttgccgggcatcaccgcccacctcgaccacatcgcctcgctgggcgtcgagggcgtgtggctgtcgccgtttttcacgtcgccgatgaaggacttcggttacgatgtctcgaactattgcgatgtggatccgatcttcgggaccctggccgatttcgacgcgctgatcgcgcgcgcccatgcgctgggcctgaagatcatcatcgatcttgtgttctcgcacacctcggacgagcacccgtggttcgtcgagagccggcaggaccggtccaacgcgaaggccgactggttcgtctgggccgacgccaagccggacggcagcccgcccagcaactggcagtcggtgttcggtggtcccgcctggacctgggacgcccggcgcggccagtactacatgcacaacttcctcagcagccaaccgcagctgaacctgcacaatcccgcagtccaggaagccctgctggccgtcactcagttctggatcgacaagggcgtggacggcttccgcttcgacgccatcaacttctcgatgcacgaccctgcgctgaccgataatccgcccctgccgccgggcggcaagcgcacgcggccgttcgacttccaggacaagatccacaaccagagccacgccgatattccgaagttcctcagccgcctgcgggcgctgaccgacgcggcgggcgggcgcttctcggtggcggaagtcggcggcgatcacgccgagcgcgagatgaagctgttcacggccggcgaagatcgcctgaacagcgcctatggctttctctatctctacgccgacaagctgatcggcgagatgatcccgcagggcgcggccatgtggccgggcgaggcgggcgagggctggccgtcctggaccttctccaaccacgacgcgccccgggcggtgtcgcgctgggccgaagggcgcgatcgcaaggccttcgccgagttgtgcctgctgctgctgatgggcctgcggggcaatgtgttcgtctaccagggcgaggaactgggcctgccccaggcccatgtgccgttcgagcggctgcaggaccctgaggccatcgccaactggccccagaccctgggccgcgacggggcccgcaccccgatgccgtgggtttcaggcgcattgaacgccggcttctctggcgtcgagccctggctgcccgtcgatccggaacatctgcctctggcggtcgacgcgcaggaggcagatccggcctcgacgctgaacgtcgcgcgtcgcctgatcggcctgcgtcgcgcctatccggccctgcgcaccggcgcgatcaccttcatcgacaccaacagcccgctgctgatcttccagcgcggcgaaggggcggacgcggtgctgctggcgttcaatctaggcttcgagacggtgacatggtcgctgcccgatggctggacgctgatcgacggcgtcaacctgggcggtgaggggcagatgccggtgtgcgcggggctgatcgcgcggcggggttag

SEQ ID NO: 32753 - protein, 526 aa, Caulobacter crescentus CB15
MNAEWWRGAVIYQVYPRSFADSNGDGVGDLPGITAHLDHIASLGVEGVWLSPFFTSPMKDFGYDVSNYCDVDPIFGTLADFDALIARAHALGLKIIIDLVFSHTSDEHPWFVESRQDRSNAKADWFVWADAKPDGSPPSNWQSVFGGPAWTWDARRGQYYMHNFLSSQPQLNLHNPAVQEALLAVTQFWIDKGVDGFRFDAINFSMHDPALTDNPPLPPGGKRTRPFDFQDKIHNQSHADIPKFLSRLRALTDAAGGRFSVAEVGGDHAEREMKLFTAGEDRLNSAYGFLYLYADKLIGEMIPQGAAMWPGEAGEGWPSWTFSNHDAPRAVSRWAEGRDRKAFAELCLLLLMGLRGNVFVYQGEELGLPQAHVPFERLQDPEAIANWPQTLGRDGARTPMPWVSGALNAGFSGVEPWLPVDPEHLPLAVDAQEADPASTLNVARRLIGLRRAYPALRTGAITFIDTNSPLLIFQRGEGADAVLLAFNLGFETVTWSLPDGWTLIDGVNLGGEGQMPVCAGLIARRG

SEQ ID NO: 32754 - DNA, 1635 bp, Sinorhizobium meliloti 1021
  CDS (1)..(1635)
atgaaagaggcgccgtggttctcgagctcggtcatctatggaatcgacgtgcgcagattttcggacggaaatggcgacgggatcggcgacttcataggtctcaaggagcgcgtgtcttatctgcactatctgggcatcgactgtgtctggctctcgccgttcttcaggtccccctttgccgataacggctacgacgtcagcgactattattccatcgatccggttctcggaacgctggacgacttcctggatttcctgcacgccgccggcgaacagggcattcgcgtcgtcgtcgatctcgtcgccaaccacacatccagcgagcatccgtggttccaggcggcgcggcgcgacgcgaggtgccgcttccgcgactattacgtctggtcggaaagcccgccgccggtcgctccggacaacaagacggcgtttcccggcgaggaaagcagtgtctggacctatgacgatctcgcccaggcctattacttccacaagttccgccatttccagccggacctgaacatcgccaacccggcggtgcgagacgaattgcttcgtgtagtcgactattggctgacattgggcgtcgacggattccgggtggatgccgcgccattcgtaatcggcgaaaccggcatagagcacgcggaccccagggacccccagggctttctcagggaaatgcgcaagctggtcgacgggaggcgccaggacggccttctgctcggcgaagcggacctggcgccggaaaagctgcggtcctatttcggcgacggaaagctcgaccttctgttcaacttcgtgttgtgtgcggctttcgccgcgagcctcgcggggcagaaggccgaccccatcggccaggcgctttcgatcatgccggagccgcctccccatcgcggctgggcgaacttccttcgcaatctcgacgaactgaacctcgatcgcctgccggaagacattcgagaggaaacctttgcagccttcgccccggatgaggagatgcggatctacggacgcggcatcaggcgccgcctcgcgccgatgctggacggaaaccgggcgagaatagaactcgccttcagtctgcttctgtcttccccgggcgtgccgctcattctctacggcgacgagatcggccttggcgaggacctttcccgaccggggcgggagccggtccgcgtgcccatgcagtggaatgcgggttccaatgccggcttctccaccgcccagcgcgccaaactcgtccagccgccggtgacagacggcccattctccttcaagcgggtcaatgtcgaagctcaacgtgaggacccggggtcgcttctgaaccgcgtgcgggcgatgatcctggcgcggcgccggcacgagctcttcaacaggggacgcccggtcatgctgcacaccggagacccggcgctgttcgcgctggcctattccgacggcaccgaactattcgtggtgctgcacaatctttcggacggcaagcggcgggcggagctcgaactgcccggcgcaatcgacgccaggctcaatgacattctcggcgagggtgaggtcgagctttccgggcagcgtctggcgatagggctcggtccgttcggctacgtctggcttcattcgggaaagaaggattga

SEQ ID NO: 32755 - protein, 544 aa, Sinorhizobium meliloti 1021
MKEAPWFSSSVIYGIDVRRFSDGNGDGIGDFIGLKERVSYLHYLGIDCVWLSPFFRSPFADNGYDVSDYYSIDPVLGTLDDFLDFLHAAGEQGIRVVVDLVANHTSSEHPWFQAARRDARCRFRDYYVWSESPPPVAPDNKTAFPGEESSVWTYDDLAQAYYFHKFRHFQPDLNIANPAVRDELLRVVDYWLTLGVDGFRVDAAPFVIGETGIEHADPRDPQGFLREMRKLVDGRRQDGLLLGEADLAPEKLRSYFGDGKLDLLFNFVLCAAFAASLAGQKADPIGQALSIMPEPPPHRGWANFLRNLDELNLDRLPEDIREETFAAFAPDEEMRIYGRGIRRRLAPMLDGNRARIELAFSLLLSSPGVPLILYGDEIGLGEDLSRPGREPVRVPMQWNAGSNAGFSTAQRAKLVQPPVTDGPFSFKRVNVEAQREDPGSLLNRVRAMILARRRHELFNRGRPVMLHTGDPALFALAYSDGTELFVVLHNLSDGKRRAELELPGAIDARLNDILGEGEVELSGQRLAIGLGPFGYVWLHSGKKD

SEQ ID NO: 32756 - DNA, 1653 bp, Salmonella typhimurium LT2
  CDS (1)..(1653)
atgactattcccctctggtggcaaaacggcgttatttatcagatctacccaaaaagttttcaggacacgaccggcagcggcaccggcgatttacgcggcgtcacgcagcgccttgactatctacagcgactcggcgtggacgccatctggctcacgccgttttatatctcgccgcaggtggataacggttatgacgtcgcaaattatacggctatcgacccgacctacggcacgctggatgattttgacgagctggtcgcgcaggcgaaagcacgcggtattcgtatcatcctggatatggtgtttaaccatacttctacccagcacgcctggtttcgcgaagcgctgaacaaagagagtccataccgtcagttttatatctggcgcgatggcacgccggatgtctgcccgaataactggcaatccaaatttggcggcagcgcctggcgctggcatagccagagcgaacaatattatttacaccttttcgcgcctgaacaggccgacctgaactgggaaaaccccgccgtacgcgccgagctgaaaaaggtctgcgaattctgggccgatcgcggcgtggatggcctgcgtctggacgtggtgaacctgatcgccaaagatcagaattttcctgacgatccgacgggcgatggacgccgcttttataccgacgggccgcgcgcgcatacgtttttacgcgaaatgaaccgtgacgtttttacgccgcgtaatctgatgacggtaggcgaaatgtcctctaccacgctggaaaactgccagcaatatgccgcgcttagcggcgacgaactctcgatgaccttcaattttcatcatctgaaggtggattaccccaatggcgaaaagtggacgctggcaaaacctgattatgtggcgctgaaagcgttgttccgccactggcaacaggggatgcataacgtcgcctggaacgcgttattctggtgtaatcacgatcagccgcgcatcgtttcccgctttggcgacgagggtgaataccgggttccagccgcgaaaatgttggcgatggcgctgcacggtatgcaagggacgccttatatctatcagggcgaagaaatcggcatgaccaacccacactttacccgcatcaccgattatcgcgacgtggaaagccataacatgtttgccgcgctacgcgccgccgggcgcgaccccgacgaactgctggctattctggccagtaaatcccgcgacaacagccgcacgccgatgcaatgggacaacggtaaaaacgccggtttcacccaaggcgagccgtggataagcctgtgcgataactatacggaggttaacgtcgaggcggcattacgcgatgaaaactcggtgttttacacctatcaaaagctgattgcgctacgtaaaacccagcctgtactgatctggggcgattatcaggatctcctcccggatagcccatcagtatggtgttatcgccgccagtggcaggggcaaatcctgctggttgtcgccaatctgagtaaccagtgccaggagtggcatccgccgcatatcaaaggacagtggcaggcgctactgcataattatggcgaggtcgccagccagccagccgcgatgacgctccgcccatttgaagccatctggtggttacaacgctaa

SEQ ID NO: 32757 - protein, 550 aa, Salmonella typhimurium LT2
MTIPLWWQNGVIYQIYPKSFQDTTGSGTGDLRGVTQRLDYLQRLGVDAIWLTPFYISPQVDNGYDVANYTAIDPTYGTLDDFDELVAQAKARGIRIILDMVFNHTSTQHAWFREALNKESPYRQFYIWRDGTPDVCPNNWQSKFGGSAWRWHSQSEQYYLHLFAPEQADLNWENPAVRAELKKVCEFWADRGVDGLRLDVVNLIAKDQNFPDDPTGDGRRFYTDGPRAHTFLREMNRDVFTPRNLMTVGEMSSTTLENCQQYAALSGDELSMTFNFHHLKVDYPNGEKWTLAKPDYVALKALFRHWQQGMHNVAWNALFWCNHDQPRIVSRFGDEGEYRVPAAKMLAMALHGMQGTPYIYQGEEIGMTNPHFTRITDYRDVESHNMFAALRAAGRDPDELLAILASKSRDNSRTPMQWDNGKNAGFTQGEPWISLCDNYTEVNVEAALRDENSVFYTYQKLIALRKTQPVLIWGDYQDLLPDSPSVWCYRRQWQGQILLVVANLSNQCQEWHPPHIKGQWQALLHNYGEVASQPAAMTLRPFEAIWWLQR

SEQ ID NO: 32758 - DNA, 1647 bp, Listeria monocytogenes EGD-e
  CDS (1)..(1647)
atgacaaagtttgctcaaaaaacaatttatcaagtgtatccgaaatccttttatgatacgactggcgatggtactggggatattcccggtatcactgccaagcttgattatttacaaaaactcggaattgagatgatttggctgaatccattttatccttctccgcaaaatgataacggctatgatatcgctgactataccgcggttgatcctttatttggtacgatggacgatgtgacaacgcttatcaaggaagcgaaaaaaagaaatattggtattatgattgacttagtattgaatcatacttcaacagagcatccttggtttaaaaaagcgcttgctggtgatccattctatcgtgatttttactatttccgcccagcaaaagccgatggttcccctccaacaaattgggtttccaaattcggtggtaatgcttgggaaaaattgcctgactcctctgagtactatttgcatttatacgatgttactcaagctgatttagactgggccaatccgaatgtacgcgaggcactctttgctgtcgtgaatttttggattgataaaggcgtggaaggttttcgtttagatgtattaaatgtgattgccaaacctaagtttttagaagatgattttgaaggcgacggccgccgtttttatacagatggaccaggaatacatgcttatttaaaagaactacatgaacgaacttttggcgacaagccaattataacggttggagaaatgtcctctacagatattgacaactgcattcgttatagtaatccagacgaaaaagaactatcgatggtttttcatttccatcatttgaaagtagactatcctgatggagaaaaatggcgtttagcggatgtgaatttcgagaacttaaaatctattttccatacgtggcaagtcgcgatgtcagatgaaaatggttgggatgcgcttttctggaacaaccatgaccaacctcgagcacttggtcgctttgcttccgacaagccggaacattattatcattctgctaccctacttggcgcaacgattcattttatgcgcggaacaccttttgtttatatgggggaagaaatcggtatgatgaatccaaaattccctacaattgatgattatgtggatgtggaaacgctcaaccattttgatattttacaaaaaaacggacttagtgagcaggaagtaatggagattattaaagaacgttcgcgcgataacagccgaactcctatgcaatgggacgattcgcaaaatgctggttttacgactgggactccttggctaaaagtggctgataatgcaaacgaaataaatgttcaaactgctttatctaataaaacgagcattttctatttttaccaaaaactaattgcacttcggaaagagcatcctgtcattcaaacgggtgattacacaccatatttgacggaagaagattctattatcgcctacaagcgttcaaacgaaactacttcccttctatccattcatcattttggttccgagaagaaaaaaattcaactgccaactgagtttttaaatgctgaagtacttctttctaattatgagcgccagagaatcagttctgaactggaattagcgccatatgaaacattaacattaatacaataa

SEQ ID NO: 32759 - protein, 548 aa, Listeria monocytogenes EGD-e
MTKFAQKTIYQVYPKSFYDTTGDGTGDIPGITAKLDYLQKLGIEMIWLNPFYPSPQNDNGYDIADYTAVDPLFGTMDDVTTLIKEAKKRNIGIMIDLVLNHTSTEHPWFKKALAGDPFYRDFYYFRPAKADGSPPTNWVSKFGGNAWEKLPDSSEYYLHLYDVTQADLDWANPNVREALFAVVNFWIDKGVEGFRLDVLNVIAKPKFLEDDFEGDGRRFYTDGPGIHAYLKELHERTFGDKPIITVGEMSSTDIDNCIRYSNPDEKELSMVFHFHHLKVDYPDGEKWRLADVNFENLKSIFHTWQVAMSDENGWDALFWNNHDQPRALGRFASDKPEHYYHSATLLGATIHFMRGTPFVYMGEEIGMMNPKFPTIDDYVDVETLNHFDILQKNGLSEQEVMEIIKERSRDNSRTPMQWDDSQNAGFTTGTPWLKVADNANEINVQTALSNKTSIFYFYQKLIALRKEHPVIQTGDYTPYLTEEDSIIAYKRSNETTSLLSIHHFGSEKKKIQLPTEFLNAEVLLSNYERQRISSELELAPYETLTLIQ

SEQ ID NO: 32760 - DNA, 1662 bp, Listeria innocua Clip11262
  CDS (1)..(1662)
atgaaagaaaaagactggtggaaaaaaagcgtagtttaccaaatctatccaaagagtttcaatgactcaaatggcgatggagtcggtgatattcaagggattattgagaaattagattatttaaaagagcttggcgtagacgttatctggctatctccggtgtatgattcgccgcaagatgacaatggatacgatattcgcgattaccaaaaaatttacgaagaatatggcgatatggcaacgtttgacaatctgttacaaggtttacatgatcgtgatatgaaactcgtaatggatttagttgttaaccacacttccgacgaacataaatggtttgaagaatctcggaaatccaaagacaacccttatcgtgattactatttctggcgtgaagaaaatgaaatcaacaactggggctcgattttcagtggtccagcatgggaattggacgagaaaacaggcgagtactacttacaccttttctctaaaaaacaaccagatttaaactgggaaaatcctaaattacgccaagatgtatataatatgatgaaattctggcttgataaaggtatcgatgggttccgcatggacgtaattaacttcatttccaaaaacacagctttcccagatggaccagttgcagaaggtcaaatttacggagatgcaggtaacgatttttgcaatggaccacgtattcatgagttcttgcaagagatgaaccaagaagtaacttccaaatatgatgtaatgactgttggcgaaatgccaggtgctagcacaactgacgcgcaaatttatacaaatccagcaaataatgaagtggatatgatttttacatttgaacatatgaacctagactccgatggtgataacaaatgggatctaaaaccaatttatttaccagatttaaaagaaaatatgtccgagtggcaagtagcgcttcaagaaaacggctggaacagtttatattggaacaatcatgaccaaccacgtattgtttctcgttttgggaatgataatcgtttccgcgttcgttcggcgaaaatgcttgcaacatgtctgcacatgatgaaaggaacaccgtacatttatcaaggtgaagaaatcgggatgactaatgttcattttgaaacgctggaagaatatcgagatatagaaacattaaacatgtataaagaacgtaaagagcaaggacacagccacgaaagcattatgcagtctatttacactaaaggacgcgacaacgcaagaacaccataccagtgggataatagcgaaaatgctggcttcacaaccggaacgccgtggcttaaagttaacccgcgttatacagaaatcaacaacgaagaagcgctgaaaaatccagattcgattttctactactaccaaaacctaattaagttacgcaaaacaacagaaatcatcacaactggtaattatcgcctgttgttaccaaaagatgaagcgattttcgcatatgaacgttatacagaaaatgaaaaattagtcgttttatgtaatttcacagaagaagagcaagttcttaccgatgaaaatattttaaacgacatcaaaaaaggctccgtacttgcaaataatgttcctgatattatagaaggaactttacgaccatacgaagcgatagtttatcaaattaaataa

SEQ ID NO: 32761 - protein, 553 aa, Listeria innocua Clip11262
MKEKDWWKKSVVYQIYPKSFNDSNGDGVGDIQGIIEKLDYLKELGVDVIWLSPVYDSPQDDNGYDIRDYQKIYEEYGDMATFDNLLQGLHDRDMKLVMDLVVNHTSDEHKWFEESRKSKDNPYRDYYFWREENEINNWGSIFSGPAWELDEKTGEYYLHLFSKKQPDLNWENPKLRQDVYNMMKFWLDKGIDGFRMDVINFISKNTAFPDGPVAEGQIYGDAGNDFCNGPRIHEFLQEMNQEVTSKYDVMTVGEMPGASTTDAQIYTNPANNEVDMIFTFEHMNLDSDGDNKWDLKPIYLPDLKENMSEWQVALQENGWNSLYWNNHDQPRIVSRFGNDNRFRVRSAKMLATCLHMMKGTPYIYQGEEIGMTNVHFETLEEYRDIETLNMYKERKEQGHSHESIMQSIYTKGRDNARTPYQWDNSENAGFTTGTPWLKVNPRYTEINNEEALKNPDSIFYYYQNLIKLRKTTEIITTGNYRLLLPKDEAIFAYERYTENEKLVVLCNFTEEEQVLTDENILNDIKKGSVLANNVPDIIEGTLRPYEAIVYQIK

SEQ ID NO: 32762 - DNA, 1533 bp, Listeria innocua Clip11262
  CDS (1)..(1533)
ttggaattttggcgaggtagtgttttttatgaaatttatatgaaatcatttcaagatagtaatggtgatggtttaggtgattttaaaggattgactagtagattagattatttggtagatttaggggttgatggcatttggctcactccattttatccttcaccacaagtggataatggctacgatgtttcggattactgtgatataaatccagattacggtaatatggctgattttcgagaatttatgaaagcagcagacgcgcgaggcataaaagtgattattgacttagttttaaatcattcttcgacggagcacgcgtggtttaaggagtcgcggagtagcaaaacaaatcctaaacgagattattatatttggcgtgaaaaaccaaataattgggagtcgttttttggtggctcagcttgggagcttgataaacttactggtgaatattattatcacagttttgcaaaggaacaagctgatcttaactgggcgaatccggctgttcgcgctgaaatcgagcaagttttagcattttggttaaatgaaggcgtggcaggattcaggttagacgtgattaataatttaacgctagtacttgagttcccagataatccagttgtagataatgaaatggagcatgtttatgatcgaaatcaacaaggactcgaacaagctttagagcagattgctgctttttgtcgcaaagagcgagaggtatttttagtaggtgaaattagttctgataaattgccagaaattgcgaaatatagttcgaaaacaatgcttgatgtgacctttaattttaattttggaagtgtcgaactgcttgatgcgcaatcggtatttactactttaaatgaaatggaaacggcattacaagaagggcaatggccaacgcttttctttggtagccacgatatgagtcgatttacaacacgactttcaaacggaaacttgtccaaaacgaaactgttagcgtttttaatgttaactgctaaagggataccgtttatttattatggtgaggaagtggggatgccagatttaaccttttcctccgtggaagaaatgcgtgatattcaaggaactgcagcttattatcaagcgttacaagctggttcagatgaacaaagtgcacttgagctcgcgataaataaaacgcgcgataaagcacgcggcccgatggtatttccagatgggaagccatttacgaccggtcaaccctggattaaaatggctagtttaaatgaggaagatgcattatcaatgtggcatttttaccaagctttactcgcttttcgaaaaggtcatgattttaaagaaaaagaatacgcgtcattaacgttagatggtgaaacacttagctatcagcgcggggaattcttatttttactgcattttggtgagacagaggtgacatatccacttcaagagaaatcagagcttgtttttggagatgcggaaatgttagaagctgacgttaagatgggagcgtatgctggtattgcgctcagagtggaggattaa

SEQ ID NO: 32763 - protein, 510 aa, Listeria innocua Clip11262
MEFWRGSVFYEIYMKSFQDSNGDGLGDFKGLTSRLDYLVDLGVDGIWLTPFYPSPQVDNGYDVSDYCDINPDYGNMADFREFMKAADARGIKVIIDLVLNHSSTEHAWFKESRSSKTNPKRDYYIWREKPNNWESFFGGSAWELDKLTGEYYYHSFAKEQADLNWANPAVRAEIEQVLAFWLNEGVAGFRLDVINNLTLVLEFPDNPVVDNEMEHVYDRNQQGLEQALEQIAAFCRKEREVFLVGEISSDKLPEIAKYSSKTMLDVTFNFNFGSVELLDAQSVFTTLNEMETALQEGQWPTLFFGSHDMSRFTTRLSNGNLSKTKLLAFLMLTAKGIPFIYYGEEVGMPDLTFSSVEEMRDIQGTAAYYQALQAGSDEQSALELAINKTRDKARGPMVFPDGKPFTTGQPWIKMASLNEEDALSMWHFYQALLAFRKGHDFKEKEYASLTLDGETLSYQRGEFLFLLHFGETEVTYPLQEKSELVFGDAEMLEADVKMGAYAGIALRVED

SEQ ID NO: 32764 - DNA, 1686 bp, Agrobacterium tumefaciens str. C58
  CDS (1)..(1686)
atgaacgcccataccagacaggacacttccatgaccgcttcggtgacttccgctttgacgcctaacaaggactggtggcgtggtgcggtgatctatcagatctacccgcgctcctatcaggactccaatggcgacggcatcggcgatctcaagggcattaccgaccgtctgcatcacatcgccggtctcggtgccgatgcgatctggatttcgccctttttcacctcgccgatgaaggatttcggctacgacgtctcgaactatgtcgatgtcgatccgatgttcggcacgcttgccgatttcgacgggctgattgccgaagcccaccggcttggcatccgcgtgatgatcgacctcgttctgtcgcacacgtctgaccagcatccgtggttcgtggaaagccgcgccagccgcaacaatccgaaatcggactggtatgtctggtcggaagcgaagcccgatggcacaccgcctaacaactggctgtcgatcttcggcggttccggctggcagtgggatcccacccgcatgcaatattacatgcacaacttcctgacctcgcaaccggacctcaacctgcataaccctgaagtgcaggaggaactgcttaatatcacccgcttctggctgaagcgcggcgtcgatggtttccgcctcgacactatcaacttctatttccatgatctggaattacgagacaacccggcgctggcaccggagcgccgcaatgcctcgaccgcgcctgcagtcaatccctacaatttccaggaacatctctacgataagaaccgcccggaaaacatcgccttcctgaagcgcttccgcgcggtgctggacgaattccccgatatcgccgccgttggcgaagtgggcgacagccagcgcggtctcgaaatcgtcggtgaatacacctccggcgatgacaagatgcagatgtgctatgccttcgaattcctcgcacccgatgcgctcaccccccagcgcgttgccgatgtgcaggcggattttgcgcgcgcagcaccagagggctgggcctgctgggccttctccaaccatgatgtcgtgcgccatgtcagccgctggggcgagcatgtcgaggacaaggatgccttcgcgaagctgctgtcggcactgctgatgacgcagcgaggctccgtctgcatctatgagggcgaggaactgggcctcactgaagccgatattgctttcgaggacttacaggacccctatggcatccagttctggccggaattcaagggtcgcgatggttgccgcacgccgatggtgtgggatgcgggccatgcgcaggccggcttttcgacttcggacaagatctggctgcccattccggccgagcacaagcagcgcgccgtcagcgcccagcagggcaacgaggcgtcggtgctggagcattaccgccgcttcctcgccttccgcaaacagcacccggctttcgccaagggcggcatcgaattccagccgcttgagggagacgtgctgagctacacccgcaagctgggcaacgaaaccattctgtgccttttcaatctgtccgcaacgccggcaaatgccacgctgccgaaagggaactgggaggttctcgaaggccatggctttgcaagcggccttgaaggcacaagcgtagaacttccggcatggggcgctttcttcgcccgttacgcctga

SEQ ID NO: 32765 - protein, 561 aa, Agrobacterium tumefaciens str. C58
MNAHTRQDTSMTASVTSALTPNKDWWRGAVIYQIYPRSYQDSNGDGIGDLKGITDRLHHIAGLGADAIWISPFFTSPMKDFGYDVSNYVDVDPMFGTLADFDGLIAEAHRLGIRVMIDLVLSHTSDQHPWFVESRASRNNPKSDWYVWSEAKPDGTPPNNWLSIFGGSGWQWDPTRMQYYMHNFLTSQPDLNLHNPEVQEELLNITRFWLKRGVDGFRLDTINFYFHDLELRDNPALAPERRNASTAPAVNPYNFQEHLYDKNRPENIAFLKRFRAVLDEFPDIAAVGEVGDSQRGLEIVGEYTSGDDKMQMCYAFEFLAPDALTPQRVADVQADFARAAPEGWACWAFSNHDVVRHVSRWGEHVEDKDAFAKLLSALLMTQRGSVCIYEGEELGLTEADIAFEDLQDPYGIQFWPEFKGRDGCRTPMVWDAGHAQAGFSTSDKIWLPIPAEHKQRAVSAQQGNEASVLEHYRRFLAFRKQHPAFAKGGIEFQPLEGDVLSYTRKLGNETILCLFNLSATPANATLPKGNWEVLEGHGFASGLEGTSVELPAWGAFFARYA

SEQ ID NO: 32766 - DNA, 1665 bp, Clostridium perfringens str. 13
  CDS (1)..(1665)
atgaataaaaagtggtggaaagaattaattgcttaccagatttaccctaagagctttatggattctaatggtgatggtataggtgatattcaaggtataatatctaaattagattatttaaaagatttaggtattgatttaatctggttatgtccaatgtataaatcaccgaatcatgataatggttatgacattagtgattataaagatatcttagatgaatttggaactatggatgattttaatgaattgcttaatgaggttcataatagagggatgaagcttattatagatttagtaataaatcacactagtcatgaacatccatggtttatagaatcaagatcttctagggataatcctaaaagagattggtatatttggagagaaggtaaaggggatgaggaacctaataactgggaaagtatatttaaaggttcagcttgggaattctgtgagaatagtgaagagtattacctacatttatttgctaaagagcaaccagatttaaactgggagaataaagaggtaagaaatgaactatataaaatgataaactggtggcttgataagggtattgatgggtttagagttgatgccataagtcacataaaaaaagaagagggtcttaaggatatggataatccagagggacttaaatatgtttcatcctttgaaaagcatatgaatgtagagggaataaattctcatcttaaagaactaaaagaagaaactttttcaaagtataatatagttacagttggagaagcaaatggagttagtgccaatgaagctgatcactgggtagctgaagatgagggaacatttaatatgatattccaatttgagcatcttaatctttggaattatgaagagggacaaggatttgatgtgaaggcatacaaagatgttttaacaaattggcaaaattctttagaaggtaaaggatggaatgcacttttcattgaaaatcatgatatacctagagttgtttcaacttggggaaatgacaaggaatatttaactgaatgtgcaaaagcttttggagcaatttatttcttacaaaagggaacccctttcatataccaagggcaagaacttggtatgacaaatgttaaatatcatagcatatctgagtataatgatgttaaaactataaatacttacaatgaaagaattgaaagtggtgtttcagaggaaatagcattaaaagaagcttgggtaacttcaagagataattcaagaacacctatgcaatggaattcaagtgagaatgcagggtttacttgtggaaaaccttggataggagttaatgaaaattataaaacaataaatgtagaagttgaagaaagggatgaaaattcagttttaaacttctataaaaagcttataaaacttaaaaagtctaatgaagctttaatctatggtgtatatgatttaatccttgaagaggatgaaaatatctttgcttatacaagaactttaaataatgaaaagttcttgataatggctaatttaactggagaaaatgccaagtacatgtatgagaaagaaaaacttaattctaaggatttaattcttaacaattatgaggtttgtgaacataaaaacttaacagagtttacattaaaaccttatgaatgcagagtatataagctttcttaa

SEQ ID NO: 32767 - protein, 554 aa, Clostridium perfringens str. 13
MNKKWWKELIAYQIYPKSFMDSNGDGIGDIQGIISKLDYLKDLGIDLIWLCPMYKSPNHDNGYDISDYKDILDEFGTMDDFNELLNEVHNRGMKLIIDLVINHTSHEHPWFIESRSSRDNPKRDWYIWREGKGDEEPNNWESIFKGSAWEFCENSEEYYLHLFAKEQPDLNWENKEVRNELYKMINWWLDKGIDGFRVDAISHIKKEEGLKDMDNPEGLKYVSSFEKHMNVEGINSHLKELKEETFSKYNIVTVGEANGVSANEADHWVAEDEGTFNMIFQFEHLNLWNYEEGQGFDVKAYKDVLTNWQNSLEGKGWNALFIENHDIPRVVSTWGNDKEYLTECAKAFGAIYFLQKGTPFIYQGQELGMTNVKYHSISEYNDVKTINTYNERIESGVSEEIALKEAWVTSRDNSRTPMQWNSSENAGFTCGKPWIGVNENYKTINVEVEERDENSVLNFYKKLIKLKKSNEALIYGVYDLILEEDENIFAYTRTLNNEKFLIMANLTGENAKYMYEKEKLNSKDLILNNYEVCEHKNLTEFTLKPYECRVYKLS

SEQ ID NO: 32768 - DNA, 1668 bp, Clostridium perfringens str. 13
  CDS (1)..(1668)
atgaaagattttaagaaaagtgttgtttatcagatatatccaaaatcatttaaggattcaaatggagatggtcttggagatttaaggggagtaattgaaaaattagattatcttaaaactttaggagtagattatatttggatgactccattttatgtatctcctcaaaaagataatgggtatgatatagctgattattataaaattgatcctagatatggaactatggaagattttgaagaattggttaaggaagctaaaagtagaaatatagatattatgcttgatatggtttttaatcatacttctacagagcatgaatggtttaaaagagctttaaagggagaagaaaaatataaaaattattatatttttaaagaaggaaaaaaaggagaaccaccaacaaattggatttcaaagtttggagggaatgcttgggagtatgttgaggagctaggagaatattatctacatttatttgatgtttcacaggctgatttaaactgggataataaagaattaagagaagaaatctataaagtggtgaatttctggatagataaaggtgttaagggatttaggttagatgttataaatcttatttctaagccagaaaaatttgaaaatgattatgaaggtgatggaagaagattttatactgatgggcatagaatacatgagtatttaaaagaacttaatgaaagaacttttggtaaagatgtagaaatagtaactgttggtgaaatgtcatcaacaactatagaaaactgtataaaatattctaatcctaaggaaaaagaattatcaatggtatttaattttcatcatttaaaggtagattataaagatggtcaaaaatggtctttaatggattttgactttattgaattaaaaaaactttttaataattggcaaagaggaatgattaagggaggaggctggaatgctgttttctggtgtaatcatgatcaaccaagagttaattcaagatttggagatgtaaagaaatactttaatgaatcttcaaaaatgctagctacttcaattcatatgatgagtggaactccttatgtatatcaaggagaagaaattggaatgacaaatccagggtttgaaagtattgaagagtatagagatgtagaatcaataaactattttaatattttaaaagaagagggaattgataaaaaagaaataatggaaatccttaagagcaaatcaagagataactcaagaactcctgttcaatggaatgaagaaaagaatgctggatttactacaggaactccttggataaatattgctaataattatagagaaataaatgttgaaagagctttagaaaataaggattctgtattttatcattataagaaacttattgaattaagaaagaatgaagatgtaatagcttatggagattacattccgcttttagaagatcatcctaaagtttatgcttatgaaagaaattataatggtgaaaagttacttgttataaataacttctatggagaagagtgcttagtagatttatcaaaggaaattgaagggctagaaaattacaataagagtattttaatatctaattataaggatagtacattagatttattaaatttaaagttaagaccatatgaatcaatagtttataaattagaaaagtaa

SEQ ID NO: 32769 - protein, 555 aa, Clostridium perfringens str. 13
MKDFKKSVVYQIYPKSFKDSNGDGLGDLRGVIEKLDYLKTLGVDYIWMTPFYVSPQKDNGYDIADYYKIDPRYGTMEDFEELVKEAKSRNIDIMLDMVFNHTSTEHEWFKRALKGEEKYKNYYIFKEGKKGEPPTNWISKFGGNAWEYVEELGEYYLHLFDVSQADLNWDNKELREEIYKVVNFWIDKGVKGFRLDVINLISKPEKFENDYEGDGRRFYTDGHRIHEYLKELNERTFGKDVEIVTVGEMSSTTIENCIKYSNPKEKELSMVFNFHHLKVDYKDGQKWSLMDFDFIELKKLFNNWQRGMIKGGGWNAVFWCNHDQPRVNSRFGDVKKYFNESSKMLATSIHMMSGTPYVYQGEEIGMTNPGFESIEEYRDVESINYFNILKEEGIDKKEIMEILKSKSRDNSRTPVQWNEEKNAGFTTGTPWINIANNYREINVERALENKDSVFYHYKKLIELRKNEDVIAYGDYIPLLEDHPKVYAYERNYNGEKLLVINNFYGEECLVDLSKEIEGLENYNKSILISNYKDSTLDLLNLKLRPYESIVYKLEK

SEQ ID NO: 32770 - DNA, 1740 bp, Schizosaccharomyces pombe
  CDS (1)..(1740)
atgaaagttgtgccaagcgaaaaaatcaaaccgaattggtggagagagacttcagtatatcaaatatatcctgcctctttcaaagattcaaacggtgatggctttggtgatttagaaggaatcatttccaaagtggattatctgaaagctctaaatgtagagtctatttggctttgtcctatttacccatctcctctaaaagacatgggttatgatgtttctgattacaaacaaattgactctcgatatggaactttagaggatttggacaggctaatgaaagctctacacgaaagggacatgaagttagttatggacttggtgttaaaccacacttctgatcaacatgagtggtttaaggagtccagatcttctaaaacaaatccgaagcgagattggtacttttggaaaccagctaggtacaatgaaaaaggcgaacgcttacccccaaataattggagaagctatttcgatacttcggcgtgggaatgggacgaagctacgcaagaatactacctacatctttggtccgtagggcaacccgatcttaattgggaaaccccaaaagttagggaagcggtacacgatattctacgtttctggcttgatagaggagtagatgggtttcgacttgatgctattaacatgatcagcaaagaccaaaggtttctagatgctccaattactgatgacaggtacgaatatcaactagcctatcaatattacgccaatggtcccagaattcacgagtatcttaatgggataggcaatattcttacagagtatgacgctttttctgtaggggaaatgccttacgttttggatacgaacgaaatcctgcatgtcgttggtgctgatcgtagagaactgacgatgatatttcagtttgattttgtggaccttgatctcgatcctaatcagcataagtatattgaaggaagttgggagctttctgatttgaaaaagtcattaaaaaaatggcagtctgcactactttccggtggtggttggaatgcttcctttattgaaaatcacgaccaaacgagaactgtttcacgatatctttctgattctcccaagtatagagcatatagctccaaattgatggctctttttatcatattccaaagtggtaccccatttgtattccagggtcaggaacttgctcttgccaatatcccacgagattggccgattgatgaataccttgatgttgaaacgcagaacttctggaaactttttatgagtggcaatcctagtcaggaagaaattgagaagactatggacattgttaacaaacgtgctcgtgacaacggtcgcacaccaatgcattgggatagctcacccaacggtggtttcacaaaggctggagtaaaaccgtggatgagagtgactaatgactacaaagaatggaatgctgccaatcaagttaatgaccctgaaagtccttacacattttggtcaaaggcattggagcttcgtaaagaattgaaggatgctgttgtgtatggatcgtttgaattgatatctgaagaggatccatcgattgttgcatttgttcgtgaatcatcgacttataaactcatcattcttttgaatttcacgggtaataaagtttcttatgactgtcctttgaacctgacttcctatgaaattctacttgacaactataaggactttatttgtatgacttctcctgtcacattgaatccttatcaagcagtcttgttaaagctctaa

SEQ ID NO: 32771 - protein, 579 aa, Schizosaccharomyces pombe
MKVVPSEKIKPNWWRETSVYQIYPASFKDSNGDGFGDLEGIISKVDYLKALNVESIWLCPIYPSPLKDMGYDVSDYKQIDSRYGTLEDLDRLMKALHERDMKLVMDLVLNHTSDQHEWFKESRSSKTNPKRDWYFWKPARYNEKGERLPPNNWRSYFDTSAWEWDEATQEYYLHLWSVGQPDLNWETPKVREAVHDILRFWLDRGVDGFRLDAINMISKDQRFLDAPITDDRYEYQLAYQYYANGPRIHEYLNGIGNILTEYDAFSVGEMPYVLDTNEILHVVGADRRELTMIFQFDFVDLDLDPNQHKYIEGSWELSDLKKSLKKWQSALLSGGGWNASFIENHDQTRTVSRYLSDSPKYRAYSSKLMALFIIFQSGTPFVFQGQELALANIPRDWPIDEYLDVETQNFWKLFMSGNPSQEEIEKTMDIVNKRARDNGRTPMHWDSSPNGGFTKAGVKPWMRVTNDYKEWNAANQVNDPESPYTFWSKALELRKELKDAVVYGSFELISEEDPSIVAFVRESSTYKLIILLNFTGNKVSYDCPLNLTSYEILLDNYKDFICMTSPVTLNPYQAVLLKL

SEQ ID NO: 32772 - DNA, 1797 bp, Corynebacterium glutamicum ATCC 13032
  CDS (1)..(1797)
ttgaattctcagccgagtgcagatcaccaccctgatcacgcggctcgcccagttcttgatgcccacggcttgatcgttgagcacgaatcggaagagtttccagtccccgcacccgctcccggtgaacagccctgggagaagaaaaaccgcgagtggtacaaagacgccgttttctacgaagtgctggttcgtgccttctacgatccagaaggcaacggagtcggatcgttgaaaggcctgaccgaaaaactggattacatccagtggctcggcgtggattgcatttggatcccaccgttttatgattccccactgcgcgacggcggttacgatatccgcaacttccgtgaaatcctgcccgaattcggcaccgtcgatgacttcgtggaactcgttgaccacgcccaccgccgtggcctgcgtgttatcaccgacttggtcatgaatcacacctccgaccagcacgcatggttccaagaatcccggcgcgacccaaccggcccctacggagatttctatgtgtggagcgatgatcccaccctgtacaacgaagcccgcatcatctttgtagatacagaagaatccaactggacctatgatccggtgcgtggccagtacttctggcaccgcttcttctcccaccaaccagacctcaactacgacaaccccgcagtccaagaggccatgctagatgtcttgcgtttctggctggacctgggacttgatggtttccgactagatgccgttccttatctttttgaacgcgaaggcaccaacggcgaaaacctcaaagaaacccacgatttcctcaaactgtgtcgctctgtcattgagaaggaataccccggccgaatcctgctcgcagaagccaaccaatggccccaagatgtggtcgaatacttcggtgaaaaagacaaaggcgatgaatgccacatggccttccacttccctttgatgccgcgcatcttcatgggagttcgccaaggttcacgcaccccgatcagtgagatcctggccaacaccccggagattcccaagactgcccaatggggtattttcctgcgtaatcatgatgagctcacccttgaaatggtctccgatgaggaacgcagctacatgtactcccaattcgcctccgaacctcgcatgcgcgccaacgtaggaatccgcaggcgcctttccccactgcttgaaggcgaccgcaaccagctggaactccttcacggtttgttgctgtctctacctggctcacccgtgttgtattacggtgatgaaattggcatgggcgacaatatctggctccacgaccgcgacggagtgcgcacccccatgcagtggtccaacgaccgcaacggtggtttctccaaagctgatcctgaacgcctgtaccttccagcgatccaaaatgatcaatacggctacgcccaagtaaacgtggaaagccaactcaaccgcgaaaactccctgctgcgctggctccgaaaccaaatccttatccgcaagcagtaccgcgcatttggtgccggaacctaccgtgaagtgtcctccaccaatgagtcagtgttgacatttttacgagaacacaagggccaaaccattttgtgtgtcaacaacatgagcaaatatcctcaggcagtctcgcttgatttgcgtgaatttgcaggacacacccctcgagagatgtcgggcgggcagctgttccctaccattgctgaacgggagtggattgtcactttagcccctcacggattcttctggtttgatctcaccgccgatgaaaaggacgatatggaatga

SEQ ID NO: 32773 - protein, 598 aa, Corynebacterium glutamicum ATCC 13032
MNSQPSADHHPDHAARPVLDAHGLIVEHESEEFPVPAPAPGEQPWEKKNREWYKDAVFYEVLVRAFYDPEGNGVGSLKGLTEKLDYIQWLGVDCIWIPPFYDSPLRDGGYDIRNFREILPEFGTVDDFVELVDHAHRRGLRVITDLVMNHTSDQHAWFQESRRDPTGPYGDFYVWSDDPTLYNEARIIFVDTEESNWTYDPVRGQYFWHRFFSHQPDLNYDNPAVQEAMLDVLRFWLDLGLDGFRLDAVPYLFEREGTNGENLKETHDFLKLCRSVIEKEYPGRILLAEANQWPQDVVEYFGEKDKGDECHMAFHFPLMPRIFMGVRQGSRTPISEILANTPEIPKTAQWGIFLRNHDELTLEMVSDEERSYMYSQFASEPRMRANVGIRRRLSPLLEGDRNQLELLHGLLLSLPGSPVLYYGDEIGMGDNIWLHDRDGVRTPMQWSNDRNGGFSKADPERLYLPAIQNDQYGYAQVNVESQLNRENSLLRWLRNQILIRKQYRAFGAGTYREVSSTNESVLTFLREHKGQTILCVNNMSKYPQAVSLDLREFAGHTPREMSGGQLFPTIAEREWIVTLAPHGFFWFDLTADEKDDME

SEQ ID NO: 32774 - DNA, 1629 bp, Streptococcus pyogenes MGAS8232
  CDS (1)..(1629)
atgacaattgataaaaagaaagtcgtctatcaaatttacccaaaatcctataaggacactactggaaatggtgtgggagacttgcgagggatcattgataaattgccttacttacaagaactaggaatagatatgatttggttgaaccctttctaccttagtccacaacgagacaatggctatgatgtttcagattatacagcagtcaaccctgattttgggacaatggctgattttgaaaatttggtaaaagctgctaaggagcatcagattgagttaatgttggatatggttttgaatcactgttccacagaccacgagtggttccaaaaagctttagcaggagacccttattatcaggatttctttatcttgagagatcagccgactgattgggtttccaaatttggtgggaatgcttgggcgccttttggagatacaggcaagtactacttacacttgtttgatgtgacacaggctgacttgaattggcggaacccacatgttcgtgaggaattggctaaagtggttaatttttggcgagataaaggagtgaagggattccggtttgatgtgattaacctgattggaaaagatgaagagctggcggattgtccggtcaatgatggtaagccagcttatacggatcgtcctattactcacacttatcttcatgatctcaatcaagccagttttggccaggatgattcgtttatgacagtaggggaaatgtctgccacgactattgacaactgtcttttatacacggctcccgaacgtgaggagctatccatggcttttaatttccaccatctaaaagttgattatgagaacggtcagaaatggactattatggcttttgattttgcagcgctgcgagacttattccatgcttggggtgaaggcatgagtcagggcaatgggtggaatgccttgttctacaataaccatgatcaaccacgtgccctgaatcgttttgttgatgtaacacatttccgaaacgaaggtgcgacgatgttagcggcctccatccatttgtcacgaggaacgccttacatttatatgggtgaggagattggcatgcttgatccagactttgatagtatggatgattatgtggatgtggaaagtcttaatgcttactcaagcttactagtctcaggtaaaagtgcaaaagaagcctttgccattatcaaggctaagtcaagggacaatgccagaacaccaatgcaatgggatgctagtgaacatgctggctttacgactggtaagccttggttagaggttggcaaatcttatcgagacatcaatgtcgaaacagaaaaagagggacgtatttttcctttctaccaacgcttgattgctttgcgtaaggaactccctattattgctgaaggggactatcgggctgcttttaaagatagtcaggctgtctatgcctttgaacgccatttaggtgaccagtgtttgcttgttctcaatcatttctatgctgatgaggtcgaactggaattacctctacgttatcaacatggacaggtcttaatcagcaactatgagaaagtctctatttgtgaaaaagtgatgctgaaaccttatcagacacttgctattttagctgataactaa

SEQ ID NO: 32775 - protein, 542 aa, Streptococcus pyogenes MGAS8232
MTIDKKKVVYQIYPKSYKDTTGNGVGDLRGIIDKLPYLQELGIDMIWLNPFYLSPQRDNGYDVSDYTAVNPDFGTMADFENLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELADCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMSQGNGWNALFYNNHDQPRALNRFVDVTHFRNEGATMLAASIHLSRGTPYIYMGEEIGMLDPDFDSMDDYVDVESLNAYSSLLVSGKSAKEAFAIIKAKSRDNARTPMQWDASEHAGFTTGKPWLEVGKSYRDINVETEKEGRIFPFYQRLIALRKELPIIAEGDYRAAFKDSQAVYAFERHLGDQCLLVLNHFYADEVELELPLRYQHGQVLISNYEKVSICEKVMLKPYQTLAILADN

SEQ ID NO: 32776 - DNA, 1695 bp, Drosophila melanogaster
  CDS (1)..(1695)
atggccggtctggttaagagcgatacggaggactttatcgactggtggccgcacacggtgttctatcagatctacccgaggtcattcaaggacagcaatggcgatggtatcggcgatttgaaaggaatcacctccaagctgcgctatctggcggacactggcatcacggccacctggttgagtcccatttttcagtcgcccatgattgactttggctatgatatatcggattacaaggcaatccagccggagtatggcaccatgcaggatttcgaggagctgatcgacacggctttcgagctgggcatcaaggttgttctggactttgtgccgaatcacagctcggatcagcatgagtggttcaagaagtctgcggcaagggagccgggttacgaggatttctatgtgtggcacgatggcatcgtccaggagaatggcactcgggtgccacccaacaactggccatcggtgttctacggatccgcttgggagtggcacgaaggtcgtgagcagtattacctgcaccagttcaccaaggagcagccggacttgaactatcgcaatcccaaagtggttcaggccatggatgatgtgttgcttttctggctcaacaagggcgtagctggtttccgcatcgatgcagtgaatcatttgtttgaggacgaatctcttaaagatgagccattgagtggcaaaacaacggattcactttcctatgactacactaagcacatctactcgagagatctgccagaagtcttggaaatgattcatcactggaggcaactgctggatgactttagtgccaagcaccccgaaagaccaacacgcatcatgatgacggaggcgtacgcaggactaacccagctggcggactactacgaggattccaacggggttcggggctcccatctgcccttcaactttcactttatcacggatgtcaaaggcgactcggatgcgcgtgactatgtctacaacgtggagaagtggctgatctacatgccacgcgggcacgcggccaactgggtcatgggcaaccacgacaacccccgagtcgcttctcgattcggtccagccagtgtggacgccatgaacatgctactgctcacccttcccggtgtcgccgtcacttataatggcgaggagctgggcatggtggactaccgcgaactgagctgggaggaaacggtggatccaccggccagaaatgttggagagaagctataccaggaggtctcccgtgacccagtccgaacaccgttccagtggaataacgagaccaatgctggtttttccactgccgccaaaacctggctgcctgtccacccgaactacctcgagctcaaccttgaggcccagaaggtggccaacaggagccattaccaggtctacaaggatctgcttgagctgcgaaaatcggccattatgcgtgtgggccgatttaatattgaaccccttactcgttgggtgtttgcctttaagcggtcctatcccaattttgagtcgataattaccgtgataaatgtgagcgacaaggagcagttggtggatctctcagagtttcttagccagcctaagaaactagtggttgaagtttccggcgtggattccaaatatcaacctggtcaatccctcgccgcaagtgcattgctcctggccgcccgtgagggtctcgtctgtcggctggtctag

SEQ ID NO: 32777 - protein, 564 aa, Drosophila melanogaster
MAGLVKSDTEDFIDWWPHTVFYQIYPRSFKDSNGDGIGDLKGITSKLRYLADTGITATWLSPIFQSPMIDFGYDISDYKAIQPEYGTMQDFEELIDTAFELGIKVVLDFVPNHSSDQHEWFKKSAAREPGYEDFYVWHDGIVQENGTRVPPNNWPSVFYGSAWEWHEGREQYYLHQFTKEQPDLNYRNPKVVQAMDDVLLFWLNKGVAGFRIDAVNHLFEDESLKDEPLSGKTTDSLSYDYTKHIYSRDLPEVLEMIHHWRQLLDDFSAKHPERPTRIMMTEAYAGLTQLADYYEDSNGVRGSHLPFNFHFITDVKGDSDARDYVYNVEKWLIYMPRGHAANWVMGNHDNPRVASRFGPASVDAMNMLLLTLPGVAVTYNGEELGMVDYRELSWEETVDPPARNVGEKLYQEVSRDPVRTPFQWNNETNAGFSTAAKTWLPVHPNYLELNLEAQKVANRSHYQVYKDLLELRKSAIMRVGRFNIEPLTRWVFAFKRSYPNFESIITVINVSDKEQLVDLSEFLSQPKKLVVEVSGVDSKYQPGQSLAASALLLAAREGLVCRLV

SEQ ID NO: 32778 - DNA, 1605 bp, Streptomyces coelicolor A3(2)
  CDS (1)..(1605)
atggcagcccccaactcgcaccgcgccgaagactggtggcgcgacgccgtcatctaccaggtgtacccccgcagtttcgccgacggcgacggcgacggcaccggtgacctcgcgggcgtgagggcgagactgccctacctcgccgaactcggcgtggacgccgtctggttcaccccctggtacgtctccccgctcgtggacggcggctacgacgtcgccgactaccgcaccatcgaccccgccttcggcaccctgggcgaggccgagaagctgatcgccgaggcgcgggagctgggcatccgcaccatcgtcgacatcgtgcccaaccacgtctccgaccggcacgcctggttccgggccgcgctggaggccgggccgggcagcgcggagcgggagcggttccacttccgccccggccgcggtgccgacggcgagctgccgcccaacgactggccctcccagttctccggccgcacctggacccgggtcccggacggcgagtggtacctgcacctgttcaccccggagcagcccgacctcaactgggcccatcccgaggtgcgccgggagcacgaggaggtgctgcgcttctggttcgagcgcggggtggcgggcgtacgcatcgactccgccgcgctgctcgcgaaggaccccgcgctcgcggacttcgtggagggcgtcgacccgcacccgtacatcgaccaggacgagctgcacgacatctaccgctcctggcgcaaggtggcggacgagtacgggggtgtcttcgtcggtgaggtgtggctgcccgacgccgagcgcttcgcgcgctatctgcggcccgacgaactgcacacggccttcaacttcaacttcctgtcctgcccgtgggaggcggaccggctgcgtcgcaccatcgacgacaccctggccgagcacgccccggtcggcgccccggccacctgggtgctctgcaaccacgacgtgacccgcacggtgacccggtacggccgtgcggacaccggcttcgacttcgcgaagaaggccttcggcaccccgaccgacctggtcctgggcacccggcgggcgcgggccgcggcgctgctgacgctggcgctgcccggctccgtctacctctaccagggggaggaactcggcctgcccgaggcggacatcccgcgcgaccggatccaggacccgatgcacttccgctccggaggcgtcgatccgggccgggacggctgccgcgtgccgcttccatgggccgccgacgcgccgtactgcgggttcggctcggagacggagccctggctgccgcagccggagggctgggcggcgtacgcggcggaccgtcagggcgcggacccggagtcgatgctctcgctctaccgccgggccctcggcctgcgacggtccacggcggggttcggcgacggcggcctggactggctgcccgcgccggacggtgtcctcgcgttccggcgcgcgggcggtccggtgtgcgtcgtcaacctgtccgcggcgccggtcgagctgcccgcgcacagcgccgtcctgctcgtcagcgggccgctggacgaggcgggccggctgccggcggacacggcggtgtggctgcgcgcctga

SEQ ID NO: 32779 - protein, 534 aa, Streptomyces coelicolor A3(2)
MAAPNSHRAEDWWRDAVIYQVYPRSFADGDGDGTGDLAGVRARLPYLAELGVDAVWFTPWYVSPLVDGGYDVADYRTIDPAFGTLGEAEKLIAEARELGIRTIVDIVPNHVSDRHAWFRAALEAGPGSAERERFHFRPGRGADGELPPNDWPSQFSGRTWTRVPDGEWYLHLFTPEQPDLNWAHPEVRREHEEVLRFWFERGVAGVRIDSAALLAKDPALADFVEGVDPHPYIDQDELHDIYRSWRKVADEYGGVFVGEVWLPDAERFARYLRPDELHTAFNFNFLSCPWEADRLRRTIDDTLAEHAPVGAPATWVLCNHDVTRTVTRYGRADTGFDFAKKAFGTPTDLVLGTRRARAAALLTLALPGSVYLYQGEELGLPEADIPRDRIQDPMHFRSGGVDPGRDGCRVPLPWAADAPYCGFGSETEPWLPQPEGWAAYAADRQGADPESMLSLYRRALGLRRSTAGFGDGGLDWLPAPDGVLAFRRAGGPVCVVNLSAAPVELPAHSAVLLVSGPLDEAGRLPADTAVWLRA

SEQ ID NO: 32780 - DNA, 1719 bp, Streptomyces coelicolor A3(2)
  CDS (1)..(1719)
atgaccgtcaacgagcccgtacctgacaccttcgaggacacccccgcgggggaccggcacccggactggttcaaacgagccgtcttctacgaggtcctcgtccgctccttccaggacagcaacggcgacggcatcggtgatctcaagggcctgaccgccaagctggactacctgcaatggctcggcgtggactgcctgtggctcccgcccttcttcaagtcaccgctgcgcgacggcggttacgacgtctccgactacaccgccgtgctgccggagttcggcgacctggccgacttcgtggagttcgtggacgcggcgcaccagcgcggcatgcgcgtgatcatcgacttcgtcatgaaccacaccagcgaccagcacccgtggttccaggagtcccgcaagaacccggacggcccctacggcgactactacgtctgggccgacgacgacacccggtacgccgacgcccgcatcatcttcgtcgacaccgaggcctccaactggacccacgacccggtccgcggccagtactactggcaccggttcttctcccaccagccggacctcaactacgagaacccggccgtgcaggaggagatgctcgccgccctgaagttctggctggacctgggcgtggacggctaccgtctcgacgccgtgccctacctgtacgccgaggagggcaccaactgcgagaacctgcccgcctcccacgcgttcctcaagcgggtgcgccgcgagatcgacgcgcagtacccggacaccgtactgctggccgaggccaaccagtggccggaggacgtggtcgactacttcggcgactactccacgggcggcgacgagtgccacatggccttccacttccccgtcatgccccgcatcttcatggccgtgcgccgcgagtcccgctacccggtctccgaaatcctcgccaagacccccgcgatcccgtccggctgccagtggggcatcttcctgcgcaaccacgacgagctgaccctggagatggtcaccgacgaggaacgcgactacatgtacgcggagtacgccaaggacccgcgcatgcgcgccaacatcggcatccgccggcggctggccaccctgctggacaacgaccgcgaccagatcgagctgttcaccgccctgctgctcgccctcccgggatccccgatcctctactacggcgacgagatcggcatgggcgacaacatctggctcggcgaccgcgacgccgtgcgcacccccatgcagtggacgcccgaccgcaacgccggcttctcgacctgtgacccgggccgcctctacctgcccgcgatcatggacccggtctacggctaccaggtgacgaatgtcgaggcgtccatggcctcgccctcctccctgctgcactggacccggcgcatgatcgagatccgcaagcagaaccccgccttcggcctcggcacctacaccgaactgccctcctccaacccggcggtgctcgccttcctgcgggagtacgaggacgacctggtgctgtgcgtgaacaacttcgcacggttcgcccagcccaccgagctggatctgcgcgagttcgccggacgccatccggtcgagctgttcggcggggtccgcttccccgccatcggcgaactgccgtacctgctgaccctcgggggccacggcttctactggttccggctcacccgagtcgcatcccgcatcggccgccgcgcttga

SEQ ID NO: 32781 - protein, 572 aa, Streptomyces coelicolor A3(2)
MTVNEPVPDTFEDTPAGDRHPDWFKRAVFYEVLVRSFQDSNGDGIGDLKGLTAKLDYLQWLGVDCLWLPPFFKSPLRDGGYDVSDYTAVLPEFGDLADFVEFVDAAHQRGMRVIIDFVMNHTSDQHPWFQESRKNPDGPYGDYYVWADDDTRYADARIIFVDTEASNWTHDPVRGQYYWHRFFSHQPDLNYENPAVQEEMLAALKFWLDLGVDGYRLDAVPYLYAEEGTNCENLPASHAFLKRVRREIDAQYPDTVLLAEANQWPEDVVDYFGDYSTGGDECHMAFHFPVMPRIFMAVRRESRYPVSEILAKTPAIPSGCQWGIFLRNHDELTLEMVTDEERDYMYAEYAKDPRMRANIGIRRRLATLLDNDRDQIELFTALLLALPGSPILYYGDEIGMGDNIWLGDRDAVRTPMQWTPDRNAGFSTCDPGRLYLPAIMDPVYGYQVTNVEASMASPSSLLHWTRRMIEIRKQNPAFGLGTYTELPSSNPAVLAFLREYEDDLVLCVNNFARFAQPTELDLREFAGRHPVELFGGVRFPAIGELPYLLTLGGHGFYWFRLTRVASRIGRRA

SEQ ID NO: 32782 - DNA, 1617 bp, Xanthomonas axonopodis pv. citri str. 306
  CDS (1)..(1617)
atgttgcagacaccatggtggcgcggggccgtcatctatcagatctatccgcgtagctttccggattccaatggcgatggggtcggcgatctgccgggcatcatcgccaagctcgactacatcgctgggctgggcgtggatgccatctggatctcgccgtttttcaagtcgccgatggcagatttcggctatgacatcgcggactaccgtgcggtggatccgttgttcggaacgctggacgatttcgaccgtctgctcgacagggcgcatgcgcttggcctgaaggtgatgatcgatcaggtgttgagccacacctcgatcgaacatgcgtggttccaggaaagccggcaggaccggaccaatgcgaaggcggattggtatgtgtgggccgatccgcgcgaggacggaacgccgcccaacaactggttgtcgctgttcggtggtgtggcgtggcagtgggagccgcggcgcgagcagtactacctgcataacttcctggtcgatcagccggacctcaatttccataatgcggaggtgcagcaggcaaccctggacaatgtgcggttctggttggatcgtggagtagatggctttcgcctggacgcgatcaacttctgcttccatgacgcgcagctgcgcgataacccggccaagccggccgacaagcgggtggggcgtggctttagcgcggacaatccgtacgcctatcagtaccactacttcaacaacacgcagccggagaacctggcgttcctggagcgcctgcgtgcgctgctcgatcgctatccggatgcggtaagcctgggcgaaatctcttcggaagactcgctggcgaccacggccgaatacaccgccaagggccgcttgcacatgggctacagcttcgagctgttggtgcaggattacagcgcggcgtacatccgcggaacggtcagcaggctcgaggccaccatgttggaaggatggccgtgctgggccatttccaaccacgatgtggtgcgtgcggtgacgcgttggggcggtgaagatgcgtcgcctgcgttcgctcgcatggtagttgcgctgctatgttcgttgcgtggctcggtttgcctgtaccagggcgaggagcttgggctaggcgaggcggatgtggcgttcgaggatctgcgggatccgtacggcatcacgttctggccgaccttcaagggccgcgatggatgccgtacgccgatgccgtggaccgatgcgccgtcggcgggtttcaccagcggcaagccgtggttgccgttgtccgagccgcatcgtctggctgcagtgagtgtgcagcaggacgatgcccagtctgtgctgcgcgcagtgcgggcatttctgagttggcgcaggagcatgccggccctgctcgaaggggcgatcgcgttctacgacatcgcagagccggtgctgatgttccggcgtgagcatgcgggccaggtcatgctgttggcgttcaatttgtctgcagacatcaccgagctggcactgcctgcgggtgcatggcgccagatcgatgtgccgggggtggagcgtggcgtgatcgagcatggccgcgtgcgcttgccggggcatgctgtggtttgcgcaatgggcgggcagtga

SEQ ID NO: 32783 - protein, 538 aa, Xanthomonas axonopodis pv. citri str. 306
MLQTPWWRGAVIYQIYPRSFPDSNGDGVGDLPGIIAKLDYIAGLGVDAIWISPFFKSPMADFGYDIADYRAVDPLFGTLDDFDRLLDRAHALGLKVMIDQVLSHTSIEHAWFQESRQDRTNAKADWYVWADPREDGTPPNNWLSLFGGVAWQWEPRREQYYLHNFLVDQPDLNFHNAEVQQATLDNVRFWLDRGVDGFRLDAINFCFHDAQLRDNPAKPADKRVGRGFSADNPYAYQYHYFNNTQPENLAFLERLRALLDRYPDAVSLGEISSEDSLATTAEYTAKGRLHMGYSFELLVQDYSAAYIRGTVSRLEATMLEGWPCWAISNHDVVRAVTRWGGEDASPAFARMVVALLCSLRGSVCLYQGEELGLGEADVAFEDLRDPYGITFWPTFKGRDGCRTPMPWTDAPSAGFTSGKPWLPLSEPHRLAAVSVQQDDAQSVLRAVRAFLSWRRSMPALLEGAIAFYDIAEPVLMFRREHAGQVMLLAFNLSADITELALPAGAWRQIDVPGVERGVIEHGRVRLPGHAVVCAMGGQ

SEQ ID NO: 32784 - DNA, 1668 bp, Yersinia pestis KIM
  CDS (1)..(1668)
atgaataatccaatcccttggtggcaacatggtgtcatctatcagatttacccgaagagctttcaggacagtaccggtaatggctatggtgacctggcaggcgttgcgcagcggctggattatctgcaaaagctgggcgttgatgccatttggctgacaccggtgtatgtctcgccacaagtggataacggttatgacgtggcggattactgcgccattgaccccgcttatggcacattggatgactttaaacgtttggtcgcgggtgctcatcagcgaggcatacgcatcatcatggatatggtgttcaatcacacctccacagaacatgcctggtttaaagcttcgcaggatcgtaatagcccttatcggcaattttatatttggcgtgacggtgacggtggagacggcagtttaccgaataactggcgctcgaaattcggtggtcacgcatggcagtggcacgcggccagcggccagtattatctgcatttgtttgccccagagcaggctgatctgaattgggaacaccaaccggtacgcgatgagctcaaaaaggtgtgtgaattttgggccgatctgggggttgatggtctgcgtttggatgtcatcaatctggtgtccaaacagcaggatttccctaatgatctggacggcgatggccgccgtttttataccgatggcccacgcattcatgagtttttgcaggaactgagccgcgatgtgttccagccacgccgcctgatgacggtaggcgagatgtcatccacccgtctcgagcattgtcagcgatatgcggcattaggcggtgatgagttatccatgacctttaatttccatcacctgaaagtggattatcttaacggtgaaaagtggtcattgatgccgccgaatcgggtggagttgaaacacatttttaatcagtggcagcaagggatgcacaaccgagcatggaacgcactattttggtgtaatcacgatcaaccacgcattgtctcgcgttttggtcatgaaggcgcactacgtttgccagcggcaaagatgctggcgatggtactgcacggtatgcagggcacgccttatatttatcagggggaagaaattggcatgacgaaccccaatttcactgatatcactcaataccgtgatgttgaaagcctgaatatgtttgccgaactgagtgtggcaggccgcgaacccgatgagttattggcgattctggcagctaaatcccgtgataatagccgtacccccatgcaatgggatagcagcgataatgcgggtttcagccaaggcactccctggattgccccttgcagcaattatcatgagattaacgttaatgccgcattggccgacgctgactcggtgttttatgcctatcaatacctgatagccctgcgtaaacaatacgatattttcactttcggtgattatcaggatctttgcccacagcaccctgatttatggtgctatttgcgcagttggcaagggaagcaactgttggtagtcgctaacctgagtgaagagccccagcgatggcaacccgagggcctcacgctggacggtaattggcaattattgatgagcagctacgaccaaagcgccttccaaccgcaagatatgatattacgcggatatgaggggatttattgggtatgtgagtaa

SEQ ID NO: 32785 - protein, 555 aa, Yersinia pestis KIM
MNNPIPWWQHGVIYQIYPKSFQDSTGNGYGDLAGVAQRLDYLQKLGVDAIWLTPVYVSPQVDNGYDVADYCAIDPAYGTLDDFKRLVAGAHQRGIRIIMDMVFNHTSTEHAWFKASQDRNSPYRQFYIWRDGDGGDGSLPNNWRSKFGGHAWQWHAASGQYYLHLFAPEQADLNWEHQPVRDELKKVCEFWADLGVDGLRLDVINLVSKQQDFPNDLDGDGRRFYTDGPRIHEFLQELSRDVFQPRRLMTVGEMSSTRLEHCQRYAALGGDELSMTFNFHHLKVDYLNGEKWSLMPPNRVELKHIFNQWQQGMHNRAWNALFWCNHDQPRIVSRFGHEGALRLPAAKMLAMVLHGMQGTPYIYQGEEIGMTNPNFTDITQYRDVESLNMFAELSVAGREPDELLAILAAKSRDNSRTPMQWDSSDNAGFSQGTPWIAPCSNYHEINVNAALADADSVFYAYQYLIALRKQYDIFTFGDYQDLCPQHPDLWCYLRSWQGKQLLVVANLSEEPQRWQPEGLTLDGNWQLLMSSYDQSAFQPQDMILRGYEGIYWVCE

SEQ ID NO: 32786 - DNA, 1626 bp, Streptococcus agalactiae 2603V/R
  CDS (1)..(1626)
atgacgattgataaacgtaaagttgtctatcaaatttatccaaaatcatacaaagacacaactggtaatggggttggtgatcttcgtggtattatcgaaaaattaccctatttagcagaacttggtattgatatggtttggctcaacccattttatccaagtccacaacgagataatggatatgatatctctgattatacagctattaaccctgattttggaacgatggacgattttgaagaaatgattgaggtgggacgtcaataccgtatagattttatgcttgatatggtgcttaatcattgttcaatagaacatgagtggtttaaaaaagcacttgcaggagatcgctactatcaagatttctttatcttacgtgataatccaacagattgggtatctaaatttggtggaaatgcttgggcaccatttggtgatacagggaagtattatcttcatctttttgatatcactcaagctgaccttaattggcgcaatgccgatgttcgcaaggaactttttaaagttgtcaatttttggcgtgataaaggggttaaaggttttcgatttgatgtgattaatttaattgggaaagatgagatacttgagaactgcccaattaatgatggaaaaccagcttatactgatcgtccaataacacatgattatctcaagatgttgaataatgctagttttggacaagatgattccttcatgacagttggtgaaatgtcttcaacgacaattgcaaattgcattctttacactgcaccagaacgtgaagagttatccatggcttttaattttcaccacctcaaagtagattataaagatgggcaaaagtggaccattatggcttttgattttcctgcattacgtgaccttttccatagttggggcgaagggatgagcgaaggaaatggttggaatgctttattctataataatcatgaccaaccgcgagcattaaatcgttttgtagacgtgaaacgttttcgaaatgaaggagcaaccatgttagcagcatctatccacttatcgcgtggtactccttatatatatatgggtgaagaaatcggaatgcttgatcccgattacagttctatggatgattatgtggatattgagagtttgaatgcctaccaaataatgcttgatgaaggcaagtcacaagaagaggcatttagcattattcgagcgaaatctcgagacaattctcgagtaccaatgcaatgggatgatagtacgaatgcaggtttttctgaaggcgctccatggttgaaagtaggaaaatcatataaagaaatcaatgtcgcaaaggagaaaacagggctgatatttactttctatcaagagttgataaggctacgtaaacaactgccaataatagctgacgggaattataaagcagctttcaaagataatgaaaaagtatatgcttttgaacgccatcttgataaggaaaaacttcttgttttaaataatttctttgctgagaaagttaagataaaattaccggagaattatctccaaggacaagttcttctatcaaattataaggatgttactcttgatgaaacggttactttgcaaccttatcaaactttagctatcttagtgtcataa

SEQ ID NO: 32787 - protein, 541 aa, Streptococcus agalactiae 2603V/R
MTIDKRKVVYQIYPKSYKDTTGNGVGDLRGIIEKLPYLAELGIDMVWLNPFYPSPQRDNGYDISDYTAINPDFGTMDDFEEMIEVGRQYRIDFMLDMVLNHCSIEHEWFKKALAGDRYYQDFFILRDNPTDWVSKFGGNAWAPFGDTGKYYLHLFDITQADLNWRNADVRKELFKVVNFWRDKGVKGFRFDVINLIGKDEILENCPINDGKPAYTDRPITHDYLKMLNNASFGQDDSFMTVGEMSSTTIANCILYTAPEREELSMAFNFHHLKVDYKDGQKWTIMAFDFPALRDLFHSWGEGMSEGNGWNALFYNNHDQPRALNRFVDVKRFRNEGATMLAASIHLSRGTPYIYMGEEIGMLDPDYSSMDDYVDIESLNAYQIMLDEGKSQEEAFSIIRAKSRDNSRVPMQWDDSTNAGFSEGAPWLKVGKSYKEINVAKEKTGLIFTFYQELIRLRKQLPIIADGNYKAAFKDNEKVYAFERHLDKEKLLVLNNFFAEKVKIKLPENYLQGQVLLSNYKDVTLDETVTLQPYQTLAILVS

SEQ ID NO: 32788 - DNA, 1659 bp, Oceanobacillus iheyensis HTE831
  CDS (1)..(1659)
atgaataaaatatggtggaaagaagcagttacctatcaaatatatccaaggagctttatggattcaaacggtgacggtattggtgatatacaaggaattatttcaaagttagattatattaagggccttggtattgatgttatttgggttagtcctatttatgaatcacctaatgatgataatggatatgatatcagtgattatcaagacattatggatgagtttggcaccatggaggattttgatgaactattagaacaagttcatcatcgtggcatgcgtctgataatggatttagtgattaaccatacatctgatgagcatccttggtttatagaatctcgatcatctaaagataatccatatcgtgattattatatttggcgttcaagtgaaaacaatctggaaccgaataattgggcttctatatttggaggttctgcttggaaatatgataaaaagacagatgaatattttatgcatattttctccaaaaaacagcctgaccttaattgggaaaacccaaaggtgagagaagagttatacgatatggtaaattggtggttagacaaaggaatcgatggcttccgagtagacgctatttctcatattaaaaagacagctgactttccaaatcttcctaatccagaaaataaaaagtatgttccttcctttgaaggccatatgaatcgtgatggaatacagatattcttgcaagaatttaaagaaaagacattagataactatgatattatgactgttggggaagcaaatggggtatctatttcacaggcggatgaatgggttggcgaggataatggtgtattcaatatgatatttcaatttgaacatttggacttatggggaaaaaatacggataatggattagacttgaaagctttaaaagaaacgttaaccaaatggcaaaaaggtctagaatctgtcggttggaatgcattatttttagaaaatcatgatcaaccaagatcaatttctagttggggtgacccaaagacatatcatatagaatctgcgaaagcattggctactctttattttcttatgcaaggtacaccgtttatttaccagggacaagaaattggtatgacaaatgtccactatccttccatcgaagattatgatgatatagatgctaaaaatctttatgaagaaatgatgcaagagggagcgtcttccaaagaagtacttgagattatatggaagacggggagagataattctcgtactccaatgcagtggaataattccaaaaatgctgggtttaccagtgggaatccctggttaaaagtgaatgataattatactagtataaatgttgaacagcaattgaatgatttagattcaatatatcattattatcgtaaattgattgaactacgaaaacaacatgaaacgctaatttatggtggttatgatttaattttagagaatcattcgcaaatttacgcttatacgagaacattggatgagaaacaattcgttgtttttattaacttatttcctgaaaaatgtagttttgaactaccatcttctttagctaagatggaaaggtcattactattaagtaattatgaagcagcagttaatggagaattacagccatatgaagcaagagtctatcaaataactaaaaaatga

SEQ ID NO: 32789 - protein, 552 aa, Oceanobacillus iheyensis HTE831
MNKIWWKEAVTYQIYPRSFMDSNGDGIGDIQGIISKLDYIKGLGIDVIWVSPIYESPNDDNGYDISDYQDIMDEFGTMEDFDELLEQVHHRGMRLIMDLVINHTSDEHPWFIESRSSKDNPYRDYYIWRSSENNLEPNNWASIFGGSAWKYDKKTDEYFMHIFSKKQPDLNWENPKVREELYDMVNWWLDKGIDGFRVDAISHIKKTADFPNLPNPENKKYVPSFEGHMNRDGIQIFLQEFKEKTLDNYDIMTVGEANGVSISQADEWVGEDNGVFNMIFQFEHLDLWGKNTDNGLDLKALKETLTKWQKGLESVGWNALFLENHDQPRSISSWGDPKTYHIESAKALATLYFLMQGTPFIYQGQEIGMTNVHYPSIEDYDDIDAKNLYEEMMQEGASSKEVLEIIWKTGRDNSRTPMQWNNSKNAGFTSGNPWLKVNDNYTSINVEQQLNDLDSIYHYYRKLIELRKQHETLIYGGYDLILENHSQIYAYTRTLDEKQFVVFINLFPEKCSFELPSSLAKMERSLLLSNYEAAVNGELQPYEARVYQITKK

SEQ ID NO: 32790 - DNA, 1815 bp, Bifidobacterium longum NCC2705
  CDS (1)..(1815)
atgaccgccaacaacctcaatgacgactggtggaagcaggccgtcgtctaccagatctacccgcgcagcttcaaggacgtcaacggcgacggactcggcgacatcgccggcgtcaccgagaagatggattacctgaagaacctcggcgtcgacgcgatctggctctccccgttctacccctcggatctggcggacggcggctacgacgtgatcgactaccgcaacgtcgacccgcgcctaggcaccatggacgacttcgacgcgatggccgaggccgcgcacgaggccggcatcaaagtgatcgtggacatcgtgcccaaccacaccgccgacaagcacgtgttcttccaagaggccctcgccgccgagcccggctccccggcgcgcgaccgctacatcttccgcgacggccgcggcgagcacggcgaactgccgcccaacgactggcaatccttcttcggcggcccggcctgggcgcgcgtggccgacggccagtggtatctgcacctgttcgataaggcgcagccggacgtcaactggaagaatccggacatccacgaggagttcaagaagaccctacgtttctggtccgaccacggcaccgacggcttccgcatcgacgtggcgcacggcctggccaaggatctcgaatccaagccgttggaagagctcggccgcgaatacagcgtggtcggcgtgctgaatcatgacttcagccacccgctgttcgaccgtcgtgaggtgcacgacatctaccgcgagtggcgcaaggtgttcaacgaatacaacccgccgcgctttgccgtggccgaggcgtgggtggtgcctgagcaccagcacctgtacgcttcgatggacgagctgggccagtccttcaacttcgacttcgcgcaggccaactggtatgccgacgagttccgcaaggccatcgccgcgggtcttaaggcggcggccgaaaccggcggctccaccaccacgtgggtcatgaacaatcacgacgtgccgcgcagcccctcccgctacggtctgccgcaggtcaagggcgcgccctaccaccagctgccgcacgactggctgctgcgcaacggcaccacatatcccgaagaccgcgagctcggcacccgccgtgcccgtgccgccgcgctgatggagcttggtctgcccggcgccgcctatatttatcagggcgaggagctgggtctgtttgaggtggccgatattccgtgggatcgactggaggatccgaccgctttccacaccgctcaggccacgatggataagggccgtgacggttgccgcgtgcctctgccttggaccgcttccgacgagcccgctctggccgatttcagccgtccggctccggccgacgatggcaccggcgagaaccatgtgccgctgtgcgccgccggccagttcggcacgggcgcttccttcggcttctcccctgcggttcgcgccgatggcgtgacgccggccgccgacccgcacctgccgcagccgctgtggttcaaggattacgcggtggacgtggagcaggccgacccggattcgatgtacacgttgtatcatgcggcgttggcgattcgtcaggagtcgctgaccgccacgcgcgacaccaccgccgagcaggtggatatgggagcggacgtggtggcgtaccgccgtgcggcggttgagggacgcacgttcacctcggttactaactttggcactgccccggtctcactgcccgaaggctctgtggtgctcacttccggcccgctgactcccgacggccaacttcccaccgacacctctgcgtgggtaatcaagtaa

SEQ ID NO: 32791 - protein, 604 aa, Bifidobacterium longum NCC2705
MTANNLNDDWWKQAVVYQIYPRSFKDVNGDGLGDIAGVTEKMDYLKNLGVDAIWLSPFYPSDLADGGYDVIDYRNVDPRLGTMDDFDAMAEAAHEAGIKVIVDIVPNHTADKHVFFQEALAAEPGSPARDRYIFRDGRGEHGELPPNDWQSFFGGPAWARVADGQWYLHLFDKAQPDVNWKNPDIHEEFKKTLRFWSDHGTDGFRIDVAHGLAKDLESKPLEELGREYSVVGVLNHDFSHPLFDRREVHDIYREWRKVFNEYNPPRFAVAEAWVVPEHQHLYASMDELGQSFNFDFAQANWYADEFRKAIAAGLKAAAETGGSTTTWVMNNHDVPRSPSRYGLPQVKGAPYHQLPHDWLLRNGTTYPEDRELGTRRARAAALMELGLPGAAYIYQGEELGLFEVADIPWDRLEDPTAFHTAQATMDKGRDGCRVPLPWTASDEPALADFSRPAPADDGTGENHVPLCAAGQFGTGASFGFSPAVRADGVTPAADPHLPQPLWFKDYAVDVEQADPDSMYTLYHAALAIRQESLTATRDTTAEQVDMGADVVAYRRAAVEGRTFTSVTNFGTAPVSLPEGSVVLTSGPLTPDGQLPTDTSAWVIK

SEQ ID NO: 32792 - DNA, 1746 bp, Leptospira interrogans serovar Lai str. 56601
  CDS (1)..(1746)
ttgttggaatacagccttgacagtcttcattcttatatttttgattccattaaagctcgagtaaatatgacttctaaaaaatcaacttccaaaaaaaaatcacccaatcaattggataagtggtggcaaaaaacaacgatttaccagatttatccccgctcttttgcagatagtaatcgggatggtgttggagacattccagggatcatttctaaattggattatcttcaagatcttgggtttgaaacaatttggatatctcctttgtataaaagtccacaaatggatcacggttacgatgtaagtgattattactcgatcgctccagaatatggaactataaaagatgcagaaaagttaataaaggaagttcataagcgcgggatgaaaatcgtttttgatatggtgatgaatcatacttctattgaacacgattggtttatacaatcccgttctagtcgagataatcctaaaagagattggtatatttggaaagacggaagaggaaaaaataaacctcctaataattggagttcgtttgtgacacccaaggcctggcattatgattccaatacggatcaatggtatcttgcgagttttctagattttcaaccagacttaaattattacaatccagaagtcaaaaaggcaatgttcgacgttttgcgtttttggcttaagaagggagtagatggtttccgtttggatatttttcacgcgatttataaggataaatatttcagagacaatccgtttcgatttaaatatatcgtttcggaaaatgatcacgatggttattttcagagtagggttcatactgtaaaccatccaaataactttgcttttgcgaaagagctaagatccgttttagatgagtttgatggagatcgttttgcggtaggagaggtggccggagatgatcatatcatcaaacgctacttaggcgaaaaaaaagatggcctgaatctaatctttttattcgaaactttgttgttaaagttcaagactagtttttttaagggaatcgtaaaaaaaatggaacaagtatatccgtatccaaacgttcccacatacgtttttggaaaccatgaccaaagacgttacatgatgaaaatcaataataatctcgaaaaaggaaaattgattgctctgtttcagtttaccgcgaggggggttccagtcacttattacggagaagaaattggaatgaccaatgagacgatcaaattaactgaggcacaggatccgcttgcaagaatctatcgctggttaggtgattcgctttccgaattgttgggactcgcagacgttatcattcgggatcgagcaaggtcgccgatgcaatgggacgactcgccaaacgcaggttttacggttcaagaagcaaaaccatggattcgggttcacggaaattatagagaacgtaacgttttgatcgagtccgaagattcggattctcttttaaatacttataaaagtgttcttcgcattcgaaatggaagttttgctcttaaagagggttctttgagattaattgaagaaaacgttccaaaagatatgttagtttatttaagggaatttggtaaggaacgtaaactgatcgtttttaattttggtaaaaaaaccaaatttttttctaatcctaccgattgtagaaaatattttttctctacggtttctttcgatcataacgaatttgatcaatttaaaatacctccttgttctggagttatattaggtaattag

SEQ ID NO: 32793 - protein, 581 aa, Leptospira interrogans serovar Lai str. 56601
MLEYSLDSLHSYIFDSIKARVNMTSKKSTSKKKSPNQLDKWWQKTTIYQIYPRSFADSNRDGVGDIPGIISKLDYLQDLGFETIWISPLYKSPQMDHGYDVSDYYSIAPEYGTIKDAEKLIKEVHKRGMKIVFDMVMNHTSIEHDWFIQSRSSRDNPKRDWYIWKDGRGKNKPPNNWSSFVTPKAWHYDSNTDQWYLASFLDFQPDLNYYNPEVKKAMFDVLRFWLKKGVDGFRLDIFHAIYKDKYFRDNPFRFKYIVSENDHDGYFQSRVHTVNHPNNFAFAKELRSVLDEFDGDRFAVGEVAGDDHIIKRYLGEKKDGLNLIFLFETLLLKFKTSFFKGIVKKMEQVYPYPNVPTYVFGNHDQRRYMMKINNNLEKGKLIALFQFTARGVPVTYYGEEIGMTNETIKLTEAQDPLARIYRWLGDSLSELLGLADVIIRDRARSPMQWDDSPNAGFTVQEAKPWIRVHGNYRERNVLIESEDSDSLLNTYKSVLRIRNGSFALKEGSLRLIEENVPKDMLVYLREFGKERKLIVFNFGKKTKFFSNPTDCRKYFFSTVSFDHNEFDQFKIPPCSGVILGN

SEQ ID NO: 32794 - DNA, 1623 bp, Shewanella oneidensis MR-1
  CDS (1)..(1623)
atgagtgagttaacttggtggcgtggcgccgtaatttatcaaatctatccgcgcagccttttagataccaatggtgatggcgtgggtgatttacgcgggatcatcactaagttggattatattgccagcctaaatgtagatgcgatttggatttcgcctttctttaaatccccaatggcggattttggttacgacattagtgactatcgcgagatcgatcccttattcggctcgatgcaagattttgatgagttgattgaaaaggcgcatcaacgcggcattaaagtcattatcgaccaagtgttaagtcatacatccgatcaacatgcctggtttatcgaaagccgagagagtcgcaccaatcctaaggccgattggtatgtctgggccgatcctagagaagatggcaccccaccaaataactggttagcgatttttggcggctgtgcgtgggagtgggagccgcgcagacaacaatattatttgcacaattttttacgtagccagcccgatatcaacttccataatcctgatgtgcgccaagcggtattggataatgtcgagttttggctcaagaagggcgtcgatggtttccgcttagatgcaattaccttctgtttccacgatgaattgcttcgggataatcccgccaaacctaaagaaaaacgtcaggggcggggatttagtgaagataatccttatgcctatcagtaccattattacaataacgaccgtccgcaaacgattcagtttattgaagcattacgccagcttatcaatcgttatcccggtactgtgaccttaggggaagtctctgcagaagattctctcgcggtgatggccgcttacactaagggtgatgatcgcttacatatggcttacagctttgagctgctgaccgatgattatagtgccgcctacattcgccaaacggtagaggcgttggaaaatagcattggcgacggttggccctgctgggcgatcggaaatcatgatgtgcagcgggtagccagccgttgggggcgcggtaagcaaaccagcgatatggccaaaatgcttaatgcgatgctttgttcgctgcgtggcagtgtctgtagttatcaaggggaagagcttggtttaaccgaagtgccgattgaattccatgaattgcaggacccttttggtaaaactttctggccgatgtttaaggggcgagatggttgccgcaccccaatgccatgggaacaatatgctgattttagtggttttagccaagtatcgccttggttgcctattgcagctgcacatcgagcactggcggtagatctgcaagaagcggattgccattctgtgttgcatggctatcgtcaattccttgcttggcgtaagtgttatcctgcgttgattactagtgagattgagtttctcgatgcgcctgagcccctattggtgtttgtgcgtaaacttggggaacagaagctattggtttgctttaacctgttagacgctgaaactcagttgtcgctaacagggctcaagttacagcaagaattagctggacatggtttgaaaaccgcacatagacaaggtgatagcttgatattttcagcctatgccagcttctatgcgctattggcctaa

SEQ ID NO: 32795 - protein, 540 aa, Shewanella oneidensis MR-1
MSELTWWRGAVIYQIYPRSLLDTNGDGVGDLRGIITKLDYIASLNVDAIWISPFFKSPMADFGYDISDYREIDPLFGSMQDFDELIEKAHQRGIKVIIDQVLSHTSDQHAWFIESRESRTNPKADWYVWADPREDGTPPNNWLAIFGGCAWEWEPRRQQYYLHNFLRSQPDINFHNPDVRQAVLDNVEFWLKKGVDGFRLDAITFCFHDELLRDNPAKPKEKRQGRGFSEDNPYAYQYHYYNNDRPQTIQFIEALRQLINRYPGTVTLGEVSAEDSLAVMAAYTKGDDRLHMAYSFELLTDDYSAAYIRQTVEALENSIGDGWPCWAIGNHDVQRVASRWGRGKQTSDMAKMLNAMLCSLRGSVCSYQGEELGLTEVPIEFHELQDPFGKTFWPMFKGRDGCRTPMPWEQYADFSGFSQVSPWLPIAAAHRALAVDLQEADCHSVLHGYRQFLAWRKCYPALITSEIEFLDAPEPLLVFVRKLGEQKLLVCFNLLDAETQLSLTGLKLQQELAGHGLKTAHRQGDSLIFSAYASFYALLA

SEQ ID NO: 32796 - DNA, 1629 bp, Streptococcus mutans UA159
  CDS (1)..(1629)
atgacattagacaaaaggaaagttgtctatcaaatttatcccaaatcgtataaagacacaagtggaaatggggtcggggatcttcagggaattattgaaaaattaccttatttagaagaattgggaattgatgttatctggctcaacccattttatcctagtccacagcgcgataacggctatgatgtgtctgactatactgctgtgaatcctttatttgggagcatggccgattttgaagaattagtacgcaaaggaaaagagcatggcattgagatcatgctggacatggtactcaatcactgttcgatagaacacgaatggttccaaaaggccttggctggagataagtattatcaggatttctttattttaagagataggcctactgactgggtttctaaattcgggggcaatgcttgggcaccttttggagagacagggaagtattacctgcatctgtatgatgtcacgcaggctgatttaaattggcgcaatcctcacgttcgtgaggaactgtttaaggtggtcaatttctggcgcaacaggggagtcaagggctttcgctttgatgttatcaatgtgattgggaaagacgaggtcctaaaggataatcctcattttgatgggaaacctgaatatacagaccgtcccattaatcatgattatttaaaaatgctcaataaagccagctttggtcaggatgaaaatggtatgactgttggcgagatgagttttacagacattcctaactgcatacaatacagcaatcccgacaaccatgaattggatatggtctttaattttcatcatcttaaagtggattatgaaaatggtcaaaaatggacacgcaaaacgtttgattttgaagaactgaaacatctctttcatacttggggtgaagggatgagtcaaggtaacggctggtctgctctcttttggaataatcacgatcagccacgagcgcttaatcgctttgttgatattaagcagtttcgcaatgaaggagcgaccatgcttgcagcctcgattcatttatctcgtggtacgccctatatttatatgggggaagaaattggcatgattgatccagactatggttctatggctgattatgttgatgtggaaagcctgaatgcctatcaagaattaatagataaaggcaaatcttctgaggaagcctttcacattattcgagccaaatcgcgtgataatgcacgtacccctatgcaatgggatactagcgagaatgcaggtttttcaactggcaggccgtggctgaaggttggaaagagctacccacaaatcaatgtggctaatgaaaaacaaggtaagatctttcctttttatcaaaaattgattcgtttgcgaaaagaaatgccgctaattgctcaaggcagttatcaagcagctttgacagacagtgataaaatctatgcctttgaacgagagtacgaaggccaaaagctgctggttctcaataatttctttgctgaaacagttgagctagacttgccttccctttatcaagcagggaccgttctcattagtaattacgatgatgttatcttagataaacggatttccttaaaaccttatcagacagtagcgattttagcagaagtctga

SEQ ID NO: 32797 - protein, 542 aa, Streptococcus mutans UA159
MTLDKRKVVYQIYPKSYKDTSGNGVGDLQGIIEKLPYLEELGIDVIWLNPFYPSPQRDNGYDVSDYTAVNPLFGSMADFEELVRKGKEHGIEIMLDMVLNHCSIEHEWFQKALAGDKYYQDFFILRDRPTDWVSKFGGNAWAPFGETGKYYLHLYDVTQADLNWRNPHVREELFKVVNFWRNRGVKGFRFDVINVIGKDEVLKDNPHFDGKPEYTDRPINHDYLKMLNKASFGQDENGMTVGEMSFTDIPNCIQYSNPDNHELDMVFNFHHLKVDYENGQKWTRKTFDFEELKHLFHTWGEGMSQGNGWSALFWNNHDQPRALNRFVDIKQFRNEGATMLAASIHLSRGTPYIYMGEEIGMIDPDYGSMADYVDVESLNAYQELIDKGKSSEEAFHIIRAKSRDNARTPMQWDTSENAGFSTGRPWLKVGKSYPQINVANEKQGKIFPFYQKLIRLRKEMPLIAQGSYQAALTDSDKIYAFEREYEGQKLLVLNNFFAETVELDLPSLYQAGTVLISNYDDVILDKRISLKPYQTVAILAEV

SEQ ID NO: 32798 - DNA, 1839 bp, Corynebacterium efficiens YS-314
  CDS (1)..(1839)
atgcagggtcgacgagacgtggaaaatgtctctacccttgtgggtatgactgacactaccccgttgagttcggacctgatcccagagagcaccgcccgcccggtagtcgatgccgagggcttcatcattgagcatgagtcggaggagtaccacactcccacccccgcccccggtgaacagccctgggagaaacatgaccgcgaatggtacaaggacgctgtgttctatgaggtgctggtgcgtgccttctacgacccggacaacaccggttcgggcaccctgaagggtctgacggagaagctggattacatccagtggctgggtgtggactgcatctgggtgccgcccttctacgactctcccctgcgtgatggtgggtatgacatccggaacttccgtgagatcctgccggagttcggcacggtggaggatttcgtggagctggttgaccaggcccaccgccgtggtctgcgtgtgatcaccgacctggtgatgaaccacacctccgatcagcatccgtggttccagcagtcccggacggatccggatggcccctatggtgacttctacgtctggggggatgatccggagatgtacaaggaagcccgcatcatcttcgtcgataccgaggaatccaactggacctacgacccggtgcgcaagcagtactactggcaccggttcttctcccaccagccggacctgaactatgacaacccggcggtgcaggaggcgatgctcgatgtgctgcggttctggctggatctgggtctggatgggttccgtctggatgccgtgccctacctgttcgagcgtgagggtaccaacggtgagaacctgccggagacccacgagtttctcaagcggtgccgtcgggtgatcgatgaggagtacccgggccgcatcgtcctggcggaggccaaccagtggccccatgatgtggtggagtacttcggtgagaaggagaagggcgatgagtgccacatggccttccacttcccgctcatgccccgcatcttcatgggtgtgcgccaggggtcccgcaccccggtcagtgagatcctcgagcacaccccggacatccccaagaccgcccagtggggtatcttcctgcgcaaccatgacgagctgaccctcgagatggtgtccgaagaggaacgcgcctacatgtaccagcagttcgcccccgagcctcggatgcgcgcgaacgtgggtatcaggcgtcgactagcaacgcttgtcgacggcgaccgcaaccagctcgaactcctgcacgggctgttgctgtccctcccgggttcccccgtgctgtactacggcgatgagatcggcatgggcgacaacatctggctgccggaccgtgatggcgtgcgcacccccatgcagtggtccaatgaccgcaacgggggtttctccaaggcagatcccgagcgtctttatctgccagcgatccagaatgaccgcttcggttatgcccaggtcaatgtggaaacccagctcaagcaggagaactccctgctgcagtggatccgcaaccagatcatgatccgcaagcagtacaaggccttcggcaagggcacctaccgggagatcgactccaccaacgaggcggtgctgaccttcctccgtgagtacaaaggccagaccattctgtgtgtcaacaacatgtcgaagctgccacaggcggtggccctggatctcagcgagttcgccggcatcaccccgcgtgaggtctccggcggccagtacttccccaccatcggtgagcgccagtgtgtgttcaccctggcaccgcatgggttcttctggctcgatctcaccggtgaggaggaggaatga

SEQ ID NO: 32799 - protein, 612 aa, Corynebacterium efficiens YS-314
MQGRRDVENVSTLVGMTDTTPLSSDLIPESTARPVVDAEGFIIEHESEEYHTPTPAPGEQPWEKHDREWYKDAVFYEVLVRAFYDPDNTGSGTLKGLTEKLDYIQWLGVDCIWVPPFYDSPLRDGGYDIRNFREILPEFGTVEDFVELVDQAHRRGLRVITDLVMNHTSDQHPWFQQSRTDPDGPYGDFYVWGDDPEMYKEARIIFVDTEESNWTYDPVRKQYYWHRFFSHQPDLNYDNPAVQEAMLDVLRFWLDLGLDGFRLDAVPYLFEREGTNGENLPETHEFLKRCRRVIDEEYPGRIVLAEANQWPHDVVEYFGEKEKGDECHMAFHFPLMPRIFMGVRQGSRTPVSEILEHTPDIPKTAQWGIFLRNHDELTLEMVSEEERAYMYQQFAPEPRMRANVGIRRRLATLVDGDRNQLELLHGLLLSLPGSPVLYYGDEIGMGDNIWLPDRDGVRTPMQWSNDRNGGFSKADPERLYLPAIQNDRFGYAQVNVETQLKQENSLLQWIRNQIMIRKQYKAFGKGTYREIDSTNEAVLTFLREYKGQTILCVNNMSKLPQAVALDLSEFAGITPREVSGGQYFPTIGERQCVFTLAPHGFFWLDLTGEEEE

SEQ ID NO: 32800 - DNA, 1656 bp, Escherichia coli CFT073
  CDS (1)..(1656)
atgactcatcttccccactggtggcaaaacggcgttatctaccagatttatccaaagagttttcaggacaccacgggtagcggcaccggcgatttacgtggcgttatccaacgcctggactatctgcataaactgggcgttgatgccatctggctaacccccttttatgtctctccccaggtcgataacggttacgacgtagcgaattatacggcgattgatcccacctatggcacgctggacgattttgacgaactggtgacacaggcaaaatcgcgtgggattcgtatcattctcgatatggtgtttaaccatacctctacccaacatgcctggtttcgcgaggcgctgaacaaagaaagcccttaccgccagttttatatctggcgcgatggagaaccagaaacgccaccgaacaactggcgttcaaaattcggtggtagtgcgtggcgctggcatgcagaaagcgaacagtactatttgcatctctttgcaccagaacaggcggatctcaactgggagaatccagcggtacgcgcagagctgaaaaaagtctgtgagttctgggccgatcgtggggtcgacgggttgcgcctggatgtggtgaatctgatctccaaagatccgcgttaccctgaagacctggatggcgacgggcgtcgcttctataccgacgggccacgagcacacgagtttttgcacgagatgaaccgcgatgtgtttacgccacgcgggttaatgaccgtaggtgaaatgtcctccaccagccttgagcattgccagcgatacgcggcactgacaggcagtgaattgtcgatgacctttaattttcatcacctgaaggtcgattatcccggaggtgaaaaatggacgctggctaaacctgactttgtggcgttgaaaacattgttccgccactggcaacaaggaatgcacaacgtggcatggaatgccttgttctggtgtaaccacgatcagccgcgcattgtttctcgctttggtgatgaaggtgaataccgcgtgcctgcggcaaaaatgctggcgatggtgctgcatggcatgcagggaacgccgtatatctaccagggcgaagagattggcatgaccaacccacatttcacgcgcattactgactatcgcgacgtggagagcctcaatatgtttgccgagctgcgcaacgatgggcgtgatgccgacgagttattggcaatcctcgccagtaaatcccgtgacaacagtcgcacacccatgcaatggaccaacggcgataatgccgggtttacggctggcgaaccgtggattggcctgggcgataactatcaggaaatcaacgtagaagcagcgctggccgatgagtcctcggtgttttacacctaccaaaagttaatcgcactgcgtaagcaagaagccgtcctgacatggggcgattaccaggatctgctgccaaacagccctgtattgtggtgctatcgccgtgagtggaaggggcaaaccttgctggtcattgccaaccttagccgtgagacccaaccctggcagccagggaaaatgctcggcaactggcagcttgtgatgcataactacgaagaagcctcaccacaaccctgtaccatgactttacggccttttgaggctgtctggtggttacagaagtaa

SEQ ID NO: 32801 - protein, 551 aa, Escherichia coli CFT073
MTHLPHWWQNGVIYQIYPKSFQDTTGSGTGDLRGVIQRLDYLHKLGVDAIWLTPFYVSPQVDNGYDVANYTAIDPTYGTLDDFDELVTQAKSRGIRIILDMVFNHTSTQHAWFREALNKESPYRQFYIWRDGEPETPPNNWRSKFGGSAWRWHAESEQYYLHLFAPEQADLNWENPAVRAELKKVCEFWADRGVDGLRLDVVNLISKDPRYPEDLDGDGRRFYTDGPRAHEFLHEMNRDVFTPRGLMTVGEMSSTSLEHCQRYAALTGSELSMTFNFHHLKVDYPGGEKWTLAKPDFVALKTLFRHWQQGMHNVAWNALFWCNHDQPRIVSRFGDEGEYRVPAAKMLAMVLHGMQGTPYIYQGEEIGMTNPHFTRITDYRDVESLNMFAELRNDGRDADELLAILASKSRDNSRTPMQWTNGDNAGFTAGEPWIGLGDNYQEINVEAALADESSVFYTYQKLIALRKQEAVLTWGDYQDLLPNSPVLWCYRREWKGQTLLVIANLSRETQPWQPGKMLGNWQLVMHNYEEASPQPCTMTLRPFEAVWWLQK

SEQ ID NO: 32802 - DNA, 1686 bp, Vibrio vulnificus CMCP6
  CDS (1)..(1686)
atgacaacacgtaacacagatgcacattggtggaaaaccgccactatctatcaaatctacccaaaaagtttttgcgacagcggggcaaaggggacgggagatattcaaggcatcatctctaagttggaatatttgaagcatctcggtattgatgcaatctggctaacgccggtttaccaatcgccgatggtcgataatggatacgacatttcggattactaccgaattaatcctcagtttggcacgatggctgattttgatgaattgctcgagaaagcgcatcagcttggaatccgtcttatcatggacattgtggtgaaccacacctcgaccgaacacgcttggtttcaatcggcactgggtaacaaaaacagtccgtatcgggattactacatctggaaagacccagtggaaggaaaagtgcccaataattggcagtctaagtttggcggcagcgcttgggcgctggatgaacaaacgggccaatattatctgcaccttttcgccaaagagcaggccgatctcaattgggaaaatcccacggttcgtgaggaagtgaaaaatgttattcgtttttgggcggaaaaaggcgtcgacggatttcgtctggacgtcatcaatctgatttcgaagcaacaagatttttgcgacgatgagattggcgatgggcgtcgtttctatactgatggaccgcgtgtgcacgactatctccaagagatcagtcaagccgttttccaaaagtatggcagtgtgacagtgggtgagatgtcatcgacaaccttagagcattgtcagcagtactcctcacttgatggcaaagagctttccatggtgttcaatttccatcacctgaaagtggattattcaaatggtgaaaaatggaccaaggcaccatttgactttctccagctcaaacagatttttaatcattggcaaaccggcctgaatgggaaagggtggggagcgctcttttggtgtaaccatgatcagccacgtatcgtgagccgtttgggcaacgatcaagtgtatcgcgttgaatcggcaaaaatgttggctgcctcggttcatatgatgcaaggcacgccttatgtttatcaaggcgaagaaattggcatgaccaacccagggtatacagcgattgaacagtatcgtgatgttgaaagcaccaacatgtatcagatcatggttgagcagcaaggaattgaccatgacgaaatgatggcaattttggcacaaaagtctcgtgataattcacgcaccccaatgcagtggtcagaagaaaaacacgcaggatttacgcaaggagaaccttggttagcggtggcgagtaactacccgaagatcaacgcggaagcggcggtggcggatctcaattcggtgttctatttctataagcgattgattgaactgcgtaaagaagagccagtgatcacccaaggtgattatcaagacttattacccgagcatcagagtgtgtttgcttatgcacggaccagtgcggctcagcaactggtgtgcatcaataactactacggggaagaagtagagtgcgtgttgccattggatctcgacatgcgtaaagcgaaatgtttgctgtctaactaccaaaatcaaccgagtgccatggcttcgcatcaccaagtgctcaaaccttacgagactcgtattctcttgattgaacgttaa

SEQ ID NO: 32803 - protein, 561 aa, Vibrio vulnificus CMCP6
MTTRNTDAHWWKTATIYQIYPKSFCDSGAKGTGDIQGIISKLEYLKHLGIDAIWLTPVYQSPMVDNGYDISDYYRINPQFGTMADFDELLEKAHQLGIRLIMDIVVNHTSTEHAWFQSALGNKNSPYRDYYIWKDPVEGKVPNNWQSKFGGSAWALDEQTGQYYLHLFAKEQADLNWENPTVREEVKNVIRFWAEKGVDGFRLDVINLISKQQDFCDDEIGDGRRFYTDGPRVHDYLQEISQAVFQKYGSVTVGEMSSTTLEHCQQYSSLDGKELSMVFNFHHLKVDYSNGEKWTKAPFDFLQLKQIFNHWQTGLNGKGWGALFWCNHDQPRIVSRLGNDQVYRVESAKMLAASVHMMQGTPYVYQGEEIGMTNPGYTAIEQYRDVESTNMYQIMVEQQGIDHDEMMAILAQKSRDNSRTPMQWSEEKHAGFTQGEPWLAVASNYPKINAEAAVADLNSVFYFYKRLIELRKEEPVITQGDYQDLLPEHQSVFAYARTSAAQQLVCINNYYGEEVECVLPLDLDMRKAKCLLSNYQNQPSAMASHHQVLKPYETRILLIER

SEQ ID NO: 32804 - DNA, 1656 bp, Staphylococcus epidermidis ATCC 12228
  CDS (1)..(1656)
atgaaaagaaattggtggaaagaagcagttgcatatcaagtatatccacgaagttttaatgatagtaatggagatggaataggtgatctacctggattaattgaaaaattagattatctagaaaatttaggaatagatgtcatttggttaagcccaatgtatccatcaccaaacgatgataatggatatgatattagtgactacaaaggcattatgagtgaatttggtacaatgaacgattttgatcaattgttatcaagcatacatcaaagagggatgaaattaatattagacttagtggttaatcacacatcagatgaacacccttggtttattgaatcaaaatctagtaaaacaaatgcaaaaagagattggtatatttgggcagatcctaaaccggatggatctgaacctaataactgggaaagtatctttaatggttcaacttgggagtttgacgaatcgactaagcaatactatttccatttatttagcaaaaagcagccagatttaaattgggaaaatccagatgtaagacaagctgtgtttgaaatgatgaattggtggtttgaaaaaggtattgacggatttagagttgatgccattactcatattaaaaagaattttgaagcaggagatttacctgtacctgatggcaaaaaatttgctccagcatttgatgtagatatgaatcagccaggaatacaagaatggctccaagaaatgaaagataaatcgttaagtcggtatgacattatgactgtaggcgaggctaatggtgttactcctaatgatgctgaagaatgggtaggagaagaaaatgggaaatttaatatgatattccagtttgaacatcttggtttatggagtactggcgatacgaaattcgatgttaaatcctataaacaagtcttaaatcgttggcaaaagcaactagaaaatgtaggttggaatgctttatttatcgaaaaccatgatcaaccacgtcgtgtttcaacctggggtgatgataaaaattattggtatgaatcagcaactagtcacgctactgcctactttttacaacagggcacaccttttatttaccaaggtcaagaaataggtatgactaattatccatttgaaagcattgaaagtttcaacgatgtcgcagtgaaaactgaatatcaaatagtcaaaaaagaaggtggagatgtcaatcaattactagataaatataaaatggaaaaccgagacaatgcaaggactccaatgcaatggaataattctatcaatgctggattcactactggtaagccatggtttcatgtaaaccctaactatacagaaattaatgttaaacaacaactaaatgataagttttcgatactttcttattataaagcgttaattcaactaaaaaaatctgatttgatttacatctacggtaagtttaatatggtcgatgctgaaaataagcaggtttttgcatatacacgcacatttaaaaacaatactgtattaattgtagccaatctcacaaatgaagtatcagaactaaacctaccttttgaattagatatttcatctgtagatataaaattgcataattatcacttaaatgatataaatttagaccatattaaaccttatgaatcattcgtcgttgaaatataa

SEQ ID NO: 32805 - protein, 551 aa, Staphylococcus epidermidis ATCC 12228
MKRNWWKEAVAYQVYPRSFNDSNGDGIGDLPGLIEKLDYLENLGIDVIWLSPMYPSPNDDNGYDISDYKGIMSEFGTMNDFDQLLSSIHQRGMKLILDLVVNHTSDEHPWFIESKSSKTNAKRDWYIWADPKPDGSEPNNWESIFNGSTWEFDESTKQYYFHLFSKKQPDLNWENPDVRQAVFEMMNWWFEKGIDGFRVDAITHIKKNFEAGDLPVPDGKKFAPAFDVDMNQPGIQEWLQEMKDKSLSRYDIMTVGEANGVTPNDAEEWVGEENGKFNMIFQFEHLGLWSTGDTKFDVKSYKQVLNRWQKQLENVGWNALFIENHDQPRRVSTWGDDKNYWYESATSHATAYFLQQGTPFIYQGQEIGMTNYPFESIESFNDVAVKTEYQIVKKEGGDVNQLLDKYKMENRDNARTPMQWNNSINAGFTTGKPWFHVNPNYTEINVKQQLNDKFSILSYYKALIQLKKSDLIYIYGKFNMVDAENKQVFAYTRTFKNNTVLIVANLTNEVSELNLPFELDISSVDIKLHNYHLNDINLDHIKPYESFVVEI

SEQ ID NO: 32806 - DNA, 1464 bp, Bradyrhizobium japonicum USDA 110
  CDS (1)..(1464)
atggcacagggcgaggtgaattggtggcgcgacggcatcttctaccaggtctatccgcgctcgtttcaggacagcgacggtgacggcgtcggcgatctcgccggcatcttgcggcggctgccttatgtgaagtcgctcggcgtcgacgcgatctggctgtcgccgatcttcccctcgccgatggccgatttcggctacgacatttccgaccataccggcatcgatccgctgttcggcacgatggcggatttcgacgcgctgctcacggccgcgcatgagcatggtctcaagctgatcctcgacctcgtgcccaaccacacctcggaccagcatccctggtttgtcgagagccggtcctcgcgcgacaatcccaagcgcgactggtacgtctggcgcgatccggcgcccgatggcggcgtgccgaacaactggctgtccgagttcggcggcagcgcgtggcagttcgacgagacgacgggtcaatattactatcacgccttcctcgcccagcagccggacctcaactggcgcaacccggacgtccgcgcggcgatctacgacgcgatgcggttctggctggacaagggcgtcgacggctttcgcgtcgacgtgatctggcacctgatcaaggacgccgaattccgcgacaatccgctcaatcctcactacgtcgagggccgtccgccgaacgagaagatcctgacgcaatattccaccgaccagccgccgttcaacttcgcgctgctctcgacgttctggagcgcgcgctcgatcgagacgatcatcgacgactacgagaaggcgctgccgaaaggcgcctggccgaactgggtgctcggcaatcacgaccgcccgcgggtcgccagccgtgtcgggcccgagcaggcccgcgtcgccgccatgctgctgctgacgctgcgcggcacgccgacgctctattacggcgacgagatcggcatgcatcagctcgcgatcgcgcccgaggacgtgcgcgatcccttcgagaagaacgtgcccggcatcggcgtcggccgcgacggttgccgcacgccgatgcagtgggattcctcgaacttcgccggcttctcgaacgtcaggccgtggctgccgctgcctgaggatcatatccacgagaatgtcgtcaatctcgaagccgacacgcgctcgatcctcagcctgtacaggcggctcatcgtgctgcgaaagagcagcccgcccctggtggccggcaactatcatccgatcgctgcgcagggcgatctcctgatctaccgccgcgaggccgagggcagggcggtgatcgtggccctcaatctcggccccgacccgatcgccgtcaccaccagcgcgatccgcttcggcagcgagatcctgctgtcgacgttcctggatcgtgagggtgagcggctggaaggggtgctggatctgcgcgggaatgaaggggtgatcgtgcagccgccctaa

SEQ ID NO: 32807 - protein, 487 aa, Bradyrhizobium japonicum USDA 110
MAQGEVNWWRDGIFYQVYPRSFQDSDGDGVGDLAGILRRLPYVKSLGVDAIWLSPIFPSPMADFGYDISDHTGIDPLFGTMADFDALLTAAHEHGLKLILDLVPNHTSDQHPWFVESRSSRDNPKRDWYVWRDPAPDGGVPNNWLSEFGGSAWQFDETTGQYYYHAFLAQQPDLNWRNPDVRAAIYDAMRFWLDKGVDGFRVDVIWHLIKDAEFRDNPLNPHYVEGRPPNEKILTQYSTDQPPFNFALLSTFWSARSIETIIDDYEKALPKGAWPNWVLGNHDRPRVASRVGPEQARVAAMLLLTLRGTPTLYYGDEIGMHQLAIAPEDVRDPFEKNVPGIGVGRDGCRTPMQWDSSNFAGFSNVRPWLPLPEDHIHENVVNLEADTRSILSLYRRLIVLRKSSPPLVAGNYHPIAAQGDLLIYRREAEGRAVIVALNLGPDPIAVTTSAIRFGSEILLSTFLDREGERLEGVLDLRGNEGVIVQPP

SEQ ID NO: 32808 - DNA, 1674 bp, Lactobacillus plantarum WCFS1
  CDS (1)..(1674)
atggctaatcaatggtggcaatcagcggttgtttatcaggtttatccacggtcgtttcaggattcaaatggtgatggaatcggtgatttgccaggaattacacaacggttagattatattaaacagctcggcgcggatgtgatttggctcaacccaatttaccgttcacccggtgtcgataatggctatgatattagtgattattacgatattaatccagaattcgggacgatggctgattttgatcaattattaacaacggcccatgcgaaagggttaaaaatcatgatggacattgttgtcaaccattcatctgatcaaaataagtggtttacgacgagtgcgcaaagtaaggataatccgtacgcggactattatatttggcgtgatcctgttgatgggcatgaacctaacaactggggtggctttttcggtggctctgcttggaaatatgttgccagccgtgatcagtattacttacattcatttgcggttgaacagccagatttgaactgggataatccgcaactacggcaagcagtctatgacatgatgaatttctgggtcaataagggcgtggacggtttccgcttggatgtcattaacttgatttccaagcctgatagctttgcagatgggcagccagaagctggggaaccatacgcggcaatcggtggaattattgccaatggtccgcatctccatgaatacttacaagaaatgaatcagcaagtgtttgcaggccatcaactgatgacggtcggcgaaacgcctggggctacggttgctgatgctaagcaactggcaagcggccaaggtcaggaattaaacatggtgtttgaatttgaacacatgggcctggatggtaatccagatccggcgctaggtaagtggaatgaccagcccgtccgactggttgacctaaagcagagcttgtctaagtggcaaatgggcttacaagggacagcctggaatagtctctattggaataatcatgaccaaccgcgaattgtgtcacgattcggggatgaacggccagcttatcgggaacgttcagccaaaatgctagcgaccctattgcactttcttcaagggacaccctacatctacgaaggtgaggagctaggcatgacgaatgcccattttaccaagttaaccgactatcaagacttggaatcactgaatgcgtatcatcactttgttgatgacgaacaggtcgttcaacctgaacagatgttaggttatctcgcccatatgtcgcgggataatgcgcgtacaccgatgcagtgggatgatagtcagaatgctgggttttcaacggcaacaccgtggctagcggttaatgccaattatccgcggatcaacgcgcaactcgcgcaacgaacgcccggttcagttctgagctattatcagcggctgattaagctccggcaccatttaccagtcataacgacgggaacttatcacctattatcacctgatgatgcggccgtttatgcctatgtgcggcatatggggtcgcagcacctgctagtaatttgtaactttactgcggcaacccagacgcgacactttgcagaattacccgctgatgcgcatctgttgatcagtaactacgatgaagatcatcaagacgtattacgagcgtacgaagcgaaagtttaccagttttag

SEQ ID NO: 32809 - protein, 557 aa, Lactobacillus plantarum WCFS1
MANQWWQSAVVYQVYPRSFQDSNGDGIGDLPGITQRLDYIKQLGADVIWLNPIYRSPGVDNGYDISDYYDINPEFGTMADFDQLLTTAHAKGLKIMMDIVVNHSSDQNKWFTTSAQSKDNPYADYYIWRDPVDGHEPNNWGGFFGGSAWKYVASRDQYYLHSFAVEQPDLNWDNPQLRQAVYDMMNFWVNKGVDGFRLDVINLISKPDSFADGQPEAGEPYAAIGGIIANGPHLHEYLQEMNQQVFAGHQLMTVGETPGATVADAKQLASGQGQELNMVFEFEHMGLDGNPDPALGKWNDQPVRLVDLKQSLSKWQMGLQGTAWNSLYWNNHDQPRIVSRFGDERPAYRERSAKMLATLLHFLQGTPYIYEGEELGMTNAHFTKLTDYQDLESLNAYHHFVDDEQVVQPEQMLGYLAHMSRDNARTPMQWDDSQNAGFSTATPWLAVNANYPRINAQLAQRTPGSVLSYYQRLIKLRHHLPVITTGTYHLLSPDDAAVYAYVRHMGSQHLLVICNFTAATQTRHFAELPADAHLLISNYDEDHQDVLRAYEAKVYQF

SEQ ID NO: 32810 - DNA, 1686 bp, Vibrio parahaemolyticus RIMD 2210633
  CDS (1)..(1686)
atggctatgaccaagcatgatgagagctggtggaaaaccgcaaccatctaccaaatttacccaaaaagcttttgtgacagtggcagtaaaggcacgggcgacattaaagggatcatttctaaactggattatctaaaacaccttggtgtggatgcgatttggctaacgccagtgtatcagtctcctatggttgataacggttatgacatttccgattattacgcgatcaatccacagttcggcactatggaagatttcgataccttgctggcagaagcgcatcagttgggtattcgtatcatcatggacattgtagtgaaccacacgtcgactgagcatcattggttccaatccgcgttaggggacaaaaacagcccataccgtgactactacatctggaaagatccggttgatggcgctgaacctaacaactggcaatcgaagtttggaggcaatgcttgggaattggatgacgcgacagggcagtactacttgcacctttttgctaaagagcaggcggatttgaactgggaaaatccagcggtgcgtgaagaagtcaaagaagtcatcagtttctgggcagacaaaggcgtggatggtttccgtctcgacgtcatcaacctgatttctaaacaacaagacttcccaagtgatgatattggcgatggccgtcgtttctatacggatggtcctcgcgtgcacgaatatctgcaagaaatcagcgaagccgtgtttcaaaagtacggcagcgtgacggtgggggaaatgtcttcgaccacgctagagcactgccagcaatactcttcattaaatggcaaagagctgtcgatggtgttcaattttcaccacctgaaagtcgattatccgaatggtgaaaaatggaccaaagcgccgtttgatttcattcagttaaagcagatcttcaaccattggcaaacgggcttaaatggcaaagggtggggcgcactgttctggtgtaaccacgatcaacctcgtgtggtcagccgcttaggtgatgataaacaataccgcgttgagtcggcgaaaatgctggcggcgtctgtacatatgatgcaaggcacgccgtatgtttatcaaggtgaagagattggtatgaccaacccaggttacactgagatcagccagtaccgtgacgtagaaagcaccaacatgtacgacatcatggtcaaccgcgatggcgtatcacacgaggagatgatggcgattttggcgcagaagtcgcgtgataactcacgtacgccaatgcagtggaatagccaaaagcacgctggttttaccgaaggcacaccgtggcttgaggtggcgcagaattactctgaaatcaacgcagaagcagcggttgcagatttgaactcggtgttctacttctacaaacgtttgattgagctacgtaaacaggttccggtgatcaccgatggccgttatgaagatttactgccagagcatcaacgcatttttgcttacgctcgccagaacgacaaacaaacgctgctgtgtgtcaataactactacgctgcagaggtggaatgcgttctgccagaacgttttgaactgagtaaagcgaaaaacttgctatccaattatcaaaactcagcgagcgcagtcgcatcaaaccatcaagtgttacgaccttacgaaactcgtattttattgatagaagaataa

SEQ ID NO: 32811 - protein, 561 aa, Vibrio parahaemolyticus RIMD 2210633
MAMTKHDESWWKTATIYQIYPKSFCDSGSKGTGDIKGIISKLDYLKHLGVDAIWLTPVYQSPMVDNGYDISDYYAINPQFGTMEDFDTLLAEAHQLGIRIIMDIVVNHTSTEHHWFQSALGDKNSPYRDYYIWKDPVDGAEPNNWQSKFGGNAWELDDATGQYYLHLFAKEQADLNWENPAVREEVKEVISFWADKGVDGFRLDVINLISKQQDFPSDDIGDGRRFYTDGPRVHEYLQEISEAVFQKYGSVTVGEMSSTTLEHCQQYSSLNGKELSMVFNFHHLKVDYPNGEKWTKAPFDFIQLKQIFNHWQTGLNGKGWGALFWCNHDQPRVVSRLGDDKQYRVESAKMLAASVHMMQGTPYVYQGEEIGMTNPGYTEISQYRDVESTNMYDIMVNRDGVSHEEMMAILAQKSRDNSRTPMQWNSQKHAGFTEGTPWLEVAQNYSEINAEAAVADLNSVFYFYKRLIELRKQVPVITDGRYEDLLPEHQRIFAYARQNDKQTLLCVNNYYAAEVECVLPERFELSKAKNLLSNYQNSASAVASNHQVLRPYETRILLIEE

SEQ ID NO: 32812 - DNA, 1614 bp, Streptococcus pyogenes SSI-1
  CDS (1)..(1614)
atgaagaaacactggtggcataaagctacgatttatcagatttacccaagatcctttaaagacaccaatggcaatggtattggtgatttaaaaggcattaccagtcaactggactacttgcaaaaacttggcattacagccatttggttatctcctgtttaccagtcgcccatggatgacaatggctatgacatctctgactatgaagcgattgctgatgtttttggagacatggcagatatggatgagctcttagcagcagctaatgagcgaggcattaagattatcatggacttggtggtcaaccatacgtctgatgagcatgcttggtttgttgaagctagggaaaaccctaatagtcctgagcgtgatttttatatttggcgagatgaacctaacgatttgacttctatttttagtggctcagcttgggaatatgataatgcatcaggtcaatattatttgcacctttttagcaaacgtcagccagatctcaactgggagaatgaagctttacgtcataaaatttacgatatgatgaatttctggattgccaaaggcatcggtggttttcgtatggacgtgattgacctgattgggaaggttccagattctgaaatcacgggtaacgggccgcgcttacacgattacctcaaagaaatgaatcaagcaacctttggcaaccatgacgtgatgactgtcggtgagacttggggagcaacgcctgaaattgctcgccagtattctcgccctgaaaacaaagagttatccatggtcttccaatttgagcatgtgggtcttcaacataaacctgacgctcccaagtgggattatgccaaagaattagacgtgcctgctctgaaagctatttttagcaagtggcagacagaattaaagttaggagaaggctggaattcgcttttttggaataaccatgacttgccacgggtcttatccatttggggcaatgacagcacttaccgagaaaaatcagccaaggctttagctattttactgcatttgatgcgaggaaccccttacatttaccaaggagaagagattggcatgaccaattatccttttaaagacttaaccgaggttaatgatattgagtcccttaactatgctaaggaagctatgggaaatggagtgtcagctgcgcgtgtgatggatagcatccgtaaggtaggacgagacaatgctagaacgccaatgcagtggtctaaggacacacatgctggcttttctaaagcccaagagacttggttgccggtcaaccccaactaccaagacatcaatgtggccgatgcccttgctgatccagattctattttttacacttaccaaaaattgattgccttgcgtaaggagcaagactggctagttgaagcggattatcacctcttgccaacagctgataaagtgtttgcttatcagcgtcagcttggagaagagacgtatgtgattgttgtcaatgtgtctgatgaggagcaagtctttgccaaagatttagcaggtgcacaagtgatcatcgccaatacagatgtggacacggtattagagaccaagcacttacaaccttgggatgccttttgtctcaaactgaaggcctag

SEQ ID NO: 32813 - protein, 537 aa, Streptococcus pyogenes SSI-1
MKKHWWHKATIYQIYPRSFKDTNGNGIGDLKGITSQLDYLQKLGITAIWLSPVYQSPMDDNGYDISDYEAIADVFGDMADMDELLAAANERGIKIIMDLVVNHTSDEHAWFVEARENPNSPERDFYIWRDEPNDLTSIFSGSAWEYDNASGQYYLHLFSKRQPDLNWENEALRHKIYDMMNFWIAKGIGGFRMDVIDLIGKVPDSEITGNGPRLHDYLKEMNQATFGNHDVMTVGETWGATPEIARQYSRPENKELSMVFQFEHVGLQHKPDAPKWDYAKELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSKAQETWLPVNPNYQDINVADALADPDSIFYTYQKLIALRKEQDWLVEADYHLLPTADKVFAYQRQLGEETYVIVVNVSDEEQVFAKDLAGAQVIIANTDVDTVLETKHLQPWDAFCLKLKA

SEQ ID NO: 32814 - DNA, 1614 bp, Enterococcus faecalis V583
  CDS (1)..(1614)
atggaccaatggtggaaaaatgctgtcggttatcaaatttatcctcggagttttaaagatagcaacggggatggcattggtgatttgcagggaattattgagaaattaccgtatttaaaagaactaggggtcgattttttatggttaaatccgatttacacttcgccaaacgttgacaatggttatgatattgcggattatcaagggattcagccagagtttggtacgatggaagattttcaagaacttttggaccaagcgcatcaattaggtttgaagattattcttgatttagtggtcaatcataccagtgatcaacatccgtggtttgttgaagcgaaaaaaagtttagataatccgtatcgtgagtattatttatgggccgatgcgacaccagatcgtatgccgaatgaatggcaaagcttttttggtggctcgacttggacgtatgacgaaggtacaaagcaagcatattttcatgtgtttgcaaaagagcaacctgatttgaactggaaaaatcctaaagttcgtgaagagatttatgcgatgattcgctggtggttagatttgggaattgatggtttccgattggatgcgattagtcatatccaaaaagaaccttgggattttaaaattaccacgaatccgtgggctccatttatgaatgtaaaaggcattgaagactatatgctggatttgaaagttatttttgctgagtatgacatcatgacagtgggggaagctagtggcgtttcaagtaaaaaagcggtggaatggaccaatgatgcgggctatctgaatatgatttttgaattagagcacaatgttcgagaaggaaagccaggagaagaacggttaaatattttaggctataaaaaagtaatggctcgctggcaaaagcatttagggacagaaggctggaatgcattatatgtagaaaatcatgataatcccagaatcaattcaattttaggcaatgaaacctctcattctgctaaggcgattggaacaatcgccttgctcttgcgaggaacaccgtttatttatcaaggacaggaaatcggcatggttaattatccgtttcaacagattgacgagttagatgctaaagattctcataaccattatcgtttgcttatagaaagtggctacgatgcgaaacaagcattaaaagaagtggcgcattggacgcgggaccattcgcgtacgcctatgcagtggacgagtcaagaggcaagttcattcacctcggggcatccgtggttagcaattcatcccaatttcaaagaaataaatgtggctgaccaagaaacggatgcgcaatccgtattgaattattataaaaagttaattgcgttgcggaaagacaatccggtctttacagatggacagtttgaactattagcgcccaatcatccgtctgtttttgcttttttaagaaaaacaactgaggcaacagcgttagtgattgtcaatttaagtggagaaaagtgccaatttgacttgccgaataaattactaggcagaaagtggcaacaattattagggaatcaagattttacggtgaagaaacggatgcagttagcaccttatcaggcaggcgtcttccaataa

SEQ ID NO: 32815 - protein, 537 aa, Enterococcus faecalis V583
MDQWWKNAVGYQIYPRSFKDSNGDGIGDLQGIIEKLPYLKELGVDFLWLNPIYTSPNVDNGYDIADYQGIQPEFGTMEDFQELLDQAHQLGLKIILDLVVNHTSDQHPWFVEAKKSLDNPYREYYLWADATPDRMPNEWQSFFGGSTWTYDEGTKQAYFHVFAKEQPDLNWKNPKVREEIYAMIRWWLDLGIDGFRLDAISHIQKEPWDFKITTNPWAPFMNVKGIEDYMLDLKVIFAEYDIMTVGEASGVSSKKAVEWTNDAGYLNMIFELEHNVREGKPGEERLNILGYKKVMARWQKHLGTEGWNALYVENHDNPRINSILGNETSHSAKAIGTIALLLRGTPFIYQGQEIGMVNYPFQQIDELDAKDSHNHYRLLIESGYDAKQALKEVAHWTRDHSRTPMQWTSQEASSFTSGHPWLAIHPNFKEINVADQETDAQSVLNYYKKLIALRKDNPVFTDGQFELLAPNHPSVFAFLRKTTEATALVIVNLSGEKCQFDLPNKLLGRKWQQLLGNQDFTVKKRMQLAPYQAGVFQ

SEQ ID NO: 32816 - DNA, 1674 bp, Enterococcus faecalis V583
  CDS (1)..(1674)
atgaacagaaattggtggcaaaaagaagtggcctatcaaatttatccacgtagcttttcggatagtaataatgacggaattggtgatttacaaggcattattcaaaaactggattacttagaaaatttaggaattacgctgatttggctgagtccaatgtacccgtcgccaatggctgacaatggatatgatatttcagactattatggtatttctagcgattttggtacaatggcagacttcgatgaactcattgaagaagcaaaaaaacgaaacataaaagttattttagatttggtggtaaaccatacatctgatgaacatgcttggtttcaagatgttttaaaaaatcctcaaagtcgttttcgagacttttatattataaaagaaggacgagaagcacctacaaattggcggtctaacttcggtggtagtgtttgggaaaaattacctggggaagatgcctactactttcatgcctttcataaaaaacagccggatttaaattgggaaaatcctgaactacgcaaagaaatctatcaaatgattcgtttttggttaaacaaaggaattgctggttttcgtgtagatgcgattaattttattaagaaagatttgacttggacaaacttacctgctgatggggcagatcaattagccaaagtaacaaaagctagtagaaacatgccaggaatgagtgactttctgaacgaattaaaagaaaaagcttttgctggctttgatattgtcacagttgccgaagcggccggcgtcaattatctaaatttatcagaatttattggagaaacagggtatttcgacatgatttttgacttcaaatgggctgatttggatgtgaaatcaggaagcgaatggttttatagaatcgattggtcttggaatgatttacgcacattaattttcaaacagcaagaagccatgcaagaggctggttggagtgcaaattttattgaaaatcatgatcaacctcgagcgacaacgaaatatttaaaagaacaggctcaacagccaaatgcggttaaaacattcggcgccatgtatttctttttaaggggcacgccttttatttaccaaggacaagaattaggaatgaccaattttgaaaggggttcgattgatgaattcgatgatatttctagcattgatcaatactatcgagcaataaaagaaggatttacgcccaaagaagccttgtcacttgtcaatttgcgtagtcgagacaatgcccgcacgccttttccatggaatgattctatgtatggcggtttttcaagcgtcaagccttggttaggaatggtggataattataaagaaatcaatgccgaagcagaaataaaaaatagtcaaagtatttttcatttctataagcggatgattgcatttcgtcaaaagagtccctatacagacatcttactttatggaacatttgagggtctgtcaaatcttccagataatgttattgcttataaacgcaaattaaatgaaaaaacgatttacgccttttttaattttggtgaggcggttccaatccctcattatttagttaatggcacagttatttttgatacacagtctgaagaacgagagcaattagttcagcagggaacattattaaaaagctatcaaggactattgattactataaatgagtag

SEQ ID NO: 32817 - protein, 557 aa, Enterococcus faecalis V583
MNRNWWQKEVAYQIYPRSFSDSNNDGIGDLQGIIQKLDYLENLGITLIWLSPMYPSPMADNGYDISDYYGISSDFGTMADFDELIEEAKKRNIKVILDLVVNHTSDEHAWFQDVLKNPQSRFRDFYIIKEGREAPTNWRSNFGGSVWEKLPGEDAYYFHAFHKKQPDLNWENPELRKEIYQMIRFWLNKGIAGFRVDAINFIKKDLTWTNLPADGADQLAKVTKASRNMPGMSDFLNELKEKAFAGFDIVTVAEAAGVNYLNLSEFIGETGYFDMIFDFKWADLDVKSGSEWFYRIDWSWNDLRTLIFKQQEAMQEAGWSANFIENHDQPRATTKYLKEQAQQPNAVKTFGAMYFFLRGTPFIYQGQELGMTNFERGSIDEFDDISSIDQYYRAIKEGFTPKEALSLVNLRSRDNARTPFPWNDSMYGGFSSVKPWLGMVDNYKEINAEAEIKNSQSIFHFYKRMIAFRQKSPYTDILLYGTFEGLSNLPDNVIAYKRKLNEKTIYAFFNFGEAVPIPHYLVNGTVIFDTQSEEREQLVQQGTLLKSYQGLLITINE

SEQ ID NO: 32818 - DNA, 1590 bp, Streptomyces avermitilis MA-4680
  CDS (1)..(1590)
atgacttcgttccgtcccgcccccgcatggctggccgacgccgtcttctaccagatctatccgcagtcgttcgccgattccgacggcgacggcatcggcgacttcaacgggatcgtccagcgcctcgaccacctcgtgtggctgggcgtcaccgccgtctggctcaacccgtgcttcgtctccccgttccgcgacgcggggtacgacgtctccgactacctgaacgtcgcgccccgctacggctcggccgacgacctggccgagctggtcgacgaggcgggccgccgaggtatccgcgtccttctcgacctcgtcgccggtcacacctccgacgaacacccgtggttcacggcctcggcgaacgacccggacgaccaccgctacatctgggcgcccgagggccgcccggacggcttcgtcacctcgcccggcacccgtccgggcgcgtatctcccgaacttcttcgacacccagcccgctctcaacttcggctacggtcgcaagaacccggccgagccctggcgacagccggtcgacgccgcgggcccgcgcgccaaccgcgaggcactgcgcacgatcatggaccactggctgggtctgggcctggccggtttccgcgtggacatggcggcatcactcgtcaaggacgaccccggcaggacggagacggccaggatctggacggagctgcggcactggctggacacggctcacccggacgcggtgctgctgtcggagtggggcgagcccgaggtgtccgtcccggccggcttccacacggacttcttcctccagttcggcggcgcgacggacggcctgcccctgcgctcgctgtggagcaacggcgacggcacggtcaacgaggcctgggacccgctggactgcttcttcgacgcgagcggcaagggctcgccgcgccccttcgtcgaggcgtggcgcaaggcctccgacgccgtcggggccaccggcttcgtctccctgcccaccgccaaccacgacttctcccgcctcaactgcggtccgcgcacggccgagcagctccccgcggcgttcgccttccagctgacctggccgacactgccggcgatctactacggcgacgagatcggcatgcgctacgtcgggggcctgcccgacaaggagggcagcgtgctgggcccccgctacaaccgcgcgggctcgcgcaccccgatgcagtgggacgacggtccgggcgcgggcttctccacggccccggccgaccggctctacctgccgctcgacccgtccccggaccgcccgacggtggccgcccagcgcgccgacgacggctcgctcctccatctggtgcgccgcctcgtcgccctgcgcgcgagcacccccgcactcggctcgggcggctcggtggaggtgctgcacacggggtaccccttcgtgtacgtccggggcggccgctatctcgtggtcgtcaacccgcagcgcaacgaggtgcgttgcccctacgacgccacgcgggaggcacgcgcgctggaggcgtccggcgtgcgggtcggcaacggcaccatcgaggctgaagggttctcgtacggcgtcttcgacctgggccggtag

SEQ ID NO: 32819 - protein, 529 aa, Streptomyces avermitilis MA-4680
MTSFRPAPAWLADAVFYQIYPQSFADSDGDGIGDFNGIVQRLDHLVWLGVTAVWLNPCFVSPFRDAGYDVSDYLNVAPRYGSADDLAELVDEAGRRGIRVLLDLVAGHTSDEHPWFTASANDPDDHRYIWAPEGRPDGFVTSPGTRPGAYLPNFFDTQPALNFGYGRKNPAEPWRQPVDAAGPRANREALRTIMDHWLGLGLAGFRVDMAASLVKDDPGRTETARIWTELRHWLDTAHPDAVLLSEWGEPEVSVPAGFHTDFFLQFGGATDGLPLRSLWSNGDGTVNEAWDPLDCFFDASGKGSPRPFVEAWRKASDAVGATGFVSLPTANHDFSRLNCGPRTAEQLPAAFAFQLTWPTLPAIYYGDEIGMRYVGGLPDKEGSVLGPRYNRAGSRTPMQWDDGPGAGFSTAPADRLYLPLDPSPDRPTVAAQRADDGSLLHLVRRLVALRASTPALGSGGSVEVLHTGYPFVYVRGGRYLVVVNPQRNEVRCPYDATREARALEASGVRVGNGTIEAEGFSYGVFDLGR

SEQ ID NO: 32820 - DNA, 1719 bp, Streptomyces avermitilis MA-4680
  CDS (1)..(1719)
atgatcgtcaacgagcccgtcccggacaccttcgaggacacgcccgccaaggaccgcgatccggagtggttcaaacgcgccgtcttctacgaggtcctggtccgctccttccaggacagcaacggcgacggtgtcggcgacctgaagggcctgaccgccaagctggactatctgcagtggctgggcgtggactgcctgtggctgccgccgttcttcaagtcccccctgcgcgacggcggctacgacgtctccgactacaccgcggtgctgcccgagttcggtgacctggccgacttcgtcgagttcgtggacgcggcccaccagcgcggcatgcgcgtgatcatcgacttcgtgatgaaccacaccagcgacctgcacccgtggttccaggagtcccgcagcaaccccgacggcccctacggcgactactacgtgtgggccgacgacgacaagcagtaccaggacgcccggatcatcttcgtcgacaccgaggcctccaactggaccttcgacccggtccgcaagcagtactactggcaccgcttcttctcccaccagcccgacctcaactacgagaacccggcggtgcaggaggagatcgtctccgccctgcggttctggctcgacctcggcatcgacggcttccgcctcgacgcggtgccgtacctgtaccagcaggaaggcaccaactgcgagaacctgccggcgacgcacgagttcctgaagcgggtgcgcaaggagatcgacacgcactatccggacacggtgctgctcgcggaggcgaaccagtggccggaggacgtggtcgactacttcggcgacttcccctcgggcggcgacgagtgccacatggcgttccatttcccggtcatgccgcggatcttcatggcggtgcggcgtgagtcgcggtatccggtgtcggagatcctggcgaagacgccggcgatcccgtcgagctgccagtggggcatcttcctgcgcaaccacgacgagctgaccctggagatggtcaccgacgaggaacgcgactacatgtgggcggagtacgccaaggatccgcggatgcgggccaacatcggcatccgccggcgtctggcgccgctgctggacaacgaccgcaaccagatcgagctgttcaccgcgctgctgctgtcgctgcccggctcgccgatcctctactacggcgacgagatcggcatgggggacaacatctggctcggtgaccgggacgcggtgcgcactccgatgcagtggacgccggaccgcaacgcgggtttctcgtcctgcgacccggggcgtctgtatctgcccacgatcatggatccggtctacgggtaccaggtcacgaacgtggaggcgtcgatgtcgtcgccgtcctcgctgctgcactggacccggcggatgatcgagatccgtaagcagaacccggcgttcggcctcggctcgtacaccgaactccagtcctcgaacccggccgtcctcgcgttcctgcgggaggccccctcgaccggggggaacggggacgacctggtgctgtgcgtgcacaacttctcccggttcgcgcagcccacggagctggatctgcgggcgttcagcggccgtcatccggtcgagctgatcggcggtgtccgcttcccggccatcggggaactcccgtatctgctgaccctggcaggccacggcttctactggttccggctccgcaaggacgccgtctag

SEQ ID NO: 32821 - protein, 572 aa, Streptomyces avermitilis MA-4680
MIVNEPVPDTFEDTPAKDRDPEWFKRAVFYEVLVRSFQDSNGDGVGDLKGLTAKLDYLQWLGVDCLWLPPFFKSPLRDGGYDVSDYTAVLPEFGDLADFVEFVDAAHQRGMRVIIDFVMNHTSDLHPWFQESRSNPDGPYGDYYVWADDDKQYQDARIIFVDTEASNWTFDPVRKQYYWHRFFSHQPDLNYENPAVQEEIVSALRFWLDLGIDGFRLDAVPYLYQQEGTNCENLPATHEFLKRVRKEIDTHYPDTVLLAEANQWPEDVVDYFGDFPSGGDECHMAFHFPVMPRIFMAVRRESRYPVSEILAKTPAIPSSCQWGIFLRNHDELTLEMVTDEERDYMWAEYAKDPRMRANIGIRRRLAPLLDNDRNQIELFTALLLSLPGSPILYYGDEIGMGDNIWLGDRDAVRTPMQWTPDRNAGFSSCDPGRLYLPTIMDPVYGYQVTNVEASMSSPSSLLHWTRRMIEIRKQNPAFGLGSYTELQSSNPAVLAFLREAPSTGGNGDDLVLCVHNFSRFAQPTELDLRAFSGRHPVELIGGVRFPAIGELPYLLTLAGHGFYWFRLRKDAV

SEQ ID NO: 32822 - DNA, 1752 bp, Streptomyces avermitilis MA-4680
  CDS (1)..(1752)
atgatcgtcaacgagcccgtcccggacaccttcgaggacacgcccgccaaggaccgcgatccggagtggttcaaacgcgccgtcttctacgaggtcctggtccgctccttccaggacagcaacggcgacggtgtcggcgacctgaagggcctgaccgccaagctggactatctgcagtggctgggcgtggactgcctgtggctgccgccgttcttcaagtcccccctgcgcgacggcggctacgacgtctccgactacaccgcggtgctgcccgagttcggtgacctggccgacttcgtcgagttcgtggacgcggcccaccagcgcggcatgcgcgtgatcatcgacttcgtgatgaaccacaccagtgacctgcatccgtggttccaggagtcccgcagcaaccccgacggcccctacggcgactactacgtgtgggccgacgacgacaagcagtaccaggacgcccggatcatcttcgtcgacaccgaggcctccaactggacgtacgacccggtccgcaagcagtactactggcaccgcttcttctcccaccagcccgacctcaactacgagagtgccgccgtccaggaggagatcctggcggcgctgcggttctggctcgatctgggcatcgacggcttcaggctggacgccgtcccctacctgtacaacgaagaggggacgaactgcgagaacctgccggcgacgcacgagttcctgaagcgggtgcgcaaggagatcgacacgcactatccggacacggtgctgctcgcggaggcgaaccagtggccggaggacgtggtcgactacttcggcgacttcccctcgggcggcgacgagtgccacatggcgttccatttcccggtcatgccgcggatcttcatggcggtgcggcgtgagtcgcggtatccggtgtcggagatcctggcgaagacgccggcgatcccgtcgagctgccagtggggcatcttcctgcgcaaccacgacgagctgaccctggagatggtcaccgacgaggaacgcgactacatgtgggcggagtacgccaaggatccgcggatgcgggccaacatcggcatccgccggcgtctggcgccgctgctggacaacgaccgcaaccagatcgagctgttcaccgcgctgctgctgtcgctgcccggctcgccgatcctctactacggcgacgagatcgggatgggggacaacatctggctcggtgaccgggacgcggtgcgcacgccgatgcagtggacgccggaccgcaacgcgggtttctcgtcctgcgacccggggcgtctgtatctgcccacgatcatggatccggtctacgggtaccaggtcacgaacgtggaggcgtcgatgtcgtcgccgtcctcgctgctgcactggacccggcggatgatcgagatccgtaagcagaacccggcgttcggcctcggctcgtacaccgaactccagtcctcgaacccggccgtcctcgcgttcctgcgggaggccccctcgaccggggggaacggggacgacctggtgctgtgcgtgcacaacttctcccggttcgcgcagcccacggagctggatctgcgggcgttcagcggccgtcatccggtcgagctgatcggcggtgtccgcttcccggccatcggggaactcccgtatctgctgaccctggcaggccacggcttctactggttccggctccgcaaggacgtcacccaggtcaccaaggtgagcttgttcgtgagctcttga

SEQ ID NO: 32823 - protein, 583 aa, Streptomyces avermitilis MA-4680
MIVNEPVPDTFEDTPAKDRDPEWFKRAVFYEVLVRSFQDSNGDGVGDLKGLTAKLDYLQWLGVDCLWLPPFFKSPLRDGGYDVSDYTAVLPEFGDLADFVEFVDAAHQRGMRVIIDFVMNHTSDLHPWFQESRSNPDGPYGDYYVWADDDKQYQDARIIFVDTEASNWTYDPVRKQYYWHRFFSHQPDLNYESAAVQEEILAALRFWLDLGIDGFRLDAVPYLYNEEGTNCENLPATHEFLKRVRKEIDTHYPDTVLLAEANQWPEDVVDYFGDFPSGGDECHMAFHFPVMPRIFMAVRRESRYPVSEILAKTPAIPSSCQWGIFLRNHDELTLEMVTDEERDYMWAEYAKDPRMRANIGIRRRLAPLLDNDRNQIELFTALLLSLPGSPILYYGDEIGMGDNIWLGDRDAVRTPMQWTPDRNAGFSSCDPGRLYLPTIMDPVYGYQVTNVEASMSSPSSLLHWTRRMIEIRKQNPAFGLGSYTELQSSNPAVLAFLREAPSTGGNGDDLVLCVHNFSRFAQPTELDLRAFSGRHPVELIGGVRFPAIGELPYLLTLAGHGFYWFRLRKDVTQVTKVSLFVSS

SEQ ID NO: 32824 - DNA, 1671 bp, Bacillus cereus ATCC 14579
  CDS (1)..(1671)
atgactatgaataagacatggtggaaagaagcggttgcttatcaaatttatccacgaagctttatggattcaaatggtgatggtattggagatttacaaggtattattgcaaaactggattatttaaaagatttaggtatagatgtaatttggatttgtccaatgtataagtcgcctaatgatgataatggttatgatattagtgattatcaagatattatggatgagtttggtacaatggcagactttgatgctttactagatgaagttcataagcgtgatatgaagcttattattgatttagttattaatcatacgagtgatgaacatccatggtttattgaatcacgttcatctaaagataatccgaagcgtgattggtatatttggcatgatggtaaagatggtgcggagccaaacaactgggaaagtatttttaatggttcggcatgggaatatgatgaagaaacagaacaatattatttacatttattctcacgtaaacaaccagatttaaactgggagaataaagaagttcgcgaagtactatacgatacggttaattggtggcttgataaaggtattgatggtttccgcgttgatgcgatcagtcatattaaaaaagaagaaggcctcaaggatatgccaaatccaaaagggttaaaatatgtgccatcttttgataaacatatgaatgtgaaaggtattcaacctttattagaagagctaaaagaaaatacattctctaagtacgatattatgactgttggtgaagcaaatggtgttaagattgaagatgctgagctttgggttggagaagagcaaggtaagttcaatatggtattccaatttgaacatttaagtttatgggatgcagagaagaagaaagaccttgatgttgtaggattgaaaaaagtattaacgaaatggcaaaaaggattagaaaataaaggatggaacgctttatatattgagaatcacgataaaccacgtatcgtttcaacatggggagatgataaacaatattggcgtgaaagtgcaacagctctaggggcgatgtatttctttatgcacggtacaccttttatttatcaaggccaagaaattggtatgacaaatgttcagttaccaaatattgaagattacgatgatgtagcaattaaaaatttatatcgcgagaaaattgcagagggcgtaccacatcaagatatgatggagattatatgggcttcttgccgcgataattcacgtacacctatgcagtggaatgatgagatgaatgctggtttcacaacaagtacaccttggtttagcatgaatccaaattacaaagaaattaatgttgagaagcaaaaaaatgaagaaaagtctattttcaatttctataagaaaatgattgccctgaaaaaagagcacgatgtactgaactatggcacgtacgatttacttttagaagacgatccacaaatttatgcatatacacgtacgttacaggatgaaaaagtcattgtaattagtaatatctcaaaagaggaagctgtgtataatgagggttcatttgcactagaacgcaaacgtttgcttttaaataactatgaagttgcggaacatgaagaagtaacaacaattgctttaaagccttatgaaacaagggtttatcgcatttcataa

SEQ ID NO: 32825 - protein, 556 aa, Bacillus cereus ATCC 14579
MTMNKTWWKEAVAYQIYPRSFMDSNGDGIGDLQGIIAKLDYLKDLGIDVIWICPMYKSPNDDNGYDISDYQDIMDEFGTMADFDALLDEVHKRDMKLIIDLVINHTSDEHPWFIESRSSKDNPKRDWYIWHDGKDGAEPNNWESIFNGSAWEYDEETEQYYLHLFSRKQPDLNWENKEVREVLYDTVNWWLDKGIDGFRVDAISHIKKEEGLKDMPNPKGLKYVPSFDKHMNVKGIQPLLEELKENTFSKYDIMTVGEANGVKIEDAELWVGEEQGKFNMVFQFEHLSLWDAEKKKDLDVVGLKKVLTKWQKGLENKGWNALYIENHDKPRIVSTWGDDKQYWRESATALGAMYFFMHGTPFIYQGQEIGMTNVQLPNIEDYDDVAIKNLYREKIAEGVPHQDMMEIIWASCRDNSRTPMQWNDEMNAGFTTSTPWFSMNPNYKEINVEKQKNEEKSIFNFYKKMIALKKEHDVLNYGTYDLLLEDDPQIYAYTRTLQDEKVIVISNISKEEAVYNEGSFALERKRLLLNNYEVAEHEEVTTIALKPYETRVYRIS

SEQ ID NO: 32826 - DNA, 1662 bp, Bacillus cereus ATCC 14579
  CDS (1)..(1662)
atgaaggattggcataaaagtgtagtctatcaaatttatccgaagagctttaatagttattacaatagagaaaccggggatataaaaggtgttacagagaaactagattatttaaaagaactcggagtggattatatatggttaacaccgatataccaatcaccacaaaatgataatggatatgatgtaagtgattactacagcattgatccatcttacggaacgatggaagagtttgaagaacttttagcagaagcgaaagtacgtaacattgagattatgcttgatattgttgtaaatcatagttcgactgaacataagtggtttaaagaagcgaaggaagataaaaatagtccatatcgtaattactatatttggcgtgatgaaaaaaataattggcagtctaagtttggtggatctgcttggaaatatgatgagaagacggagcaatattatttacatttatttgatgaaacacaagctgatttaaattgggaaaatgaaaaacttcgtgaagaagtatatgatatgatgcgtttttggctggataaaggagtaacaggattccgattagatgtcattaacttaatttcaaaagaccaatgtttcttaaacgatgaaggtagtactgcgacaagtgatggacgcaagtattatacagatggtccgcgtgttcatgaatatttacaagagatgaaccgaaatgtttttgcaggaaaagatgtaattacagttggagaaatgtcatctacgacaattgataattgtattaaatattcaaaccctgagcgtaatgaattaagtatgacgtttagtttccatcatttaaaagtagattatccgaatggtgataagtggacgaaggctgattttgattttattaaattaaaagagattatgtctagctggcaaattgaaatgcaaaagggcggaggatggaatgcgttattttggtgtaatcatgaccagcctcgcatcgtgtcacgctttggtgatgatggaaagtaccgaaacgaatctgcaaaaatgttagcgacagccatgcacatgctgcaaggaacgccttatatttatcaaggggaagaaatcggtatgacgaatcctaaatttgagtccatcgagcaatatcgtgatgtggaatcgttaaatatatacgatataaagctaaaagaagggctatcaaaagaagagattatcgggattttaaagcaaaaatctcgtgacaactctcgcactccgatgcagtggaatgaagagatgaacagtggttttacaacaagtacaccttggatttcagcggctgaaaactttaaagaaataaacgtagagaaggcattagaagataaagagtccgtattttatcattataaaaagttaatagaacttagaaaaacatatgatgtaattacagaaggagaatatgctattttggataaaaatgaccctaaaatttgggcatatactcgtactacagaaagtgaagtactacttgttataaataacttctatggagaagaaataacgtactctgtaccagcgcacgttcaattagatggaatgaaacaagaagtactactgtcgaattataaagatgctagcaaggatattgcaaaacttaacttaagaccatatgaatcaattgtgtatcgatatacgaaataa

SEQ ID NO: 32827 - protein, 553 aa, Bacillus cereus ATCC 14579
MKDWHKSVVYQIYPKSFNSYYNRETGDIKGVTEKLDYLKELGVDYIWLTPIYQSPQNDNGYDVSDYYSIDPSYGTMEEFEELLAEAKVRNIEIMLDIVVNHSSTEHKWFKEAKEDKNSPYRNYYIWRDEKNNWQSKFGGSAWKYDEKTEQYYLHLFDETQADLNWENEKLREEVYDMMRFWLDKGVTGFRLDVINLISKDQCFLNDEGSTATSDGRKYYTDGPRVHEYLQEMNRNVFAGKDVITVGEMSSTTIDNCIKYSNPERNELSMTFSFHHLKVDYPNGDKWTKADFDFIKLKEIMSSWQIEMQKGGGWNALFWCNHDQPRIVSRFGDDGKYRNESAKMLATAMHMLQGTPYIYQGEEIGMTNPKFESIEQYRDVESLNIYDIKLKEGLSKEEIIGILKQKSRDNSRTPMQWNEEMNSGFTTSTPWISAAENFKEINVEKALEDKESVFYHYKKLIELRKTYDVITEGEYAILDKNDPKIWAYTRTTESEVLLVINNFYGEEITYSVPAHVQLDGMKQEVLLSNYKDASKDIAKLNLRPYESIVYRYTK

SEQ ID NO: 32828 - DNA, 1761 bp, Rhodopirellula baltica SH 1
  CDS (1)..(1761)
ttgcatgggcggaacatggcgactgtcgagtacgaaatgcagcaacaggcaatcgccccgcgttttgccaattcgaattttacgcctcacaaccgaccaaggcatcccttcactatcaaaacgcattcacaaaaatctgctccgtcgaaaccagccgaacgtcgctggtgggaaaccggtgtgatctatcaaatctatccgcggtctttccaagacagcaatgccgacggtgtgggcgatctggcaggtatcaagcaacggctggactatctggttcgcctcggagttgacgcggtatggctttcaccgatttatccttcgccgatgttcgatttcggttacgacgtctcggactactgcggcattgatccgttgttcggtgatctgacagccttcgatcggttgctcaccgccatgcattcgcgtggtctcaagcttctgatggactttgttccgaaccactcatcagatcaacatccatggtttgtccagagccgttcatctcgcgacaatcccaagcgggattggtacatctggcgagatgcatcagctgacggcggtccacctaacaattggatcagcgatttcggtggctcgtcttggcaatgggacgcaacgacccggcaatactatttgcacgcctttcttccgcagcaacccgatctcaactggcgtcatcccgaactgcgtgaggcgatgatgaatgtcctgcggttctggttggatcgcggtgtcgatggatttcgcatggacgtgctttggcacatcgtcaaagacgccgctcttcgagacaatccgatcaatccggactggacgtctgaccgtacacagcgtgaccagctgattcagctgcactccaccgaccaaccagaagcccattcaatcgcggctgagtttcgcactttggcggacaactacggtgatcgcgttttgattggtgagatcagcctgcccaatgatcgactcgcgcgatggtttgggacggaagaacgaccggaggtacatctgccgaccaactttcatctcatcgaatgcgagtggaacgctccaaccctccgacgtgtgatcgctaactacgaagcgtcccttccaaactttggatggccgaactgggttttgggcagtcacgatgctcctcgcattgccgcccgacttggtgacgctcaatcccgagtcgccgccatgctgctgctaaccctgcgtggcacgcccacgctctatcaaggcgacgaaattgggattggtgaggtccccattcctcgcgatcaaattcgcgaccctcaggatttacggcaacctgaactgaatatcggacgagatcgatctcgcacgccgatgccttgggacgattccgccttcgccggtttcagcgtcaacgacacgtggctcccgctcaatcctgattggcgtcaaagaaacgttgcgacgcaggaggctgatccacagtcaattttgaatttgtacagaacactgctctcgcttcggcgaagccacgctgcgttatcgaacggcgacttcacacttctcgattccgacgatgatgtgctcgctttcgaaagaagacacggcgacgaacacctgttgatcgcgctgaacctcagtgagcaaacccgatcgttgccggtgccgtcgaaagctgccctcgtcacggtgctctgttccaccgtgtctcctcgagcaatcgatggaactctcgtaccaaacgaagggctgcttctgcaattggtagacaacgaagatcaatccgggcaagtttcatga

SEQ ID NO: 32829 - protein, 586 aa, Rhodopirellula baltica SH 1
MHGRNMATVEYEMQQQAIAPRFANSNFTPHNRPRHPFTIKTHSQKSAPSKPAERRWWETGVIYQIYPRSFQDSNADGVGDLAGIKQRLDYLVRLGVDAVWLSPIYPSPMFDFGYDVSDYCGIDPLFGDLTAFDRLLTAMHSRGLKLLMDFVPNHSSDQHPWFVQSRSSRDNPKRDWYIWRDASADGGPPNNWISDFGGSSWQWDATTRQYYLHAFLPQQPDLNWRHPELREAMMNVLRFWLDRGVDGFRMDVLWHIVKDAALRDNPINPDWTSDRTQRDQLIQLHSTDQPEAHSIAAEFRTLADNYGDRVLIGEISLPNDRLARWFGTEERPEVHLPTNFHLIECEWNAPTLRRVIANYEASLPNFGWPNWVLGSHDAPRIAARLGDAQSRVAAMLLLTLRGTPTLYQGDEIGIGEVPIPRDQIRDPQDLRQPELNIGRDRSRTPMPWDDSAFAGFSVNDTWLPLNPDWRQRNVATQEADPQSILNLYRTLLSLRRSHAALSNGDFTLLDSDDDVLAFERRHGDEHLLIALNLSEQTRSLPVPSKAALVTVLCSTVSPRAIDGTLVPNEGLLLQLVDNEDQSGQVS

SEQ ID NO: 32830 - DNA, 1662 bp, Synechococcus sp. WH 8102
  CDS (1)..(1662)
atgagccaaaccatgccgtggtggaccggcacggtcatctatcaactgatcgtgcgcagcttcgccgatggcaacggtgatggcatcggcgatttcaagggtctggcttcgcgcttgccctatctgcgctggctcggggtgaagacgctctggctgacacccacgtacccatctcccttacgggatggtggctacgacatcaccgacttcaaggacattcaccctgatctgggcgatctggcgtcgttccatcggtttctgacggcagcccacagccagggcatgcgcgtgattctcgatctggtgctgaaccacaccagcgaccttcacccctggttccagcgagcccgctgggcccccaagggcagcactgaacgggatgtgtacgtctggagcgacgacccatcccgctacagcgacgccccggtgctgttccggcactttgaagcgtccaactgggagtgggacccagtggcggagcagtactacctgcaccgtttcctgagccatcagcccgacctcaactacgccaacccgtgggtgcaggaggccatgctcgaggtggttgacttctggctggagcgtggggtcgacggctttcgccttgatgcggtgccgtttctgtttgaggaggagggcacccggtgtgaagggttgccggagacccatgccttcctgcggcgtctgcgggcccgtgtggatgccatgggacgagaggtgctgttgctgggggaagcgatccaacccgtgcaggaggcagccccctatctggcgaaggacgaactgcacggagccttcaacttcgtgctcacagcccatctgttcgctgctgtggcctccggcagcactcgccagctcggggactgtctcaacgaggcggaacacgcggttgatggcccgcgctgggccctgccgctccgcaaccacgacgagctctggctgggggatgggcacctgatccccgacgaggtgatccagtcgatccgggtgggcttgccccaggggcaggggcattggctcaactggggcatcaaccgtcgattggcaccgctgctcaatggcgacccccgctccaaccgactgcttcacggactgatttacagccttccaggcatgccctgcctgtattacggcgacgagctggggatgggggattggccggggttacgggatcgggatccgaaccgcacacccatggcctggacacctgcccgcaacggtggcttctcctcggctcccgaccctttgctggtgcttccgccgatcacagctcctgggtacgactaccgagtcgtgaacgttgaggtacagaaacagctgccgggttccttgctgaactggcaccgccgcatgctcacttgccggcgtttgctgccggccctcgcccatggatcattgcagctgttgccgtgcagccatcccggtgccttggtttacgtccgcgcgactgaggccatgacggtgttggtggcgggcaatgtcacggccgccggagcctccttcagcctggatctcacggcctgggagggcttgcggactcgcgaggtgatgtggggctgtgaattcccgctggccagccgcgaatggtttgtgaatctgtctccttacggcatcaactggtggttgatcggcgaggtggataccgctgtgcccgtgagctga

SEQ ID NO: 32831 - protein, 553 aa, Synechococcus sp. WH 8102
MSQTMPWWTGTVIYQLIVRSFADGNGDGIGDFKGLASRLPYLRWLGVKTLWLTPTYPSPLRDGGYDITDFKDIHPDLGDLASFHRFLTAAHSQGMRVILDLVLNHTSDLHPWFQRARWAPKGSTERDVYVWSDDPSRYSDAPVLFRHFEASNWEWDPVAEQYYLHRFLSHQPDLNYANPWVQEAMLEVVDFWLERGVDGFRLDAVPFLFEEEGTRCEGLPETHAFLRRLRARVDAMGREVLLLGEAIQPVQEAAPYLAKDELHGAFNFVLTAHLFAAVASGSTRQLGDCLNEAEHAVDGPRWALPLRNHDELWLGDGHLIPDEVIQSIRVGLPQGQGHWLNWGINRRLAPLLNGDPRSNRLLHGLIYSLPGMPCLYYGDELGMGDWPGLRDRDPNRTPMAWTPARNGGFSSAPDPLLVLPPITAPGYDYRVVNVEVQKQLPGSLLNWHRRMLTCRRLLPALAHGSLQLLPCSHPGALVYVRATEAMTVLVAGNVTAAGASFSLDLTAWEGLRTREVMWGCEFPLASREWFVNLSPYGINWWLIGEVDTAVPVS

SEQ ID NO: 32832 - DNA, 1650 bp, Chromobacterium violaceum ATCC 12472
  CDS (1)..(1650)
atgtctaaggacatgaaacgggcggtggtgtaccagatctaccccaagagcttcagcagccatcgcaatcaggcgacgggggatctcctgggcgtggtggaccggctggactacctggcctggctgggcgtcgactacctgtggctgacgccgttctaccgctcgccgcagcgcgacaacggctacgacgtcagcgactactacagcatcgacccggcttatggcgagatggaagacttcgaattgctgctggccgaggccaagcggcgcggcatcggcgtgatgctggacatcgtggtcaaccacacctccaccgagcacgcctggttccaggaggctcgcaagggcagggacaatccctaccgcgacttctacatctggcgcgacgcgccgaacaactggcagtccaagttcggcggcagcgcctgggagtgggacgaggccagcggccagtactacctgcacctgttcgacaagacccaggccgacctcaactgggagaatccggcggtgcgggccgaggtgtacaagatgatgcgcttctggcgcgacaagggcgtggccggcttccgcctggacgtgatcaacctgatctccaaggacccggccttctccgaggacgacagcgacggccgccacttctacaccgacggcccgcgcgtgcaccagcatctgcaggagatgcaccgcgaggtgttcgacggccatgacttgctgaccgtgggcgagatgtcgtccacctcgttggagcactgcatcgcctacagccggccggaccggcgcgagctgagcatgaccttcaatttccaccacctgaaggtggattacccggatggcgagaaatggcggccgggcgcggtggacttcatcgcgctcaagcgcatcctgtccgactggcaaaccggcatgcacgccggcggcggctggaacgcgctgttctggtgcaaccacgaccagccgcgcgcgctgtcccgcttcggcgacgacggccgctggcggaccgaatccgccaagatgctggccaccgcgctgcacggcctgcagggcacgccttatatctaccagggcgaggagatcgccatggccaatcccggtttcgccgacatcggccagctgcgcgacgtggaaagcctgaacgcttatcgccagttgctggccgagggcttcaccgctgccgacgcgatggcggtgatccgccagcgctcgcgcgacaacgcccgcacgccgatgcagtgggacgacggcccgaacgccggcttcagcgccgccgagccctggataggcgtggcggcggacgccggcagcgtcaatgtcgccacggccatcggcgaccccaactccacggcacaccactaccgtcggctgatccagctgcgcaagcaataccgggtgttcgccgacggcgactaccgctgcctgacgcccgatcatcccagcctgtggatttacacccgccgctgcgccgacgaaatgctgctggccatcagccacttcggcgccgacgacagccattacgcgctgccggccggcgcgatgcccgagggctggacgatggaactgctgctgtccaactacccgccgcagccccctggccgattgcggccctggcattcgctgctgtaccgggcgacgccgccggccgcgacctaa

SEQ ID NO: 32833 - protein, 549 aa, Chromobacterium violaceum ATCC 12472
MSKDMKRAVVYQIYPKSFSSHRNQATGDLLGVVDRLDYLAWLGVDYLWLTPFYRSPQRDNGYDVSDYYSIDPAYGEMEDFELLLAEAKRRGIGVMLDIVVNHTSTEHAWFQEARKGRDNPYRDFYIWRDAPNNWQSKFGGSAWEWDEASGQYYLHLFDKTQADLNWENPAVRAEVYKMMRFWRDKGVAGFRLDVINLISKDPAFSEDDSDGRHFYTDGPRVHQHLQEMHREVFDGHDLLTVGEMSSTSLEHCIAYSRPDRRELSMTFNFHHLKVDYPDGEKWRPGAVDFIALKRILSDWQTGMHAGGGWNALFWCNHDQPRALSRFGDDGRWRTESAKMLATALHGLQGTPYIYQGEEIAMANPGFADIGQLRDVESLNAYRQLLAEGFTAADAMAVIRQRSRDNARTPMQWDDGPNAGFSAAEPWIGVAADAGSVNVATAIGDPNSTAHHYRRLIQLRKQYRVFADGDYRCLTPDHPSLWIYTRRCADEMLLAISHFGADDSHYALPAGAMPEGWTMELLLSNYPPQPPGRLRPWHSLLYRATPPAAT

SEQ ID NO: 32834 - DNA, 1662 bp, Photorhabdus luminescens subsp. laumondii TTO1
  CDS (1)..(1662)
atggacaaaatcattccgtggtggttacaaggtgtcatctatcagatatatcctaagagtttccaggatacgacgggtagcggaacgggcgatcttaacggcattacttaccggcttgattatttgaagaaactgggcgtagacgctatttgggtgacgcctttttacctctcaccacaggtagataatggttatgatgtcgctgattattatgcgattgatccggcttacggctcaatggatgattttaagcgtttggttgatgaggcacatcaacgtgatatccgtatcatcgtggatattgttttcaaccatacatcgactcaacatccgtggtttaaacaagcacaggatattgatagcccttatcggcaatattacatttggcgggatggggtacctggaaccccgcctaataattggttgtcgaaatttggtggcaatgcttgggcgtggcatgaagcaagccaacagtattatttgcacctgtttgctgttgagcaggctgatctaaattgggaacatgagccagtacgggctgaattgaaaaagatttgtgaattctgggctggccttggtgttgatggcttccgtctggatgtcattaacttggtttctaaacagcaagacttccctgagtcaactcagggggatgggcgtcagttctacaccgatggcccgcgtattcatgaatttctgcaagaaatgaacagagaggtattccagcctgccggagtgatgacggttggggaaatgtcttctacttcactggaacattgtcatcgctattcttcattggatggtgaagagttgtcgatggtttttgcttttcatcacttaaaagtcgattaccccaatggtgagaaatgggttgcagcgccacctgattttattgaattgaagaaaatttttgccaagtggcagcaaggtatgtacgaacgggcatggaatgcgctgttctggtgtaatcacgatcaaccgcgtattgtttcacgctttggcggtgaaggtgtttggcgggtgccgtccgctaaaatgttagcaatggtactgcatggtatgcagggaaccccttatatctatcaaggagaagagctggggatgactaatcctcacttttctcatattgaagagtaccgggatatagaaagtttaaatatttatcaagagaagattgagcagggcaatgataaacagcaaatcttatcggtcttagcgaagaaatctcgtgataatgggcgaacgccaatgcagtgggatacgactgctaatgcagggtttactcaaggagagccgtggatagcgctgaatagtgattatcaggatgtgaatgctgaaaatgcgatgcaggatgatgattcagttttccattgttatgcacgtttaatcaagctgcgtaaggaatatcctgtattgacttatggcagctatgaagacttattaccatctcatccttctctttggtgctatgtgcgtcgttgggaaaatcagacgttgttggttattgctaatctcagtgttgaagtgcagaaatggtcgctggacgcttctttatccgattgctcatgggttaaattgatggggaactatcctgaaaaccatgtacctgcaaaagatatgcagctacagccttatgaagccgtttactggttagcggagtaa

SEQ ID NO: 32835 - protein, 553 aa, Photorhabdus luminescens subsp. laumondii TTO1
MDKIIPWWLQGVIYQIYPKSFQDTTGSGTGDLNGITYRLDYLKKLGVDAIWVTPFYLSPQVDNGYDVADYYAIDPAYGSMDDFKRLVDEAHQRDIRIIVDIVFNHTSTQHPWFKQAQDIDSPYRQYYIWRDGVPGTPPNNWLSKFGGNAWAWHEASQQYYLHLFAVEQADLNWEHEPVRAELKKICEFWAGLGVDGFRLDVINLVSKQQDFPESTQGDGRQFYTDGPRIHEFLQEMNREVFQPAGVMTVGEMSSTSLEHCHRYSSLDGEELSMVFAFHHLKVDYPNGEKWVAAPPDFIELKKIFAKWQQGMYERAWNALFWCNHDQPRIVSRFGGEGVWRVPSAKMLAMVLHGMQGTPYIYQGEELGMTNPHFSHIEEYRDIESLNIYQEKIEQGNDKQQILSVLAKKSRDNGRTPMQWDTTANAGFTQGEPWIALNSDYQDVNAENAMQDDDSVFHCYARLIKLRKEYPVLTYGSYEDLLPSHPSLWCYVRRWENQTLLVIANLSVEVQKWSLDASLSDCSWVKLMGNYPENHVPAKDMQLQPYEAVYWLAE

SEQ ID NO: 32836 - DNA, 1635 bp, Vibrio vulnificus YJ016
  CDS (1)..(1635)
atggaaaacaaatggtggcacgatgcggtggtctatcaaatctacccgcgtagtttttgcgattcaaacaacgacggcatcggcgatttaaatggcatcatcagcaaactcgattacctgaaaacacttggcgtaaacgtgctttggctctcgcccgtatataagtcgcctatggatgacaacggttacgacatttctgattatcaagatatcgctgcggaatttggcaccatggctgatatgcaaaacttacttgatcaagcaaaagcgcgtgatatccgcatcgtaatggatcttgtcgtcaaccatacctcagatgaacacccttggtttgtagaagctcgtaaatcaaaagacaacccttatcgtgactactatatttggcgtgatgcaaaaccagatggcagtgtgcccgatgaccaaggttcgatttttggaggcagtgcttggcaatgggatgaagcaacacaacagtattacttccatctattttctaagcgacagccggatctcaattgggagaatcctaaagtccagcaggaagtacacaagatgatgaactggtggattgaccaaggcatcggtggatttaggctcgacgttatcgacttgattggcaaagagatcgacaaaggcattactggtaatggcccaaggctgcatccactattgcaggaaatgaacagagcgacgtttggcgacaaagatctgctgaccgttggtgaaacatggggagcaaccccagaaattgcaaaattgtatagcgatcctgagcgtcatgaactctccatggtgttccaatttgagcacatcacgctcacttggcaacacggtgacaaatggaaccctattcctcttgatctcaaacaattcaaacacgtactgaccaagtggcaaactgaattatcgaaccaaggttggaactcgttgttttggaacaaccacgatttaccacgcgtagtctcgaaatacggtgatgaccaacgctatcgtgttgagtcagcgaaaatgctggcaacggcgttgcatttcctcaaaggcacgccttacgtctaccaaggtgaagagatcggtatgaccaatgtcgcgtttgagtcgttagagcaatacaaagacattgaaacgctgaacttctacaaagtgaaaacagaatcaggggtgtcacatcaacatatgatggacgcgatacatgagaacagccgtgacaatgctcgcaccccaatgcagtggtccgcatctcagaatggtggctttagtcaggcgaaaccttggattgaagtgaatccgaactatccagagatcaacgtggaacaagcattggcagattcagattccattttctatcactaccaaaagctgattgaactgcgcaaacagcacccagcgatcgtctatggcgatttcaccccactgtttgcagagcacgatagtgtgtttgcttatgtccgctcacatcaagatgagcaactgctggtcatcaacaactttagcgatcaagatgtttcattagcgttgccggataacttgcaaaacaaagaagttaactgtctgatttataactacgattcgttggatatgctcggagtgacattgtcactaaaaccgtatcagtgctacgcatttaaacttagataa

SEQ ID NO: 32837 - protein, 544 aa, Vibrio vulnificus YJ016
MENKWWHDAVVYQIYPRSFCDSNNDGIGDLNGIISKLDYLKTLGVNVLWLSPVYKSPMDDNGYDISDYQDIAAEFGTMADMQNLLDQAKARDIRIVMDLVVNHTSDEHPWFVEARKSKDNPYRDYYIWRDAKPDGSVPDDQGSIFGGSAWQWDEATQQYYFHLFSKRQPDLNWENPKVQQEVHKMMNWWIDQGIGGFRLDVIDLIGKEIDKGITGNGPRLHPLLQEMNRATFGDKDLLTVGETWGATPEIAKLYSDPERHELSMVFQFEHITLTWQHGDKWNPIPLDLKQFKHVLTKWQTELSNQGWNSLFWNNHDLPRVVSKYGDDQRYRVESAKMLATALHFLKGTPYVYQGEEIGMTNVAFESLEQYKDIETLNFYKVKTESGVSHQHMMDAIHENSRDNARTPMQWSASQNGGFSQAKPWIEVNPNYPEINVEQALADSDSIFYHYQKLIELRKQHPAIVYGDFTPLFAEHDSVFAYVRSHQDEQLLVINNFSDQDVSLALPDNLQNKEVNCLIYNYDSLDMLGVTLSLKPYQCYAFKLR

SEQ ID NO: 32838 - DNA, 1701 bp, Corynebacterium diphtheriae NCTC 13129
  CDS (1)..(1701)
atggatactagagacccccatgcttggtggcgtgacgctgccatttaccagatttaccccaagtccttcgcttcgtcgggtggacctatgggaacgcttcggggaatcacctctcggttggattatgttcgtgaccttggcgtagacgccatctggttatcaccgttttacacttctccgcagcgtgatggcggttatgatgttgctgattatttcagcgttgatccgctgttcggttccaacgccgatgcggaggagctcatttctgaggctcatgaccgtggcctgcgggtgattttcgatctcgttcctaatcacacttccgatcagcacgtgtggtttcgtgaagcattacaagcggggcctggttctccgaagcgcaatcattattggttccgcgagggcaaggggccgcaaggctgcgagcctcctaacgattggttgtctattttcggcgggagcgcatggactcaggtatgtgcgcgtgacgacgcccccgattccccgtgggagcacgatacctcgtggtacctgcacttatttgactcttcacagccggatcttaattggtcaaacaaagatgtggtcgagttttttgatagcattcttcgtttttggcttgatcgcggagtcgatggtttccgcgttgatgtagcccatggccttgccaaggacccagagctgcccgactggcagttccactggacaatggttgatggtgggcacgacagccccgaggacgttccgccaccaccgatgtggaaccgcgaagaagtccatcagatctaccgccattggcgcacggttctggatgaatacccaggtaatcgcgccttggttgctgaggcttgggttgatgcgacaactgatattgctcattatgttcagccggatgagatgaaccaagcgtttaattttgatttcctcatctgtccatggcgttccgaggatcttgggcgtgttattcatacgtccttggaggctcttgctcctacggggtcgccggcgacgtgggtgatgtcgaaccatgacgttgttcgcgcgtcgtcacgcttgggacttagtaccccaggtgcacgccctaacggtatccgcgctaccgacgagcaacccgacgctgacctcggtgcgcgtcgcgcccgcgctgcgcatatgctgatgtattcgttgccaggttcggtgtacatctatcagggcgaggaacttaatctgccagagcacaccacgcttgacgacgccctgcgccaggatcccacgtatttccgcaccgagcaccgcgaagccggccgtgatggctgccgcatccccctgccgtggacgtcgcaacgcccaggccttgggttttcccccaccggacaaacctggttgccacagccagaaggctgggagaatcgggcagtgtcacatcaagagtcggatccccattccgatctcatgctttttaggcgcatgctgcaggtccgaaagtccttgaactttggccgaggtcggctgtctcctgtgtggttgaagcaggattgtttggcgtacatcaattctgatgatggacgttgtgacgtgatgctgatcgtcgcttttgaccaggatgtcgcagtccccgaaggctggcacatcgcgttgtccacagaggaatgccacgatgttgttgcagctaatagtgctgcttggctgctgcgtgaaggagactcatggcacgtataa

SEQ ID NO: 32839 - protein, 566 aa, Corynebacterium diphtheriae NCTC 13129
MDTRDPHAWWRDAAIYQIYPKSFASSGGPMGTLRGITSRLDYVRDLGVDAIWLSPFYTSPQRDGGYDVADYFSVDPLFGSNADAEELISEAHDRGLRVIFDLVPNHTSDQHVWFREALQAGPGSPKRNHYWFREGKGPQGCEPPNDWLSIFGGSAWTQVCARDDAPDSPWEHDTSWYLHLFDSSQPDLNWSNKDVVEFFDSILRFWLDRGVDGFRVDVAHGLAKDPELPDWQFHWTMVDGGHDSPEDVPPPPMWNREEVHQIYRHWRTVLDEYPGNRALVAEAWVDATTDIAHYVQPDEMNQAFNFDFLICPWRSEDLGRVIHTSLEALAPTGSPATWVMSNHDVVRASSRLGLSTPGARPNGIRATDEQPDADLGARRARAAHMLMYSLPGSVYIYQGEELNLPEHTTLDDALRQDPTYFRTEHREAGRDGCRIPLPWTSQRPGLGFSPTGQTWLPQPEGWENRAVSHQESDPHSDLMLFRRMLQVRKSLNFGRGRLSPVWLKQDCLAYINSDDGRCDVMLIVAFDQDVAVPEGWHIALSTEECHDVVAANSAAWLLREGDSWHV

SEQ ID NO: 32840 - DNA, 1791 bp, Corynebacterium diphtheriae NCTC 13129
  CDS (1)..(1791)
gtgcacccgaactgcaacgatatagcgcagccgcatcccctacttccgatggatattaacagagccttagctagaaatgaaccaatttgcagatatttttatccccacaccactacccccactaccccactggtaataacctcatacctcacaacgaaaaacacctcgcgtgagctcagtacgatagagagcatgacgtcgaaaagccttccaactcgcaccacgttaagctcgggaacgttctatcagatttaccctcctagctttgccgattctaataaagacggcatcggagatttccgtggaatcatctcgcgactcgactatctcagcgaccttggcatcaccggaatctggctcaacgcgtgctttgattcaccttttaaagacggcggctacgatgtgcgcgactacacaaaggtggcttctcggtacggcacccatgaggatttggtggagcttttccaccaagcgcatgcccgcggaattgccattatcttggatctggttcctggtcacaccagcgaacaacacccttggtttcaacaaagtgctgctagtaaatacacagattttgatgaccgctatatttggacttcgcacgcatttgagggtggtgcggggctagcttttattggcggcgaacacccccgcaacggtgcgtacattattaatttcttcaaatctcaacctgcactcaattatggtttcgcagaattaacccagccatggcaccaaccagtagatgcccctggcccgcgggcaaatcaagacgcgatggttgagattatgaagtactggttatcgcaaggtgccgatggtttccgcgtggatatggcggattcgcttgtgaaaaacgacggcacctcaaagcgggccacgattggtatttggcagtctatgttgagccaagttcgcgccgagtttcctaatgccatctttgtctcggagtggggcacgcctactcaagcgtttgaggcgggctttgacgctgacttttacctcgattggcgcggcaatggttacaaccttttggcacgtaacacggataccccactggagcggcgcgatgatgcaagtttctttaactctgattccgctacgggtgcccaagagtttctcgatatgtatttgccgcaatgggagcgcacccatgaggcagggctgtttagttttatcagcggtaaccatgactgcccgcgtcttgcaccacgcctgaatgaacaagaacgcgcgttgttcttcttgttccagctcactatgcctggccttcctttcatttattacggggatgaaattgggcttccctatgcggagatccctacgaaggagggcggctatgcgcgcacggggtcgcgcacccccatgtgctgggattcccagttgcctaacggcggtttttcgcttggcgacgctcccctgtacctccccatgactgatacatcccagaatgtggcgcagcagcgtgagcgtgcggattcgttgttccatcacgtacaaaagctcattcagttgcgttctcagctgccagctttagatggctttgctgatctagagtttgatctttctctcctaaagaagcaccccaaggttatggtgtatcgccgcactcatcatcatggcgacagcgtgcttattgccctcaatgcaggtaacaagccgatacgcgtcgagcttcagcagccccaagcacatgagcttttccgttgtggtgatgtgacatatcccgatctctcagatcacagcgtggttgagttgggtcctacttctggcgtcatcttgtccgtgtaa

SEQ ID NO: 32841 - protein, 596 aa, Corynebacterium diphtheriae NCTC 13129
MHPNCNDIAQPHPLLPMDINRALARNEPICRYFYPHTTTPTTPLVITSYLTTKNTSRELSTIESMTSKSLPTRTTLSSGTFYQIYPPSFADSNKDGIGDFRGIISRLDYLSDLGITGIWLNACFDSPFKDGGYDVRDYTKVASRYGTHEDLVELFHQAHARGIAIILDLVPGHTSEQHPWFQQSAASKYTDFDDRYIWTSHAFEGGAGLAFIGGEHPRNGAYIINFFKSQPALNYGFAELTQPWHQPVDAPGPRANQDAMVEIMKYWLSQGADGFRVDMADSLVKNDGTSKRATIGIWQSMLSQVRAEFPNAIFVSEWGTPTQAFEAGFDADFYLDWRGNGYNLLARNTDTPLERRDDASFFNSDSATGAQEFLDMYLPQWERTHEAGLFSFISGNHDCPRLAPRLNEQERALFFLFQLTMPGLPFIYYGDEIGLPYAEIPTKEGGYARTGSRTPMCWDSQLPNGGFSLGDAPLYLPMTDTSQNVAQQRERADSLFHHVQKLIQLRSQLPALDGFADLEFDLSLLKKHPKVMVYRRTHHHGDSVLIALNAGNKPIRVELQQPQAHELFRCGDVTYPDLSDHSVVELGPTSGVILSV

SEQ ID NO: 32842 - DNA, 1617 bp, Rhodopseudomonas palustris CGA009
  CDS (1)..(1617)
atggaaagcgtgacgagcgtgtcgtggtgggcggcgggtgtgctgtaccagatctatccgcgctcgtttcaggacagcaacagcgacggcatcggtgatctgcgcgggatcatcgatcggctcggctatctgtccgatctcggcgtcgacgcgatctggctgtctccgatctttccgtcaccgatggcggactttggctacgatgtcgccgactatgtcggcatcgatccaatcttcggcacgatggacgatttcgacgcgctggtgctcacggcccatgcccgcgggctcaaggtcattctcgatctggtgccgaaccattcatccgaacagcatccctggttcatcgagagccggtcgtcgcggcacaaccccaagcgcgattggtacatctggcgcgaccccgcaccgggcggcggaccgccgaccaattggctgtcggaattcggcggcagcggctgggagtacgacgacgcgaccgggcagtattactatcacgcctttctgaagcagcagccggacctcaactggcgcaatccggaggtgcgggccgcgatctatgacgcgatgcggttctggctgcggaagggcgtcgatggcttccgggtcgacgtgatctggcacctgatcaaggacgaccaatttcgcgacaacccgcccaatccggattttcgccccggcatgccgccgcacgccgcgctgatcccgatttactccgcggatcggccagagacgttggaggtggttgccgagctgcgccgtgtcgtcgacgaattcgatcatcggctgctgattggcgagatctatctgccggtggagcggctggtcgcgtattacggagcggagctgaagggtgcgcagctgcctttcaacttcgcgctgctgtcgacgccgtggcgcgcccgggagattgcgacgctgatcgaacgctacgagcaggcgttgccggccggcgcgtggccgaattgggtgctgggcaatcacgaccggccgcgggtggcgagccgggtcgggccggcacaggcccgcgtcgccgcgatgctgctgctgacgctgcgcggcactccgacgatgtattacggcgacgagctcggcatggagcaggtcgagatcgcgcccgaggacgtgcaggatccgttcgagaagaacgtacccggcatcggtgtcggccgcgatggctgccgcacgccgatgcagtgggacgcgtcggaccaggccggattctcggatgtccggccgtggctgccgctggccccgaacgccacccaggataacgtcgctaatctgcgcgccgacgcgcagtcgatcctaaacctctatcgcgctctgctgcggctgcggcgcgcgctgccccagctggcgctcggcgcttaccagccgctcgcggcggagggcgagctgttgctgtatcgccggcatcatcaggggcagtcgatcttggtggcgctcaatcttggcccggatccgatctcggcggcgtccgacgcgatcgggctcgacggcgaggtgctgctgtcgaccatgctcgatcgcgccggcgaacgcatcggtgccacgctcgacctgcgcggcaacgaaggcatcatcgtcggccgggcgccggaggacgtggtttag

SEQ ID NO: 32843 - protein, 538 aa, Rhodopseudomonas palustris CGA009
MESVTSVSWWAAGVLYQIYPRSFQDSNSDGIGDLRGIIDRLGYLSDLGVDAIWLSPIFPSPMADFGYDVADYVGIDPIFGTMDDFDALVLTAHARGLKVILDLVPNHSSEQHPWFIESRSSRHNPKRDWYIWRDPAPGGGPPTNWLSEFGGSGWEYDDATGQYYYHAFLKQQPDLNWRNPEVRAAIYDAMRFWLRKGVDGFRVDVIWHLIKDDQFRDNPPNPDFRPGMPPHAALIPIYSADRPETLEVVAELRRVVDEFDHRLLIGEIYLPVERLVAYYGAELKGAQLPFNFALLSTPWRAREIATLIERYEQALPAGAWPNWVLGNHDRPRVASRVGPAQARVAAMLLLTLRGTPTMYYGDELGMEQVEIAPEDVQDPFEKNVPGIGVGRDGCRTPMQWDASDQAGFSDVRPWLPLAPNATQDNVANLRADAQSILNLYRALLRLRRALPQLALGAYQPLAAEGELLLYRRHHQGQSILVALNLGPDPISAASDAIGLDGEVLLSTMLDRAGERIGATLDLRGNEGIIVGRAPEDVV

SEQ ID NO: 32844 - DNA, 1773 bp, Mycobacterium avium subsp. paratuberculosis str. k10
  CDS (1)..(1773)
atgaacgacgcaagagaagctgtcgaacaccatcccgaggaaggcagtcacgtccaggacggtgtcgtcgagcaccccgaggccgaggacttcgacaacgccgccgcgctgcccaccgacccgacgtggttcaagcacgccgtgttctacgaggtgctggtccgcgcgttcttcgacgccaacgccgacggcgccggcgacctgcgcggtctgctggcgcagctggactacctgcagtggctgggcatcgactgcatctggctgcccccgttctacgactcgccgctgcgcgacggcggttacgacatccgggatttctacaaggtgctgccggagttcggcacggtcgaggatttcgtggcgctgctcaacgccgcgcacgagcggggcatccgggtgatcaccgacctggtgatgaatcacacgtcggagtcgcacccctggttccaggagtcccggcacgaccccgacggaccgtacggcgacttctacgtgtggagcgacaccagcgaccgctacgccgatgcccgcatcatcttcgtcgacaccgaggagtccaactggacgttcgacccggtgcgccgccagttttactggcaccggttcttctcccaccagcccgacctgaactacgacaacccggccgtgcaggaagccatgatcgacgtgatccggttctggctcgggctgggaatcgacgggttccggctggacgcggtgccctacctgttcgagcgggagggcaccaactgcgagaacctgccggagacgcacgccttcctcaagcgggtccgcaaggtcgtcgacgacgagttcccgggccgggtgttgctggccgaggccaaccagtggccggccgacgtggtcgagtatttcggcgaccccagcaccggcggcgacgaatgccacatggcgttccacttcccgctgatgccgcgcatcttcatggccgtgcgccgcgagtcgcgattcccgatctcggagatcctggcccagacgccgcagatccccgagatggcgcagtgggggatcttcctgcgcaaccacgacgagttgacgctggagatggtcaccgacgaagagcgcgactacatgtacgccgagtacgccaaggatccgcggatgaaggccaacgtcggcatccgccgccggctggcgccgctgctggacaacgaccgcaaccagatcgagctgttcaccgccctgctgctgtccctgcccggctcgccggtgctctactacggcgacgagatcggcatgggcgacgtgatctggctgggggatcgcgacggggtgcgcacgccgatgcagtggacgccggaccgcaacgccggcttctccaaggccaaccccggccggctgtatctgccacccagccaggacccggtgtacggctaccaggcggtcaacgtggaggcgcaacgcgacacctcgacgtcgctgctcaacttcacccgcaccatgctcgccgtgcggcgccggcacgaggccttcgcgatcggcacgttcgaggagctcggcggatccaacccgtcggtgctggcgttcgtgcggcaggtgtccaacgacggggacaccgtgctgtgcgtcaacaacctgtcgcggttcccgcagccgatcgagctgaatctgcagcactggagcgggtgcatcccggtcgagctgaccgggcacgtggaattcccccgcatcgggcacctgccctacctgctgacgctgccggggcacggtttctattggttccagctgaccgcatgcgaggaggacacatga

SEQ ID NO: 32845 - protein, 590 aa, Mycobacterium avium subsp. paratuberculosis str. k10
MNDAREAVEHHPEEGSHVQDGVVEHPEAEDFDNAAALPTDPTWFKHAVFYEVLVRAFFDANADGAGDLRGLLAQLDYLQWLGIDCIWLPPFYDSPLRDGGYDIRDFYKVLPEFGTVEDFVALLNAAHERGIRVITDLVMNHTSESHPWFQESRHDPDGPYGDFYVWSDTSDRYADARIIFVDTEESNWTFDPVRRQFYWHRFFSHQPDLNYDNPAVQEAMIDVIRFWLGLGIDGFRLDAVPYLFEREGTNCENLPETHAFLKRVRKVVDDEFPGRVLLAEANQWPADVVEYFGDPSTGGDECHMAFHFPLMPRIFMAVRRESRFPISEILAQTPQIPEMAQWGIFLRNHDELTLEMVTDEERDYMYAEYAKDPRMKANVGIRRRLAPLLDNDRNQIELFTALLLSLPGSPVLYYGDEIGMGDVIWLGDRDGVRTPMQWTPDRNAGFSKANPGRLYLPPSQDPVYGYQAVNVEAQRDTSTSLLNFTRTMLAVRRRHEAFAIGTFEELGGSNPSVLAFVRQVSNDGDTVLCVNNLSRFPQPIELNLQHWSGCIPVELTGHVEFPRIGHLPYLLTLPGHGFYWFQLTACEEDT

SEQ ID NO: 32846 - DNA, 1617 bp, Lactobacillus johnsonii NCC 533
  CDS (1)..(1617)
atgacaccttggtggaaaaaagctgttgtttatcaagtttatcctaagtcatttcaagatagtaatggtgatggaattggagatatccccggaatcatttcacggctggggtatctagaaaaactgggaattgatgctatttggctgtcgcctgtttacttatcccctggtgtagataatggctatgatatctctgattatcaaaaaatagacccacaatacggaacaatggctgacatggataatctgattagagaagctaaaaaacatcatatacgcattattatggaccttgtcgttaaccatacatctgaccagcatccttggttcattgaagcaagaaaaagtaaggagaatccatacagagatttctatatttggcatgatccggtagagggccatgaacctaatgagttgaaatctgctttttctggttcagcttggaagtttgatgaaaaaactggtcaatattacttacacttcttcgccgatcaacaaccagatcttaattggaagaacccaaaattaagaaataaaatctatgaaatgatgaattattggatcgataagggaattggcggctttaggatggatgtgattgaacttattggaaaagatcccgataaaaagattcgcgagaatggtccaatgcttcatccatatttaaaagagatgaatgagaatacttttgccggtaaagaattaatgacggtgggtgaaacatggaactctactccaaagattgctgcagaatattcagatccagctcgtcatgaattatcgatggtatttcaatttgaaaatcaaggcttagatcagcaagaaggaaaagaaaaatgggatttacgtccgcttgatttaggcgaattgaaaaaagttctagttaaatggcagacagaaattgattttaatcatgcatggaatagtcttttttgtgaaaatcatgatattccgcgagttatttcacgatggggaaatgacaaagaatatcgagttcaaagcgcaaaaatgtttgcgattgtactgcatttaatgcacggaacaccttatatctataatggtgaagaaattgggatgacgaattgtcctgttaagtcaattgatgaagtagaggacattgaaagtatcaatatgtaccgcgaaagaattgataagggctacagtaaggatgaactaattaaagcaattaatactaaaggtcgagataatgcacgccgtccaatgcagtggtcaaatggagaaaatgctgactttactacaggaacaccgtggctaaaattaaacccaaactacaagaccattaacgttaaagaagccttagaagatccaaattctattttttatacctatcaaaaattaattaaacttcgccatgaaaattctgttgtggtggatggagattttgaacttgttgaaaatactagtgataatattttggccttttggcgaaaactagaagatgaaaactggctagtagtcgctaacttgtctggtgaggaccaaaatctaaatttagatattccctttaaagaagttttgattagtaactatgaaaaacgagacagtttaaaagatatggttttaaaaccttatgaagcttttgcagttaaggcatag

SEQ ID NO: 32847 - protein, 538 aa, Lactobacillus johnsonii NCC 533
MTPWWKKAVVYQVYPKSFQDSNGDGIGDIPGIISRLGYLEKLGIDAIWLSPVYLSPGVDNGYDISDYQKIDPQYGTMADMDNLIREAKKHHIRIIMDLVVNHTSDQHPWFIEARKSKENPYRDFYIWHDPVEGHEPNELKSAFSGSAWKFDEKTGQYYLHFFADQQPDLNWKNPKLRNKIYEMMNYWIDKGIGGFRMDVIELIGKDPDKKIRENGPMLHPYLKEMNENTFAGKELMTVGETWNSTPKIAAEYSDPARHELSMVFQFENQGLDQQEGKEKWDLRPLDLGELKKVLVKWQTEIDFNHAWNSLFCENHDIPRVISRWGNDKEYRVQSAKMFAIVLHLMHGTPYIYNGEEIGMTNCPVKSIDEVEDIESINMYRERIDKGYSKDELIKAINTKGRDNARRPMQWSNGENADFTTGTPWLKLNPNYKTINVKEALEDPNSIFYTYQKLIKLRHENSVVVDGDFELVENTSDNILAFWRKLEDENWLVVANLSGEDQNLNLDIPFKEVLISNYEKRDSLKDMVLKPYEAFAVKA

SEQ ID NO: 32848 - DNA, 1674 bp, Bdellovibrio bacteriovorus HD100
  CDS (1)..(1674)
gtgtccgaagttcagaagaattggtggaaagaagcagtcgtttatcaggtctatcctcgcagctttaaggattccaacggcgatggtatgggggacctgcaaggtctgatttccaagctggattacctgaaagaactgggtatcaatgtcatctggatctgtccgatgtacaaatccccgcaggatgacaacggctatgacatcagcgattaccaggatattcaccacgagtttggcacgatgaaggactttgaccagcttttgcagcaggttcatgctcgcggcatgaagctgatcatcgatctggtcgtgaatcacaccagcgacgaacatccttggtttatcgagtcccgcagctccagaaacaatcccaagcgcgactggtacatctggcgggatggtaaaaacggtaaagagcccaacaactgggaaagtattttcagcggatcggcgtggaagtatgacgaactgacccagcagtacttcatgcatattttttcaagcaaacagcccgacttgaactgggaaaatctggacatgcgcaaggccgtctatgacatgatcaactggtggctggataagggcattgatggattccgtgtggatgccatcagccatgcccgcaaagaaccaggcctggctgacatgcccaacccgaacaatctagagtatgtgccgtcctatgataaacacatgaacgtgaatggcattcaggaatatctgaaagatctttgcaccaacaccttcaacaaatatgacatcatgaccgtggctgaagccaacggcgtgtcggcggaaaatgcagaagagtgggtgggcagagagcagaagaaattcaacatgatcattcagttcgaacacgtgggtctgtgggatgcgaatcctgagcgccgggtggatctggcgaagctaaaatctgtcctgggtcgctggcaaaaaggtcttgagggccgtggttggaacgcactgttcgtggaaaaccacgacgtgcctcgcatcacctccaaatggggtgatattcagaatttctggcgcgaaagcaccacctctattgcgaccatgtactttatgatgcaggggacaccgtttatttatcagggccaggaaattggcatgaccaatacggtgtttaatggtcctgaggactttaacgatgtttctgcgaaaaacatcttcacgatccgccgcaagcaaggggccacagatgccgagatcacggctgaccttgccagtgcctctcgtgacaatgcccgaactcctatgcaatgggactcctctgaacagggtggtttcaccacgggtcgtccttggttgaaggtgaatccaaactacaagaacatcaacgtggcggcccaggacaaggatccaacttctgttctgaatttttatcgcaatctgattcgcttacgcaaagcccattcagtgtttatatatggtgtctatgacgaggttctaagtaagcacgatcagatctatgcttacacccgcaccgacggaaatgaaaaaatgctggtgatggccaacatgaccggcaagcctgcgaagtttgacctgccgggattcagtttgtcttctgcgaatcttttaatggccaactatgccgtggctgatcacagctcaatcacgggcggggagcttcgtccgtttgaaagccgcatttacaaaattaattaa

SEQ ID NO: 32849 - protein, 557 aa, Bdellovibrio bacteriovorus HD100
MSEVQKNWWKEAVVYQVYPRSFKDSNGDGMGDLQGLISKLDYLKELGINVIWICPMYKSPQDDNGYDISDYQDIHHEFGTMKDFDQLLQQVHARGMKLIIDLVVNHTSDEHPWFIESRSSRNNPKRDWYIWRDGKNGKEPNNWESIFSGSAWKYDELTQQYFMHIFSSKQPDLNWENLDMRKAVYDMINWWLDKGIDGFRVDAISHARKEPGLADMPNPNNLEYVPSYDKHMNVNGIQEYLKDLCTNTFNKYDIMTVAEANGVSAENAEEWVGREQKKFNMIIQFEHVGLWDANPERRVDLAKLKSVLGRWQKGLEGRGWNALFVENHDVPRITSKWGDIQNFWRESTTSIATMYFMMQGTPFIYQGQEIGMTNTVFNGPEDFNDVSAKNIFTIRRKQGATDAEITADLASASRDNARTPMQWDSSEQGGFTTGRPWLKVNPNYKNINVAAQDKDPTSVLNFYRNLIRLRKAHSVFIYGVYDEVLSKHDQIYAYTRTDGNEKMLVMANMTGKPAKFDLPGFSLSSANLLMANYAVADHSSITGGELRPFESRIYKIN

SEQ ID NO: 32850 - DNA, 1626 bp, Treponema denticola ATCC 35405
  CDS (1)..(1626)
atggaatggtggaataaaagggttttttatcagatatatcccagaagtttttgtgatgcaaacaatgacgggatgggggacattcagggtattatctcaaaattgccttatttaaaggaactgggtataggggcaatttggctttctcccgtaaccgcatcctccgattatgataacggctatgatgtttccgattattgcgatatcaaccccaaattcggcacaatggatgactttaagtctctattaaaagaagcggataaactggatataaaaattgtgatggacttggttataaaccatacaagcgatcagcataggtggtttatcgaatctaaaaatcccgaatctccctaccataattattatgtttggaaagagcctaggcttgtaaagggtaaaaagctgcctcccaataattgggacagcctttttttaggttctgcatggaagtattgtgaagaaaacggcctctattatcttcacctttttaccgaaaatcagccggatctaaactataacaatcccgcggttactgaagaagtaaaaaagatattgaagttttggctggatatgggtgttgcgggcttccgctgcgatgttataaactgtatttataaaacctcttacgaggatgcaaaaaaaagaaggattaaaacaggcaaagagttttatctttctcaaaagggatgccatgatattctaaaagaattaaatagagatgtcctaaaaccctacaatgcctttacagtaggcgaaactatggacgtttctttagaagaagctaaagattttattcaggacgaattgactcttgtttttccttttgaacatcacaccggggtagactgctggtttcaaattccggttttaaaacggaaatataagcctttccgaatgattaaaatcttaaaaaaatggcagactaaaatgccatggactcctcttttctttgaaaatcacgatcaggcacgttctgtttcgcggtttggggatgagggaaaatactacaaagaaagcgtcaaaatgcttgcaaccgtgcttttgacccaaaaaggaaccccctttatttatcaagggcaggaaattgggcttactaataccgattttaaaagcatggatgaaatcgacgatatagccacaaagaatatttatgacactctccgccgtcttaaattcggtaaaaaacgggcctttaaaatgacaatgaactatgcccgggaccatgcaagaactcccataccgtgggatgattccgaaaacgggggcttttgtaccgtaaagccttggctgcggcttaacgaaaaatataaagaaataaatgtaaagaagaatctatcggaatccgattcctgctttaattattataagaaactgatagccttaagaaacgaggaagaagtcttacagctcggcgatatagaatttgcggatttgggaaaggatatttttgcatattatcgcaaaaaaggcgataaaactttttttattgtttccaatatgtcaggcaaggctcagaagataagggaagaggtcagaggtcttccgattctatttaattatagaaactttaaccctcaacagaagattttacgtccctttgagtctgtaattacaagaatttag

SEQ ID NO: 32851 - protein, 541 aa, Treponema denticola ATCC 35405
MEWWNKRVFYQIYPRSFCDANNDGMGDIQGIISKLPYLKELGIGAIWLSPVTASSDYDNGYDVSDYCDINPKFGTMDDFKSLLKEADKLDIKIVMDLVINHTSDQHRWFIESKNPESPYHNYYVWKEPRLVKGKKLPPNNWDSLFLGSAWKYCEENGLYYLHLFTENQPDLNYNNPAVTEEVKKILKFWLDMGVAGFRCDVINCIYKTSYEDAKKRRIKTGKEFYLSQKGCHDILKELNRDVLKPYNAFTVGETMDVSLEEAKDFIQDELTLVFPFEHHTGVDCWFQIPVLKRKYKPFRMIKILKKWQTKMPWTPLFFENHDQARSVSRFGDEGKYYKESVKMLATVLLTQKGTPFIYQGQEIGLTNTDFKSMDEIDDIATKNIYDTLRRLKFGKKRAFKMTMNYARDHARTPIPWDDSENGGFCTVKPWLRLNEKYKEINVKKNLSESDSCFNYYKKLIALRNEEEVLQLGDIEFADLGKDIFAYYRKKGDKTFFIVSNMSGKAQKIREEVRGLPILFNYRNFNPQQKILRPFESVITRI

SEQ ID NO: 32852 - DNA, 1665 bp, Bacillus cereus ATCC 10987
  CDS (1)..(1665)
atgaataaaacatggtggaaagaagcggttgcttatcaaatttacccacgtagctttatggattcaaatggtgatggtattggggatttacaaggtattattgcaaaactggattatttaaaagatttaggtatagatgtaatttggatttgtccaatgtataagtcacctaatgatgataatggttatgacattagtgattatcaagatattatggatgagtttggtacgatggaggacttcgatgctttactagatgaagttcataagcgtgatatgaagcttattattgatttagttattaatcatacaagtgatgaacatccatggtttattgagtctcgttcatctaaagacaatccgaagcgtgattggtatatttggcatgatggtaaagatggtgcggaaccaaacaactgggaaagtatttttaatggttcggcatgggaatacgatgaagtaacaggacaatattatttacacttattctcacgtaaacaaccagatttaaactgggagaataaagaagttcgcgaagtgttatacgatacagttaattggtggcttgataaaggaattgatggtttccgtgtggatgcgatcagccatattaaaaaagaggatggctttaaagatatgccaaatccaaaagaactaaagtatgtaccatcttttgataaacatatgaatgtggatggtattcaacctttattagaagagttaaaagaaaatacattttctaagtacgatattatgactgtcggtgaagcgaatggtgttaagattgaagatgctgagctttgggttggagaagaacaaggtaagttcaatatggtattccaattcgaacatttaagcttatgggatgcagaaaagaagaaagatcttgatgttgtagggttgaaaaaagtattaacgaaatggcaaaaaggtctagaaaataaagggtggaatgctttatatattgagaatcacgataagccacgtatcgtttcaacttggggagatgataaacaatattggcgtgaaagtgcgacagctcttggagcgatgtatttctttatgcatggtacaccgtttatttatcaaggacaagaaattgggatgacaaatgttcaattcccaaatattgaagattacgatgatgtagcaattaaaaatttatatcgtgagaaaattgcagagggtgtatctcatcaagatatgatggagattatatgggcttcttgccgcgataattcacgtacacctatgcagtggaacgatgagatgaatgctggcttcacaacaggtgccccttggtttgggatgaatccaaactataaagaaattaatgttgaaaagcaaaagagtgaagagaactctattttcaatttctataagaaaatgattgctttgaaaaaagagcacgatgtactgaattatggtacgtacgatttacttttagaagatgatccgcaaatttatgcatatactcgtacattaagcgatgaaaaaatcgttgtaattagtaatatctcaaaagaggaagctgtatataatgagggttcattcgcgatagaacgcaaacgtttgcttttaaataactacgaagttgcggaacatgaacaagtaactacaatcacgttaaagccttatgaaacaagggtttatcgtatttcataa

SEQ ID NO: 32853 - protein, 554 aa, Bacillus cereus ATCC 10987
MNKTWWKEAVAYQIYPRSFMDSNGDGIGDLQGIIAKLDYLKDLGIDVIWICPMYKSPNDDNGYDISDYQDIMDEFGTMEDFDALLDEVHKRDMKLIIDLVINHTSDEHPWFIESRSSKDNPKRDWYIWHDGKDGAEPNNWESIFNGSAWEYDEVTGQYYLHLFSRKQPDLNWENKEVREVLYDTVNWWLDKGIDGFRVDAISHIKKEDGFKDMPNPKELKYVPSFDKHMNVDGIQPLLEELKENTFSKYDIMTVGEANGVKIEDAELWVGEEQGKFNMVFQFEHLSLWDAEKKKDLDVVGLKKVLTKWQKGLENKGWNALYIENHDKPRIVSTWGDDKQYWRESATALGAMYFFMHGTPFIYQGQEIGMTNVQFPNIEDYDDVAIKNLYREKIAEGVSHQDMMEIIWASCRDNSRTPMQWNDEMNAGFTTGAPWFGMNPNYKEINVEKQKSEENSIFNFYKKMIALKKEHDVLNYGTYDLLLEDDPQIYAYTRTLSDEKIVVISNISKEEAVYNEGSFAIERKRLLLNNYEVAEHEQVTTITLKPYETRVYRIS

SEQ ID NO: 32854 - DNA, 1743 bp, Drosophila melanogaster
  CDS (1)..(1743)
atggcgtgttttaaagtcttaatcgcagcgatactcgttttggggatccactgcgcccttgggagtgcagcagcagtggatctcgaccttgagagagcgaccacggccgcggacaccactcgagattggtggcaagtggcacaattttatcagatctatccgcgctcctacaaggactccgatggcgatggcattggcgacctgcagggcatcatttccaagttggactacctaaaggagattggagtgactgccacctggctttcgcccatctacagttcgcccatggcggacttcggatacgatatttctgacttcttcgatattcagccggagtacggcaccctggccgacttcgatgaactgatcgcggaggctaaaaagcggaacatcaagatcatcctggactttgtgccgaaccactcgagtgatgaaaacgtctggttccagaagtcggttaagagggaaaaaggctatgaggactattatatgtggcacgatggctacgtgaatgccactaccgggaaaagggaaccaccgtccaactggctacaagccttccgcggaagcgcctgggagtggaacgatgaacgccagcaatactacctccaccagttcgccgttaagcagccggatctcaattaccggaatccagcggtggttgcccagatgaagcgggtgctcacctactggttggatcgtggagtagctgggttccgcatggatgcggtgccgtggtgctttgaggtcttgccagacgctgatggtcggtatcccgacgagccgttgagtggctacaccgatgatccggatgactcctcctatctgaagcacatctacactcaggatctgcgcgaaacggtggagatggttttccagtggcgcactctgctggacgattaccaacgcattcacggcggtgatacgcgagttatcatggtggagacctattccggcctggactatgtgatgcagttctatggcaatcgtaccaccaagggtgctcagatgccctttaattttcagttcattattggcggcaatggagacaagaacaacactcagctcaatgcgacgggattcgtgaagataatcagtagctggttgagccaaatgccggctggccagacagcaaactgggtgatgggaaatcacgatcagcggagagtgggtagtcgctacggcgagaaccgcatcgacttgatgaatatgctgcagatgttcctgcccggcgtgagcatcacttatcagggagaggaactgggaatgactgacctggacatcagctgggaggacagccgggatcctgcggcctgcaattccaactcggatatttacgagcagttcactcgcgatcccgccaggactccattccagtggagcgatgaggccaacgcaggtttctccaccaacgccaccacctggttgccaataaatccaaactatgttaccgtaaatgcaaaggcggagaattccacgagtcccagccacttgagcttgtacaagcagctggtggatctgcgaaaatcaaagactctgcagtttggcgccactcgatatgcgaatgtgggcgacaatgtggtggccattaggaggtatctgagcggggagccctcctacgtgctggttgccaatgtgctggacaccagtgtctctggaatagacgtagccagtgccatatatgcgactggtagctacaaaatcaagctgctcaatccgcaagccaaggccacagttgggtaa

SEQ ID NO: 32855 - protein, 580 aa, Drosophila melanogaster
MACFKVLIAAILVLGIHCALGSAAAVDLDLERATTAADTTRDWWQVAQFYQIYPRSYKDSDGDGIGDLQGIISKLDYLKEIGVTATWLSPIYSSPMADFGYDISDFFDIQPEYGTLADFDELIAEAKKRNIKIILDFVPNHSSDENVWFQKSVKREKGYEDYYMWHDGYVNATTGKREPPSNWLQAFRGSAWEWNDERQQYYLHQFAVKQPDLNYRNPAVVAQMKRVLTYWLDRGVAGFRMDAVPWCFEVLPDADGRYPDEPLSGYTDDPDDSSYLKHIYTQDLRETVEMVFQWRTLLDDYQRIHGGDTRVIMVETYSGLDYVMQFYGNRTTKGAQMPFNFQFIIGGNGDKNNTQLNATGFVKIISSWLSQMPAGQTANWVMGNHDQRRVGSRYGENRIDLMNMLQMFLPGVSITYQGEELGMTDLDISWEDSRDPAACNSNSDIYEQFTRDPARTPFQWSDEANAGFSTNATTWLPINPNYVTVNAKAENSTSPSHLSLYKQLVDLRKSKTLQFGATRYANVGDNVVAIRRYLSGEPSYVLVANVLDTSVSGIDVASAIYATGSYKIKLLNPQAKATVG

SEQ ID NO: 32856 - DNA, 1827 bp, Neurospora crassa
  CDS (1)..(1827)
atgggttccgtcaacaacgcctccctatgcgtgggcaagactccctggtggaaagaagctgtcttctaccaagtctacccagccagcttcaaagactccaacaatgacggctggggtgacattcccggcctcatcgccaaaatcgactacctccacgacctaggcgtcgattgcgtgtggctgtctcccatgttcgagtctccccaaaaagacatgggctacgacatctccgattaccaagccgtctactcccgctatggcaccctctccgacgtcgacaacctgatcgccgcctgccacgtccgcggcatgaagctgattcttgacctggtcgtcaaccacacttccgaccaacacccgtggttccaagaatcgcgctcctccaaaaccaatcccaagcgcgactggtacatgtggaagccggcccgctacgacgccaacgggaaccgcataccgcccaccaactggcgcagctactttgccggtcccacctggacctgggacgagctgacccaagagtactacctgcacctgtacgacaactcccaacccgacctgaactgggaaaacgaggagtgtcgcaaggccatctacaacgaggccatgcgtttctggctcgatcgcggtgtcgacggctttcgtatcgacaccgtcaacaagtactccaagcgcactgacttcccggatgcgccggtcaccatgccgggcgagacggaccagcccgccgcggaaatgtggtgcaacggcccgcgcattcacgagttcatccgcgaaatgaacgagcaggtgctggcgccgtacaatgccgtctcggtgggcgagctgtccaacacgccgctgccgagccaggtcctgccgtatgtctctgctgcggccaaggaactggatatggtgtttgagtttagcaccatccgcttgggcacgggcgggccgtttcatggcaagtatctctatagagagtttccgctgtcggagctgaaagcgtatgtggcgacgtggcagcagtggctggagggtacggatgggtggcacacggtgttttgcgagaatcatgataacgggcgggcggtgtcaaggtttggagatgattcgactgtggagtcgtgggaggcgagcgcaaagactattgccttgtggcaggcgacgctgacggggacgattttcttgtatcaggggcaggagattggtatggtcaatatgccgaaggagtggcggattgagcaggagtataaggatgttgagagcttgaacttctacagagaggccaaggcgtttggggatgcagagaggataaggaagacggaggagggtctgaggatcctggcaagagatcactcgaggataccgatgcagtgggatgcatcacccaatgcgggcttcacttctgctggagtgacgccgtggatgagagtgcatgatgggttcaaagatctgaatgtggagaagcaggagggagatgatgagtcgatccttgggttctacaagaagatcctgaagttgaggaaggaatacagcgggctgttcgtgcatggtgcgttcagaccttcactgcaagaggacgagacactgtttgtttacgtcaaggacgatcaaggttcggaagagagtggtgtccaggcagacaagaggaggaaggcgttagtcgtcatgaatttctctgggcagccagctattcttcgggagcataatctcaacgtggcagccacgctgggatgcaaacaaggggaggagcggctgttagtgactactctgaagaagaaggatacgcctagaatggaagctggcgttttggagccatgggaaagcagaatgtatctgaacttttag

SEQ ID NO: 32857 - protein, 608 aa, Neurospora crassa
MGSVNNASLCVGKTPWWKEAVFYQVYPASFKDSNNDGWGDIPGLIAKIDYLHDLGVDCVWLSPMFESPQKDMGYDISDYQAVYSRYGTLSDVDNLIAACHVRGMKLILDLVVNHTSDQHPWFQESRSSKTNPKRDWYMWKPARYDANGNRIPPTNWRSYFAGPTWTWDELTQEYYLHLYDNSQPDLNWENEECRKAIYNEAMRFWLDRGVDGFRIDTVNKYSKRTDFPDAPVTMPGETDQPAAEMWCNGPRIHEFIREMNEQVLAPYNAVSVGELSNTPLPSQVLPYVSAAAKELDMVFEFSTIRLGTGGPFHGKYLYREFPLSELKAYVATWQQWLEGTDGWHTVFCENHDNGRAVSRFGDDSTVESWEASAKTIALWQATLTGTIFLYQGQEIGMVNMPKEWRIEQEYKDVESLNFYREAKAFGDAERIRKTEEGLRILARDHSRIPMQWDASPNAGFTSAGVTPWMRVHDGFKDLNVEKQEGDDESILGFYKKILKLRKEYSGLFVHGAFRPSLQEDETLFVYVKDDQGSEESGVQADKRRKALVVMNFSGQPAILREHNLNVAATLGCKQGEERLLVTTLKKKDTPRMEAGVLEPWESRMYLNF

SEQ ID NO: 32858 - DNA, 1749 bp, Neurospora crassa
  CDS (1)..(1749)
atggccgacaatctcgacagggtctggtggaaagatggagtggtctatcaaatctacccggcgtctttcaaggactcgaatggagacgggttaggggatataccgggcatcatcagcaagttggactacatccagaatctgggcgttgatatcatttgggtttctccaatgtttgagagtccacagattgacatgggctacgacgtctcaaactatgaggaggtctaccccccgtacggcacagtcaaggacatggagaacctcattgaagcttgccacaagaggggaatgagactggtcttggacctggttgtcaatcacacctctgatcagcatgcctggttcaaggagtcgcgatcctccaaggacaatccgaagcgtgactggtacatctggaagcctcctcgttacgccgaagatggaacacgccttccaccgacgaactggcggagttacttctcaggcagtgcgtgggagtatgacgaacatacaaacgaatattatcttcatctgtttgccaaggagatgccagacctcaactgggagagtgaagagtgccgcaaagccatttacgacagcgccatgcgcttctggttggataagggcgtggatggcttccgagttgactgtgtgaacatgtactcaaagtccacagaatttctcgatgctcccatcgttgactcacgcttctacgagcagccggcatggtgctattatgccaacgggccacgcatgcacgagtttctgcgcgagatgaatgaaaaggtgctcgaccgctacgacgctatgaccgtcggcgagttaccgcacactcccgacccgaagagggtgctcgactatgttgggcgcaaagataagcagctcagcatggtgtttcagttcgacattgtggacatcggccaaggtggcacccacaagtaccattttgaggagtggaagttacctgtgctgaagaagattgtcgagaagtggcaacgcttcatcgagggcactgatggatggacaacatccttctgcgaaaaccacgaccaaggccgttccatttcacgcttcgcctccgacgcccccgaataccgcgtcctctcgggcaagatgctctcgctgatgatgtgctctttgacgggaaccctcttcatctaccaaggccaagagatcggcatgatcaacgtgcccaaggactggcccatcgactactaccaggacatcgagtcggtcaacttttacaagctgatggccgccaagaccaacaacgaccccgaggagatggcgtacgtgatgcgcagcctccagactctgagtagagataacgcccggatacctatgcagtgggatgacagtccgtatgctgggttcactgaaaggaaggaaggtgcctgggcgcacgtccacgacctgtatcccgagatcaacgtggccaagcaactcgacgatccgaactcgacgctcagcttttggaaagacatgatccgtttccgcaagcaacatagcgaggtactggtgcatggaacgttcgaggcgtgtgatatcgagaacgagaagacgtttgtgttcgtcaagagattcggaggtaaacgggttgtagttactctgaacttcagcaatgaagagcaggaggtggtgttgccggagcatgaaaaggggttgaagtttatggtcggaaactatggcaacgaagaaggggggatgggcgaaaggagaaggttgaggccatgggagggaaggttgtacatggctggaggtgaggcttga

SEQ ID NO: 32859 - protein, 582 aa, Neurospora crassa
MADNLDRVWWKDGVVYQIYPASFKDSNGDGLGDIPGIISKLDYIQNLGVDIIWVSPMFESPQIDMGYDVSNYEEVYPPYGTVKDMENLIEACHKRGMRLVLDLVVNHTSDQHAWFKESRSSKDNPKRDWYIWKPPRYAEDGTRLPPTNWRSYFSGSAWEYDEHTNEYYLHLFAKEMPDLNWESEECRKAIYDSAMRFWLDKGVDGFRVDCVNMYSKSTEFLDAPIVDSRFYEQPAWCYYANGPRMHEFLREMNEKVLDRYDAMTVGELPHTPDPKRVLDYVGRKDKQLSMVFQFDIVDIGQGGTHKYHFEEWKLPVLKKIVEKWQRFIEGTDGWTTSFCENHDQGRSISRFASDAPEYRVLSGKMLSLMMCSLTGTLFIYQGQEIGMINVPKDWPIDYYQDIESVNFYKLMAAKTNNDPEEMAYVMRSLQTLSRDNARIPMQWDDSPYAGFTERKEGAWAHVHDLYPEINVAKQLDDPNSTLSFWKDMIRFRKQHSEVLVHGTFEACDIENEKTFVFVKRFGGKRVVVTLNFSNEEQEVVLPEHEKGLKFMVGNYGNEEGGMGERRRLRPWEGRLYMAGGEA

SEQ ID NO: 32860 - DNA, 1869 bp, Magnaporthe grisea 70-15
  CDS (1)..(1869)
atgggctgcattccattagacctacaaactgacgcctcaaatcggctgtacggcaagttaccatggtggaaagatgccgtattttaccaagtctacccggctagctttgtagacagcaacggggatgggtggggtgacattccgggcctagtcacaaagctcgattacctcgccaaccttggcgtcgactgcgtctggctatcgcccgtcttcgacagcccacaagccgacatgggatacgacgtctcggactatcagagcatatatgcgccttatgggaccgtcgccgacgtcgacgctctgcttgcgggctgtcatgcaagagggatgaaattaatcttggacttggtggtcaaccacacgagcgtcgaacactcgtggttcaaggagggtcgcagcagcagagcaagctctaagcgtgactggtatatatggaggccagcacggtatgatcccatcacaggtggaaggctgcccccgacgaactggcggggctactttgccggctcaacttggacatgggatgagcagacgcaggagtactatcttcatctgtacgctcccgagcagccggatttgaactgggataacgaggactgtcgaatggccatctataaagacactatgaacttttggcttgaccgcggagttgacggctttcgcatagatacagtcaacaagtattccaagagggattacgtcgacgtcccggtgacggaccccagcagctacactcagcccgctccggacatgtggtgcaacggcccttgtatccatgagtatatccgcgagatggcagccgaaacactacaccggtatcccggcgccgtcagcgttggggagttgagcaacatgaccaagggcccctcgcaggtcctcgaatacgtgtccgcgtcgcgcagcgagctggacatggtgtttgagttctccgcaatcaggctaggaaccggggacggctttggtgccaagtacatatacacgccatttccattgtcccacctcaagcgcatcacagagacttggcaggcgttcatcgagggaacagacggctggacaacggcttttgtcgagaaccacgacaacggccgggccgtgtcgaggtttggcgacgaccgctcgcccgaggcgtggcgggccagcgcgaggtgtatcgcactgtggcaggctacattgacaggtactctattcttgtaccaagggcaggagatcggaatgaccaacatgcccgagaattgggacatcgatgagtacaaagatgttgagagccagggcttctacaaggaggcggtaggaagcggtgatgtggacagtataaagaagacgatgcacggtctgagaattcttgcacgggaccacagccggctgccgatgcgatgggacggcggggcacctaatgccggattcgggcagtccacagatggctgcaagccatggatgcgagtcgtccaagacgcagaatgccgcggcggcggtgccgaggttagcgtggctgcgcaaactggcagaaaggagagcgttttggagttttatcgacttgtgttggcgctgaggaagaaacatcgcgagctgatggtacatggcagcttcaggctcctagatccggaagatgagtacatctttgcgtacgtcaaggaggcaagtcaaggcgtcaacgccaaagaaaacgacaggacagtcaaaaagtgcgtcgtcgtgctcaatttctcaggagaagcacaagagtgcgtggatgttgctgcggcaatgggctgtggactgacagacgtacgactactggtcgatactattgtgggcgaaccggaggacggacgggtcatctcgatcccagcacttggagcctgggaagggagagtatatgtcaacttttag

SEQ ID NO: 32861 - protein, 622 aa, Magnaporthe grisea 70-15
MGCIPLDLQTDASNRLYGKLPWWKDAVFYQVYPASFVDSNGDGWGDIPGLVTKLDYLANLGVDCVWLSPVFDSPQADMGYDVSDYQSIYAPYGTVADVDALLAGCHARGMKLILDLVVNHTSVEHSWFKEGRSSRASSKRDWYIWRPARYDPITGGRLPPTNWRGYFAGSTWTWDEQTQEYYLHLYAPEQPDLNWDNEDCRMAIYKDTMNFWLDRGVDGFRIDTVNKYSKRDYVDVPVTDPSSYTQPAPDMWCNGPCIHEYIREMAAETLHRYPGAVSVGELSNMTKGPSQVLEYVSASRSELDMVFEFSAIRLGTGDGFGAKYIYTPFPLSHLKRITETWQAFIEGTDGWTTAFVENHDNGRAVSRFGDDRSPEAWRASARCIALWQATLTGTLFLYQGQEIGMTNMPENWDIDEYKDVESQGFYKEAVGSGDVDSIKKTMHGLRILARDHSRLPMRWDGGAPNAGFGQSTDGCKPWMRVVQDAECRGGGAEVSVAAQTGRKESVLEFYRLVLALRKKHRELMVHGSFRLLDPEDEYIFAYVKEASQGVNAKENDRTVKKCVVVLNFSGEAQECVDVAAAMGCGLTDVRLLVDTIVGEPEDGRVISIPALGAWEGRVYVNF

SEQ ID NO: 32862 - DNA, 1716 bp, Gibberella zeae PH-1
  CDS (1)..(1716)
atgggtagtacaggtcaaactctacgagcttggtggaaagagagctcggtatatcaaatataccctgcgtcttaccaagactccacaggctctggtgttggtgacctcaaaggtatcatctctcgagttgactacctcaaagacttgggcgttgatatcatatggctttctcccatcttcaagagtccccaggttgatatggggtacgatatcagcgactactacaccgttgatcctccgtatggcaacgtctctgatgttgatgttctcaaagacaaactacatgagcgaggaatgaaacttgttctcgatttggtgatgaaccacaccagcgaccaacacgagtggttcaaggagtctcgcaagtccaaggacaacccctaccgagactggtatatctggaagcctgcaaagtacgatgcagacggaaacagacacccccccaacaactgggatgctcacttccagggaagtgcctgggagtacgacgagatcacagatgagtactacctctgcctcttctgcaagcagcagccagatctcaactgggagaacccagcggtcagaaaacaggtccaccaggtaatgcgcttctggcttgaccgaggcgtcgatggtttccgcatggacgtcatcaactttgtcagcaaggaccaagcattccccgactcagacaagactgtcctccgtgggacagagtactatgcatgtggtcctaggtgtcatgagttcctcaaggaaatcggtagcattctccaggagtacgatgcctttagtgttggtgaaatgccttgtgttcatgatgagagggagttgatcaaggctgtgcacggtgaccgaggagagctgagcatgatcttccattttgagctgatggatcttgatcacggcgtcgaaggcaagttcacgcccagatcctggaaactatcagagctgaaggctacaaccctcaagtggcagaggttcatgtacgacaacgaaggctggaacgcgctgtacctggagaaccacgatcagccacgagctgtcagccgcttcgtccacgatgatcctgagcatcgcgttgccagcgcgaaactgatcgcactcttcctcggcttccagtcaggcacacccttcatctaccaaggccaggagattggtatgaccaatgttccgaaggactgggacttggaagagtacaaggaccttgactgtcttaaacattgggatcttcacaagaatgatgatgttgcagcccagaattcctacaaggtcgagtatcaaaggaagtctcgtgacaacgctcgtacccctatgcaatgggatgcaagcccaaacgcaggcttcaccactgctgatgccaacccgtggatgcgcgtcaacgacaactataccgacatcaacgctgcttcacagacatcagattccaactctgtgtacagctgttatcgtcaagtacttgggaagcgcaaggagtacaaggatatctttgtctatggtaacttccaactcgtggacgagtccaacgacaagatctttgcgtactcacgacgggctgatagcggggagacggctctcgtcgtgtgcaacttctcagtggattccgttgcatggaagttacctggcgaggctcgagaggtgctgactagtccagcgggaaggacactcaatgacttgaacagtggtgagatcaagctagcaccctgtgaggctttcgctgtcctcctgaaatga

SEQ ID NO: 32863 - protein, 571 aa, Gibberella zeae PH-1
MGSTGQTLRAWWKESSVYQIYPASYQDSTGSGVGDLKGIISRVDYLKDLGVDIIWLSPIFKSPQVDMGYDISDYYTVDPPYGNVSDVDVLKDKLHERGMKLVLDLVMNHTSDQHEWFKESRKSKDNPYRDWYIWKPAKYDADGNRHPPNNWDAHFQGSAWEYDEITDEYYLCLFCKQQPDLNWENPAVRKQVHQVMRFWLDRGVDGFRMDVINFVSKDQAFPDSDKTVLRGTEYYACGPRCHEFLKEIGSILQEYDAFSVGEMPCVHDERELIKAVHGDRGELSMIFHFELMDLDHGVEGKFTPRSWKLSELKATTLKWQRFMYDNEGWNALYLENHDQPRAVSRFVHDDPEHRVASAKLIALFLGFQSGTPFIYQGQEIGMTNVPKDWDLEEYKDLDCLKHWDLHKNDDVAAQNSYKVEYQRKSRDNARTPMQWDASPNAGFTTADANPWMRVNDNYTDINAASQTSDSNSVYSCYRQVLGKRKEYKDIFVYGNFQLVDESNDKIFAYSRRADSGETALVVCNFSVDSVAWKLPGEAREVLTSPAGRTLNDLNSGEIKLAPCEAFAVLLK

SEQ ID NO: 32864 - DNA, 1728 bp, Gibberella zeae PH-1
  CDS (1)..(1728)
atgtctcccgcaatacagaatatcaacagtcccatcactgcagcctggtggaaggaggcgtcggtttaccagatttacccttcgtcctttaaagacactaacggagatggcatcggtgatatcccgggcataatcgagaaactcgactacttcaagcaacttggtgttgacattatttggttatgtcccatctatccatcgccccaaattgatatgggatacgacgtcgccgattaccgcgacattgatcctcagtatggaactatggctgatgttgaacgattgatcgagggcctacactcgagagggttgaagctgctgatggatcttgttgtcaaccatacctctgatcagcacaagtggtttcaagagtccaagtcgtcacgagataatccttacaggaactggtacatctggaggaagcctcgatatgacgaagacggccagcgacatccaccaaacaactggctctcttactttcgaggcagtgcgtgggaatacgacccagcttctgatgagtactatcttcacctgttcgccaaggaacaacccgatctcaactgggaacatgctcctgtacgtgaagccgtacacgaaatcattcgtttctggttagataagggcgtcgacggctttcgcaaatcggagggactacctgatgccccgatcacggttctaggatccgagtatcaatttggtcacgaccattacgcctgcggccctcggcttcatgagtatcttcgcgacattggctctatcctcaaagagtatgatgccttctccgtcggtgagatgcctgcagttcaagaccccgaagaaatcatcaagagcgttggagaaagccgaggcgagctgaatatgatcttcaactttgagatcgttgacatggatcatggtgaccaagggaagttctccgcaaagaaatgggaaatgaaagagctcaagatgattgtcaataaatggcagacgtttatgtataacaacaagggctggaacgctctttaccttgaaaatcacgaccaatcgcgctccatcagtcgatgggtatccgacaagcctgtataccgtgagatgtcggctaagatgttatcgacatttctctgcttccaaagcggaactgtttttgtgtaccaaggcgaggaattgggcatggccaacatgcctccagattgggaaatgactgagcatcgtgatgtagaaacgttgaaccattgggaagagctgaagcggacaacgggttccgatgcaaaggttctagagcttgctcgaaaggagtaccagctcaaggcgcgagatcacgcgagaacaccagtacaatgggattcttcgcccaatgccgggttcacaacgggcaagccctggatcagagtcaatgacgactaccaacagtggaacgcagcaacccaaaccaacacaaagggtagtgtgtttgactattggcgatctgcgctttccctgcggaaagagcttaaggatattgttgtctatggcgactttgagttgcttgacgcggagaatagcgatatctttgcgtatgctcgatctgacggaaagcaaaagcttattgttgtttgcagttttcgagatcgagagattgcctggccggtacctgcttcgaccggtctacagtcgagcaaggttttgctgtccaactacccggagattgatttgtcccaggatgtgatctccatacgccccttcgaggcttttgtatgcctggttggttaa

SEQ ID NO: 32865 - protein, 575 aa, Gibberella zeae PH-1
MSPAIQNINSPITAAWWKEASVYQIYPSSFKDTNGDGIGDIPGIIEKLDYFKQLGVDIIWLCPIYPSPQIDMGYDVADYRDIDPQYGTMADVERLIEGLHSRGLKLLMDLVVNHTSDQHKWFQESKSSRDNPYRNWYIWRKPRYDEDGQRHPPNNWLSYFRGSAWEYDPASDEYYLHLFAKEQPDLNWEHAPVREAVHEIIRFWLDKGVDGFRKSEGLPDAPITVLGSEYQFGHDHYACGPRLHEYLRDIGSILKEYDAFSVGEMPAVQDPEEIIKSVGESRGELNMIFNFEIVDMDHGDQGKFSAKKWEMKELKMIVNKWQTFMYNNKGWNALYLENHDQSRSISRWVSDKPVYREMSAKMLSTFLCFQSGTVFVYQGEELGMANMPPDWEMTEHRDVETLNHWEELKRTTGSDAKVLELARKEYQLKARDHARTPVQWDSSPNAGFTTGKPWIRVNDDYQQWNAATQTNTKGSVFDYWRSALSLRKELKDIVVYGDFELLDAENSDIFAYARSDGKQKLIVVCSFRDREIAWPVPASTGLQSSKVLLSNYPEIDLSQDVISIRPFEAFVCLVG

SEQ ID NO: 32866 - DNA, 1743 bp, Apis mellifera
  CDS (1)..(1743)
atgtttcgagcgacgatagttacggtcgcttgcctcttgctcgccgcgtctccgatcgattgcgtggacgccaattggtacaaaaatgctctcgtgtaccaaatctatccgaggagtttccaagacagcgacggggacggtataggcgatttgaacgggatcacggcccggatggatcacatagccgacataggggcggacgctctctggttgtcgcccatctacaagagtccccaggtcgatttcggctacgacatctccaacttcacggacgtggacccggtttacggcactctggcagatttcgacaggctcgtgagaagggcgaaatctctcggtttgaaggtgatactcgacttcgtgcccaatcacagttcccacgagcatccgtggttcaagaagagcgtccaaaggatcaaaccgtacgacgagtactacgtgtggcgggacgcgaggatcgtgaacgggaccaggcaaccgcccaacaattggctcagcgtcttctggggttcggcgtggcaatggaacgaggaacgaaagcagtactatcttcaccagttcgcgaccggccaaccggatctgaattacaggagcgccgcgttggatcaggagatgaagaacgtgttgacgttctggatgaacaggggggtggacggtttccggatcgacgccatcaaccacatgttcgaggacgcgaggctgttggacgagccgagcgccaacaggaccgacctgtccaaggacgattacgaaagcttggtccacttgtacacgagggatcaaagcgagacgtacgacgtgttgagaagttggagaaacctcatggacgagcactcgaatcgcaccaactccgaccccaggatgatcctcaccgaagcgtatacagagttcaatttgacgatcaagtattacaagtccggatccacggtcccgttcaactttatgttcatcgcggatctcaacaaccagtcgaccgcctcggacttcaaacagctgatcgacagatgggtggcgaacgtgccgaatgggagcgttaccaattgggtctcgggcaatcacgacaatcaccgcgtcgcctcgagattcggcaggcaaaggggcgacgagatcgtgatgctgacgttgactttgcccggcataggggttgtttacaatggggacgagatcgggatggaggacaggtggttcacgtaccaggagaccgtagacccggccggttgcaacgccggcccagccagatattacttgaaatccagggatccagagaggactccgtatcaatgggacaacagcacgagcgccggattctcccaaacgaacaaaacttggctacccgtcaacgaaaattacaagtctttgaatcttgccgctcaaaagagggaatattattcccattacgtggcgttcaagtccttgtcgtatctgaagaagcagccggtgatcgcgaacgggagcttggaggtggacgtgatcgatggaagggttctgagcgtgaaacgggaattgggtaacgacacggtgatagttatgatgaatttctccaaaaatcccgtcactgtcaacctcaccaagctgcatccacctgccgatctcgtcgtttacgcttgcaacgttgtcggctccggtctcagccacggcaactggatctatccggcctcgatgactatccccggatctaactcagccgtattcaccaattacaaattgtattggcgatattggcaaggtgtagactggttgtaa

SEQ ID NO: 32867 - protein, 580 aa, Apis mellifera
MFRATIVTVACLLLAASPIDCVDANWYKNALVYQIYPRSFQDSDGDGIGDLNGITARMDHIADIGADALWLSPIYKSPQVDFGYDISNFTDVDPVYGTLADFDRLVRRAKSLGLKVILDFVPNHSSHEHPWFKKSVQRIKPYDEYYVWRDARIVNGTRQPPNNWLSVFWGSAWQWNEERKQYYLHQFATGQPDLNYRSAALDQEMKNVLTFWMNRGVDGFRIDAINHMFEDARLLDEPSANRTDLSKDDYESLVHLYTRDQSETYDVLRSWRNLMDEHSNRTNSDPRMILTEAYTEFNLTIKYYKSGSTVPFNFMFIADLNNQSTASDFKQLIDRWVANVPNGSVTNWVSGNHDNHRVASRFGRQRGDEIVMLTLTLPGIGVVYNGDEIGMEDRWFTYQETVDPAGCNAGPARYYLKSRDPERTPYQWDNSTSAGFSQTNKTWLPVNENYKSLNLAAQKREYYSHYVAFKSLSYLKKQPVIANGSLEVDVIDGRVLSVKRELGNDTVIVMMNFSKNPVTVNLTKLHPPADLVVYACNVVGSGLSHGNWIYPASMTIPGSNSAVFTNYKLYWRYWQGVDWL

SEQ ID NO: 32868 - DNA, 1770 bp, Ustilago maydis 521
  CDS (1)..(1770)
atggccactctacctgcgatggacaagcgcaccttttggtttcgcgatgccatcgtctaccaaatctggcctgcttcttacaaggacagcaacaatgatggtatcggcgatattcagggtatcatctcgacgctcgactacgtcgaatcgctaggagtcaacacgatctggctctcaccgatgtacgagtctccccaagtcgacatgggctacgatatctcagactaccagaacgtttacgctccctatggtacgctgcaggacatggacgagctgatccgtgaatgccatgcgcgcgagatcaagctcatcctagacctcgtcatcaatcacacctctgatcagcatgcatggtttcaggagtccaagaagagcaaggtcagtcctaagagggactggtatatctggcgacctgccaagtacgatgccaggacgggcgagcgaaggcctccgaacaattggagaggtgccctcaatcaatctgcttggacgtgggatgaagcaacgcaggaatattacctgcaccttttcacaccgcaacagcccgatctcaattggagtaacgtggaatgtcgacgcacgctgtacagcgacacaatcgagttctggcttaaaagaggcatcaatggtttcagagtcgacacggtgaacctgtacagcaagccgatggattttcccgacgcacccatcacagatcctaatgctgagtggcagatgggtgacacagtcttctgcaacggtcccaggatgcacgaatatctgcaagaaatgggtgtcatcttcgctaaatacgatgccatgacggtgggcgagctaccgagcacgccaaagatcgaggacgtgcttcggtacatctcggcagaacgcaacgaactgagccaagttttccagttcgatatctctaccctgggaagagacgagaacgatttttatgcgacgcatccgttctcgctccaggagctcaaggaggtggtggaaaagtggcaacgatacgttgagggtacagacgcatggccaaccgtgttcttggagaaccacgatctgcccagagccatcagcaaatacgcttcagaccgaccagagtttatcgcggcgagtggaaagatgctcgcactgatggagatcggtctcaccggaacgctttacatctaccaaggacaagagatcggaatgacaaacgtgccaaaggcttgggctcacgaagagtacaaggatgtaattgccgtcaactattaccgagatgcagtgacacgctcgggaggagatgagaaggtgctgaaaaagacactcgaagatatcaataagcaaggcagggacagcgcacgcacaccagtccagtggagctcagagccaaatggcggattcagcactgatccgaacactgtaccttggatgagaaccaacgacaactacacgagcatcaacgtagctgctcaggagaaagacgaccagtcggtgctagcattttatcgcaaaggactagcactcaggaaggaatatgcctgcttgcttgcgagaggagagtttaggctgttggacagggagaaccagcaggtgttgaaatacctcaagattccagaaggtggtcaagaagacgataacggccaaagggtctttgttgtgctcaatttctccaactgcccgcaggaatatacggtgccagaagaggctgggggaaacaaggcatcgatgcttgttgagactctcgagaagggtgagccaggcaagttgaggccgtgggagggaagaatgtacctctaccgaccctga

SEQ ID NO: 32869 - protein, 589 aa, Ustilago maydis 521
MATLPAMDKRTFWFRDAIVYQIWPASYKDSNNDGIGDIQGIISTLDYVESLGVNTIWLSPMYESPQVDMGYDISDYQNVYAPYGTLQDMDELIRECHAREIKLILDLVINHTSDQHAWFQESKKSKVSPKRDWYIWRPAKYDARTGERRPPNNWRGALNQSAWTWDEATQEYYLHLFTPQQPDLNWSNVECRRTLYSDTIEFWLKRGINGFRVDTVNLYSKPMDFPDAPITDPNAEWQMGDTVFCNGPRMHEYLQEMGVIFAKYDAMTVGELPSTPKIEDVLRYISAERNELSQVFQFDISTLGRDENDFYATHPFSLQELKEVVEKWQRYVEGTDAWPTVFLENHDLPRAISKYASDRPEFIAASGKMLALMEIGLTGTLYIYQGQEIGMTNVPKAWAHEEYKDVIAVNYYRDAVTRSGGDEKVLKKTLEDINKQGRDSARTPVQWSSEPNGGFSTDPNTVPWMRTNDNYTSINVAAQEKDDQSVLAFYRKGLALRKEYACLLARGEFRLLDRENQQVLKYLKIPEGGQEDDNGQRVFVVLNFSNCPQEYTVPEEAGGNKASMLVETLEKGEPGKLRPWEGRMYLYRP

SEQ ID NO: 32870 - DNA, 1776 bp, Aspergillus nidulans FGSC A4
  CDS (1)..(1776)
atgagctacgcgcacgtcaaaccccccagcgagatccaccgggcctggtggaaagaaagctctgtgtaccagatctggccggcatcgttcaaggactctaatgatgacggtattggcgacattcctggcatcatctcgaagctcgactacattcgtgaccttggtgtcgatattgtctggctctgtccgtcttacaagtctccccaggtagacatgggatacgacattgcggactactacagtattgcagacgaatatggtacggtcgcagatgtcgaaaagctgatcaagggctgccacgacaggggcatgaagctccttatggacttggtcgtgaaccacaccagtgataagcatgaatggttcaagaaatcacgcagctcaaaggataacgagtttcgcgattggtatgtctggaagccgccccgctacgacgagaatgggaatcgtcaacctccaaacaactgggtatcgcacttccaaggaagcgcctgggaattcgatgaggcgacaggagagtattatcttcatctatacgccgtcgaacaacctgacttaaactgggagaaccccgccgtgagaaaggcagtgcatgatatcgtgcgtttctggctcgacaaaggagctgatggcttccgcatggacgtcatcaactttatcagtaaggatcaggcgttccccgacgcaccggaacaggacaaggatgccgtatggcagtggggtgacaagtactacgcaaacggtcctcggctccatgagtatctgcagggtattgggaagatacttaaggaatacgacacctttagcgtcggggaaatgccttttgtaaaggataccaatgaagtgctgaaagcggttcgctacgaccgcaacgaaatcaacatgatcttcaattttgagcacgtcgacattgaccatggcccctggggcaacaaattcaagcctggcggctggaaactcactgatctcaaggcctttttcgagcgctggcaagttttcatgtacgacaacggcggctggaacgctttgtattgggaaaaccacgaccaaccccgatcgattgaccgctatgtcaacccccctcaggctctccgaccagcggccggaaagatgttggctaccatactagccttgcacgcgggctctccgttcatttaccagggccaggagataggaatgggaaatgttcctattgaatggggaatggaagaatacaaagacatcgactgtctgaaccattggaaagggttgctggaaaccagaccaacggacaccgaggtacagaaaattgccagacaggaataccggaagaaatcccgagacaacgctcgcactccagtgcagtggtcctcagaacccaatgccggattcaccgggccgaacgttaagccttggatgtctgtcaatccagagtacactcgagttaatgcagcggaccaagtcaaggaccccaactctttgtaccattactgggcatcagtcctgcacctcaggaaaacctacctcgatatctttgtctatggaaattacgagcttgtggatcgtgatagtcaggaggtttacgcctacacccgggcatgccacacctccaaggctctggtattggcgaactggactgaccgtggattgacgtggaacgcggcagcacacaaggctgatcagttcgagcaagtgctgctagacacttatgagtccgcaaacgcagcgcagggaaggttttcaggtggtcaatggacgcttcgaccatatgaagcggttgtgatcttgctaaaatag

SEQ ID NO: 32871 - protein, 591 aa, Aspergillus nidulans FGSC A4
MSYAHVKPPSEIHRAWWKESSVYQIWPASFKDSNDDGIGDIPGIISKLDYIRDLGVDIVWLCPSYKSPQVDMGYDIADYYSIADEYGTVADVEKLIKGCHDRGMKLLMDLVVNHTSDKHEWFKKSRSSKDNEFRDWYVWKPPRYDENGNRQPPNNWVSHFQGSAWEFDEATGEYYLHLYAVEQPDLNWENPAVRKAVHDIVRFWLDKGADGFRMDVINFISKDQAFPDAPEQDKDAVWQWGDKYYANGPRLHEYLQGIGKILKEYDTFSVGEMPFVKDTNEVLKAVRYDRNEINMIFNFEHVDIDHGPWGNKFKPGGWKLTDLKAFFERWQVFMYDNGGWNALYWENHDQPRSIDRYVNPPQALRPAAGKMLATILALHAGSPFIYQGQEIGMGNVPIEWGMEEYKDIDCLNHWKGLLETRPTDTEVQKIARQEYRKKSRDNARTPVQWSSEPNAGFTGPNVKPWMSVNPEYTRVNAADQVKDPNSLYHYWASVLHLRKTYLDIFVYGNYELVDRDSQEVYAYTRACHTSKALVLANWTDRGLTWNAAAHKADQFEQVLLDTYESANAAQGRFSGGQWTLRPYEAVVILLK

SEQ ID NO: 32872 - DNA, 1773 bp, Kluyveromyces lactis NRRL Y-1140
  CDS (1)..(1773)
atgacgattaccaagtttgtatccgagcacccccaaacagacccaaagtggtggaaagaagcaattgtttaccaggtttaccctgctagtttcaaagactctaaccatgatggatggggtgatatcaaaggtattgattcgaagctggagtacattaaagaacttggagctaacgcgatttggatctgcccattctatgattctccacaagaggatatgggttatgatatttcagattacgaaaaggtttggccacgctacggtacgaatgaagatatcttcaatttgatcgacagagcacacggtttgggaatcaaaatcattgtggatcttgttatcaatcactgctcttctgaacacgcttggttcaaagaagctcggtcgagcttggataaccccaaacgtgattggtttatctggaaagcaccaaagggattcgactccaatggcaaaccaattcctcccaataactggagatctttctttggtggttctgcctgggagtacgatgaacataccggccaattctacctgcgtttatttgcgaaaggtcaaccagatttcaattgggagaatgaagtgactcgtaatgccatttacgaaagtgctgtaggattctggttagaccatggtgtcgatggtttcagaatcgatacagctggtctatactccaagcaaccagggttccctgatgtgccaataatcaaccctggtttggacttccagcatcctgacccagctattttgaatggtccaaggattcatgaattccacaaggagatgaacaaatttatgagagagcgtgttaaagatggcagagagttgttaacggtgggtgagattccttgtgggactcatgacgtgtgcaaggcgtacaccagtgcaaaagagcaagaaattactcaactattcgaatttgagcacgtgtctgtgggtaggaagccgggaaatgttggtgtagttaactttaaactgtcagaattcaaggatggtattgcggcagcattccagttcattgataagacagactcttggtccactgtctacattgaaaaccatgaccagccacgttctgtgacaagattcggggatgacagcccagagtaccgagaaatatcagcaaaattgctggctctgttggaaacaagtttgacaggcactctgtacgtataccaaggccaggaattaggtatgattaacttcagagactggccaattgagaaatatgaagatgtcgaagtgaaaggtatgtacaagatgatggttgatcaattcggtgcggactctgatcaagtcaaagattacgttaatggtttgcagttgatttctagagaccatgcgaggactccattcccatggacatccgaggctccatatgctggattcacagacggcaaggaaccatggttccctttaactgagactttccaagaaggtatcaacgccgaagatgagctgaaagacccaaagtctgttttcaatttttggaagacggctattgaagtcagaaagacacacaaggatgtattgaattatggatatgacttcacctttgttgaccatgctaacgagaaactctttgctttcactaagaagtacggagagaaggtattgtatgtggtgttgaacttcagcaaagaagagattgagttcagcttcttggaaggttacaactcttatgactacattttcggtaattatccagaggccgaaatcgacactggatctaacaagttacagccatgggaaggtagattttactatgccaattga

SEQ ID NO: 32873 - protein, 590 aa, Kluyveromyces lactis NRRL Y-1140
MTITKFVSEHPQTDPKWWKEAIVYQVYPASFKDSNHDGWGDIKGIDSKLEYIKELGANAIWICPFYDSPQEDMGYDISDYEKVWPRYGTNEDIFNLIDRAHGLGIKIIVDLVINHCSSEHAWFKEARSSLDNPKRDWFIWKAPKGFDSNGKPIPPNNWRSFFGGSAWEYDEHTGQFYLRLFAKGQPDFNWENEVTRNAIYESAVGFWLDHGVDGFRIDTAGLYSKQPGFPDVPIINPGLDFQHPDPAILNGPRIHEFHKEMNKFMRERVKDGRELLTVGEIPCGTHDVCKAYTSAKEQEITQLFEFEHVSVGRKPGNVGVVNFKLSEFKDGIAAAFQFIDKTDSWSTVYIENHDQPRSVTRFGDDSPEYREISAKLLALLETSLTGTLYVYQGQELGMINFRDWPIEKYEDVEVKGMYKMMVDQFGADSDQVKDYVNGLQLISRDHARTPFPWTSEAPYAGFTDGKEPWFPLTETFQEGINAEDELKDPKSVFNFWKTAIEVRKTHKDVLNYGYDFTFVDHANEKLFAFTKKYGEKVLYVVLNFSKEEIEFSFLEGYNSYDYIFGNYPEAEIDTGSNKLQPWEGRFYYAN

SEQ ID NO: 32874 - DNA, 1707 bp, Debaryomyces hansenii CBS767
  CDS (1)..(1707)
atgactaaagattacatttggtggaaagacgctagtgtttatcaaatctggcctgcttcgtataaagattcgaatggagatggtgtaggtgatattccaggtattatttccacattgaactatgttaaatcattaggaacggacgttatttggctttccccaatgtatgactctccacaggatgacatgggttacgatatttccaactatgaaaaggtctatccaaaatacggaacattagaagatatggataacttaattgagggaacccacaaaagaggtatgaagttgattttagatttagttattaaccatacttcaaccgaacatgactggtttaagcaatcgagatcgtctaaaaccgacccaaaaagagattggtatatctggaagccagcacgctatgatgctgaaggtaatagacatcctccaaataactgggtatctcacttttcgggatctgcttgggcttacgatgaaaccactgatgaatattacttacatctttttgctgaatcgcaaccagacttgaattgggagaatgaagaaacaagaaaggcgatctataagtctgctttgtcattctggtttgaaaaaggaatcgatggtttcagaattgatacagccggtatgtattcaaaagttcaatcattctctgatgccccaatcgttttcccagattcggaatggcaaccatgtcaaaagtatttccaaaatggacctagaattcacgaatttcacaaggagatgtttgcatctgtcacttctaaatacgatgctatgactgtcggagaagttggtcattcacctcgtgaagattctttgaaatatgtaagcgccaaagaaaaagagatgaatatgatgttcttattcgacgctgtggaagttggatcaaacccttctgatagatttatttatgatggatacaaattaactgatttcaaaaaggcagtacaaaatcaaagttcttttatcgaaggtactgatgcctggtctaccgtcttctatgaaaaccatgatcaaccaagatctattaccagatttggtaacgactctaataaatatagggttaaatcaggtaagcttttagctttattacagtctactttgagtggtactttatatatttatcaaggtcaagaaattggtatgactaatttaccaagatcgtggtctattgatgaatatcttgatattaatactatcaattattacaaggaattcaaagctaaatatggagacaacaaagaaaaaatggataaattgatggataacattaatttattggccagagatcatgccagatctcctgttcaatgggatgacactgaaaatgcaggtttctctacaggtaaaccatggatgagagttaacgataactataaggaaattaatgttgcatcgcaagtgaatgatccaaattccttattttccttctggaaacaaagtttaaagattagaaaggaatataaggatttgttgatctacggttctttcaaaattcttgataacgaaaaccagaaaatctttacttatgttaaggaagctgctggccagaaggcatatattgttttaaattttacttcagaaagtttaaagtttgaaaacttggacggaggtaaattagaattattgcactctaacgtcaatgtcgaagatgaaggtaccttgagtccttacgaaggtagattttatctcattaagtag

SEQ ID NO: 32875 - protein, 568 aa, Debaryomyces hansenii CBS767
MTKDYIWWKDASVYQIWPASYKDSNGDGVGDIPGIISTLNYVKSLGTDVIWLSPMYDSPQDDMGYDISNYEKVYPKYGTLEDMDNLIEGTHKRGMKLILDLVINHTSTEHDWFKQSRSSKTDPKRDWYIWKPARYDAEGNRHPPNNWVSHFSGSAWAYDETTDEYYLHLFAESQPDLNWENEETRKAIYKSALSFWFEKGIDGFRIDTAGMYSKVQSFSDAPIVFPDSEWQPCQKYFQNGPRIHEFHKEMFASVTSKYDAMTVGEVGHSPREDSLKYVSAKEKEMNMMFLFDAVEVGSNPSDRFIYDGYKLTDFKKAVQNQSSFIEGTDAWSTVFYENHDQPRSITRFGNDSNKYRVKSGKLLALLQSTLSGTLYIYQGQEIGMTNLPRSWSIDEYLDINTINYYKEFKAKYGDNKEKMDKLMDNINLLARDHARSPVQWDDTENAGFSTGKPWMRVNDNYKEINVASQVNDPNSLFSFWKQSLKIRKEYKDLLIYGSFKILDNENQKIFTYVKEAAGQKAYIVLNFTSESLKFENLDGGKLELLHSNVNVEDEGTLSPYEGRFYLIK

SEQ ID NO: 32876 - DNA, 1737 bp, Debaryomyces hansenii CBS767
  CDS (1)..(1737)
atgacagttattgaattgaataaagctttaaagccatcatggtggaaggaaaccaccgtctaccaagtctatccttcttccttccaagactctaatggtgatggaatcggtgatcttccaggtattacttcacgcttggactatatcaagtctctcggtgtggatgcaatttggttaagtccttgttttgactctccccaggttgatatgggctatgatatttcggattacaagaagatctatcctgcttatggtacaatggaagatgcagatgaacttatcaaaggcgtgcatgaacgtggattaaaaatcttgatggatcttgttgttaatcacacatcagatcagcatccatggttcaaaaaatcacgctctagtattgaaaactcataccgcgactggtatatctggcgtaaaccgagatatgattcagaaggtaacagacaacctccaaataattgggctgctgctttcggaggaagcgcatggaccttcgatgaaacaactcaagaatactatttgcatctttttgcagttgagcagccagacttgaattgggagaacgaaaatgtccgtgcagcagttcatgacattatgagattttggttggataaaggcgctgatggattccgtatggatgttatcaattttatttcaaaagaccaaagattcccggatgctgaggttaagcatccaaatgctaaatatcaggatggttctccctattttgcttgtggaccgagactacatgaatacttacaaggaattgggcaaatccttatcgaatacgacgctttcagtgttggcgaaatgcctgcttgtaatgaccctgaagaaattattaaggcagttaatatcgaccgtcacgaattgaatatgatcttcaactttgaattggtagatattgaccatgggaatgaaggcaagtttacagctggaagctggaagctcgctgatgcttataaaattatcaacaagtggcaaacatttatgcaagagaatggtggttggaatgctatttatttggaaaaccatgatcaaccacgttccgtttctcgttttgctgaagatagcccagaattcagaaagattagtgccaaaatggtcagtactttcttagcacttcaacaaggcacattatttgtttatcagggacaggaactagggctcaagaatgtcccagaaacatgggatatttccaactacagagatcttgaagtccttaaccattataatgaactaaaagaagatggcgcatctccagaaattcttaaggcagccatggctgaataccagaagaaatcaagagataatgcacgttatccagttcaatgggatacttcagctaatgccggctttagctcgtcaaccccatggatagatgtcaatgaggactacttggaatggaatgcagcagaagaagaaaaagatccggaatctgttttaaactattggagaagcattttaaaaattagaaaggaatggaaagatatcttgatatatggaaggtttgaaatggttacaagtattgaagacgaaaaggtcttggcatttaaacgtactactagcgataagagtgctattgtaatttgcaacttttctagcgatgctgttctgtggaccattcctgaggaatttgaaaatagcaaagttatattatctaactacgacagatcaaaggtttctggaccaagtgttgaattgaaaccctatgaagctttcactttacttaaataa

SEQ ID NO: 32877 - protein, 578 aa, Debaryomyces hansenii CBS767
MTVIELNKALKPSWWKETTVYQVYPSSFQDSNGDGIGDLPGITSRLDYIKSLGVDAIWLSPCFDSPQVDMGYDISDYKKIYPAYGTMEDADELIKGVHERGLKILMDLVVNHTSDQHPWFKKSRSSIENSYRDWYIWRKPRYDSEGNRQPPNNWAAAFGGSAWTFDETTQEYYLHLFAVEQPDLNWENENVRAAVHDIMRFWLDKGADGFRMDVINFISKDQRFPDAEVKHPNAKYQDGSPYFACGPRLHEYLQGIGQILIEYDAFSVGEMPACNDPEEIIKAVNIDRHELNMIFNFELVDIDHGNEGKFTAGSWKLADAYKIINKWQTFMQENGGWNAIYLENHDQPRSVSRFAEDSPEFRKISAKMVSTFLALQQGTLFVYQGQELGLKNVPETWDISNYRDLEVLNHYNELKEDGASPEILKAAMAEYQKKSRDNARYPVQWDTSANAGFSSSTPWIDVNEDYLEWNAAEEEKDPESVLNYWRSILKIRKEWKDILIYGRFEMVTSIEDEKVLAFKRTTSDKSAIVICNFSSDAVLWTIPEEFENSKVILSNYDRSKVSGPSVELKPYEAFTLLK

SEQ ID NO: 32878 - DNA, 1587 bp, Thermus thermophilus HB27
  CDS (1)..(1587)
atgtggtggaaagaggcggtcatctaccaggtttatccccggagcttccaggacacgaacggggacggagtgggggacctcgagggggtgcgcaggcggcttccctacctcaagtccttgggggtggacgccctctggctttcccccttctacaaaagccccatgaaggacttcggttacgacgtggctgactactgcgacgtggaccccgtcttcgggacccttcaggactttgaccgcctcctagaggaggcccacgccctggggcttaaggtcctcgtggacctggtgccgaaccacacctccagcgagcacccctggttcctggagtcccgcgcctcccggaacagccccaagcgggactggtacatctggaaagaccccgccccggacggcggcccccccaacaactggcagagcttcttcggcggccccgcctggaccctggacgaggcgacgggccagtactacctccaccagttcctccccgagcagcccgacctcaactggcgaaaccccgaggtgcgggaggccatttacgaggtgatgcgcttctggctcagacgcggggtggacggcttccgggtggacgtcctctggcttctcgccgaggacctcctctttcgggatgagcccggaaaccccgactggcgcccgggcatgtgggaccggggccgccacctccacatcttcaccgaggaccagccggagacctacgcctacgtgcgggagatgcgccaggtcctggacgagttctccgagcccgggcgggagcgggtgatggtgggggagatctaccttccctacccccagctcgtgcgctactaccaggccgggtgccacctgcccttcaacttccacctcatcttccgggggcttcccgactggcggcccgagaacctggcccgcatcgtggaggagtacgagagcctcctcacccgctgggactggcccaactgggtcctcggcaaccacgaccagccccgccttgcctcccgcctgggggaggcccaggcccgggtcgcggccatgctccttttcaccttaaggggcacccccacctggtactacggggacgagatcgggatgaagaacggggagatccccccggagaaggtgcaagaccccgccgccctccgccagaaggaccgcctgggggagcacaacctgcccccgggccgggaccccgagcggacccccatgcagtgggacgacacccccttcgcgggcttttccaccgtggaaccctggcttcccgtgaaccccgactacaagacccggaacgtggccgcccaggagcaagacccccgctccatgctccacctggtgcgccgcctcatcgccttgaggaaggaccccgacctcctctacggggcctaccgcacctaccgggcgagggagggggtctacgcctacctccggggggaggggtggcttgtggccttgaacctcacggaaaaggagaaggccctggagcttccccgcggggggagggtggtcctttccacccacctggaccgggaggaaagggtgggggagaggctcttcttgcggcccgacgagggcgtggcggtgcggctagactag

SEQ ID NO: 32879 - protein, 528 aa, Thermus thermophilus HB27
MWWKEAVIYQVYPRSFQDTNGDGVGDLEGVRRRLPYLKSLGVDALWLSPFYKSPMKDFGYDVADYCDVDPVFGTLQDFDRLLEEAHALGLKVLVDLVPNHTSSEHPWFLESRASRNSPKRDWYIWKDPAPDGGPPNNWQSFFGGPAWTLDEATGQYYLHQFLPEQPDLNWRNPEVREAIYEVMRFWLRRGVDGFRVDVLWLLAEDLLFRDEPGNPDWRPGMWDRGRHLHIFTEDQPETYAYVREMRQVLDEFSEPGRERVMVGEIYLPYPQLVRYYQAGCHLPFNFHLIFRGLPDWRPENLARIVEEYESLLTRWDWPNWVLGNHDQPRLASRLGEAQARVAAMLLFTLRGTPTWYYGDEIGMKNGEIPPEKVQDPAALRQKDRLGEHNLPPGRDPERTPMQWDDTPFAGFSTVEPWLPVNPDYKTRNVAAQEQDPRSMLHLVRRLIALRKDPDLLYGAYRTYRAREGVYAYLRGEGWLVALNLTEKEKALELPRGGRVVLSTHLDREERVGERLFLRPDEGVAVRLD

SEQ ID NO: 32880 - DNA, 1698 bp, Listeria monocytogenes str. 4b F2365
  CDS (1)..(1698)
gtggaaataacagaaacgaaagaatggtggaaagaatcggtagtgtaccaaatctatccgcgtagttttcaagattcaaatggggatggcattggagatattagaggaattatagaacgacttccttatttgaaagatttaggtattaatgtgatttggctttgtcctgtctataaatcacctatggatgatggtggttatgacatttctgattactatgagattgatccaatgtttggaacgatgagtgatatggatgaattaattgagaaggcagaaaaattaggaataaaaatattgatggatttggtggtaaaccatacatctgatgaacatgaatggtttgaaaaagcaatagctgacccaaaaagtaaatatcgagattattatattttccgagagggtgtaaatggaaacccgcctaataattggcgttcttattttggaggatctgcgtgggaagccgtaccaggtgaggaaaacatgttttacctacatgctttttctaaaaaacagccagatttaaactgggaaaacattgtagtgcgtaatgaatgtatccaaatgattaactggtggcttgaaaaaggtttaggtggctttagaattgatgccattttaaatttgaagaaaagaattgagtacggtactttcccagcggacggggaagatggcttggttttcatcggtcattggattttaaatcagccgggaattgaagagtggctcaaggagattgacgaacggacatttaaaaaacataatgcatttactgtggctgaggcggatgtgcctgaagaaagactttctgaatttataggtgaaaatggtcatttccgtatggtgtttgattttagctatacagatattgatactcctgaaacaggcgaatggttcaagaattcagaatggacagtaaaagaattaaaagagaaaataattaccaatgaactggtgacacagcgaaatggttggggggcaaaatacttagaaaatcatgatcaaccgcgttcgataaataagtatttacctcaagaataccaagatgatcgtagcaaaaaaatgctaggcacgttatttatgatgttgcacggtacgccgttcatttatcaaggacaagagattggcatgagtaatactcggatggaaagtatagatgattataacgatatcgcgacgcacgatcaataccatcgcgcaattctctctggaatgagtccggaagaagcgcttgaaggaatgtatcggcgtagtagggataattcaagaacaccgatgcaatggaataatcaaaagaacgctggtttttccgactcagatgaaatttggttgaaagcaaaccctaattaccttgatattaacgtagagcaggaacaaatcgatgataattccgtattgaatttttataagaaattaatccatttaagaagtgattctagtaaatataaagaagtggctgtttatggagaattactgccagtagaatcaagtgatgaagttattgcttacaaacgtaaaacagatgacgctgagctcttaatcatcgtgaatttttctgattctgaaaatcaattatgcattgaaggtacttatgaacaggtacttgctaatgtagcgttgccagaaatggtagaaaatgtccttgaaatacctgcatatacaggtgccgtcttctcaagggttttggaggtagactga

SEQ ID NO: 32881 - protein, 565 aa, Listeria monocytogenes str. 4b F2365
MEITETKEWWKESVVYQIYPRSFQDSNGDGIGDIRGIIERLPYLKDLGINVIWLCPVYKSPMDDGGYDISDYYEIDPMFGTMSDMDELIEKAEKLGIKILMDLVVNHTSDEHEWFEKAIADPKSKYRDYYIFREGVNGNPPNNWRSYFGGSAWEAVPGEENMFYLHAFSKKQPDLNWENIVVRNECIQMINWWLEKGLGGFRIDAILNLKKRIEYGTFPADGEDGLVFIGHWILNQPGIEEWLKEIDERTFKKHNAFTVAEADVPEERLSEFIGENGHFRMVFDFSYTDIDTPETGEWFKNSEWTVKELKEKIITNELVTQRNGWGAKYLENHDQPRSINKYLPQEYQDDRSKKMLGTLFMMLHGTPFIYQGQEIGMSNTRMESIDDYNDIATHDQYHRAILSGMSPEEALEGMYRRSRDNSRTPMQWNNQKNAGFSDSDEIWLKANPNYLDINVEQEQIDDNSVLNFYKKLIHLRSDSSKYKEVAVYGELLPVESSDEVIAYKRKTDDAELLIIVNFSDSENQLCIEGTYEQVLANVALPEMVENVLEIPAYTGAVFSRVLEVD

SEQ ID NO: 32882 - DNA, 1596 bp, Mycoplasma mobile 163K
  CDS (1)..(1596)
gtgaaaaatgtaaattcaaaaaaaattgtatatcaaatttatccttcttcttttaaggattcaaaaggaaccggaaggggagatatcaaaggaataatagaaaaattggactatatcaaagatctaggagtagattatctttgattaagtccaatttttaaatctcctcttaaagataatggttatgatgtaagtgattatttatctataaatactcttttcggtgatctagaagatcttaaatctttgatcaaaaaagctaaagaaaaaaatttaaaagttatgttagatatggtttttaatcatacttcaacagaacacgaatgatttaaaaagtgaattaataacgacccagaatataaagatttttatatttcaaaaaaaagtgttgggaaacctccgacaaattgagtttcaaaatttggaggaagtgcttgaaaagaatataagaaaaataattgataccttcatctttttgatgaaactcaagctgatttaaattgggaaaatgaaaaagttaaagaaaaaataaaagaagttattagattttatattaatttaggtgtaaaaggctttagatttgatgttattaacttgatttcaaaatctaattttaatgaagatgaaactgatggaagaaaattttatacagatggaaaaaaagttgaagattacttacaagaattaagaaatgaatttccaaaagaaggagattttcttactgttggagagctatcatcaacaacaatgcaaaaagcaagtatttattccaatttagacaaaaagagattagatagtgcatttacatttcatcatttaaaaattgattatgatgaaaaaggtaaatttatttacaaaaaacctgatatcaaaaaacttaatgaaatttttgatacttcttttactgaaacacaaaaattaaatggatatttagcagtatttttgaataaccatgatcaaccaagagctgtttctagatttatagatgaagaatttcacaatgttggtgcaaagatgttaggaatgttaactctttctttgccaggtgatacatacatctatcaaggtgaagaaattggaatgaaaaatcctaattttgaaaataaagaagattataaagatgttgaaacattgaattattttaaagaattaaaattggaaaaagcaaatgatggaataaagcaaaaatcaagagataattccagaactcctatgcaatgaaattctgaaaaaaattcaggtttttctatggttaagccttgaataaatgtggctccttcttataaagaaataaatgttgaaaaacaagaaaatgatccaaattccattttaagcttttatcgaaaaatggttaaagtatctaaaagtgataaagtttttgcaaatggtaatattacctttttaccatataaagaaaatttaattcaattcacaagaacttataaaaataaaacttattattttattttttcattttctaataaaaaaataagtttggatagcaaaagtaatataattattctttattcaaattacgaatatgaaaaaaatattattaaaccatatcaatttattgtaggagaaattagtgagtaa

SEQ ID NO: 32883 - protein, 531 aa, Mycoplasma mobile 163K
MKNVNSKKIVYQIYPSSFKDSKGTGRGDIKGIIEKLDYIKDLGVDYLWLSPIFKSPLKDNGYDVSDYLSINTLFGDLEDLKSLIKKAKEKNLKVMLDMVFNHTSTEHEWFKKWINNDPEYKDFYISKKSVGKPPTNWVSKFGGSAWKEYKKNNWYLHLFDETQADLNWENEKVKEKIKEVIRFYINLGVKGFRFDVINLISKSNFNEDETDGRKFYTDGKKVEDYLQELRNEFPKEGDFLTVGELSSTTMQKASIYSNLDKKRLDSAFTFHHLKIDYDEKGKFIYKKPDIKKLNEIFDTSFTETQKLNGYLAVFLNNHDQPRAVSRFIDEEFHNVGAKMLGMLTLSLPGDTYIYQGEEIGMKNPNFENKEDYKDVETLNYFKELKLEKANDGIKQKSRDNSRTPMQWNSEKNSGFSMVKPWINVAPSYKEINVEKQENDPNSILSFYRKMVKVSKSDKVFANGNITFLPYKENLIQFTRTYKNKTYYFIFSFSNKKISLDSKSNIIILYSNYEYEKNIIKPYQFIVGEISE

SEQ ID NO: 32884 - DNA, 1650 bp, Mycoplasma mobile 163K
  CDS (1)..(1650)
atgaaattattaaagtgacaagataaaattatttatcaaatttttcctaggtcattttttgacacatcaaatgatggtaatggtgatattaaaggaattattaaaaaactaaattatctatcttgactaggtgtagatgcattatgactatgccctgtttatgaaactgaatttgctgatgctggttatgatgttttagattattataaagtttgagaaaagtttggaactttaaaggattttaaaacgcttattaaaaaagcaaaggaattaaatattgaaataatcatggatattgttttaaatcacacttcaactagtcatgaatgatttaaaaaagcaatagaagatcctacatcaaaagaattcaactattacatttggcaagataaagcaacagatgaaaaatctatttttggatcaagcgcatgagaatatgttccaagtattaaaaaatattattttcacttgttttcaatttctcaagctgatttaaattgagaaaatcctgcgaccatcgatgctatggctgatgtaataaattattgatatactctaggggtaaaagggtttagactagatgcaattcaacatattcataaagatttttctgaaaaagatacttcatttttttcatttggaaaaaaaatgacttctctacttcaagatttaaaatcaaaaattgataaagaagatatttttttaataggtgaaagtagtggaattcaaccagaattaattccaaactgaactgaaggtaaaaataaaattgtagataatttcttcaatttttcatgatgatgaattggttgaaatcaaataagtggaagaaatggatataatcctgactgaagttttaaagatttttattcaaaacaatttattgaataccaagaaagcaacaaaatattagataatgcttttacagttttttgatctaatcatgatacttcaagagcattaagtagatgaggaaatgaaaatattttctgagaagaaagtgcaaaaaccttagcacttttccaatttaccttaaaaggtcttatgtgtatttattatggagaagaaatcggaatgttaaatacattttttgattcaaaagaagaattaagagatgtcgatgcaattaattcgttttcattttgagtagatgaaaaaaaatattacacagaaaacgaaatgttaagagctcataatattaatagtagagataatactagaactccaatgttatgagatgaaaaacaagtaaattttggttttagtaaagcaaaaaatacatgaattaaattaaatcaaaactctaaaaacactagtgttgaaaagcaaataaaaaaccctaattctattcttaatttttatagaaaattaattcaattaagaaaagattctaagtttaaaaatattttactatttggaacttcaaaagtgcaaacattcaataattttgaagtatctagtataactagagaatttaatggtgaaaaaatcatttcttatattaatttatcaagtcattcgcattctattgtatttccaaaaaatgcagaaataattttaagttcatacagtgaacagccttttaaaattgactatttaagagcatatgaatcaattatgttttatacaaatgagaaaaaaaatgattaa

SEQ ID NO: 32885 - protein, 549 aa, Mycoplasma mobile 163K
MKLLKWQDKIIYQIFPRSFFDTSNDGNGDIKGIIKKLNYLSWLGVDALWLCPVYETEFADAGYDVLDYYKVWEKFGTLKDFKTLIKKAKELNIEIIMDIVLNHTSTSHEWFKKAIEDPTSKEFNYYIWQDKATDEKSIFGSSAWEYVPSIKKYYFHLFSISQADLNWENPATIDAMADVINYWYTLGVKGFRLDAIQHIHKDFSEKDTSFFSFGKKMTSLLQDLKSKIDKEDIFLIGESSGIQPELIPNWTEGKNKIVDNFFNFSWWWIGWNQISGRNGYNPDWSFKDFYSKQFIEYQESNKILDNAFTVFWSNHDTSRALSRWGNENIFWEESAKTLALFQFTLKGLMCIYYGEEIGMLNTFFDSKEELRDVDAINSFSFWVDEKKYYTENEMLRAHNINSRDNTRTPMLWDEKQVNFGFSKAKNTWIKLNQNSKNTSVEKQIKNPNSILNFYRKLIQLRKDSKFKNILLFGTSKVQTFNNFEVSSITREFNGEKIISYINLSSHSHSIVFPKNAEIILSSYSEQPFKIDYLRAYESIMFYTNEKKND

SEQ ID NO: 32886 - DNA, 1677 bp, Picrophilus torridus DSM 9790
  CDS (1)..(1677)
atgcttgataataatggtttatggtaccgtgatgctgtattttatgaggttcctgtaaaatcattctatgattcaaacaacgatggcataggcgattttaatggcctaacaatgaagcttgactatttaaaaaagcttggtgttgacgctttatggctgctgccattctataaatcgccattgaaggacgacggttacgatatatctgattactattcaatactgccggagtatggaacaattgatgattttaaaaacttcatagataccgcgcattcaatgaacataagggttatagcggacctcgttctaaaccatgtatctgaccagcatccatggttcattgaatcaagaagcagcattgataatccaaagagggactggtttatatggagcgacacaccagaaaaatttaaggaggcaaggataatatttatagatacagaaaaatcaaactggacatatgatccggaaacaaaacagtattactttcacaggttttactcatcccagccggatcttaactatgacaatcctgatgtcaggaacgaggttaaaaaggttataaggtactggcttgaccttggccttgacggcttcagggcagatgcggttccatacctctttaaaagggagaatacaaactgtgagaacctgccagaaacacacaacttctttaaggaaataaggaagatgatggatgaagattaccctggaacaatacttttagcagaggcaaaccagtggcctacagaaacaaaggcatactttggtaacggcgatgaatttcatatggcattcaattttcctttgatgccaaggatctttatagcactggccaggagcgattactatccaataatggatataataaagcagacgctgccgatacctgataactgcgactggtgcatctttcttagaaaccatgacgagcttacccttgagatggtcacggattcagaaagggatatcatgtacagggagtacgcaaagataccaaagatgcgtttaaatcttggaataaggcgcaggctagcaccgcttgctgacaatgatataaacacaatagaactattaaacgcattaatattttcactgcccggcacgccgataatatactatggcgacgagataggcatgggtgataacatatatcttggcgatagaaacggtgtgagaacgccaatgcagtggtcatatgatagaaacgcaggtttctcaatggcagattcggagcagctctactcaccggtgataacaaatcctaattatcattatgaaagcgtgaacgttgaggctgagctcaggctgagctcatcgcttttaaactggatgataaagattatacatgttagaaaggattacaaggagctcctcggccgcggttcaataaaatttatagagcagggtaataaaagggtgctttcttatataagagagtatgaaaaccagaggatgctgtgcctttttaatttatcaaggaatccaacgtacgttgagctaaatttaagtgattacatagggcttaaaccaatagaggccataacaaaggcagcatttccaaggataaaggatgataggtatttcataacaatgacaccaaggtcattcttctggtttaatttaattgtacctgaaagggatgattcatacgacctcattggagaagattaa

SEQ ID NO: 32887 - protein, 558 aa, Picrophilus torridus DSM 9790
MLDNNGLWYRDAVFYEVPVKSFYDSNNDGIGDFNGLTMKLDYLKKLGVDALWLLPFYKSPLKDDGYDISDYYSILPEYGTIDDFKNFIDTAHSMNIRVIADLVLNHVSDQHPWFIESRSSIDNPKRDWFIWSDTPEKFKEARIIFIDTEKSNWTYDPETKQYYFHRFYSSQPDLNYDNPDVRNEVKKVIRYWLDLGLDGFRADAVPYLFKRENTNCENLPETHNFFKEIRKMMDEDYPGTILLAEANQWPTETKAYFGNGDEFHMAFNFPLMPRIFIALARSDYYPIMDIIKQTLPIPDNCDWCIFLRNHDELTLEMVTDSERDIMYREYAKIPKMRLNLGIRRRLAPLADNDINTIELLNALIFSLPGTPIIYYGDEIGMGDNIYLGDRNGVRTPMQWSYDRNAGFSMADSEQLYSPVITNPNYHYESVNVEAELRLSSSLLNWMIKIIHVRKDYKELLGRGSIKFIEQGNKRVLSYIREYENQRMLCLFNLSRNPTYVELNLSDYIGLKPIEAITKAAFPRIKDDRYFITMTPRSFFWFNLIVPERDDSYDLIGED

SEQ ID NO: 32888 - DNA, 1650 bp, Staphylococcus aureus subsp. aureus MRSA252
  CDS (1)..(1650)
atgaataagcaatggtggaaagaagcagtagcatatcaagtatatccaagaagttttaatgatagtaatcacgatggtattggggatttacctggaatgattgataaattggactacttaaaagatttaggtatcgatgtcatttggctcagtccaatgtttaaatcacctaatgatgataatggttatgatattagtgactaccaagagattatggatgaatttggaacgatggaagactttgatcgtttattaaaaggtgttcatgatagaggtatgaagcttattttagatttagttgtgaatcatacatctgatgaacatccttggtttatagaatccaaatctagtaaagacaatcccaaacgtgattggtacatttggcaagatccaaagccagatggctctgaacctaacaactgggaaagtatatttaatggatctacatgggaatatgatgctaatactgagcaatattatttccatctattcagtaaaaaacaacctgatttgaattggggtaatccggaagttagagatgctgtatttgaaatgatgaactggtggtttgataaaggcattgatggatttagagtagatgcaattacgcatattaagaagacgtttgaagcgggtgacttacctgtacctgagggtaaaacatatgccccagcatttgatgtagatatgaatcagccaggtatacaaacttggttacaagagatgaaagatcgctcattaagtaagtatgacattatgactgttggtgaagcgaatggtgtaagccctgatgatgctgatgactgggtcggggaagaaaatggtaaatttaatatgatattccaatttgaacatttgggactgtggaatagtggtgattctcactttgatgtaaattcgtataagtctgtattaaatagatggcaaaaacaacttgaaaataaaggttggaatgcgttgtttattgaaaatcatgaccaaccacgacgtgtatcgacgtggggtgacgatgacaagtattggtatgaatcagcaacaagtcatgcagcagtttatttcttgcaacaaggtacgccattcatttatcaaggtcaagaaattggtatgacgaattatccatttgaaagtattgaaacatttaacgatgttgctgttaaaaatgactatcaaattgtgaaagctcaaggtggagatgtagacgctttacttgcgaaatataaagatgagaaccgagataattctcgcacaccaatgcaatgggatgatacgttaaatggaggatttacaaatggtgaaccgtggttcccagtgaatccgaattataaaactatcaatgttgcacaacaattagaagatgaggattcagtattacaattttataaagatttaattcaattaagaaagtctaatgatgtatacgtatatggtcaatttgatttagtagatgctgaaaattcacaagtttttgcgtacacgagaacattaaatgaaaagcaagttcttattgtaggtaatcttactaaccacgaagcagaattaactgtaccatttgatataagtcatggagaagtgaagctatttaattatgatgccaaagttaatttaaaacagttacttccatatgaagcatgtgttatcgaactaaattaa

SEQ ID NO: 32889 - protein, 549 aa, Staphylococcus aureus subsp. aureus MRSA252
MNKQWWKEAVAYQVYPRSFNDSNHDGIGDLPGMIDKLDYLKDLGIDVIWLSPMFKSPNDDNGYDISDYQEIMDEFGTMEDFDRLLKGVHDRGMKLILDLVVNHTSDEHPWFIESKSSKDNPKRDWYIWQDPKPDGSEPNNWESIFNGSTWEYDANTEQYYFHLFSKKQPDLNWGNPEVRDAVFEMMNWWFDKGIDGFRVDAITHIKKTFEAGDLPVPEGKTYAPAFDVDMNQPGIQTWLQEMKDRSLSKYDIMTVGEANGVSPDDADDWVGEENGKFNMIFQFEHLGLWNSGDSHFDVNSYKSVLNRWQKQLENKGWNALFIENHDQPRRVSTWGDDDKYWYESATSHAAVYFLQQGTPFIYQGQEIGMTNYPFESIETFNDVAVKNDYQIVKAQGGDVDALLAKYKDENRDNSRTPMQWDDTLNGGFTNGEPWFPVNPNYKTINVAQQLEDEDSVLQFYKDLIQLRKSNDVYVYGQFDLVDAENSQVFAYTRTLNEKQVLIVGNLTNHEAELTVPFDISHGEVKLFNYDAKVNLKQLLPYEACVIELN

SEQ ID NO: 32890 - DNA, 1692 bp, Erwinia carotovora subsp. atroseptica SCRI1043
  CDS (1)..(1692)
atgagtacatcactcccctggtggcaaaacggcgtgatttatcaaatctatccgaagagctttcaggacagtaccggaaatggcattggcgacatcgctggtgtcaccgcccgactcgattacctacaacagttgggcatcgatgctatttggctgactccggtttacctttctcctcaggttgacaacggctatgacgtggccgactactgcgctatcgacccagcctacggcacgatggccgatatggaaacgttgatcgccgaagcacatcgacgtcgtattcgtattgtcatggatatggtgttcaaccatacctctactcagcaccactggttccagaacgctcaggatcgccgcagcccctatcgtcatttttatatctggcgtgatggtaatgacggtgcaccgcccaataactggcgttcaaaatttggcggcccagcttggctgtggcacgcggaaagcaaacaatactatctgcaccttttcgctaccgaacaggccgatctgaactgggagcacccgcgcgtacgggatgaattaaaacaggtctgtggattttgggcggataaaggcgtagacgggctgcggctggatgtaatcaatctagtctccaagcagcaggatttcccgtcagacacacagggcgatggacgccgtttttataccgatgggccacttattcacgattacttacaggagttcagtcaggatgtatttcagccccgcgggttgatgactgtcggtgagatgtcatcgacctcactggaacattgccgccgctacgccgcactggacggcagcgaactctccatgacgttcaattttcatcatctgaaagttgattaccctaatggggaaaaatggacgctggcggaacctgattttatccaactcaagctgatttttaaccactggcagcagggtatgcataaccacgcctggaatgcgctgttctggtgtaatcacgatcagccacgcatcgtgtcgcgttttggcgatgaaggggaattccgtgtgcaatccgccaaaatgctggcgatggtgctacacggtatgcagggcacgccctatatctatcagggcgaagagctgggcatgaccaatcccggctatacacagattgaacaataccgcgatattgaaagcctgaatcaatttgccgaacagcgcgatcggggtcaggtagatgagcaaatcttagcgatcctcgccagcaaatcacgcgataacggccgtacgccaatgcagtgggatgagagcgatcatgctggatttacgaccggcacaccgtggataacccccagccagaactttcctcacatcaacgcagagcagtcgctggcggataaagagtccgtcttttatacctaccagcagcttattgctatgcgtaaagcccttccgctgctaacgcacggcgactataaggatctgctgccagaccaccctaacgtctggtgctatcagcgcacttgggaggggcaacggcttctggttctggcaaacctcagcaaacagcccctgcgctggcaacctccgatggagacccacgaccgccgctggcgactgttatttagcaattattctgatgcacagccgcaaccggcaatactggagttgcgaccatttgaagccatctattggatacagggaatgcaggagaaagaggataagatccaagaatag

SEQ ID NO: 32891 - protein, 563 aa, Erwinia carotovora subsp. atroseptica SCRI1043
MSTSLPWWQNGVIYQIYPKSFQDSTGNGIGDIAGVTARLDYLQQLGIDAIWLTPVYLSPQVDNGYDVADYCAIDPAYGTMADMETLIAEAHRRRIRIVMDMVFNHTSTQHHWFQNAQDRRSPYRHFYIWRDGNDGAPPNNWRSKFGGPAWLWHAESKQYYLHLFATEQADLNWEHPRVRDELKQVCGFWADKGVDGLRLDVINLVSKQQDFPSDTQGDGRRFYTDGPLIHDYLQEFSQDVFQPRGLMTVGEMSSTSLEHCRRYAALDGSELSMTFNFHHLKVDYPNGEKWTLAEPDFIQLKLIFNHWQQGMHNHAWNALFWCNHDQPRIVSRFGDEGEFRVQSAKMLAMVLHGMQGTPYIYQGEELGMTNPGYTQIEQYRDIESLNQFAEQRDRGQVDEQILAILASKSRDNGRTPMQWDESDHAGFTTGTPWITPSQNFPHINAEQSLADKESVFYTYQQLIAMRKALPLLTHGDYKDLLPDHPNVWCYQRTWEGQRLLVLANLSKQPLRWQPPMETHDRRWRLLFSNYSDAQPQPAILELRPFEAIYWIQGMQEKEDKIQE

SEQ ID NO: 32892 - DNA, 1620 bp, Mesoplasma florum L1
  CDS (1)..(1620)
atgagaaatgaagtaatttatcagatattccctttaactttttctgatggtaagaaaaaaggtaaaggaaatatcaaaggtataataaataaattagattatttaaaaagtttaggcataactagaatatgaatatctccctttacaaaatcaccttttaaagatagtggttatgatgtttcagattattgtggaataaatgaagaatttggtactatggaagaagtggaaattcttatatctgaagcaaagaaaagagatttaacaattgttttagatatagttttcaatcatacttctgaccaacacgaatgatttaaaaaagctttagctggtgatgaaaaatatatgaattattatatttttaaagatccagtcgatggtaaagagccaactaattgaaaaagtaaaatgggtggtttaagttgagaatttgtacctaatctaaataaatactatttacatttatttacaaaagaacaaccagatttaaattgagaaaatccagaagttagaaatgaactaattaatatattaaagttttgaaaagataaaggtattagtggtttcagacttgatgtttgtaatctttatagcaaacccacattatttgaaaatgatgaaattggggatgggcgaagattctatacagatggagtaaaagttgaagagtattttaacttgatgcataatgaagtttttggaactgataatgaaatatttacagttggtgaagtttcatcaacaactaaagaaaaatcagctaaatatgctaaggtagaaaataaagagcttgattcagtttttacattcttacatctaaaagttgattatgaaaataatgacaaatgaacaaatgttaaacctgatttaaacttgttttgaaaattacaaaaagaatgacaagaatattatcaattagaaaattctactttagctttatttatgaataatcatgatcaaccaagagctgtttcaagatttggaaatgtagataaatattgatatgaaagtgcaacttctatttttgcatttacttcattaatgcgtggagttccattcatttatcaaggcgaagaaattggtatgacaaatttaacttttaataaccttaatgaatttaaagatgttgaatcaattggaaatgctaatgatttattaaaaataaaatcagaagaagaagtacttgatattttaagaattaaatcaagagacaatgcaagaagtgtgatgcaatgaaatgatgaattcaatgctggattttcagaaaaagaaaatatagatttatttgttaataaaaattacaaaacaatcaatgttaaaaaccaattaaatgatgataaatctgttttaaatttttacaaaaaagtaattaatttaagattaaatgaagaagtatttaatgatggaacaattagcttttttgaaaatcaggattatgcatattgtagaaaattaaaagataaagaaataattatattaacaaactgaacaactgaaaataaattgataaaattaaaactagatagcaataattgaaaaataattttaaataattatgaagattttagttttgattctttaaaaccttatcaagtaatagcaatcgaaaggaaataa

SEQ ID NO: 32893 - protein, 539 aa, Mesoplasma florum L1
MRNEVIYQIFPLTFSDGKKKGKGNIKGIINKLDYLKSLGITRIWISPFTKSPFKDSGYDVSDYCGINEEFGTMEEVEILISEAKKRDLTIVLDIVFNHTSDQHEWFKKALAGDEKYMNYYIFKDPVDGKEPTNWKSKMGGLSWEFVPNLNKYYLHLFTKEQPDLNWENPEVRNELINILKFWKDKGISGFRLDVCNLYSKPTLFENDEIGDGRRFYTDGVKVEEYFNLMHNEVFGTDNEIFTVGEVSSTTKEKSAKYAKVENKELDSVFTFLHLKVDYENNDKWTNVKPDLNLFWKLQKEWQEYYQLENSTLALFMNNHDQPRAVSRFGNVDKYWYESATSIFAFTSLMRGVPFIYQGEEIGMTNLTFNNLNEFKDVESIGNANDLLKIKSEEEVLDILRIKSRDNARSVMQWNDEFNAGFSEKENIDLFVNKNYKTINVKNQLNDDKSVLNFYKKVINLRLNEEVFNDGTISFFENQDYAYCRKLKDKEIIILTNWTTENKLIKLKLDSNNWKIILNNYEDFSFDSLKPYQVIAIERK

SEQ ID NO: 32894 - DNA, 1848 bp, Propionibacterium acnes KPA171202
  CDS (1)..(1848)
gtggggccagcaagccttcgtcaggctctaccccgctcagcccgcccatatcctgcatgtgcgaaagaccacctcatgacccatgtcccctgcacccccgccgcggagatccctgagaccctggctcctaccggggctctcgggctgacctcggcccagttgcaggccagactcgatgagatccacccggtcggttctatcgatcgcaccgagactgaatggttccgcaccgctgtcttctatgaggttctggtgcgatcctttaaggactccaatggtgacggaattggcgactttaaagggctgacgggaaaactcgattacctacaatggctcggggtggattgcctatggttaccacccttctatgactctcctctccatgacggaggttacgacattcgtgactatcgctggatccgtgaggagctgggcaccattgaggactttaaggttttccttgacgcagcccatgaccgtggccttcgcgtcatcatcgacttcgtcatgaaccacacctcggattcccatccgtggttccagtcctcacgcgccgatccggatggtccttacggtaactactacgtatggtcggacactgacgaggcctactccgatgctcgtatcatcttctgcgataccgaggactcgaattggtcctgggattcccagcgtaagcagttctactggcaccgattcttccatcaccaacccgatctcaactttgaagagcctcgagttatggaggaaatgctcgacgccgtccgcttctggatggacttgggtattgacggattccgactcgacgccgtcccgtacctcattgaggccgagggcacgaactgcgagaacttgccaggaactcacaagatcctcaagcagctgcgcgccatggtcgatgaagaatacccaggccgcatcctgctgtgtgaagctaaccagtggcctgacgacgtcgtcgagtattttggcaacggtgacgaatgccagatggccttccactttccggtcatgccacgcctgtacatgggactgcgtcgcggttcacgggaatgcattagcgagatcctggctcacactccacacatcccggacggctgccagtgggggaccttcctgcgcaaccacgacgaactcaccctcgaaatggtgaccgaagaagatcgtcactacatgtgggaggaatatgctcctgaatcccggtggcggtgcaacttgggcattcgtcgccgcttgagccctcttgtcgataacgacgatgcgaagatccggctacttaacgccatgttgctgtccctacccggctctccggtgctgtactacggcgacgagattggcatgggggacgatccctggctgcctgaccgtgatggggtgcgtaccccgatgcagtgggatgactcggagacggctggcttttccactgcccttccagaggactttcatctacctctcatccgcacctttggccacgatccagagcacgtcaatgtcgcccgccagatggacgacccgtcctccttgctggtgtggacgcgtgccatgctcggtatccgccgccaccaccccgtctttgggaccggcgagttcaccgatctaggcgggccggacatggcggtgatgtccttcctgcgtcacaacgagcacgaaacggtcctgtgcctggctaacttctccgatactgagcggatggttgcccttcaccttccacaattcgcgggcatgacgggctcttctctcatccatggtcaggacgcgcaaccagtaaaagctgacggaacactgtccgtaccgttgtggccatatggctatcgatggctgcaaatgtcccgcgaggagaggtcatga

SEQ ID NO: 32895 - protein, 615 aa, Propionibacterium acnes KPA171202
MGPASLRQALPRSARPYPACAKDHLMTHVPCTPAAEIPETLAPTGALGLTSAQLQARLDEIHPVGSIDRTETEWFRTAVFYEVLVRSFKDSNGDGIGDFKGLTGKLDYLQWLGVDCLWLPPFYDSPLHDGGYDIRDYRWIREELGTIEDFKVFLDAAHDRGLRVIIDFVMNHTSDSHPWFQSSRADPDGPYGNYYVWSDTDEAYSDARIIFCDTEDSNWSWDSQRKQFYWHRFFHHQPDLNFEEPRVMEEMLDAVRFWMDLGIDGFRLDAVPYLIEAEGTNCENLPGTHKILKQLRAMVDEEYPGRILLCEANQWPDDVVEYFGNGDECQMAFHFPVMPRLYMGLRRGSRECISEILAHTPHIPDGCQWGTFLRNHDELTLEMVTEEDRHYMWEEYAPESRWRCNLGIRRRLSPLVDNDDAKIRLLNAMLLSLPGSPVLYYGDEIGMGDDPWLPDRDGVRTPMQWDDSETAGFSTALPEDFHLPLIRTFGHDPEHVNVARQMDDPSSLLVWTRAMLGIRRHHPVFGTGEFTDLGGPDMAVMSFLRHNEHETVLCLANFSDTERMVALHLPQFAGMTGSSLIHGQDAQPVKADGTLSVPLWPYGYRWLQMSREERS

SEQ ID NO: 32896 - DNA, 1674 bp, Propionibacterium acnes KPA171202
  CDS (1)..(1674)
atgaccacctcccctacgatcaacgactggtggaagtccgctgtcgtctatcaggtctacccacgcagcttcgccgactcgaacggagacggcattggcgacgtgcgtggcatcatcgaccacctcgaccacctcgtcaccttgggtgtcgacgccctgtggatctcaccgtggtacccctcccccatggctgacggcggatacgacgtcagcgactactgcgacatcaacccggactttggcaccctcgccgatgcggacgccctcgtggcacaggcgcacgagctgggtctgcgggtcatcatcgatctcgtcccgaaccactcctctcaagagcatccatggttcaaaaaggcgttagccgcagctcccggctccccagaacgcgaccgctacatctttcgtgatggccggggcgagaacggtgaacttcccccgaacaactggccgtcagttttcggcagcggcgcatgggagcgcatcaccgagccggacggcactcccggtcagtggtacctacacttttttgacgtttcccagcccgactggaactgggagaactccgacgtcctcgaagagtttgaccgggtgctgaggttctggttcgaccgcgggatcgacggtttccgcatcgacgtcgccaactcgctggttaaggaatccggtcttccagatctccccgagaacgaaaagttcggcgagctcgtcggggatagtccgatgtgggatcagcctgaacttgcatcaattcagcgacgctggcgtgctatcgccgacgaatacgccgatactcccgagggacccaggatgtttgtcgccgaggcttacctcccccacgaccgcctggtccgctacctcgagtcagatcggctgcatacgtcctttaacttcgagttcctcatctcggcgtggaaggccaactcgcttcgcaccacgatcaccgaatcgctagcagctcacgagtcggtgggcgctagtgccacctgggtacttggtaaccacgacaatgtccgcccggtctcccgctacggcaaggagatctccgggctggacttctcggatccgtcggctccgcacgcccagtttcatggcacccctaccgatgtggctctgggacggtgtcgggctcgcgccgccgccatgctggagctggctctaccgggcggtgcctacatttaccaaggcgaagaacttggcctcccagaggtcgaagatcttcccgaagaaaccctccaagaccccacctggaaacgttctggacacacagatcgcggtcgtgacggatgtcgcgttcccatgccgtggagcggttccaacgcaccctatgggtggtcgacaaacgcgaacacctggctccccatgccgagtaattgggccgagtggaccgtcgaatctgagcagaacgattcgtcatccttctttgccctctaccgcaccctactggccgagcgccatgccaacccagcactgggcgccggaacgatgacttggaacgagtccagcgacgaggtcctcgacttttcccgcgagcccggtttccggtgcatcgtcaacttcggcgccgaaaaggtgaccgtggacgctgacgcggttatcgcatcgtcgattccgttggacacccaaggtaagacggtgtcagtcggacgcgatcaggctgtctggttgcgagtctga

SEQ ID NO: 32897 - protein, 557 aa, Propionibacterium acnes KPA171202
MTTSPTINDWWKSAVVYQVYPRSFADSNGDGIGDVRGIIDHLDHLVTLGVDALWISPWYPSPMADGGYDVSDYCDINPDFGTLADADALVAQAHELGLRVIIDLVPNHSSQEHPWFKKALAAAPGSPERDRYIFRDGRGENGELPPNNWPSVFGSGAWERITEPDGTPGQWYLHFFDVSQPDWNWENSDVLEEFDRVLRFWFDRGIDGFRIDVANSLVKESGLPDLPENEKFGELVGDSPMWDQPELASIQRRWRAIADEYADTPEGPRMFVAEAYLPHDRLVRYLESDRLHTSFNFEFLISAWKANSLRTTITESLAAHESVGASATWVLGNHDNVRPVSRYGKEISGLDFSDPSAPHAQFHGTPTDVALGRCRARAAAMLELALPGGAYIYQGEELGLPEVEDLPEETLQDPTWKRSGHTDRGRDGCRVPMPWSGSNAPYGWSTNANTWLPMPSNWAEWTVESEQNDSSSFFALYRTLLAERHANPALGAGTMTWNESSDEVLDFSREPGFRCIVNFGAEKVTVDADAVIASSIPLDTQGKTVSVGRDQAVWLRV

SEQ ID NO: 32898 - DNA, 1710 bp, Leifsonia xyli subsp. xyli str. CTCB07
  CDS (1)..(1710)
gtgagtttcaccgcaccgatcacgcttcccgggctcaccctcgacccgcagtggtatcgccgatccgtcttctacgaggtgatggtccgctccttcgtcgacagcaacggcgacggctccggcgatctcgcgggtctgacctccaaactcgactacctgcagtggctcggcatcgacgcgctctggctcccgccgttcttccagtcccccctgcgcgacggcggctacgacgtgagcgacttccgcgcgatcctgcccgagttcggaaccatcgacgagttccgcgacctggtcaccaaggcgcacgagcgcaacatgcggatcatcatcgacctgccgatgaaccacacctccgaccagcacgagtggttccagcaatcgcggtccaacccggaagggcccttcggcgatttctatgtctggaacgagaccgacgacaagtacccggacatccgcatcatcttcgtggacaccgaggactccaactgggccttcgacgaggcgcgtcgccagtactactttcaccggttcttctcgcaccagccggacctcaacttcgagaaccccgccgtacacgacgcaatgttcgacatcgtccggttctggctcgacctcggcgtcgacggcttccggctcgacgctatcccctacctctacgagtcggacgagggcaacggcgagggcgagccgcccacgcacgagttcatcaagaggctccgcgaggtggtcgatcgggagtacccgggccggatgatggtcgccgaggccaaccagtggccgcgcgaagtcgctgccttcttcggcagcgaggaggagccggagtgtcacatggccttcgacttcccggtgatgccgcgtatcttctacgcgctccgctcgcaacaggcctccgagctcatccacgtgctctccgagaccacggacgtgcccgatgggtacgcctggggcgtgttcctgcgcaaccacgacgagctgacgctggaaatggtaagcgaggagtaccgccaggccatgtacggctggtatgcctacgacccgcgcatgcgcgccaacatcggcatccgccggcggctcgcgccgctcctggacaactcgcgcgccgaactcgaactcgcccacgccctcctcttctccctcgccggcagcccgtttctctactacggcgacgagatcgggatgggcgacaacatctggctgcccgatcgcgacagctcgcgcacgccgatgcagtggacccccgaccgcaacgccggtttctccagcgccgacccgggcaaactcttcctcccggtcgtccagtcgctcgtctatcactacaaccaggtgaatgtggaggcgcagctcgcgcagtcgcgctcgctgctgcactgggtgcgcaacgtcatccatgtgcggaaagcgcatcccgtgttcggtctgggcgacatgcgtgtgctgccgaccaaccacgagtcggtgctggccttcgtgcggacgtacgagggcagcggcagccacttcggcgaccagccggaggatgtgctgtgcgtgttctcgttcgcgcacaatccggtctccgtcaccctcgaagcgccggagttcgccggtcggacactgtacgatctgttcggcggcgcagagttcccgaccgtcgccgaggacggccgcttcaccctgaccctcggcacccagagcttctactggctgcacatcgaaccgcgccgcgattaa

SEQ ID NO: 32899 - protein, 569 aa, Leifsonia xyli subsp. xyli str. CTCB07
MSFTAPITLPGLTLDPQWYRRSVFYEVMVRSFVDSNGDGSGDLAGLTSKLDYLQWLGIDALWLPPFFQSPLRDGGYDVSDFRAILPEFGTIDEFRDLVTKAHERNMRIIIDLPMNHTSDQHEWFQQSRSNPEGPFGDFYVWNETDDKYPDIRIIFVDTEDSNWAFDEARRQYYFHRFFSHQPDLNFENPAVHDAMFDIVRFWLDLGVDGFRLDAIPYLYESDEGNGEGEPPTHEFIKRLREVVDREYPGRMMVAEANQWPREVAAFFGSEEEPECHMAFDFPVMPRIFYALRSQQASELIHVLSETTDVPDGYAWGVFLRNHDELTLEMVSEEYRQAMYGWYAYDPRMRANIGIRRRLAPLLDNSRAELELAHALLFSLAGSPFLYYGDEIGMGDNIWLPDRDSSRTPMQWTPDRNAGFSSADPGKLFLPVVQSLVYHYNQVNVEAQLAQSRSLLHWVRNVIHVRKAHPVFGLGDMRVLPTNHESVLAFVRTYEGSGSHFGDQPEDVLCVFSFAHNPVSVTLEAPEFAGRTLYDLFGGAEFPTVAEDGRFTLTLGTQSFYWLHIEPRRD

SEQ ID NO: 32900 - DNA, 1623 bp, Mannheimia succiniciproducens MBEL55E
  CDS (1)..(1623)
atgaacgataactggtggaaaaacggggtaatttatcagatttacccgaaaagttttcaggacacgacaggttccggtaccggtgatattcagggaattattaagcgcttggattatctgcaaactctgggtattgacggtatctggattactccgatgtatgtttcgccgcaaattgataacggttatgacatcgccgattaccgtaatatcgacccgagttacggtacgatggcggattttgagcaactgattgccgaggcgcataagcgtgatatccgtattgtgatggatatggtattcaatcacagctcaacttttcaccaatggtttaagcagggcgaagatccgaacagcgagtaccacgactattatatttggcgcgagcagccgactaattggcaatccaaattcggcggtaatgcgtggaaatggtcggataaggcgcaaaaatattacctgcatttatttgcgccggagcaggcggatcttaactgggaaaatcctaaattacgcgccgaactgtacgatatttgtcgtttctgggcggaaaagggcgtggacggcttgcgtctggatgtcgtcaacctgatttccaagccggaaaaatatgaggacgattttgagggtgacggtcgccgcttttataccgacgggccgaaaatccaccaatatctgcaagaattgaatcaaaatgcgttaaaacctttcggtttgatgacggtgggcgaaatgtcttcgactaaactggaacattgtcagcgctacgccaatctggacggctccgagttatcgatgaccttcaatttccatcatctcaaagtagattatccgaacggtgaaaaatggacttatgccaaaccggattatgtagagcttaaatcgattttcaactactggcaaaagggtatgcatggtaaagcgtggaatgcgctgttttggtgcaaccacgaccagccgcgtattgtttcccgtttcggcgatgaaggcgaactgcgcaccctgtccgccaaaatgctggcgatgttattacacggaatgcagggtacgccgtatatctatcaaggtgaagaaatcggtatgactaacccgaatttctcttccattgaagagtatcgcgatgtagaaagtctgaatgcctatcaaattctgcaaaatcagggaaaaagtgcggttgaaattttgcagattttagcgcaaaaatcacgtgataattcgcgtacgccggtacaatgggacgcttcgccgaatgccggttttaccagtgctacgccgtggattggcgtggctaaaaattatccgcaaatcaacgtcgaacaggcgttggcggatagagattcggtattttatacctatcaaaaattgattgcgttacgtaaacaattagcggtattaaccgacggcgattatagtgatcttctaccgaaccatgagtccgtatggctgtatcaacgttcgactgccggtgagcggttaacggttgcggctaatttgagcaatcagccgcaatttatcgaaataaaaccgcaaggtcaggtgttaatcaacaattatgcggatataacccaagaagactccggcatttgtttaaaaccttaccaggcgctgtatttcctagcttaa

SEQ ID NO: 32901 - protein, 540 aa, Mannheimia succiniciproducens MBEL55E
MNDNWWKNGVIYQIYPKSFQDTTGSGTGDIQGIIKRLDYLQTLGIDGIWITPMYVSPQIDNGYDIADYRNIDPSYGTMADFEQLIAEAHKRDIRIVMDMVFNHSSTFHQWFKQGEDPNSEYHDYYIWREQPTNWQSKFGGNAWKWSDKAQKYYLHLFAPEQADLNWENPKLRAELYDICRFWAEKGVDGLRLDVVNLISKPEKYEDDFEGDGRRFYTDGPKIHQYLQELNQNALKPFGLMTVGEMSSTKLEHCQRYANLDGSELSMTFNFHHLKVDYPNGEKWTYAKPDYVELKSIFNYWQKGMHGKAWNALFWCNHDQPRIVSRFGDEGELRTLSAKMLAMLLHGMQGTPYIYQGEEIGMTNPNFSSIEEYRDVESLNAYQILQNQGKSAVEILQILAQKSRDNSRTPVQWDASPNAGFTSATPWIGVAKNYPQINVEQALADRDSVFYTYQKLIALRKQLAVLTDGDYSDLLPNHESVWLYQRSTAGERLTVAANLSNQPQFIEIKPQGQVLINNYADITQEDSGICLKPYQALYFLA

SEQ ID NO: 32902 - DNA, 1689 bp, Bacillus licheniformis DSM 13
  CDS (1)..(1689)
atggaaacgaaagaaaatccatggtggaaaaaagcagtcgtctaccaaatttatccgaaaagctttaaagatacaacaggaaacggtgtcggcgacatacgcggcatcatcgaaaagctcgactacatcaaggagctcgcctgtgatgtcatttggctgacgccgatttatcaatcgccgcaaaacgacaacggctatgacatcagcgactattacagcatccatgaagaatatggaacaatggccgactttgaagagcttcttgaagaggcccacaagcgcggcataaaggtgatcatggatcttgtcgtcaaccatacatcaacagagcacagatggtttaaagaagcggcgtccggcaaagaaaatctgtaccgcgacttttatatttggaaagacatgaagccgaacggcgctccgccgacaaattgggaatcgaaattcggcggctcggcgtgggagtttcatgcagagagcggacagtattatctccatctctatgatgtgacacaggcggatttgaattgggagaatgaagcagtcagaaaaaaagtgtacgagatgatgcatttctggtttgaaaaaggaatcgacggcttcagacttgatgtcatcaatgtcatctcaaaagaccagcgtttccctgatgatgacgagggggacggacgcagattttatacggacgggccgagggttcacgagtttttgaatgaaatgaacagggaggttttttcaaaatatgacagcatgacggtcggagaaatgtcatcgactacaatcgcagattgcatccggtatacaaaccccgaaagccgtgagctcgatatggtgtttaactttcatcatttaaaggccgactatccaaacggggaaaaatgggcgcttgcggattttgattttctaaagctgaagaagattctttctgaatggcagacggaaatgaataaagggggcggatggaacgcattgttctggtgcaaccacgaccagccgcggatcgtctcacggtacggggacgacggaaaataccgcaaaaagtctgcgaaaatgctggcaaccgcgattcatatgcttcagggaacgccatacatttaccagggagaagagcttgggatgaccaacccgaaattcgatgacatctccctttacagggatgtcgaatctctcaatatgtaccgtatcctgaaagaagcagggaagccggaagccgaaatcatcgaaatcttgaaagcgaaatcccgtgataattcgcggacgccggtgcagtggaacggagaagaaaatgccgggtttacggcgggcacaccgtggattccggtgcctgacaactacaaagaaatcaacgcagaagaagcgctcaacgatcctgattcgattttctaccattataaaaagctgaatgagctccgcaaggaattcgatatcattacaaccggcgattatcagctcatactggaagacgatcaagagctttacgcgtatttgagaaacggagcggatgaaaaactgctggtgatcaataatttttacgggaaagagaccgagtttcagctgcctgacgatattgatattgaaggctatgatgccaaggttctcatttccaatgacaccgatcttcccgagtcatttaaacgcttcacagtgaaaccatatcaatcgattgtttatcatcttgccaaaccatgctaa

SEQ ID NO: 32903 - protein, 562 aa, Bacillus licheniformis DSM 13
METKENPWWKKAVVYQIYPKSFKDTTGNGVGDIRGIIEKLDYIKELACDVIWLTPIYQSPQNDNGYDISDYYSIHEEYGTMADFEELLEEAHKRGIKVIMDLVVNHTSTEHRWFKEAASGKENLYRDFYIWKDMKPNGAPPTNWESKFGGSAWEFHAESGQYYLHLYDVTQADLNWENEAVRKKVYEMMHFWFEKGIDGFRLDVINVISKDQRFPDDDEGDGRRFYTDGPRVHEFLNEMNREVFSKYDSMTVGEMSSTTIADCIRYTNPESRELDMVFNFHHLKADYPNGEKWALADFDFLKLKKILSEWQTEMNKGGGWNALFWCNHDQPRIVSRYGDDGKYRKKSAKMLATAIHMLQGTPYIYQGEELGMTNPKFDDISLYRDVESLNMYRILKEAGKPEAEIIEILKAKSRDNSRTPVQWNGEENAGFTAGTPWIPVPDNYKEINAEEALNDPDSIFYHYKKLNELRKEFDIITTGDYQLILEDDQELYAYLRNGADEKLLVINNFYGKETEFQLPDDIDIEGYDAKVLISNDTDLPESFKRFTVKPYQSIVYHLAKPC

SEQ ID NO: 32904 - DNA, 1620 bp, Methylococcus capsulatus str. Bath
  CDS (1)..(1620)
atgacggacgggaacggcacgctggcctggtggcagaccggcatcatctaccagatctatcccctttccttccaggacagcgacggcgacggcaggggtgatcttcccggcatcctccaccggctcgactacctggccgacctgaacatcgccgccgtctggctgtcgcccgtcttcgcctcgccgatgcgggacttcggctatgacgtggctgactacacgtccatccatccctggttcggaaccctgagcgatttcgaccggctgctggccggcttgcacggccgtggcatcaagctgatcctggacctggtgccgaaccacacctccgaccggcacccctggttcctggaaagccgaagttcgcgcgacaaccctagacgcgactggtacctctggcgcgatccggcaccgggcggcgggccacccaacaactggctgagctttttcggtggcccggcctggacctacgacgagaccaccggacaatactatctgcaccagttcacgccggagcagccggagctgaacctgcgccacccggccgtgctggaggcgatgctggaggtgatgcggttctggctggatcgaggcgtggacggcttccgggtcgacgtgccctggctgctgatcaaagacgccgggttccgagacgaaccggaaaatccggcctgggacggcatcgatccgcacggccggctgctccacatccatacggcgcatcagcccgaactgcaccgcatcatccgggccatgcgcgcggtcgtcgacggctatcccggcgagcgggtcttgatcggggagacaaacgtgccggaggaagaactcgtcaagtactatggcgcggcacgggacgaattccacctacccttcaacttccggctgatccatgccccctgggacgcgcggaaaatccggcagatggtcgaaacttacgaagcgatcctcccccaaagggcctcgcccgcctgggtgctcggcaaccatgaccagccccgcatcgccagccgcttcggtcccgacgcggcccgtgtcgccaccatgctgctgctgaccctgcgtggcacaccgacctgctattacggcgacgagttggggatggagaacggggtgatcccaagggaccgcatccgtgatccgcaggcattgaatcagcccgggatttcgggcgtgttcaatcgcgatgaggcacggaccccgctgccttgggacacctcgcccaatgccggcttcgcgcccgaaggcgtcgacccctggctgccgttgggggaggactggcccatgagaaacgttgcccggcaggcggcggacccccgctccatgctggcgctcttcagggctctgaccagactgcgccaatgccacccggccttgagccatggcagttacgaaagcgtggacacgaaggccgacggcgtcttcgcctacaagcggacggccggcgccgaacgcctcctcatcgtgctcgatttcgccggcagtgaacatctcctggactcgggcgaactcgccgatggcgcggagattctgctgagcaccggcatgcggcgcaccggccgggtcgatctgcggcggctccgtttgctctccaatgaaggtctcatactgaaaatatcttga

SEQ ID NO: 32905 - protein, 539 aa, Methylococcus capsulatus str. Bath
MTDGNGTLAWWQTGIIYQIYPLSFQDSDGDGRGDLPGILHRLDYLADLNIAAVWLSPVFASPMRDFGYDVADYTSIHPWFGTLSDFDRLLAGLHGRGIKLILDLVPNHTSDRHPWFLESRSSRDNPRRDWYLWRDPAPGGGPPNNWLSFFGGPAWTYDETTGQYYLHQFTPEQPELNLRHPAVLEAMLEVMRFWLDRGVDGFRVDVPWLLIKDAGFRDEPENPAWDGIDPHGRLLHIHTAHQPELHRIIRAMRAVVDGYPGERVLIGETNVPEEELVKYYGAARDEFHLPFNFRLIHAPWDARKIRQMVETYEAILPQRASPAWVLGNHDQPRIASRFGPDAARVATMLLLTLRGTPTCYYGDELGMENGVIPRDRIRDPQALNQPGISGVFNRDEARTPLPWDTSPNAGFAPEGVDPWLPLGEDWPMRNVARQAADPRSMLALFRALTRLRQCHPALSHGSYESVDTKADGVFAYKRTAGAERLLIVLDFAGSEHLLDSGELADGAEILLSTGMRRTGRVDLRRLRLLSNEGLILKIS

SEQ ID NO: 32906 - DNA, 1596 bp, Nocardia farcinica IFM 10152
  CDS (1)..(1596)
gtgacagcgacacctgccgtgccggatgatcctcgtcgttcctggtggcggtccgccgtgttctatcaggtctacccgcgctcgttcgccgattccgacggtgacggcgtcggcgatctcgggggcgtgcgcgagaagctcggctacctggaactgctcggggtgaacgccctgtggatctgcccggtgatgcggtcgccgatggccgacggcggctacgacgtgtccgacccccgcgacatcgaccccctcttcggcggcatggcggcgatggacgcgctgatcgccgaggcgcacgcgcgcgacatcaaggtcaccatggacctggtgcccaaccacaccagcgaccggcacccctggttcgccgaggcgctgcggtccgcgccgggcagccccgcccgcgcccgctacatcttccgcgacggccgcggcccggacggctcgctgccgccgaacaactggccgagcatcttcggcggcccggcctggacccgcgtcaccgaacccgacggcacccccgggcagtggtacctgcaccttttcgcccgcgaacagcccgacctgaactgggagaatcccgaggtcgtcgccgatttcgagaagacgctgcggttctggctggaccggggtgtcgacggattccgcatcgatgtcgcgcacgggatggccaagcccgccgacctgcccgacatggccgcggtctcgaccaagatgctcatccacgacgacagcgacccgcggttcaacaaccccggcgtgcacgacatccaccgccgcatccgcaaggtgctcgacgaatacccgcacgcggtgtccatcggtgaggtgtgggtggacgacaacacccgcttcggcgagtacgtgcgccccgacgaactgcacctggcgttcaacttccggctggccgagaccccgttccgggccgaggcggtacgggaggcgatcgagaactcgctggccgcggtggccgaggtcggcgccccacccacctggacgctgtccaaccacgacatcgaacgcgaggtgacccgttacggcggcggcgcgcgcggggtggcgcgggccagggcgatgatcctggtcgagctggcgctgccgggcgcggtgttcctttacaacgggtccgaactgggcctgcccaatgtggacgacctgcccgaggaggtgttgcaggacccggtgtgggagcgctccggccacaccgagcgcggccgcgacggctgccgggtgccgctgccctgggaaggggagcggccgccgttcggctttacccgcgccgagcgatcctggctgcccattccacccgaatgggccgacctcaccgtcgaagcccagctcgaacgcctcgactccaccctgtgcctgtatcgcatggccgtcgacctgcgcggcacccgcccggaattcgccggcgagggcctggaatggtacggctccccacccggccgcctcgccttccgccgccccggcggcctggtctgcgtcctcaacaccaccgaagaacccatccccctccccccgggcgaacccctcctcaccagcacccccctcgacaacggccacctccccccggacgccgccgcctggctcgtctga

SEQ ID NO: 32907 - protein, 531 aa, Nocardia farcinica IFM 10152
MTATPAVPDDPRRSWWRSAVFYQVYPRSFADSDGDGVGDLGGVREKLGYLELLGVNALWICPVMRSPMADGGYDVSDPRDIDPLFGGMAAMDALIAEAHARDIKVTMDLVPNHTSDRHPWFAEALRSAPGSPARARYIFRDGRGPDGSLPPNNWPSIFGGPAWTRVTEPDGTPGQWYLHLFAREQPDLNWENPEVVADFEKTLRFWLDRGVDGFRIDVAHGMAKPADLPDMAAVSTKMLIHDDSDPRFNNPGVHDIHRRIRKVLDEYPHAVSIGEVWVDDNTRFGEYVRPDELHLAFNFRLAETPFRAEAVREAIENSLAAVAEVGAPPTWTLSNHDIEREVTRYGGGARGVARARAMILVELALPGAVFLYNGSELGLPNVDDLPEEVLQDPVWERSGHTERGRDGCRVPLPWEGERPPFGFTRAERSWLPIPPEWADLTVEAQLERLDSTLCLYRMAVDLRGTRPEFAGEGLEWYGSPPGRLAFRRPGGLVCVLNTTEEPIPLPPGEPLLTSTPLDNGHLPPDAAAWLV

SEQ ID NO: 32908 - DNA, 1683 bp, Photobacterium profundum SS9
  CDS (1)..(1683)
atgatgacagagcataatgaatggtggcgtacagcgaccatttatcagatttatcctaaaagtttttgtgacagtggatgtcagggcacgggcgatattaaagggattatttcaaagctcggttatctccaaaagttaggtattgatgcgatttggttaaccccgatttattgttcaccgatgatcgataatggctacgatatatctgattactataatgtgaatccagattttggcactatgaacgatttcgacctgctattagatgaagcgcatcaaaaaggtatccgtattgttatggatattgtggttaatcatacctcgactgaacatgcatggtttaaatcggcactaggtaataagcaaagcccatatcgtgattattatatttggaaagatccggttgatggcgcagagccaacgaattgggcatctaagtttggtggcaatgcgtgggcattagacgaagcaaccaatcagtattacctgcacctttttgctaaagaacaagccgatttgaattgggaaaacccaaaagttcgggatgaagtgaaagaggtcattagcttctgggctgaaaaaggggtcgatggttttcgtttagatgtgattaatttaatctctaaacaacaagatttcccaaatgatcacatcggtgatgggcgttgtttctatactgatggcccacatgtacatgagtatcttagagatatcagtgaaagcgtttttcaaaaatacggttcagtaactgtgggtgaaatgtcatcgacaaccttggaacactgtcagcagtattcagcgaatgacggtaaagagttgtctatggtgtttaattttcaccatctaaaagctgattatgaaaatggtgaaaagtggaccaaagcaccgtttgattttctgcaacttaagcagatttttaaccattggcaacaaggcttaaacggcaaagggtggggcgctttattctggtgtaaccatgaccaacctcgtgtagtcagccgtttaggggatgatcagcaataccgagttgagtcagccaaaatgctcgcgacgtctattcatatgatgcagggtacgccgtatatttatcaaggtgaagaaattggcatgaccaacccagcttatacctcgatagaacaataccgcgatgtggaaagtaccaatatgtacgacattatggtaaatcaacaaggtgtaagtgaagcggatatgctcgctattttggcgcaaaaatcccgcgataacgcccgtaccccgatgcaatgggatgctaccgagcaagctggatttactcaaggaaagccttggctagctgttgcagaaaactatcacgagataaacgcgcagcaagccgttgaagatcccaactctgtattctatttctaccgtaagttgattgaattacgtaaagagattgcagtgatcacaacgggagattacagcgatttaatgccagataacatgcagctgttttgttatcgccgagagtcagaacaacaactgcttgtctgtattaacaattattatggtactgatattgagtgcgatctaccgtctgatattgatactactcaggggcgttatattttaggtaactatgaaggttatcaagatcgaacagcaagccaaacggtacgactaaaaccatatgaatgtttggtgctattaattgataaagtgtaa

SEQ ID NO: 32909 - protein, 560 aa, Photobacterium profundum SS9
MMTEHNEWWRTATIYQIYPKSFCDSGCQGTGDIKGIISKLGYLQKLGIDAIWLTPIYCSPMIDNGYDISDYYNVNPDFGTMNDFDLLLDEAHQKGIRIVMDIVVNHTSTEHAWFKSALGNKQSPYRDYYIWKDPVDGAEPTNWASKFGGNAWALDEATNQYYLHLFAKEQADLNWENPKVRDEVKEVISFWAEKGVDGFRLDVINLISKQQDFPNDHIGDGRCFYTDGPHVHEYLRDISESVFQKYGSVTVGEMSSTTLEHCQQYSANDGKELSMVFNFHHLKADYENGEKWTKAPFDFLQLKQIFNHWQQGLNGKGWGALFWCNHDQPRVVSRLGDDQQYRVESAKMLATSIHMMQGTPYIYQGEEIGMTNPAYTSIEQYRDVESTNMYDIMVNQQGVSEADMLAILAQKSRDNARTPMQWDATEQAGFTQGKPWLAVAENYHEINAQQAVEDPNSVFYFYRKLIELRKEIAVITTGDYSDLMPDNMQLFCYRRESEQQLLVCINNYYGTDIECDLPSDIDTTQGRYILGNYEGYQDRTASQTVRLKPYECLVLLIDKV

SEQ ID NO: 32910 - DNA, 1644 bp, Photobacterium profundum SS9
  CDS (1)..(1644)
ttgtccatgaaaatgaccccaaaatggtggcatgatgctgttgtttatcaggtttatccacgcagtttttgcgattcaaataacgatggcatgggtgatctgcaaggcatcatcagcaagcttgattacatcaaaaaattaggtgttaatgttgtttggttgtcacctgtttatcgttcaccaatggatgataatggttacgatatttctgactatcaagatatcgctgcagagttcggttcgatggaagatatgcagcaattacttgcagaggccaaacagcgcgatattcgcatcattatggatttagttgttaaccatacatctgatgagcacccatggtttatcgaatcacgtaaatcgaaagataacccatatcgtgattactatatttggcgtcagcctaatgaagatggttcagtgcctgatgatcaaggatctgtctttggcggtggtgcttgggaatttgatgacaccacgggtgaatattactaccacatcttctctaagagacaaccagacttgaactgggaaaaccccaaaattcaagaagaagtgcataagatgatgaactggtggatcgatcagggtattggtggtttccgtcttgacgttatcgatcttattggtaaagaaatcgataagaaaattacgggtaatgggcctcgtcttcacccgttgctgcaggaaatgaacaaagcaacgtttggtgataaagatctgcttactgtaggggaaacgtgggacgcgactcctgaaactgctaagttgtacagtaatcctgcacgtaatgagttttcaatggttttccagtttgagcatatttctctgacttggaagcaaggtgacaaatggaatccaattgcgcttgatctacctaaattcaaaaatgcgttaactaagtggcagattgagctggctgatgaggggtggaactcactgttctggaacaatcatgaccttcctcgtgcagtatcaaagtttggcgatgacggccagtatcgagttgaatccgctaaaatgctcgccacaacattgcatatgatgaaaggtactccgtatgtctatcaaggcgaagagatcggtatgacgaacgttgcgtttgacagcattgatgactaccgtgatatcgaaacattgaatttctacaaagaacgtacagaaaatggtgttgcacctgaaaccatgttggcagcggtacatgaaaatagccgtgataatggccgtacaccaatgcagtggaacaataataaaaatgcgggtttctcagagcagcaaccgtggttgcaggttaatcctaactatccagaaatcaacgtagatgctgcgctagaagatcagaactcgatcttctaccactatcaaaaattgattcaactgcgtaagtcattatcagtgattgtacatggtgcttttgaaccagtatttgaagatcatgaacaggtattcggttaccttcgttctgattcccaacatcgtttgtttgtacttaataactttacgggcgaagaagtcactgtttctatgccagagccgcttcaaactgaacatgccgaatgcattatttgcaactatgaatcacatcagcagttaagctcaaccttaaccttgaagccttttgagtcttttgctgttttgatttaa

SEQ ID NO: 32911 - protein, 547 aa, Photobacterium profundum SS9
MSMKMTPKWWHDAVVYQVYPRSFCDSNNDGMGDLQGIISKLDYIKKLGVNVVWLSPVYRSPMDDNGYDISDYQDIAAEFGSMEDMQQLLAEAKQRDIRIIMDLVVNHTSDEHPWFIESRKSKDNPYRDYYIWRQPNEDGSVPDDQGSVFGGGAWEFDDTTGEYYYHIFSKRQPDLNWENPKIQEEVHKMMNWWIDQGIGGFRLDVIDLIGKEIDKKITGNGPRLHPLLQEMNKATFGDKDLLTVGETWDATPETAKLYSNPARNEFSMVFQFEHISLTWKQGDKWNPIALDLPKFKNALTKWQIELADEGWNSLFWNNHDLPRAVSKFGDDGQYRVESAKMLATTLHMMKGTPYVYQGEEIGMTNVAFDSIDDYRDIETLNFYKERTENGVAPETMLAAVHENSRDNGRTPMQWNNNKNAGFSEQQPWLQVNPNYPEINVDAALEDQNSIFYHYQKLIQLRKSLSVIVHGAFEPVFEDHEQVFGYLRSDSQHRLFVLNNFTGEEVTVSMPEPLQTEHAECIICNYESHQQLSSTLTLKPFESFAVLI

SEQ ID NO: 32912 - DNA, 1611 bp, Rhodobacter sphaeroides 2.4.1
  CDS (1)..(1611)
atgtcggactggtggcgcgggtcggtgacctatcagatctatccccgctcgtttcaggattccgacggcgacggcgtgggcgacctgcgcggcatcatcgagcggctcgaccatgtggcctggctcggggccgatgcgatctggctctcgccgatctttccctcgcccatggaggacatgggctacgacgtgtcggactacaccgccatccacccgctcttcggctcgatggaggatttcgacgcgctcctcgctcgcgcgcacgagcttgggctgaaggtcatcatcgaccaggtgctcagccattcctcctcggcccatccgttcttccgcgagagccggcggagccgcgacaatcccaaggccgactggtatgtctgggccgacgcgcagcccgacggcagcccgccgaacaactggctgtcggtcttcggcggctcggcctgggaatgggatgcgcagcggcggcagtattacctgcacaacttcctgatctcgcagcccgacttcaacttccacaatcccgaggtgcaggactggctgctcgaccagatgcgcttctggcttgatcggggcgtggacggcttccgtctcgacacggtgaacttctacttccatgacgccgagctcaggtcgaaccggccgaacccgcagaacgggccgatcccgccggtcaatgcctacgacatgcaggaccatgccttctcgaagtcgcggatcgagaatatcgccttcctcctcaggatgcggaagctgctcgacgactacccggacagggcgatggtcggcgaggtggccgacgggctgcgcggccttgcgatcatggccgaatataccagcgggaccgaccggctgcacatggcctacacgttcgagatgctctcgcgcaccttcaccgccgggcatttccgcagccggatcgaggagttcttcgccaccgcaccgcagggctggccctgctgggccttttccaaccacgatgtggtgcgccatgcgacgcgctgggccggccacggggccgaggacgatgtggcgcggctcgcggcggccatgctcctgtccttcgagggctcggtcagtctctatcagggcgaggagctgggccagacagagaccgagctgctctatgaggagctgaccgatccgccgggcctccggttctggcccgaggagaaagggcgcgacggctgccgcacgccgatggtctgggacgacgggcccgcgggcggcttcaccaccggcacgccgtggcttccggtgaagccgccgcagctggcgcgcaacgtggcgtcgcagaagggcatccccggctcgctgctggagacctaccgggcgctcctgcagttccgccggagccagcccgcgctgatccgcggccgcagccggttcttcgacctgccggagccgatgctgggcttcacccggacgctcgacggccagtcgctcgcctgcttcttcaacctcggcatcgagccggtctcggcgaccctgccgggccatggcgggctgatcggcccggcacaggccgccgtgctcgagggcgaccgccttaccctcggggcgaacggctatgccttcctgcccgctccggaggatgccagcgtcagctga

SEQ ID NO: 32913 - protein, 536 aa, Rhodobacter sphaeroides 2.4.1
MSDWWRGSVTYQIYPRSFQDSDGDGVGDLRGIIERLDHVAWLGADAIWLSPIFPSPMEDMGYDVSDYTAIHPLFGSMEDFDALLARAHELGLKVIIDQVLSHSSSAHPFFRESRRSRDNPKADWYVWADAQPDGSPPNNWLSVFGGSAWEWDAQRRQYYLHNFLISQPDFNFHNPEVQDWLLDQMRFWLDRGVDGFRLDTVNFYFHDAELRSNRPNPQNGPIPPVNAYDMQDHAFSKSRIENIAFLLRMRKLLDDYPDRAMVGEVADGLRGLAIMAEYTSGTDRLHMAYTFEMLSRTFTAGHFRSRIEEFFATAPQGWPCWAFSNHDVVRHATRWAGHGAEDDVARLAAAMLLSFEGSVSLYQGEELGQTETELLYEELTDPPGLRFWPEEKGRDGCRTPMVWDDGPAGGFTTGTPWLPVKPPQLARNVASQKGIPGSLLETYRALLQFRRSQPALIRGRSRFFDLPEPMLGFTRTLDGQSLACFFNLGIEPVSATLPGHGGLIGPAQAAVLEGDRLTLGANGYAFLPAPEDASVS

SEQ ID NO: 32914 - DNA, 1647 bp, Rhodobacter sphaeroides 2.4.1
  CDS (1)..(1647)
atggatatcagccgcacgagcgatgtctggtggaagaacgccgtcttctattgtctcgatgtcgagacctttcaggacagcaacggcgacgggatcggagatttcgcggggctgacccggcggctcgaccatctcgaccggctgggggtgagctgcatctggctgatgcccttctatcccagcccgaaccaggacgatggctacgacatcaccgactattactccgtcgatccccgcctcggcacgctgggcgatttcgtcgagttcctgcgcgcggcccatgaccgcgggatgcgggtgatcgcggacctcgtggtgaaccacacctcgcgcgagcatccgtggttccaagcctcgcgcgccgatcccgattcgccctaccgcgactggtatgtctggcgcgatgagaaacccgacgaggatgccgcctcgctggtcttccccggagaagagaacagcagctggacctgggacgcgaaggcggggaaatactatctccaccgcttctacagccaccagccggacctgaatgtcgagaaccgcgcggtgcgcgacgagatccagcggatcgtgggcttctggctccagctcggcctgtcgggcttccgcgtggatgccgtgcccttcctgctcgagcagatgtcgacggtggacacgggcttcgcgccgcaccgctggctgcgcgacctgcgcgccttcatcaaccgccggtcgggcgatgcggtgcttctgggcgaggtgaacctcgactacccggacgtgcgccgcttcttcggcgacgaggatggcgacgagctgcacatgtgcctcgacttcaacctcaatcaggcgatggcgctggcgctggcccgcgaggatgcggggcccatcgtccacgggctgcgccacatgcccgaactcgcgcccgacgatggctgggcgcatttcctgcgcaatcacgacgaatggtcgctcgacaagctgaccgaggccgagcggcaggaggtcttcgcctccttcgggcccgatccctcgatgcagctcttcggacgcggcctgcggcggcggatgcccaccatgctgaagggcaatcccgaccggctgcggatggcctatgcgctgatggcctcgatgccgggctcacccgtgatcttctatggcgaggagatcggcatggcggaaaatctcgagatccccggacggctcgccgtgcgcgcgccgatgcagtgggatgccggcccgcatggcggtttctcgaacgcgagcaccgaggccctgcaccggcccatggtctcggatccgcaatggggacccgggaaggtcaatgccatcgaccagcaggaccggccggacacgatgttccacttcatggagcatctcctgcggcggcggcgggagtgccccgagatcgccttcggcgagcatgccgtgctgccgtttcccgagcccgagatcttcgccatccggcacgactgggagggccgtacgctcatcgctctcgccaatctcggcgcaaagccgcagaaggtgacgctcacgctgccgaaggcctcggggctgggcaggctgcggcccatcctcggcgaggggaaggtctcgctgcgcaaagacgagctgacggtcgagctcgggggctacgggctgcgctgggtgcggttcgagagctga

SEQ ID NO: 32915 - protein, 548 aa, Rhodobacter sphaeroides 2.4.1
MDISRTSDVWWKNAVFYCLDVETFQDSNGDGIGDFAGLTRRLDHLDRLGVSCIWLMPFYPSPNQDDGYDITDYYSVDPRLGTLGDFVEFLRAAHDRGMRVIADLVVNHTSREHPWFQASRADPDSPYRDWYVWRDEKPDEDAASLVFPGEENSSWTWDAKAGKYYLHRFYSHQPDLNVENRAVRDEIQRIVGFWLQLGLSGFRVDAVPFLLEQMSTVDTGFAPHRWLRDLRAFINRRSGDAVLLGEVNLDYPDVRRFFGDEDGDELHMCLDFNLNQAMALALAREDAGPIVHGLRHMPELAPDDGWAHFLRNHDEWSLDKLTEAERQEVFASFGPDPSMQLFGRGLRRRMPTMLKGNPDRLRMAYALMASMPGSPVIFYGEEIGMAENLEIPGRLAVRAPMQWDAGPHGGFSNASTEALHRPMVSDPQWGPGKVNAIDQQDRPDTMFHFMEHLLRRRRECPEIAFGEHAVLPFPEPEIFAIRHDWEGRTLIALANLGAKPQKVTLTLPKASGLGRLRPILGEGKVSLRKDELTVELGGYGLRWVRFES

SEQ ID NO: 32916 - DNA, 1671 bp, Leuconostoc mesenteroides subsp. mesenteroides ATCC 8293
  CDS (1)..(1671)
atggaaaaagtacagtggtggcagaatactgttgtctaccaaatttatcccaggagctttcaagatagtaacggagatggtgtgggggatatacccggcattattgaacgattaccctatttgaaagctcttggtgtccaagtgatttggctaagtccaatttatcagtcgccaaatgatgataatggctatgacattagtgattatcgtaaagttttaccggaatttggaacaatggcagatgttcaagaaatgctcgaggtagcacatcatttaggtctaaaaattatgatggatttggtcgtcaaccatacttctgatgaacatcaatggtttaaagagagtcgtaaaaacaaggataatccttatcgcaattattacatttggcgtgatcctgtggatggtcacgaacctaataattggttgtcagactttggtggatcagcatgggaatttgacaataatacacaacagtattatttgcatttattctcaaagaagcaaccagatcttaattgggataaccccgatttacgacaagatatttacgacacaatgaaatggtggttagatcaaggtgttgatggttttcgcatggatgttattaacctaatttcaaaaccatcagatttaccaaatgatccaaatgtcaccttagaaaatcatggctcatcgatggattttgttgctaatggtccaaatattcatgattatttacaagaaatgaatcaagaagtattgtcaaagcatgatatcatcactgttggtgaaacgccaggcgtatcaacaaaggatgcaatgaaatatgccggatttgattcgcatgagttgcagatgattttccagtttgaacatactgaggttgataacagtcatgagggattaggcaaatggagtgatgaacgcttcaatctggttgatttaaagcgtattttatccagatggcaaaatgagttgtatggtaaggcttggaacagtctttattggaataatcatgatcgaccaagagtagtctcacgatttggaaatgattcagatgaatatcgcgtattgtctgctaaaatgttggctgcaactttacattttatgcagggaacaccttatatttaccaaggtgaagaaattggtatgaccaatattgacttaccatctattaaagactaccgagatattgataccttgaatgcatatgatgacttagttgtccaacaaagacgagttactgctgataaaatgatgtcttatgttcatcattcttcaagagacaatgcacgaacaccaatgcaatgggataacactaaaaatgccggatttactgaaagtcacccatggttaagtgttaatcctaattaccagaccatcaatgtggcagattcattaactgatcaacagtcagtctttcatttttaccaaaagctcatcgccttaaggcaagagttatccattatcacgactgggaagtatgaagtgttggatttagaagacgaatctgtttacgcttacaagcggattgacaaagacacgcaattactggttattagcaattttactgatcaaaagcaaacacgtcattacgatcgaacccaatctgcacaattagttataagtaattattcagatgatcaaggtgacacactcagaccttacgaatcaaaagtatatttgttttaa

SEQ ID NO: 32917 - protein, 556 aa, Leuconostoc mesenteroides subsp. mesenteroides ATCC 8293
MEKVQWWQNTVVYQIYPRSFQDSNGDGVGDIPGIIERLPYLKALGVQVIWLSPIYQSPNDDNGYDISDYRKVLPEFGTMADVQEMLEVAHHLGLKIMMDLVVNHTSDEHQWFKESRKNKDNPYRNYYIWRDPVDGHEPNNWLSDFGGSAWEFDNNTQQYYLHLFSKKQPDLNWDNPDLRQDIYDTMKWWLDQGVDGFRMDVINLISKPSDLPNDPNVTLENHGSSMDFVANGPNIHDYLQEMNQEVLSKHDIITVGETPGVSTKDAMKYAGFDSHELQMIFQFEHTEVDNSHEGLGKWSDERFNLVDLKRILSRWQNELYGKAWNSLYWNNHDRPRVVSRFGNDSDEYRVLSAKMLAATLHFMQGTPYIYQGEEIGMTNIDLPSIKDYRDIDTLNAYDDLVVQQRRVTADKMMSYVHHSSRDNARTPMQWDNTKNAGFTESHPWLSVNPNYQTINVADSLTDQQSVFHFYQKLIALRQELSIITTGKYEVLDLEDESVYAYKRIDKDTQLLVISNFTDQKQTRHYDRTQSAQLVISNYSDDQGDTLRPYESKVYLF

SEQ ID NO: 32918 - DNA, 1731 bp, Azotobacter vinelandii
  CDS (1)..(1731)
atgggcactccgaacacaggcagcgacacggcgcgagaagacgttgcaaaaactccggccgcgcgccccgacgcgccctggtggaaggaggcggtcgtctaccaggtctatccgcgctcgttcaacgacacgaacggcgacggcatcggcgacctgaacggcatcacggcgaagctggattacctgaaggcactaggcgtcgacacgatctggctgagcccgcacttcgactcgcccaacgccgacaatggctacgacatccgcgattaccgcaaggtgatgagcgaattcggcgacatggacgacttcgagcgcctgctcgccgggatgaacaagcgcggcatgcgcctgatcatcgatctggtggtcaaccacagcagcgacgagcatcgctggttcgtcgagagccgccggtcgaaggacaacccctatcgcgactactacacttggcgcgacggcaaggacggcgctgcgccgaacaactatccgtcgttcttcggcggctcggcctggaagaaggacgaggccacggggcagtactacctccactacttcgccggcaagcagcccgacctgaactgggaaaaccccgaggtccgcgccgaggtccacgacatcatgcgcttctggctggacaagggcgtgtccggcttccgcatggacgtgattcccttcatctccaaacaggacggcctgcccgacctgcctgcgcaagccctggcccatcccgagttcgtctacgcgaacggcccgcgcatccatgagtatctccaggaaatgaaccgcgaagtcctgtcccgctatgacaccatgacggtcggcgaagccttcggcatcaccttcgaacaggccccgctgttcaccgacgcccgccgtcacgaactgaacatgatcttccatttcgacctggtgcggctggaccgcgacggctggcgcaaaaaggactggacgctgcccgagctcaaggcgacctacgcgcggatcgaccgcaccggcggcgaccatggctggaacaccagtttcctgggcaaccacgacaatccccgcgccgtttcccatttcggcgacgacagccccgaatggcgcgccgcctcggccaaggcgctggcgaccatgatgctcacccagcgcgccacgcccttcctctaccagggcgacgaactgggcatgaccaactatcccttccgcggcctcgaggactacgacgatgtcgaagtgaagggccaatggcgcgacttcgtggaaagcggcaaggtgtcggcggacgagtatctcgcccacctgcgccagaccagccgcgacaacgcccgcaccccgatgcagtggagcgacgcgccgaacggcggcttcaccaccggcaagccctggcttgcggtcaacccgaactatccgcaggtcaatgcggcatcccaggtcgacgatcccggctcgatctaccatcactaccgtcgcctgctggaagtgcgccgccagacccccgcgctcatccacggccagttccgcgatctcgatccggccaatcccaaggtcttcgcctacacgcgcacgctcgacgacaagcgctatctggtgctgatcaacttcacccgcgagacggtcgcctacgacctgccggaaggactgaagatcgccgccacgctgctggacaacggcgccgcgcaagagtcgatgcaacccggcgccgcgagcgtaacgctccagccctggcaggcgacgatctaccggctctga

SEQ ID NO: 32919 - protein, 576 aa, Azotobacter vinelandii
MGTPNTGSDTAREDVAKTPAARPDAPWWKEAVVYQVYPRSFNDTNGDGIGDLNGITAKLDYLKALGVDTIWLSPHFDSPNADNGYDIRDYRKVMSEFGDMDDFERLLAGMNKRGMRLIIDLVVNHSSDEHRWFVESRRSKDNPYRDYYTWRDGKDGAAPNNYPSFFGGSAWKKDEATGQYYLHYFAGKQPDLNWENPEVRAEVHDIMRFWLDKGVSGFRMDVIPFISKQDGLPDLPAQALAHPEFVYANGPRIHEYLQEMNREVLSRYDTMTVGEAFGITFEQAPLFTDARRHELNMIFHFDLVRLDRDGWRKKDWTLPELKATYARIDRTGGDHGWNTSFLGNHDNPRAVSHFGDDSPEWRAASAKALATMMLTQRATPFLYQGDELGMTNYPFRGLEDYDDVEVKGQWRDFVESGKVSADEYLAHLRQTSRDNARTPMQWSDAPNGGFTTGKPWLAVNPNYPQVNAASQVDDPGSIYHHYRRLLEVRRQTPALIHGQFRDLDPANPKVFAYTRTLDDKRYLVLINFTRETVAYDLPEGLKIAATLLDNGAAQESMQPGAASVTLQPWQATIYRL

SEQ ID NO: 32920 - DNA, 1698 bp, Azotobacter vinelandii
  CDS (1)..(1698)
atgagtgcagtgaatccatccctggaaaccgtccgagacggtgcatccgccgacgccccccgggcagccgaggccgggctggcctggtgggctgacgcgatcatctatcagatctacccgcgctccttcgccgacgccaacggtgacggcatcggcgatctgccgggcatcacctcgcggctgccctacctgaagcgcctgggtgtggatgcactgtggctatcacccttctataaatcgccccaggccgacgccggctacgacgtggccgactaccgggtggtcgatccgctgttcggcacgctggaggatttcgatcggctgctgcacgaggcccatggcctgggcatcaaggtgatcgtcgacctggtgcccaaccacacttccgacgagcatgcctggttccgggcggcattgcagtcgccgccgggcagcgccgagcgcgcccgctacctgttccgcgacggccgcggtgaaaacggcgagttgccacccaacaactggcagagcgtgttcggcggcgcggcctggtcgcgggcgccgggcgaccggcattggtatctgcacctgttcgacggcaagcagcccgacctcaactgggacaacccgcaggtgcgggccgagttcgaggacgtgctgcgcttctggctggaccgaggcgtggacggctttcgggtcgacgtggcgcacggcctggtcaaggactcggaactacccgatgcggagcagcgcaaggaaaaccgcgtactggtcggccccatgtgggaccaggacggcgtgcacgagatctaccgcgcctggcaccgcatcctggaccagtacccgggcgagcgcatgatggtggctgaggcctgggttaccccgcaagaacgcctgacccactacatccgctccgacgagatgcaacaggcgttcaacttcgactacctgctgctcgaaaactgggatgcgggcaccttcaaaagcgtcatcgacgcctcgctgagcctggcggccgaggtgagcgcgacgaccacttgggtgacctccaaccacgacgtcgtgcgcgcgccttcgcgctatggcctgagccggcccggcgcccatcccaagggtatcgacgcggccggcgaacagccgaacgaggccctgggcctgcgccgcgcccgcgcccttgccttgctcaccctggccctgcccggctcggcctatatctatcagggcgaggaactgggcctgcccgaacacacgaccctggaggcccgttaccgccaggaccccatgttcatccgcacccatggcgcggacatcggtcgcgacggctgccgggtgccgctgccctggagggcggatgctccgtccctcggcttcggcccgggcgacaggagttggctgccgcaaccggccacgtacgcgcattacaccgtggatcgccaggagggcgtggccggctccaccttggagctgtaccggcagatgctgcggctacgccgtgaacatgcacttggcaaaggccagttgcgctgggtcgacaccgaccgtgacctgctggtcttcgacaacggcgacgtccgcgtcctgatcaacttcgggacacaaaccagggcactgccggcaggtggacagatactgctgtccagcgagccgttgaaggagcccagcaaactacctggcaatacagcagcctggttgacgggatcgtgcccgtcctcaagttga

SEQ ID NO: 32921 - protein, 565 aa, Azotobacter vinelandii
MSAVNPSLETVRDGASADAPRAAEAGLAWWADAIIYQIYPRSFADANGDGIGDLPGITSRLPYLKRLGVDALWLSPFYKSPQADAGYDVADYRVVDPLFGTLEDFDRLLHEAHGLGIKVIVDLVPNHTSDEHAWFRAALQSPPGSAERARYLFRDGRGENGELPPNNWQSVFGGAAWSRAPGDRHWYLHLFDGKQPDLNWDNPQVRAEFEDVLRFWLDRGVDGFRVDVAHGLVKDSELPDAEQRKENRVLVGPMWDQDGVHEIYRAWHRILDQYPGERMMVAEAWVTPQERLTHYIRSDEMQQAFNFDYLLLENWDAGTFKSVIDASLSLAAEVSATTTWVTSNHDVVRAPSRYGLSRPGAHPKGIDAAGEQPNEALGLRRARALALLTLALPGSAYIYQGEELGLPEHTTLEARYRQDPMFIRTHGADIGRDGCRVPLPWRADAPSLGFGPGDRSWLPQPATYAHYTVDRQEGVAGSTLELYRQMLRLRREHALGKGQLRWVDTDRDLLVFDNGDVRVLINFGTQTRALPAGGQILLSSEPLKEPSKLPGNTAAWLTGSCPSSS

SEQ ID NO: 32922 - DNA, 1824 bp, Bifidobacterium longum DJO10A
  CDS (1)..(1824)
atgatgactactttcaaccgcgcaataatccccgacgccatccgcaccaacggcgccacccccaatccgtggtggtccaacgcggtggtctatcagatttacccgcgctctttccaagacacgaacggcgatggattcggcgatcttaagggcatcacgtcgcgtcttgattacttagctgatcttggcgtggatgtgctgtggctatccccggtctataagtctccgcaagacgacaacggctatgacatttccgactatcaggacattgatcctctgttcggcacgctcgacgatatggacgagctgctggccgaggcccacaagcgtgggctcaagatcgtgatggatcttgttgtcaatcacacttccgatgaacacgcctggtttgaagcatccaagaacaaagacgacgaacacgccgactggtattggtggcgtccggctcgtcccggcaccacgcccggcgagcccggcgccgagcccaatcagtggggctcctactttggcggctccgcatgggaatactgccccgagcgtggcgaatacttcctgcatcagttctcgaagaagcagccggacctcaactgggagaaccctgccgtgcgccgcgctgtgtacgacatgatgaactggtggcttgaccgaggcgtcgacggcttccgcatggacgtcatcaccctgatctccaagcgcaccgattcgaacggcaagctgccgggcgagtacggctcggagcttgaggatcttcctgtgggcgaggagggctattccaacccgaatccgttctgtgcggacggcccccgtcaggatgaattcctggctgaaatgcgacgtgaggtattcgaggggcgtgaaggcttcctgactgtgggcgaggcgccaggcgtcacggctcagcgtaacgagcacattactgatccgggcaacggtgaattggacatgctcttcctgttcgagcatgttgattttgattgcgaaggtaccaagtggaagccgctgccgcttgacctgccgaaattcaagagcattatggccggttaccagactgccgtgcagaacgcaggatgggccagcttgttcaccggcaatcatgatcagccgcgcgtggtctcccgctggggcgacgactccgcggaggaatcccgcgtccgttcggccaaggcacttggcctgatgctgcacatgcaccgcggcaccccgtacatctatcagggtgaggaactgggcatgaccgacgcccacttcacgcgtctcgaccagtaccgtgaccttgaatccttgaatgcctaccggcagagggtcgaggaggccaaggtgcagtcgtctgagtcaatgatggccggtctggccgcgcgcagccgtgacaacgcgcgtactccgatgcaatgggacggttccggctacgccggtttcaccgctccggacgccgccactgagccatggatttccgtgaatccgaatcatgccgagatcaacgccgccggtgaattcgatgatccggattcggtgtactccttctacaagcaactcgttgcgctgcgtcacaacagcccggtcgtggccgccggcgactggcgactgattgacgccgctgatccgcacgtctatgcctttacccgtgagctcgacgctgagaagttgttggtcgtagtcaatatgtccagtcgaaccgttgacctgccacgtgaggctgccgaactaaccgccgtcggaatcgccgagccgaatgtggtgatcagcacgtatgacgctccgcacaccgtggcctcccttgccaaccgcgagctcgacccgtgggaggcagccgtcatccagttgtag

SEQ ID NO: 32923 - protein, 607 aa, Bifidobacterium longum DJO10A
MMTTFNRAIIPDAIRTNGATPNPWWSNAVVYQIYPRSFQDTNGDGFGDLKGITSRLDYLADLGVDVLWLSPVYKSPQDDNGYDISDYQDIDPLFGTLDDMDELLAEAHKRGLKIVMDLVVNHTSDEHAWFEASKNKDDEHADWYWWRPARPGTTPGEPGAEPNQWGSYFGGSAWEYCPERGEYFLHQFSKKQPDLNWENPAVRRAVYDMMNWWLDRGVDGFRMDVITLISKRTDSNGKLPGEYGSELEDLPVGEEGYSNPNPFCADGPRQDEFLAEMRREVFEGREGFLTVGEAPGVTAQRNEHITDPGNGELDMLFLFEHVDFDCEGTKWKPLPLDLPKFKSIMAGYQTAVQNAGWASLFTGNHDQPRVVSRWGDDSAEESRVRSAKALGLMLHMHRGTPYIYQGEELGMTDAHFTRLDQYRDLESLNAYRQRVEEAKVQSSESMMAGLAARSRDNARTPMQWDGSGYAGFTAPDAATEPWISVNPNHAEINAAGEFDDPDSVYSFYKQLVALRHNSPVVAAGDWRLIDAADPHVYAFTRELDAEKLLVVVNMSSRTVDLPREAAELTAVGIAEPNVVISTYDAPHTVASLANRELDPWEAAVIQL

SEQ ID NO: 32924 - DNA, 1671 bp, Bifidobacterium longum DJO10A
  CDS (1)..(1671)
atgactttcaccaacaatgactggtggcgcgatgccgtcatctaccagatttacccccgctcattcagcgatgccaatggagacggcaacggtgatctccaaggcgtgatcgatcgtctcgactatctgcaggcgctcggggtggacgcgctctggctttctccattctatccatcgccgctggcggatggaggttatgatgttgccgactattgtgatgtggatccccgccttggcacactcgatcagttcgacgaattagtggccaaagcgcacgaacgcggtatcggcatcatcgtggacatcgtgccgaaccacacgtccgatcagcaccgttggttccaagaggccctggctcaaggtccggaatcggaagcggcacaacggtatgtgttccggcagggcaagggggagcacggcgaattgccgcctaccaactggctgagtaacttcggcggttccgcatgggagtcgtgtggagacggctggtactacctgcatctgttcgccaaggagcagccggacctcaattgggacaatcccgaggtgcggcatgagttcctgcgtgtactcacattctggtgcgatcgcggtgtggacggtttccgcatcgatgtctcgcacggtctggccaaagacctgcgtgagccgctgcgcgaccgtatcgacccgacactgatgtctccacaggctaccgatggctccgatccgctctgggaccgcgacgccgtgcatgatatctaccgtgaatggcgcgacctgttcaatcagtacacgccagccaagtatgcggtcggcgaatcgtggtcgccattcaccacccgtattttccaatacgccaagcctgatgaacttggtgccgtattcgacttctccatgtcaaaggccgcctggaatcgcgaagaataccgcaccacgattgagcgcacgcatcgctatgctctcgctgccgaaaccgcccccacctgggtgctcggcaaccacgatgtgccacgtatcgcctcgcgtctcggactgccgagcggtgcaaacatcgagcagtgggtgacgtccaacggcacgaatccgccgattgaccccgcgctcgccgctcgtcgtgcccgtgcagcagcgctggtgatgctcggcctgccaggtaccgcctttgtgtatcagggtgaagagcttggtttgccggaggactttgatttgaccgaagatgaaattcaggatcccaattgggaacgttccggtcattatttcaaggggcgcgacggttgccgcgtaccgctgccgtggcagtcagacggcccggcgttcggcttcaatgccaccggtgcttcgtggctgccccagccggcatggtttgcgcagtatgccactaatcgtcagattggtgacggggcttccgtcctgcacctgtattgtgctgctgtcgcattgcgcaaacagtgggtggccaacggcacggacttccagttctcgtggcttaccaacgaagagtgtccggcgccgctgcttggttggcgcttgccgtccggcatggttgtgatggcgaacttctctgacagtcaaccagtcgccttgccgcagccgatgaccgtgctacttgtgtctgacgcgactgtgcaggcgaacactcaggtcgagagcgttcctccagctgctaccgtctgggccttgccagcataa

SEQ ID NO: 32925 - protein, 556 aa, Bifidobacterium longum DJO10A
MTFTNNDWWRDAVIYQIYPRSFSDANGDGNGDLQGVIDRLDYLQALGVDALWLSPFYPSPLADGGYDVADYCDVDPRLGTLDQFDELVAKAHERGIGIIVDIVPNHTSDQHRWFQEALAQGPESEAAQRYVFRQGKGEHGELPPTNWLSNFGGSAWESCGDGWYYLHLFAKEQPDLNWDNPEVRHEFLRVLTFWCDRGVDGFRIDVSHGLAKDLREPLRDRIDPTLMSPQATDGSDPLWDRDAVHDIYREWRDLFNQYTPAKYAVGESWSPFTTRIFQYAKPDELGAVFDFSMSKAAWNREEYRTTIERTHRYALAAETAPTWVLGNHDVPRIASRLGLPSGANIEQWVTSNGTNPPIDPALAARRARAAALVMLGLPGTAFVYQGEELGLPEDFDLTEDEIQDPNWERSGHYFKGRDGCRVPLPWQSDGPAFGFNATGASWLPQPAWFAQYATNRQIGDGASVLHLYCAAVALRKQWVANGTDFQFSWLTNEECPAPLLGWRLPSGMVVMANFSDSQPVALPQPMTVLLVSDATVQANTQVESVPPAATVWALPA

SEQ ID NO: 32926 - DNA, 1635 bp, Exiguobacterium sp. 255-15
  CDS (1)..(1635)
atgacaaccgactggcgtaaatccgccgtctatcaaatctatccaaaaagtttttacagtccggaaggcaaaccgaccggcactttacgcggcgtgaccgcaaaactcgattacttggcggagctcggcgtcgattatctttggctgacgccggtctacgcgtcaccacagcgcgacaacggctatgacgtcagtgactattatgcgattgatccgtcttacggcacgatgacagacttcgatcaattgattgcggaagccggtaaacgccagttatccgtcatgatggatatcgtcgtcaatcactgttcgaccgatcacgagtggttccggcaaggacgacatccggacagcccctaccacgactacttcatctggcgggacgaaccgacggattgggtatcgaaattcggcggacctgcctggtcgtttgacgaggtggccggcaagtattacctgcatctgtttgacgaaactcaggccgatctcaactgggaaaacccggcactccgggaagctgtctatcagatgatgtgcttctggcgtgataaaggtgtccgcggtttccggctcgatgtcatcaacttgatttcaaaagacgacagtttcgccaatgacccgaccggtgacggacggaaacactacacggacggtccacgtgtccatgactatctgcaggagatgaatcaacgcgtctttgccggtcatgatttaatgaccgtcggcgagatgtcgtcgacgacactcgatcattgcctccgttattcgaatctgaatgagcaggagctgaagatgacgttcaacttccatcatctgaaagtcgattatccgaacggggagaaatggacggcggcgccgttcgatttcctggaactgaaacggattatctccgactggcaggtcggaatgcagggaaatgcctggaatgcgattttctggtgtaatcatgatcagccccgtgtcgtcagccggtttggggacgatacggtttaccgggtcgaaagtgcgaagatgctcgcgacgacgttgcacggtttgcaaggaacaccgtacatctatcagggcgaggaaatcggtacaccgaatccggacttcacggatctgaccgattaccgggatgtcgagacactgaacgcgtataccgaaaaagcggcgcttagggagacggaagcagacattttggcagccatccgtcagaaatcccgcgataatgcccggacaccgatgcagtgggacgcttcaccgcacgccggtttctcgacagcgacaccgtggattccggttcctgaaaaccatacctcgatcaatgtcgaagcggctctcgccgacccggactcggtcttctatcattacaagcagctgattcacctgcgcaaacagtatgacgtcttgacgaacggaagttaccggcttctgacaccggacgatctctcgctttgggcgtacgaacgggcgaccgacgacgaacaacttctcgtcctgtcgaacttttacggcacggaccgtccgttcacgttaccggacgagtggctcgactatcaggtattgattcagaactatccggaggtttcagagaaatccggacagcttatcttacggccatacgaatccgtcatgctgtaccggacggtctga

SEQ ID NO: 32927 - protein, 544 aa, Exiguobacterium sp. 255-15
MTTDWRKSAVYQIYPKSFYSPEGKPTGTLRGVTAKLDYLAELGVDYLWLTPVYASPQRDNGYDVSDYYAIDPSYGTMTDFDQLIAEAGKRQLSVMMDIVVNHCSTDHEWFRQGRHPDSPYHDYFIWRDEPTDWVSKFGGPAWSFDEVAGKYYLHLFDETQADLNWENPALREAVYQMMCFWRDKGVRGFRLDVINLISKDDSFANDPTGDGRKHYTDGPRVHDYLQEMNQRVFAGHDLMTVGEMSSTTLDHCLRYSNLNEQELKMTFNFHHLKVDYPNGEKWTAAPFDFLELKRIISDWQVGMQGNAWNAIFWCNHDQPRVVSRFGDDTVYRVESAKMLATTLHGLQGTPYIYQGEEIGTPNPDFTDLTDYRDVETLNAYTEKAALRETEADILAAIRQKSRDNARTPMQWDASPHAGFSTATPWIPVPENHTSINVEAALADPDSVFYHYKQLIHLRKQYDVLTNGSYRLLTPDDLSLWAYERATDDEQLLVLSNFYGTDRPFTLPDEWLDYQVLIQNYPEVSEKSGQLILRPYESVMLYRTV

SEQ ID NO: 32928 - DNA, 1701 bp, Exiguobacterium sp. 255-15
  CDS (1)..(1701)
atgacacaaatgataccgcgtccggaaacggcacaaaaaacacttacacgagcttggtggaaagaagccgttgcttaccaaatctatccgcgcagcttttatgatgcaaacaatgatggaatcggcgatatcccgggtatcattgccaagttggattatctaaaagatctcggagtcgatgtattatggatttgcccaatgtttaaatcaccgaatgatgacaacggatatgacatcagtgattatgaagacatcatggacgaattcggaacgatggccgattttgatttattaatggaagaagcacataaacgtgacattaaagtattactcgatttggtcgtcaaccacacgtcggatgaacacccgtggttcctcgaatcccgttcgtcaaaagacaacgacaaacgggattggtacatctggaaagatgccgtcaacggtggcgaaccgaacaactgggaaagtattttcggaggatcggcttgggaatacgacgaaaaaacggaacaatacttcctccacgttttctcacgccgtcagccggacttgaactggcgtaataaagacatgcgtcaggccgtctatacgatgatcaactggtggctcgataaaggggtcgacggattccggatcgatgccatcagccacattaacaaagatcaatcgtacgcggatcttccgaatccactcgggatgccgcatgtgccatcgtttgagatgcacatgaatgtcgaaggaatccacgaataccttgaagaattgaaaaacgagacgttctcaaaatacgacatcatgacagtcggtgaagcgaacggtgtaacgcctgaagaagccgatctttgggtcggagaagaaaacggtaagatgaacatggtcttccagtttgaacacatggacctgtggcgggctgacgcggaaaaaggcgtcgacgttgtcaaactgaaacaagttttgacgaaatggcaaaaaggacttgaagaaacaggctggaacgcactgtatcttgaaaaccacgataaggtccgctccgtctccctttggggtgatgaaggacaatactggaaacaaagcgcgaagtcacttgcgatgatgtatttcttcatgcaaggaacaccgttcatctatcaaggacaagaaatcgggatgacgaacgtccagttcccggatatctccgactacgatgatgtcgcgacgaaaaacatgtacaacatgcaactggcatcagggaaaacacatgaagagatcatggaagtcatctggaactcgtcgcgtgataactcccggacaccgatgcagtggacaaatgaacaaaacggcggtttctcggaacaatccccatggttcggtgtcaatccgaactttgccgacatcaacgtggcggcgcagcaagccgatgaggattcgatcctgaacttctataaacggatgattcaaatccggaagatggaagagacgttgatttacggagaatacgatctcattcttccggaagatacaaaagtctatggttacacgcggacgctcggaaacgaacagttcctgattgtgacgaacctgaaagacgaagtggcggaagtcgacaccgacatcatcctccattcggataacatcatgcttgcgaactatgagacaacgtatcatgaaggaaccgaactcacgcttcaaccttttgaagcacgcctgtaccgcgtacgttaa

SEQ ID NO: 32929 - protein, 566 aa, Exiguobacterium sp. 255-15
MTQMIPRPETAQKTLTRAWWKEAVAYQIYPRSFYDANNDGIGDIPGIIAKLDYLKDLGVDVLWICPMFKSPNDDNGYDISDYEDIMDEFGTMADFDLLMEEAHKRDIKVLLDLVVNHTSDEHPWFLESRSSKDNDKRDWYIWKDAVNGGEPNNWESIFGGSAWEYDEKTEQYFLHVFSRRQPDLNWRNKDMRQAVYTMINWWLDKGVDGFRIDAISHINKDQSYADLPNPLGMPHVPSFEMHMNVEGIHEYLEELKNETFSKYDIMTVGEANGVTPEEADLWVGEENGKMNMVFQFEHMDLWRADAEKGVDVVKLKQVLTKWQKGLEETGWNALYLENHDKVRSVSLWGDEGQYWKQSAKSLAMMYFFMQGTPFIYQGQEIGMTNVQFPDISDYDDVATKNMYNMQLASGKTHEEIMEVIWNSSRDNSRTPMQWTNEQNGGFSEQSPWFGVNPNFADINVAAQQADEDSILNFYKRMIQIRKMEETLIYGEYDLILPEDTKVYGYTRTLGNEQFLIVTNLKDEVAEVDTDIILHSDNIMLANYETTYHEGTELTLQPFEARLYRVR

SEQ ID NO: 32930 - DNA, 1554 bp, Rubrobacter xylanophilus DSM 9941
  CDS (1)..(1554)
atggtctaccacatctacccccgcagcttcgccgacgcgagcggcgacggggtgggcgacctcgagggcatcgcctcccgcctggactacctggagtggctcggggtcgacgccatctggctctcccccttctacccctcccccatggcggacttcggctacgacatctccgaccactgcgccgtggaccccctcttcggcacgctcgcggacttcgacgagctggtcgcggagacgcaccggaggggcatgcgcctcatcgtcgactacgtccccaaccacacctcggacgagcacccgtggtttttggagtcccgcgcctcgcgcgagagcccgaggcgcgactggtacatctgggccgacccgaagcccgacggctcgccgcccaacaactggcggagcgtcttcgggggttctgcgtgggagtgggacgagagaacggggcagtactactaccacgccttccaccgcaagcagccggacctcaactggcgcaaccccgcggtgagggaggcgatgcacggggtgatgcgcttctggctggagaggggcgtggacggcttccgggtggacgccctgcgccacctcgtaaaagacgagaagctccgggacaacccgcccaacccggcctacgaggagggtcggccctcctacgaggcccatctccccgtctacaccaccgaccgcccggaggtgcaccggatgatctccgggatgcgccgcgtcctcgacggctgcggcggggagcgggtgatgatcggcgagctctacctgccgttcgacaggctcgtgctctactacggggagggggggcgcggggtccacctgccgacgaacatgcacctcatcacgacgccctggagcgccccctccctcgccgccctcatctccgagtacgaggcggccctccccccgcacggctggcccaactgggtcctgagcaaccacgacaacccccgcgtcgccacccgggtcggcccggagagggcgcgggcggccgccgtgctgctcctcaccctgcgcgggacccccacggtctactacggcgacgagatcggcatggtcgacgggaagatcccgccggagcgtctccgcgacccggccggctcgcagaacccgcgcctcagccgcgacccggcccgcaccccgatgcagtgggacgcctccccgaacgccgggttctgcccgccggacgccgagccctggctcccgctctcccccgaccgccgccaccgcaacgtcgccgcgcagagggagagccggggctccctcctctgcctctaccgcaggctcctgcgcctccgccgctcggagcccgccctctccgtgggctcctacgagccgctcgaggccgggggctccctgctggcctacgcccgcagccacgccgggcgccgcctcctcgtcgccctgaacctgggcgaggcccccgagcccctgccgccggtcctccgggggcgcgtcctgctctccacctctcccgggcaggagggcggagacctccgcccccccgcccggctcggccccggcgaggccctcgtcgtggcgccctag

SEQ ID NO: 32931 - protein, 517 aa, Rubrobacter xylanophilus DSM 9941
MVYHIYPRSFADASGDGVGDLEGIASRLDYLEWLGVDAIWLSPFYPSPMADFGYDISDHCAVDPLFGTLADFDELVAETHRRGMRLIVDYVPNHTSDEHPWFLESRASRESPRRDWYIWADPKPDGSPPNNWRSVFGGSAWEWDERTGQYYYHAFHRKQPDLNWRNPAVREAMHGVMRFWLERGVDGFRVDALRHLVKDEKLRDNPPNPAYEEGRPSYEAHLPVYTTDRPEVHRMISGMRRVLDGCGGERVMIGELYLPFDRLVLYYGEGGRGVHLPTNMHLITTPWSAPSLAALISEYEAALPPHGWPNWVLSNHDNPRVATRVGPERARAAAVLLLTLRGTPTVYYGDEIGMVDGKIPPERLRDPAGSQNPRLSRDPARTPMQWDASPNAGFCPPDAEPWLPLSPDRRHRNVAAQRESRGSLLCLYRRLLRLRRSEPALSVGSYEPLEAGGSLLAYARSHAGRRLLVALNLGEAPEPLPPVLRGRVLLSTSPGQEGGDLRPPARLGPGEALVVAP

SEQ ID NO: 32932 - DNA, 1623 bp, Mesorhizobium sp. BNC1
  CDS (1)..(1623)
atgaaaggcacaagccctgacgttgaggtgcactcatcgcaagagccatggtggcggcgcggcgtcatctaccaaatctatccgcgctcctttcaggacagcaatggcgacggcatcggcgacatccgcggcatcatagatcgcctggactacctcgtctggctcgggatagatgccgtctggatttcgccgatcttcttctcgccaatggccgatttcggctatgacatcgcggattatcgcaagatcgaccctcttttcggtacgctcacggatttcgaccagctcattgaagccgcgcatcggcgtggaattcggatattgctcgactatgtgccgaaccactcctcagaccgtcatcaatggtttctggaggcgcgcagctcccgcgataatcctcggcgcgatttctacatatggcgggatgcggcgccggacgggggaccgccaaacaactggcaaagcgaattcggcggcagcgcatgggaactggatgccgcaaccggccaatattactaccatgccttcctgaaagagcagcccgatctaaactggcgcaatccagaagtgcgccgtgaaatgtacgacgtgctccgcttctggctggaccggggcgtcgacggttttcgcgtcgatgtcatgtggcatctcatcaaggacgcggagtttcgcgacaatccgcagaaccccgactggaccgaagacatgccgccgcacaagtcggtgctttcgatctattcctgcgatcaggaggaggtgcacgacgtagtctccgaaatgcgcgccgtgctggacgaatacgggggcgaccggctgcttatcggagaaatatatctgccgattgcccggctcgtcgcctattatggccgggatcttcgcggtgcgcacctgccgttcaatttccgccttattgaggcgcaatgggacgctcgccacatcgagcggcagattgtcgaatacgaggccgctctgccggagggcggctggccgaactgggttttgagcaatcacgataagccgcgtatcgcctcccgtgtcggccgggaccaggcgcgtgttgccgccatgatgctacttacgttgcgcggcacgccaaccatctattatggcgacgagatcgggatgaacgacgctcccattccgcctgagcgcgtgcaggacccgttcgagctgcgcgttcccggacgcggtttcgggcgtgatccccaacgcacgcctatgcagtgggacaatacggtgaatgcaggcttcagcaccggctcgccttggcttcctcttgccccggacaaggacagcttcaatgtggaggcggaacgcagcgatccgcactcaatgctgtcgctctatcgcaggctgattgcattccggcgagaaaatgatgcgctgaaccttggccgttacgcctccgtcgaggcagacagctgcgtgctcgcttacctccgggagacggagaatgatcgctatttgattgcacttaatctcgggcccgagccggcggtgctggaaacacccgggcaatgccggattgtgatcagcacggaaggcaaggcggaaggcgagattgtcgaggaaaagctccacctgcaaggcaatgagggcgtgctggcggagatgatgagttag

SEQ ID NO: 32933 - protein, 540 aa, Mesorhizobium sp. BNC1
MKGTSPDVEVHSSQEPWWRRGVIYQIYPRSFQDSNGDGIGDIRGIIDRLDYLVWLGIDAVWISPIFFSPMADFGYDIADYRKIDPLFGTLTDFDQLIEAAHRRGIRILLDYVPNHSSDRHQWFLEARSSRDNPRRDFYIWRDAAPDGGPPNNWQSEFGGSAWELDAATGQYYYHAFLKEQPDLNWRNPEVRREMYDVLRFWLDRGVDGFRVDVMWHLIKDAEFRDNPQNPDWTEDMPPHKSVLSIYSCDQEEVHDVVSEMRAVLDEYGGDRLLIGEIYLPIARLVAYYGRDLRGAHLPFNFRLIEAQWDARHIERQIVEYEAALPEGGWPNWVLSNHDKPRIASRVGRDQARVAAMMLLTLRGTPTIYYGDEIGMNDAPIPPERVQDPFELRVPGRGFGRDPQRTPMQWDNTVNAGFSTGSPWLPLAPDKDSFNVEAERSDPHSMLSLYRRLIAFRRENDALNLGRYASVEADSCVLAYLRETENDRYLIALNLGPEPAVLETPGQCRIVISTEGKAEGEIVEEKLHLQGNEGVLAEMMS

SEQ ID NO: 32934 - DNA, 1623 bp, Mesorhizobium sp. BNC1
  CDS (1)..(1623)
atgaaagactattggtggaaggatgccatcgtctacgcagtggatgtagagcggttctgtgattcggatggtgacggggtaggagacttcaaggggctcacgtctaagctggactatatcgctgagctcggtgtcacctgcatttggcttctcccgttctatccatccacgggagaggacaacggctacagcatcaccgactacttacgcgtggactcccgctttgggctgtttcaggacttcctcgaattcattcatcgggccggcgagcacggcatccgcgtggtcgtcgatctggtggtacatcatacgtcgaaccagcatccctggtttcaggccgcgcggcacaacgagaaatcgcgttaccgcgatttctatatctggacccataacccgcctcccacacctcccggcaaggggactatttttccaggcgaggaagggactgtctggacctatgacgaggtcgcgcgcgcctattaccaccatcgcttctaccacttcgagccagggctcaaccatgcaaacccggacgtgcgcgacgagatcggccggatcatagattactggctgagcttcggcgttgctggtttccgcgtggatgccgcatcgcatatcttggaaaacccgctggcaaaatccggggaagacgagaacgcgccggacatgctgcgcgagatgttccaccgggccacgggctcgaaatccgacattgtcatgctgggcgaggtggacgagagccccaacgagcttgagaggttcttcgatggcacgcggttgaacatgatgttcaacttcctcctcaacaattatcttatcctcgggctggcaaaggagaaggcagagccgatccagcgcggcctggcaatgctgcccgttccccctgaaaacggccaatgggccaatttcctccgcaatttcgacgaggcggacctggaacgactgacgccggaggaactggagagcgttcttaaaatcttcgcgccaaaggaagagatgcgaatctatgggcgggggttgaggcgcaggcttgcccctatgctggacggagacgtacgccgcctgaaaatggcaatgagcctcctctattccatgcccggggcgcccgttttggtttatggcgatgagatcggcatgggtgaggatctgacccaagagggccgaaattccgttcgctcaccgatgcaatgggatggaagccgaaatgcaggcttctcgtcggcccgcaaggaaagaatggtgcagccgatcatcgacaagggccgttttgccttcgagcggatcaatgccgagacacagcgaaacgacccggcttcgcttctctctttcgtcaagcagctcgcgatcctgcgccgggagcgcaccgagatcgggagcggcttctgcgcgttcctggagtgcggctccgatcacgtgctcgcccaccactacaaatcggaggcggctcctctggtcatggtccacaatctggcaggtgaggcggtgaagatcgacgtcaagttgccggctggcgtaacctcgcttggcacgctctttggcggcgaaatgccgtcgatcgaagatgggcatttgcgcatgagcttggaaccatacggcgtgcgctggctgggtctgccgcgctga

SEQ ID NO: 32935 - protein, 540 aa, Mesorhizobium sp. BNC1
MKDYWWKDAIVYAVDVERFCDSDGDGVGDFKGLTSKLDYIAELGVTCIWLLPFYPSTGEDNGYSITDYLRVDSRFGLFQDFLEFIHRAGEHGIRVVVDLVVHHTSNQHPWFQAARHNEKSRYRDFYIWTHNPPPTPPGKGTIFPGEEGTVWTYDEVARAYYHHRFYHFEPGLNHANPDVRDEIGRIIDYWLSFGVAGFRVDAASHILENPLAKSGEDENAPDMLREMFHRATGSKSDIVMLGEVDESPNELERFFDGTRLNMMFNFLLNNYLILGLAKEKAEPIQRGLAMLPVPPENGQWANFLRNFDEADLERLTPEELESVLKIFAPKEEMRIYGRGLRRRLAPMLDGDVRRLKMAMSLLYSMPGAPVLVYGDEIGMGEDLTQEGRNSVRSPMQWDGSRNAGFSSARKERMVQPIIDKGRFAFERINAETQRNDPASLLSFVKQLAILRRERTEIGSGFCAFLECGSDHVLAHHYKSEAAPLVMVHNLAGEAVKIDVKLPAGVTSLGTLFGGEMPSIEDGHLRMSLEPYGVRWLGLPR

SEQ ID NO: 32936 - DNA, 1629 bp, Rhodospirillum rubrum
  CDS (1)..(1629)
atgtcgggtcaggaatggtggaaacgggccgttatctatcaaatctatccgcgcagtttccaggatgccgatggcgatggcatcggcgatttggccggcatcgcccaacgcctggattacctgtcgtggctgggggtggacgcgatctggatctcgcccttctatacctcgccgatgaaggatttcggctacgacattcaagactaccgcgatgtcgatccgatcttcggcaccctggccgatttcgacgccctggcggcgcgggcccgcgcgctggggctgaagctgatcttggatttcgttcccaaccacacctctgatcggcatccgtggtttctcgaatcccgccaatcgcccgccagcgccaagcgcgactggtacatctggcgcgacccggccgccgatggcggcccgccgaccaactggctggccgaattcggcggcagcgcctgggaatacgacgaagccagcggccagtattactaccacgccttcctcaaggagcagcccgacctcaattggcgcaatccagaagtccgcgcggcgatgtatgacgccatgcgcttttggctcgagcgcggggtggatggcttccgcgtcgatgtgatgtggcatctgatcaaggacgaccagttccgcgacaatccgcccaatccggcccgcccgcccaatgccggtccggccaatgccctgatcccgctctacaccgccgatcgccccgaagtgcacgacatcgtgcgcgagatgcgcgccgtggtcgacgcctatcccgaacgcgtgctgatcggcgagatctggctgcccaccgatcgcctggtcacctattacggccatgatctgcgcggtgcccatctgccctttaatttccaattgatcggcgccgcctgggacgccggcgtcatcaaagagatcgtcggcgactacgaaaaggccctgccccggggcggctggcccaattgggtgatgggcaatcacgacaagggccgcatcgccagccgcctgggcccccggcaggcccggctggccatgctgctgctgctcaccctgcgcggcacccccaccctttactatggcgacgagatcgccatgcgcgacgtgccgatcccccccgaccgggtctgcgatccttacgaaaagaacgtgcccggcctgggtctggggcgcgacccccagcgcacgccgatgcaatgggaggacgctccccaggccggcttcacccgcgcttcccgatcctggttgccgatcgccgccgatgcctcaacggtcaatgtcgccgcccaacgcgcggcgccggcctcgatgctgaccctcgtccaccgcctgatcgccctgcgcaaagccgaagcggccctaactatcggcgattatggggcgctcgacgctcccgagcgggtggtgatgttcctgcgccgcgttcccgggcgccgcctgctcatcgccctcaatctgggggaaagcgcccaaagcctgagcctgcccggcgacagccgccaagccaccaccctgctgtccaccgacccggagcgcccgctgggcgatctggccccggccttcacccttggcgggggcgagggcatcgtcgttttgctggccgaccgggaaacggcccccccgtccccggcggcgtaa

SEQ ID NO: 32937 - protein, 542 aa, Rhodospirillum rubrum
MSGQEWWKRAVIYQIYPRSFQDADGDGIGDLAGIAQRLDYLSWLGVDAIWISPFYTSPMKDFGYDIQDYRDVDPIFGTLADFDALAARARALGLKLILDFVPNHTSDRHPWFLESRQSPASAKRDWYIWRDPAADGGPPTNWLAEFGGSAWEYDEASGQYYYHAFLKEQPDLNWRNPEVRAAMYDAMRFWLERGVDGFRVDVMWHLIKDDQFRDNPPNPARPPNAGPANALIPLYTADRPEVHDIVREMRAVVDAYPERVLIGEIWLPTDRLVTYYGHDLRGAHLPFNFQLIGAAWDAGVIKEIVGDYEKALPRGGWPNWVMGNHDKGRIASRLGPRQARLAMLLLLTLRGTPTLYYGDEIAMRDVPIPPDRVCDPYEKNVPGLGLGRDPQRTPMQWEDAPQAGFTRASRSWLPIAADASTVNVAAQRAAPASMLTLVHRLIALRKAEAALTIGDYGALDAPERVVMFLRRVPGRRLLIALNLGESAQSLSLPGDSRQATTLLSTDPERPLGDLAPAFTLGGGEGIVVLLADRETAPPSPAA

SEQ ID NO: 32938 - DNA, 1623 bp, Enterococcus faecium
  CDS (1)..(1623)
atggaacaaaaatggtggcaccattcagttgtttatcaaatctatccaagaagttttcaagattcaaatcaagatggtattggagatttgcgggggattatttccaggttggattatctggcgtatttaggtattgatgcaatttggctttctccagtatacgagtctccgaatgatgacaatgggtatgatatcagtaattatcaagcaatcatggcagaattcggtacgatggaagaaatggaagaactgattgaagaagcaaagaaaagaaatatccgtatcatcatggatctggtggtgaatcatacttctgatgaacatccgtggttcattgaggcccgtaaaaataaagaaaatccttatcgggactattatatttggcgtgatccggtcaatggaaaagagcctaatagattgcgctcaatattcagtggttctgcttggcagttggatgaaaaaacggggcaatattttctgcacttgtatagcaagcgtcaacctgatttgaattggaaaaataaacaggttcgccaagagatttatcaaatgatgaatttctggatcgataaaggtattgggggctttcgtatggacgtgatcgatatgattggcaaagaaccggataaagaaatcacaagtaatggacctaaactgcatgagtatcttcaggaaatgaatcaagcaacttttggtgacaaaaatctgatgactgttggcgaaacatggggagcaactaccgaaatcgctaaactttattccaatcctaaaagaaatgaattatccatggtcttccaattcgaacacataggattagatcagcaagaaggcaaagacaaatgggatttgaaacccttgagtatctctgaactgaaaaaagtattatccaaatggcaaacatctttaggtgatgaaggatggaatagtttattttggaataatcacgatcttccgcgaattgtttctcgttggggaaatgacgatgtgtatcgaaaagaaagtgccaagatgtttgctatcttgctccatatgatgaaaggcaccccttatatctatcaaggagaagagttaggcatgacgaattgcccaatcgatgatatcgcggaagcaaaagatattgagacaatcaatatgtataacgaaaggatttcttctggatttacaaaagaggaaatcttggaatcaatcaaggcgaaaggaagagacaatgctaggacgcctatgcaatggaacgcccgtgaacatgctgggtttactactggaattccatggcttcgagtcaatccaaattataaagaaatcaatgcagaagaagcgttagcagatcaagattctgttttttatatgtacaagaaattgatcgatttgcgtagaaaacatgacatcatcgtctggggagactatgaattagtggaaaagacgcctgagcatgtctttgcctattctcgcatatatgaagaccagcaatggctcgttatttgtaatatgtccagtgaaaagcagacgttcactattccacgtgaagctttaagggttattgtgtcaaattatcctctgaaacagttaccagacggcaaagttgatttacgaccttatgaagcatttgtgttggaagtaaaataa

SEQ ID NO: 32939 - protein, 540 aa, Enterococcus faecium
MEQKWWHHSVVYQIYPRSFQDSNQDGIGDLRGIISRLDYLAYLGIDAIWLSPVYESPNDDNGYDISNYQAIMAEFGTMEEMEELIEEAKKRNIRIIMDLVVNHTSDEHPWFIEARKNKENPYRDYYIWRDPVNGKEPNRLRSIFSGSAWQLDEKTGQYFLHLYSKRQPDLNWKNKQVRQEIYQMMNFWIDKGIGGFRMDVIDMIGKEPDKEITSNGPKLHEYLQEMNQATFGDKNLMTVGETWGATTEIAKLYSNPKRNELSMVFQFEHIGLDQQEGKDKWDLKPLSISELKKVLSKWQTSLGDEGWNSLFWNNHDLPRIVSRWGNDDVYRKESAKMFAILLHMMKGTPYIYQGEELGMTNCPIDDIAEAKDIETINMYNERISSGFTKEEILESIKAKGRDNARTPMQWNAREHAGFTTGIPWLRVNPNYKEINAEEALADQDSVFYMYKKLIDLRRKHDIIVWGDYELVEKTPEHVFAYSRIYEDQQWLVICNMSSEKQTFTIPREALRVIVSNYPLKQLPDGKVDLRPYEAFVLEVK

SEQ ID NO: 32940 - DNA, 1644 bp, Enterococcus faecium
  CDS (1)..(1644)
atgatacaagaacaaaaatggtggaaagaagcagtaggctatcaaatctatcctgctagtttcaaagatagcaatggcgatggtcaaggagacatcaatgggatccgtgaaaaacttaattatttgaaagatcttggtatcggctttatctggatcaatccgatctatcaatctccatttgtcgataatggttatgacgtaagtgactatcaagatatagaagagagattcggaacgatggaagattttgatttattgctaaaagaagcacatgaattagggatcaaagtgattatggatcttgtcatcaaccatagttcggatcagcatcaatggtttgaagaatcgaaaaaatctaaagaaagcccgtatcgcgattattacatttgggtcgacggggtagatggcaaagaaccgaataattggacatcgattttcggcggttctgcttgggagtattctcatgaaactggacagtattatctgcatgtttttgcaaaagaacaaccagacttaaattgggaaagcgagaaattgaaagaagaactattcaatatgatccgatggtggttggataaagggatagatggatttcgtttagatgcgatttctcatgtaaaaaaagatgaatattcagtaaaagccacagagaaccctttctcaccctttcaaaatgtctcaggaatcgaagaacatttgaccgatttgaaacatgtttttgaagagtacgatatcatgactgtcggagaagcaagtggtgtcactgcagaagaaggaccacaatgggtagggaaagacggttatttcgatatgatattcgaatttgatcatatccatatctggcagcaagaaaaagaagggcaattagatgtccttaaattgaaacttgcattaagcgcttggcaaacttcattggatggtatcggatggaacgctttatatatggaaaaccatgatgttcctcgtgccgtttcagtgtttggagatactcgtcccgatttttgggctatgtctgcaaaagcaatcgctatgatgtatttctttttgcaaggtacgccatttatttatcaaggacaggaaatcggaatgacgaatatgccctttgaatcgatcgatcaagttgatgcagtagattcgaaaagactttataaaaggctgcttgcggaaggtaagacaagagaagaagcattggatatcattcgtgaaacaacgagagacaacagcaggacacccatgcaatggacttcggaacaatatgctggtttttctacacatgaaccttggctgatcactaatccaaataccaaaacgatcaatgtagaacaacaagaatatgaaccagagtcggtcctgcaattctataagaacatgatccgcattagacaaaccaataaaggtctgatatacggttcttataaagaatatcttcatgaacatccacaactttatgtctatgaaagatatttagaagatgaacaatatcttattatggtaaacttaacagaatcacttgctgactatgaacttccaaaagaagcagatcagtcctggacattactcttgtcaaattcctctagcggagaatttgaagctaaaggcatactagcaccttatgaagctcggttatataaaacaaacaagtaa

SEQ ID NO: 32941 - protein, 547 aa, Enterococcus faecium
MIQEQKWWKEAVGYQIYPASFKDSNGDGQGDINGIREKLNYLKDLGIGFIWINPIYQSPFVDNGYDVSDYQDIEERFGTMEDFDLLLKEAHELGIKVIMDLVINHSSDQHQWFEESKKSKESPYRDYYIWVDGVDGKEPNNWTSIFGGSAWEYSHETGQYYLHVFAKEQPDLNWESEKLKEELFNMIRWWLDKGIDGFRLDAISHVKKDEYSVKATENPFSPFQNVSGIEEHLTDLKHVFEEYDIMTVGEASGVTAEEGPQWVGKDGYFDMIFEFDHIHIWQQEKEGQLDVLKLKLALSAWQTSLDGIGWNALYMENHDVPRAVSVFGDTRPDFWAMSAKAIAMMYFFLQGTPFIYQGQEIGMTNMPFESIDQVDAVDSKRLYKRLLAEGKTREEALDIIRETTRDNSRTPMQWTSEQYAGFSTHEPWLITNPNTKTINVEQQEYEPESVLQFYKNMIRIRQTNKGLIYGSYKEYLHEHPQLYVYERYLEDEQYLIMVNLTESLADYELPKEADQSWTLLLSNSSSGEFEAKGILAPYEARLYKTNK

SEQ ID NO: 32942 - DNA, 1821 bp, Thermobifida fusca
  CDS (1)..(1821)
atgaccacacagccggctcctggtgcgcgcccgacgccgaccgggtccgttcccgacacgttcacccacgcaaagccgcgcgacccctactggtacaagcacgcggtgttctacgaagtcctcgtccgcggcttctacgactccaacggggacggcaccggcgacttgcggggcctcatcgaaaaactggactacctgcagtggctcggcatcgactgcctctggctgctgccgatctacgagtccccgctccgcgacggcggctacgacgtctccgactacatgaagatcctgcccgagttcggccggatctccgacttcgtggaactcgtcgaaaaagcccaccagcggggcatccgggtcatcaccgacctggtcatgaaccacaccagcgaccagcacccgtggttccaagcctcccggcacgaccccgacggaccgtacggcaacttctacgtctggtcggacaccacggaacgctacagcgacgcgcgcatcatcttcatcgacaccgagcagtccaactggacctacgacgaagtgcgcggacagtactactggcaccgcttcttctcccaccagcccgacctcaacttcgagaacccggacgtccaggacgccatcctcgaagtgatgcggttctggctggaccttggcatcgacggtttccgcttggacgccgtgccctacctgtacgagcgggaaggcacgaactgcgagaacctcaaggagacccacgagttcctcaaacgcatccgcgccgaagtcgaccggctctaccccgaccgggtcctgctcagcgaagccaaccagtggcccgccgacgtcgtcgactacttcggcgactacgaatccggcggcgacgaatgccacatgaacttccacttcccgctgatgccgcgcatgttcatggcggtccggcgcgaacagcgctaccccatctcggaaatcctcgcgcagaccccgcctattccgcgcaactgccagtgggcgatcttcctgcgcaaccacgacgagctgaccttggagatggtcagcgatgaagagcgggactacatgtactccgaatacgccaaagacccgcggatgcgcgccaacatggggatccgccgccggctggcacccctcctggaaaacgacctcaaccagatcaaactgttcaccgcgctgctgctgtcgctgcccggctccccggtgctctactacggcgacgagatcgggatgggcgacaacatctggctgggggaccgcgacagcgtgcgcacccccatgcagtggaccccggaccgcaacgccggattctcccgctgcgacccgggccgcctctacctgccggtgatcatggacccgatctacgggtaccaggcgatcaacgtcgaagcacagcagaacaacccgaactcgctgctgaactggacccgcaacatgatccagatccgcaagcagcacccggtgttcgggacgggggacttcaccgaactccacgcgagcaaccccagcgtgttcgcgttcgtgcgcgaatacggcgacgaccggatgctgtgcgtcaacaacctgtcccggtttccccaaccggtggaactggacctccgccgcttcgaagggatcaccccgatcgaatgcacggggggagtgcacttcccgcccatcggggaactgccctacctgctgactctccccgggcacggcttctactggttccagcttccgcccgtcgccgaagagcagccgctcgcccagcccgtcaccaccgtccccgcagccccgcagcctcctgctccggcagaccgtcccgcgtccgacccgacccagcggtcctga

SEQ ID NO: 32943 - protein, 606 aa, Thermobifida fusca
MTTQPAPGARPTPTGSVPDTFTHAKPRDPYWYKHAVFYEVLVRGFYDSNGDGTGDLRGLIEKLDYLQWLGIDCLWLLPIYESPLRDGGYDVSDYMKILPEFGRISDFVELVEKAHQRGIRVITDLVMNHTSDQHPWFQASRHDPDGPYGNFYVWSDTTERYSDARIIFIDTEQSNWTYDEVRGQYYWHRFFSHQPDLNFENPDVQDAILEVMRFWLDLGIDGFRLDAVPYLYEREGTNCENLKETHEFLKRIRAEVDRLYPDRVLLSEANQWPADVVDYFGDYESGGDECHMNFHFPLMPRMFMAVRREQRYPISEILAQTPPIPRNCQWAIFLRNHDELTLEMVSDEERDYMYSEYAKDPRMRANMGIRRRLAPLLENDLNQIKLFTALLLSLPGSPVLYYGDEIGMGDNIWLGDRDSVRTPMQWTPDRNAGFSRCDPGRLYLPVIMDPIYGYQAINVEAQQNNPNSLLNWTRNMIQIRKQHPVFGTGDFTELHASNPSVFAFVREYGDDRMLCVNNLSRFPQPVELDLRRFEGITPIECTGGVHFPPIGELPYLLTLPGHGFYWFQLPPVAEEQPLAQPVTTVPAAPQPPAPADRPASDPTQRS

SEQ ID NO: 32944 - DNA, 1635 bp, Thermobifida fusca
  CDS (1)..(1635)
atgcagcaagttcccgacagcgttcacttgaccgcgcccaccgcccatacccactggtggcgccacgcggtcatctaccagatctacgtccgcagcttcgcagactccaacggcgacggcgaaggcgacctcaacggcatccgggagcgcctgcccgccctggtctcgctcggcgtggacgcgatctggctgacccccttctacgtctcccccctcgccgacggcggctacgacgtcgccgactaccgtgacgtcgacccgcggttcggaacgctggccgacttcgacgccctcctggccaccgcccacgacctgggcctccgggtcatcatcgacatcgttcccaaccacacctcctccgcccaccgctggttccgcgacgcgctggccgccggaccgggcagcccggagcgcgaccggtacgtcttccgcccggggcgcggggagaacggggagctgccgccgaacaactggcagtcgatcttcggcgggcccgcctggacccgggtgacggagccggacgggacgcccggcgagtggtacctgcacctgttcgacgtagagcagcccgacctgaactgggagaacccggaggtccgggccgaattcgccgacattctgcggttctggctggaccgcggggtggacggcttccgcatcgacgtggcccacggcatgatcaaggaccccgcgctgcccgacatcgccgaaggccagaaggcggacatgctcgacggccacacgcggctgccctacttcgaccaggacggggtccacgagatctaccgggagtggcgcgccatcgtcgacagctaccccggggagcgcgcgctggtggccgaggcgtgggtggagaacgcggaacgcgtggcccgctacctccgccccgacgagctgcaccaggcgttcaacttcgagtacctcaccgcagactgggacgctgcaacgctgcgcgccgtggtggaccgctccctggccgcgaacaacgcggtgggggcgccgaccacatgggtgctctccaaccacgacgtcacccggcacgtcacccggttcggcgggggcgcgcaagggctggcgcgggcacgcgccgcgctcctgctgatgctggccctgccgggatcggtctacctctaccagggtgaggagctgggacttcccgaggtcaccgatctgccggaggaggccctgcaggaccccacgtggaagcgctccggatacaccgagcggggccgcgacggatgccgggtgccgctgccttgggaaggcgacgagcccccgttcggcttcggctgctcggcggagcgcagttggctgccggtgcccgcggagtggcggtcgctgacccgggaggtccaggagcgcgacccggactcgaccctgtcgctgtacaagaaggcgctgcggctccgccgcgaactgctgctccccgcagaggacgcgctgcactgggcggacgccccgcagaacgtgctggctttccgccgggaaccgggtttcacctgcgcggtgaacttcggcgctgacccggtcacgctgccgttcgagggcgaagtggtgctgtccagcggtccggtggagcaggacggcacgcacctcgtgctgcctggggacaccgcggtgtggctgcggcagtag

SEQ ID NO: 32945 - protein, 544 aa, Thermobifida fusca
MQQVPDSVHLTAPTAHTHWWRHAVIYQIYVRSFADSNGDGEGDLNGIRERLPALVSLGVDAIWLTPFYVSPLADGGYDVADYRDVDPRFGTLADFDALLATAHDLGLRVIIDIVPNHTSSAHRWFRDALAAGPGSPERDRYVFRPGRGENGELPPNNWQSIFGGPAWTRVTEPDGTPGEWYLHLFDVEQPDLNWENPEVRAEFADILRFWLDRGVDGFRIDVAHGMIKDPALPDIAEGQKADMLDGHTRLPYFDQDGVHEIYREWRAIVDSYPGERALVAEAWVENAERVARYLRPDELHQAFNFEYLTADWDAATLRAVVDRSLAANNAVGAPTTWVLSNHDVTRHVTRFGGGAQGLARARAALLLMLALPGSVYLYQGEELGLPEVTDLPEEALQDPTWKRSGYTERGRDGCRVPLPWEGDEPPFGFGCSAERSWLPVPAEWRSLTREVQERDPDSTLSLYKKALRLRRELLLPAEDALHWADAPQNVLAFRREPGFTCAVNFGADPVTLPFEGEVVLSSGPVEQDGTHLVLPGDTAVWLRQ

SEQ ID NO: 32946 - DNA, 1635 bp, Novosphingobium aromaticivorans DSM 12444
  CDS (1)..(1635)
atgaagcagaccgaaacagccattgccgaccccaaaatgcacacggagacgccgtggtggcgcggtgcggcgatctatcagatctatccacgcagcttttgcgattccaacggcgacggcatcggggacctgaatggcatcgcctcgcgactggatcacgtcgcgcgccttggcgtagacgcgatctggatctcgccgttcttcacctcgccgatgaaggacttcggctacgacgtcgccgactactgcgacgtcgatccgatcttcgggacgctggcggatttcgatgccctggtaaaacgcgcgcacgagctgggcctcaaggtcacgatcgaccaggtctatgcgcatacctcggacattcatccgtggtttgccgaaagccggcaggaccgtaccaacgccagggcggactggtatgtctgggccgatcctaagcccgatgggtcgcccccgtcgaactggcagtcggtattcggcggtccggcatggacgtgggatgcgcggcgctgccagtattacctgcacaacttcctatccagccagccccaggtaaacgcccacaatcccgaagtgcaggaagcgctgctcggggcgatgaagttctggctggaccggggtgttgacggcttccgcctcgatgccctgaacttcctgatgcatgacccgaccttgcgggacaatccgccggcgccggacgatggccgacgcaagacgcggccattcgacttccagctcaagatctacaaccagtcgcaccccgacatcctgaagttcatccagcgggtgcggaacctgtgcgacgactatggcgcggtgttcacagtcgcggaagtcggcggagaccttgccgagacggagatgaaggcgttcactgcgggggacaggcatctcaacagcgcctacggcttcgacttcctctacgcggacaggctgacgccgcatttcgtggaaaaggccgtggccaaatggcccgatgcacccggcatgggctggccgagctgggccttcgagaaccacgatgcgccgcgcgcgctttcgcgctggtgcgcgccggaccagcgcgagccgttcgcccggctgaaggccatgctcttcgcttcgttgcgggggaacatcatcgtctaccagggcgaggaactgggactgacgcaggtcgacattccgttcgagcagttgcaggaccccgaggccatcgccaattggccgctgacgctttcacgcgacggtgcacgcacgccgatgccctggttagtacaatcgggcgagggcgggttcacgtcgggcgcgccctggttgccgctgggcgaggaaaacctgtcgcgggccgtcgaccggcaggaaggcgatccggcatcgctcttgaacctgaccacgcgcctgcttcgcctgcgccgcgagacgcccgcgttacggatcggttccttcgaggtgatccatgcagacgaatgccttcttgccattcggcgcgttttgggtgagcaatcgattgcagggctgttcaacctgtcctccgtcccggtggtctggccccacgggctggtgcgggagggcaaggaaatggcgtcggtcaacggcgcgacagtggggcagttgccgccgttcggcgcgctcctgatcgaagagaggatctga

SEQ ID NO: 32947 - protein, 544 aa, Novosphingobium aromaticivorans DSM 12444
MKQTETAIADPKMHTETPWWRGAAIYQIYPRSFCDSNGDGIGDLNGIASRLDHVARLGVDAIWISPFFTSPMKDFGYDVADYCDVDPIFGTLADFDALVKRAHELGLKVTIDQVYAHTSDIHPWFAESRQDRTNARADWYVWADPKPDGSPPSNWQSVFGGPAWTWDARRCQYYLHNFLSSQPQVNAHNPEVQEALLGAMKFWLDRGVDGFRLDALNFLMHDPTLRDNPPAPDDGRRKTRPFDFQLKIYNQSHPDILKFIQRVRNLCDDYGAVFTVAEVGGDLAETEMKAFTAGDRHLNSAYGFDFLYADRLTPHFVEKAVAKWPDAPGMGWPSWAFENHDAPRALSRWCAPDQREPFARLKAMLFASLRGNIIVYQGEELGLTQVDIPFEQLQDPEAIANWPLTLSRDGARTPMPWLVQSGEGGFTSGAPWLPLGEENLSRAVDRQEGDPASLLNLTTRLLRLRRETPALRIGSFEVIHADECLLAIRRVLGEQSIAGLFNLSSVPVVWPHGLVREGKEMASVNGATVGQLPPFGALLIEERI

SEQ ID NO: 32948 - DNA, 2118 bp, Microbulbifer degradans 2-40
  CDS (1)..(2118)
atgcgaacgcaaaatgccaccattactcgactagttttattccttagcttaagcctcgccattagcgcgtgtaatggtaacggccccaagcaaaatactattagcgaacaaacgccacctgcagatcaaacacccgcgcaaccagacgatacggcgggcgcagacacagaaggaacagaagacccaaaagaaacaccagatactgaaaataatagccccaccgttcgtattcactacttaaatagcaatcaggcctacgataactggggcttacatctttggggcgatgcaattgcaagcagtacagccacaaattggacatctccttttgcactaacacgcgctgaaaacgattacggcctttacgaagtgccccttgccgacccaaacggcacgtttaattttattatgcactttggcgactttaaaaaccccgcctacgatttttctattattccagctcaattcggcaccgacgtatggttagtgcaggatacccctgcagatgtgacaaacggcgtagccattccattcgacaacgaagccgacgcgcgcgcagcctacgaatcgctaatggccaatatcggcaacgcgtcagccgcgttagacttaacggatattgaaataaaagatagcgatacaggcctcgctgccgactgggtagacacagcccactttgccgaaatttatattcgcggctatcaagattcagacggcaacggcataggtgatattcaaggcttaatttcgcggttagattatttagccgagtctggcataaacggcatttggttaatgccagccatggaaagctcggataacgatcacggctatgccacatcggattaccgcgccatagaaagcgactacggcaccatgcaagattttcaacaactgcttgatgaagcccatgcgcgtaacattgccatagtaatggattatgtgatgaaccattcgagcaatgccaaccccttgttccaagatgcactaagctcacccactaacagcaagcgcgattggtatattattcgcgacgataaattagaaggctggaacacatggggcagcgacccgtggaaaagcaacgccaacggctattactatgcagcgttctcttcgcaaatgcccgattttaatttgcgcaacccagatgtaattcgctttcaccaaaacaacctgcgcttttggttaaacatgggcgtggatggttttcgcttcgatgccgttggtgtattagtcgaaaatggtaaagatgcctgggaagaccaagacgataaccaccccgttattaacgccatgaaaacaaccatagaagcctatcaaaagcgctacatagtgtgcgagtcccccaccggctacgcagcctttgctcagcaaaactcctgtggccgcgcatttaatttttctgcagggcacggtattttacgcagcgtaaaacagggcaagctagatgcagaatttgttgagcaacttaatgccagcaatatagacgctatgccacttattttggccaaccacgatgcctttgctggcattcgcgtgtgggatcaacttaacggtaacaaaacacactataaactggctgctgccagctatttattggcttcgcgcaacccatttacttactatggcgaggagataggcttggcaggcgctgcgaatttatccggcgattggagtattcgcaccccaatgagctggaacaacgacccacaaaatgcaggttttagcacggcacaaccctttagggagttgtctgccaatgttatgacccaaaatgtagaagcacaattaggtaaaaccgattcactattagcctattaccgcagcatctacgatcttcgcaatgcgcacccagtaatagcgaacggtaatttaaatgtgcaggggcaagctaacgataacgcactggttttggtgcgcaccagcgacgacgcacaagcagttattctatttaattacagtgcacaagcgacaagtaaaagtgttagcgggttaaccgccagtgcaaattacagtggcgcattaggagcaagtaataacgttagtgctaatgcaagcggtacagcaacagtaaccatacctgcgcaaactgccgtggtttatattcgccagtaa

SEQ ID NO: 32949 - protein, 705 aa, Microbulbifer degradans 2-40
MRTQNATITRLVLFLSLSLAISACNGNGPKQNTISEQTPPADQTPAQPDDTAGADTEGTEDPKETPDTENNSPTVRIHYLNSNQAYDNWGLHLWGDAIASSTATNWTSPFALTRAENDYGLYEVPLADPNGTFNFIMHFGDFKNPAYDFSIIPAQFGTDVWLVQDTPADVTNGVAIPFDNEADARAAYESLMANIGNASAALDLTDIEIKDSDTGLAADWVDTAHFAEIYIRGYQDSDGNGIGDIQGLISRLDYLAESGINGIWLMPAMESSDNDHGYATSDYRAIESDYGTMQDFQQLLDEAHARNIAIVMDYVMNHSSNANPLFQDALSSPTNSKRDWYIIRDDKLEGWNTWGSDPWKSNANGYYYAAFSSQMPDFNLRNPDVIRFHQNNLRFWLNMGVDGFRFDAVGVLVENGKDAWEDQDDNHPVINAMKTTIEAYQKRYIVCESPTGYAAFAQQNSCGRAFNFSAGHGILRSVKQGKLDAEFVEQLNASNIDAMPLILANHDAFAGIRVWDQLNGNKTHYKLAAASYLLASRNPFTYYGEEIGLAGAANLSGDWSIRTPMSWNNDPQNAGFSTAQPFRELSANVMTQNVEAQLGKTDSLLAYYRSIYDLRNAHPVIANGNLNVQGQANDNALVLVRTSDDAQAVILFNYSAQATSKSVSGLTASANYSGALGASNNVSANASGTATVTIPAQTAVVYIRQ

SEQ ID NO: 32950 - DNA, 1671 bp, Oenococcus oeni PSU-1
  CDS (1)..(1671)
atgtcaaaaaaacaatggtttaaagatacagtagtttatcaagtatacccaatgagtttccaggatagcgataacgatggaattggcgacctgccggggattacaaaacgacttgactatatcaaaaaactaggtgccgatgtcatttggttaaacccgatttatgagtcacccaacaaagacaacggatatgatattgccaattatcgagctatcaacccggagtacggatcgatgaatgattttgatgatttacttaacaaagctcaccaattaaaccttaaaattatgatggatctagtcgttaaccatacttccgatcaacatcattggttccaggaaagtaaaaaaaccaaagacaatccgttttccgatttttatatttggagagatccggtagatggtcacgaacctaataattggttggccgcatttggtggttcagcatggacttatgttccggaacgcaaacaatattatttgcatttgtttgcaaccggtcaaccggatctcaattgggagaatccggatgttcgccaagcagtctttgatatagaacgtttttggctcgataaaggggttgatggttttagaatggacgttattaatcttatttcaaaaccaaagggtctgcctgatgttccggaacctgccaccgcaggaaagacgatggatttcgtagcggatgggcatcgcctaaatgagtttttgagtcaaatgaacagcgaagtattgtccaaatatgacactataacggttggtgaaatgcctggatcaactactgaagacgctattaaatacacgggccttaacagccatgaactgaatatggtatttcagtttgagcatgtcggtttaagtcccaatccggatgttagattgggaaagtggaatgaccagcctgttaaactgactgaattaaaagcctcgttgaacagatggcaaactggtcttgacggcaaaggatggaacagcctttactggaacaatcacgatcaacctcgggcagtatcccgttttggaaatgacgatcctaagtatcgtgttctatcggccaaaatgctggctacaactcttcacttgatgcagggcactccttatgtatatcagggtgaggagcttggaatgacaaatgctcacttcacaaaattaaatcaatacgaggatatcgaatctattaatttttatcatgagttggtcgaacaagaaaaaattgtcgatgggccaacaatgctaaaatatctggcaaatatttcacgtgataatgcccgtacgccaatgcaatggaacgataaaaacaatgccggattctcaagtgcaaaaccatggtttgcccttaaccctaattacaaatcaattaacgttgaggattcattggctgacaaaaattccgtattctattattatcaaaaattaattaagcttcgtcacaataatgaaataatcaaatatggaagcttcgaggaaatagaccccgatgacgatcaagtatacgcatatcgtcgtcattacgaaggaaaaactttgttacttataagcaattttaccgataaaatcgtaagtcgcgattacggtcaatcgaacgcttcaagtttgcttatagataattatgaagatgataaagtaaacgagttaagaccgtatgaggcgaaagcttatctatttaaatga

SEQ ID NO: 32951 - protein, 556 aa, Oenococcus oeni PSU-1
MSKKQWFKDTVVYQVYPMSFQDSDNDGIGDLPGITKRLDYIKKLGADVIWLNPIYESPNKDNGYDIANYRAINPEYGSMNDFDDLLNKAHQLNLKIMMDLVVNHTSDQHHWFQESKKTKDNPFSDFYIWRDPVDGHEPNNWLAAFGGSAWTYVPERKQYYLHLFATGQPDLNWENPDVRQAVFDIERFWLDKGVDGFRMDVINLISKPKGLPDVPEPATAGKTMDFVADGHRLNEFLSQMNSEVLSKYDTITVGEMPGSTTEDAIKYTGLNSHELNMVFQFEHVGLSPNPDVRLGKWNDQPVKLTELKASLNRWQTGLDGKGWNSLYWNNHDQPRAVSRFGNDDPKYRVLSAKMLATTLHLMQGTPYVYQGEELGMTNAHFTKLNQYEDIESINFYHELVEQEKIVDGPTMLKYLANISRDNARTPMQWNDKNNAGFSSAKPWFALNPNYKSINVEDSLADKNSVFYYYQKLIKLRHNNEIIKYGSFEEIDPDDDQVYAYRRHYEGKTLLLISNFTDKIVSRDYGQSNASSLLIDNYEDDKVNELRPYEAKAYLFK

SEQ ID NO: 32952 - DNA, 1677 bp, Pediococcus pentosaceus ATCC 25745
  CDS (1)..(1677)
atggcagcaacaatcaagtggtggcaacaagccgttgtctatcaggtctatccacggagttttcaagataccaatcatgatggtattggtgacttaaaggggatcacggcccacctagactacttaaagcaattaggaatcgacgtcatttggctcaatcccatttatcgttcacccaacgatgataatggttatgatattagtgattatcaacaaattgcggccgactttggcactatggctgattttgatgaactattgcaagccgcccatgaccggggcttaaagatcatcatggacttggttgttaaccatacctctgatgagcatccatggttcaaacgcagtcgccaggaccgcaccaatcaatatcgtgatttctacttttggcgctcaggtaacggcaaaaaggcgcccaataattgggatgcggcttttggtggttcagcatggcaatatgatgagcagacccagcagtattatttacacacgttttcaacaaaacaacctgatttaaactgggagaatccgaccttacgagagtcagtttatacgatgatgacctggtggctgaacaagggtgttgacggttttcgaatggacgtcattaaccaaatctctaagttacccggattaccagatggtccactgaaaccgcacagtcagtttggcgatgctcgagtaacgaacggaccgcgagttcatgaattcttgcaagaaatgaaccaagaagtattgtcacagtttgatatcatgacggttggtgagacccacggggtgacaccagcggatgcgctgaagtatgcgggcgctgatcagcacgaattagatatggtctttgaatttcaacatctgcgacttgataatagtcagcatggtcttggtaagtggagtacgcgtaagacaccgttagtggcgctaaagaaagtcattagtgactggcaagtcggacttgaagggcgggcttggaacagcctgttttggaacaatcatgatacgccacgagcggtctcacgttttggtgatgaccgaccagcatatcgggtacgttcggctaaaatgctcgcaacgtgtttacacctcttacagggaaccccatatatttatcaaggtgaggaactggggatgactgacgctcattttactgaactagccagttaccgagatattgaatcgctcagtgcctatcgtgatttagtgactgagcgccagctgctatcaccggcagatatgatggcccgattagcggcgcgttctcgggacaactcgcgaacgccgatgcaatgggacacggaggttaacgcgggttttagtgacgcggcgccatggctcacggtcaatcccaactatcgtcaaatcaatgctgccgcagctttggctgatccggattcagtgtggtactattatcagcacttgattcaattacgacatcaatacccctcagtgacgttaggttcgtttgagctcttgtgggccgatgatccgcaggtattcttatatgcacggcaatgggaagggcggacctggctagtttgttgcaatttcacagccgagacactgtcccgaccactggatcaatatctgacgcccacggccaaatgcttgattagtaattatggcgagcagcagccaaataaattacggccttatgaggcttgggtctaccaactcgcatag

SEQ ID NO: 32953 - protein, 558 aa, Pediococcus pentosaceus ATCC 25745
MAATIKWWQQAVVYQVYPRSFQDTNHDGIGDLKGITAHLDYLKQLGIDVIWLNPIYRSPNDDNGYDISDYQQIAADFGTMADFDELLQAAHDRGLKIIMDLVVNHTSDEHPWFKRSRQDRTNQYRDFYFWRSGNGKKAPNNWDAAFGGSAWQYDEQTQQYYLHTFSTKQPDLNWENPTLRESVYTMMTWWLNKGVDGFRMDVINQISKLPGLPDGPLKPHSQFGDARVTNGPRVHEFLQEMNQEVLSQFDIMTVGETHGVTPADALKYAGADQHELDMVFEFQHLRLDNSQHGLGKWSTRKTPLVALKKVISDWQVGLEGRAWNSLFWNNHDTPRAVSRFGDDRPAYRVRSAKMLATCLHLLQGTPYIYQGEELGMTDAHFTELASYRDIESLSAYRDLVTERQLLSPADMMARLAARSRDNSRTPMQWDTEVNAGFSDAAPWLTVNPNYRQINAAAALADPDSVWYYYQHLIQLRHQYPSVTLGSFELLWADDPQVFLYARQWEGRTWLVCCNFTAETLSRPLDQYLTPTAKCLISNYGEQQPNKLRPYEAWVYQLA

SEQ ID NO: 32954 - DNA, 1647 bp, Pediococcus pentosaceus ATCC 25745
  CDS (1)..(1647)
atgaattttaaaaataaggttatttaccaaatttatcccaaatcattctatgattctaacaacgatggcattggagatttacaaggaattatcaaaaaaattccttatattgataagttgaatatcgatatgatttggttcaatccttttttcgtttctcctcaatacgataatggttatgacattgccaatttctatgaaattgaccctgtctttggtacgatgtcagcttttgaagaattagtccgtaaattaaaggaaatccatgtcggagttatgctagatatggtgttaaatcatatttctactgagcatgaatggtttcaaaaagccttagctggcgacgaacactatcaaaaatacttctacattcgagatcctaaaccaaatggtgatttacccaacaattggacttctaaatttggtggaccagcttgggctaaatttggtgataccggtaaatatttcttacacttatacgacgagcatcaagccgatcttgactggcataaccctgaagttcgccaagaacttttcaaggtcattaatttttggcatgccaagggggttaagggattccgctttgatgtaattaatgtgactggaaaggacgtagagttaaccgacgctcctgaaggcgtagaatcaaaatttatgtataccgatacacctatcgttcaaagttatcttaaggaaatgcatcaagctgcacttcaagaccctgaagtaattaccgtaggagagttttcttcagcttcagttgaaaatggtgtgaaatatactcgtccggaagaacatgaattaaccatggctttcaccttccaccatttaaaagtagattacgaccacggacaaaaatggacgaaagttccttttgactttgctgcacttaaaaagacgataaatacttggcaagtgggcatggatgaaggtgatggatggaacgccctcttctggaataatcacgatcagccttgggccttaaatcgctttggagattctggtaaataccgagctaagtctgccgaaatgcttgccaccacgatgcatttgcttcgtggaacgccctatatttatcagggagaagaaatcggcatggtcgatccagattaccaaaacattgacgaatatgttgatgtagaagccttaaacgcttatcaacgactcttgaaagaaaataaatctcctcaagatgcacttgaaatcgtgaagtctaaagctcgcgataatagtcgagttcctatgcattgggatgattccaaatatgctggcttttctgaagttcaaccttggttaaaaccaactaagcaaactgaaattaacgttgcaaatgaactagaacacggtgaaatttttgcttattaccaaaaattaattcaacttcgccgagaattctccattatttctgaaggagattatcaatcctttgaacttaatcacccttctgtattcgcttatattcgtacctatcaagaccaaagcttgttggttctcaataacttctatggaaatgatgctaccatctcaattcctagtaaatacaccactgaaactgctaaaatcttgattaacaactacgagactaatcctgaattaacaacaacgctgaaattgaaaccttatcaatccatagcaattctgatttag

SEQ ID NO: 32955 - protein, 548 aa, Pediococcus pentosaceus ATCC 25745
MNFKNKVIYQIYPKSFYDSNNDGIGDLQGIIKKIPYIDKLNIDMIWFNPFFVSPQYDNGYDIANFYEIDPVFGTMSAFEELVRKLKEIHVGVMLDMVLNHISTEHEWFQKALAGDEHYQKYFYIRDPKPNGDLPNNWTSKFGGPAWAKFGDTGKYFLHLYDEHQADLDWHNPEVRQELFKVINFWHAKGVKGFRFDVINVTGKDVELTDAPEGVESKFMYTDTPIVQSYLKEMHQAALQDPEVITVGEFSSASVENGVKYTRPEEHELTMAFTFHHLKVDYDHGQKWTKVPFDFAALKKTINTWQVGMDEGDGWNALFWNNHDQPWALNRFGDSGKYRAKSAEMLATTMHLLRGTPYIYQGEEIGMVDPDYQNIDEYVDVEALNAYQRLLKENKSPQDALEIVKSKARDNSRVPMHWDDSKYAGFSEVQPWLKPTKQTEINVANELEHGEIFAYYQKLIQLRREFSIISEGDYQSFELNHPSVFAYIRTYQDQSLLVLNNFYGNDATISIPSKYTTETAKILINNYETNPELTTTLKLKPYQSIAILI

SEQ ID NO: 32956 - DNA, 1653 bp, Silicibacter sp. TM1040
  CDS (1)..(1653)
atgaacgctcagaccacaatcaaccctgcttcggtgctgtccaatgacccggattggtggcgcggtgcggtgatctaccagatttatccgcgcagctaccaagacagcaatggcgacggcatcggggatctgcagggtatcacgtcacgtctggaccacatcgcctctcttggggtggatgccatctggatttcgccctttttcacgtcaccgatgaaagactatggctacgatgtcagcgactactgcgatgttgatccgatgtttggcaacctcgcagattttgacgcgctggtggcgcgggcgcatgatctcggcctgcgggtgatgatcgatctggtgctgtcgcatagttcggatcagcacccttggttcgccgagagccgtcagagccgcgacaacccaaaggccgactggtacgtctgggccgatccccaagaagacggcacgccgccgaacaactggctgtcgatctttggcggttccgcctggcattgggacgcgcgccgcgagcaatattatctgcacaattttctggtctcgcagcctgacctaaatttccattgtccggacgtgcagaatgcgcttttggatgtgacccgcttctggctcgagcggggagtcgatgggttccgcttggacaccatcaatttctacatccacgacaaggagttgcggtcgaacccagcgcttcccaaggatcagcgcaatgccaatatcgccccttcggtgaacccctataaccatcaggaacacctctactccaagaaccagccggaaaacctcgattttctcgcgcggttccgtgcgcttttggacgaatacccggccaagaccgcggttggcgaagtcggcgatgcgcagcgcgggctggaactattgggacagtacacggccggcaacaccggtgtccacatgtgctatgccttcgagttcctggccaaagatccgctaaccgccgcgcgcgtggctgaggtttttgagcgcacagatgaggtagcagccgatggttgggcctgttgggccttctccaaccatgatgttcagcggcacgtcagccgatgggggttgtcggacgctgcgctgcgcctccatgcgactttgatcatgtgcctccgcggctctgtctgcatctatcagggcgaagaactggggctgccagaggccgatatttcctttgaagatctgcaagatccctatgggattgagttctggcctgaattcaaaggacgcgatggatgccgcactccgatggtctggcgcagcgacaatacgcatggcggcttctccgaggcgcgtccttggctgccggtcagcctcgagcatgcggcgctgtccgtagcagagcaagaagcaaaccccgatgcgttgctgcaccactaccgccgcgtgattgccctgcgacgcgcccacgcggcactgtcgcacggaacccacgacaaggtcgtggcaagcgggtctgtcgttcattttctgcgcagcgccgagtccgaggacatcttctgtgccttcaatcttggcgaggcggcggcagaggtcagcttgcccgcgggaacgtgggagcagcttggtgctgacatcggcactgccgaaatcaatggtgatctggtgaaacttggcccttggcaagcctgcctcgtacggcgcgtataa

SEQ ID NO: 32957 - protein, 550 aa, Silicibacter sp. TM1040
MNAQTTINPASVLSNDPDWWRGAVIYQIYPRSYQDSNGDGIGDLQGITSRLDHIASLGVDAIWISPFFTSPMKDYGYDVSDYCDVDPMFGNLADFDALVARAHDLGLRVMIDLVLSHSSDQHPWFAESRQSRDNPKADWYVWADPQEDGTPPNNWLSIFGGSAWHWDARREQYYLHNFLVSQPDLNFHCPDVQNALLDVTRFWLERGVDGFRLDTINFYIHDKELRSNPALPKDQRNANIAPSVNPYNHQEHLYSKNQPENLDFLARFRALLDEYPAKTAVGEVGDAQRGLELLGQYTAGNTGVHMCYAFEFLAKDPLTAARVAEVFERTDEVAADGWACWAFSNHDVQRHVSRWGLSDAALRLHATLIMCLRGSVCIYQGEELGLPEADISFEDLQDPYGIEFWPEFKGRDGCRTPMVWRSDNTHGGFSEARPWLPVSLEHAALSVAEQEANPDALLHHYRRVIALRRAHAALSHGTHDKVVASGSVVHFLRSAESEDIFCAFNLGEAAAEVSLPAGTWEQLGADIGTAEINGDLVKLGPWQACLVRRV

SEQ ID NO: 32958 - DNA, 1629 bp, Streptococcus suis
  CDS (1)..(1629)
atgacaatagacaaacgaaaggttgtttatcaaatctacccaaaatcttacaaggatacaactggaaatggtgtaggggatttacgaggaattattgaaaaactcccatatttaaaagagctaggtattgatatgatttggctcaatcccttctacccaagtcctcagcgggacaacggctatgatatttctgattatacagctgtcaatcctgattttggcaccatggctgactttgaagaaatggtgactgtcggcaaagaactaggcatcgaattcatgctagacatggtcctcaatcactgctcaaccgaccacgaatggttccaaaaagccctttccggcgaccaatattaccaagatttctttatcctgcgtgaccagccaactgactgggtgtccaagtttggtggcaatgcctgggctccttttggagatactgggaaatactacctccacctctttgacgtgacccaagccgacctcaactggcgaaatcctcatatccgtgaagaactcttcaaggtggtcaacttctggaaagacaagggtgtcaaaggcttccgcttcgacgttattaacctgattggtaaggacgaagctagggaagattgcccaattaatgacggcaagccagcttacaccgaccgcccgattacccacgattacctcaagatgatgaacaatgctacttttggtagtgaaaagggcttcatgaccgttggggaaatgtctgccaccaccattgaaaactgtatcctctacacagctcctgaacggaaagaattgtccatggccttcaacttccaccacttgaaagtggattacaaggacgggcaaaaatggaccatcatggactttgactttgaagaactcaaacacctcttccacacttggggtgaagaaatgtccgtcggaaatggctggaacgcccttttctacaacaaccacgaccaacctcgtgccctaaaccgctttattgatgtggagaatttccgcaaggaaggagcaaccatgttggcagcctctatccacctatcacgcggcaacaaccttacatctacatgggtgaggagatcggtatcatcgaccctgactacgatagcatggacgactacgtggacgtggagtctatcaatgcctaccagatgctcttggaccaaggtcacacgcctaagcaggccttcaagattatccaggccaagtcccgtgacaattcccgcaccccgatgcaatgggacgcttctgacaatgcaggcttctcaacaggcaactccttggttgaaagctggcaaatcctaccaaacgattaacgttgaacaggaaaaaacaggcccaatctttaccttctacaaaagaactcatccgctgcggaaagaactccctctgatttcagaaggggactacaaggcagcctacaaggatagccagaaagtctacgcctttgaacgcttgctaaatgacgaaaaactgttggtcctcaacaatttctttgcagaagaggtcgaattagacctggcagacgactatgcccacggccaagtcctcatcagcaactatcctgacaacaaactaggcaaaaaaatcattctcaaaccttaccaagcattggcgattcaagttaaataa

SEQ ID NO: 32959 - protein, 542 aa, Streptococcus suis
MTIDKRKVVYQIYPKSYKDTTGNGVGDLRGIIEKLPYLKELGIDMIWLNPFYPSPQRDNGYDISDYTAVNPDFGTMADFEEMVTVGKELGIEFMLDMVLNHCSTDHEWFQKALSGDQYYQDFFILRDQPTDWVSKFGGNAWAPFGDTGKYYLHLFDVTQADLNWRNPHIREELFKVVNFWKDKGVKGFRFDVINLIGKDEAREDCPINDGKPAYTDRPITHDYLKMMNNATFGSEKGFMTVGEMSATTIENCILYTAPERKELSMAFNFHHLKVDYKDGQKWTIMDFDFEELKHLFHTWGEEMSVGNGWNALFYNNHDQPRALNRFIDVENFRKEGATMLAASIHLSRGNNLTSTWVRRSVSSTLTTIAWTTTWTWSLSMPTRCSWTKVTRLSRPSRLSRPSPVTIPAPRCNGTLLTMQASQQATPWLKAGKSYQTINVEQEKTGPIFTFYKRTHPLRKELPLISEGDYKAAYKDSQKVYAFERLLNDEKLLVLNNFFAEEVELDLADDYAHGQVLISNYPDNKLGKKIILKPYQALAIQVK

SEQ ID NO: 32960 - DNA, 1701 bp, Streptomyces coelicolor
  CDS (1)..(1701)
atgatcgtcaacgagcccgtgccggacaccttcgaggacacccccgccaaggaccgggacccggactggttcaaacgagccgtcttctacgaggtcctcgtccgctccttccaggacagcaacggcgacggcatcggtgatctcaagggcctgaccgccaagctggactacctgcaatggctcggcgtggactgcctgtggctcccgcccttcttcaagtcaccgctgcgcgacggcggttacgacgtctccgactacaccgccgtgctgccggagttcggcgacctggccgacttcgtggagttcgtggacgcggcgcaccagcgcggcatgcgcgtgatcatcgacttcgtcatgaaccacaccagcgaccagcacccgtggttccaggagtcccgcaggaacccggacggcccctacggcgactactacgtctgggccgacgacgacaagcagttccaggacgcgcggatcatcttcgtcgacaccgaggcgtccaactggacctacgacccggtgcgcaagcagtactactggcaccggttcttctcccaccagccggacctcaactacgagaacccggtcgtgcaggaggagatgatctccgcgctgaagttctggctggacctgggcatcgacgggttccggctggacgcggtgccgtacctctaccaggaggagggcaccaactgcgagaacctcccgcgcacgcacgacttcctgaagcgggtgcgcaaggagatcgacgcgcagtacccggacacggtggtgctggccgaggccaaccagtggccggaggacgtggtcgactacttcggcgactacgcggcgggcggcgacgagtgccacatggccttccacttccccgtcatgccccgcatcttcatggcggtcagaagggagtcccgctacccggtctccgaaatcctcgccaagaccccggccatcccgtccggctgccagtggggcatcttcctgcgcaaccacgacgagctgaccctggagatggtcaccgacgaggaacgcgactacatgtacgcggagtacgccaaggacccgcgcatgcgcgccaacatcggcatccggcgcaggctcgccccgctcctcgacaacgaccgcaaccagatcgagctgttcaccgccctgctgctgtccctgcccggctcgccgatcctctactacggcgacgagatcggcatgggcgacaacatctggctcggcgaccgcgacgccgtgcgcacccccatgcagtggacgcccgaccgcaacgcgggcttctcgtcgtccgacccgggccgcctgttcctgcccacgatcatggacccggtccacggttaccaggtgacgaacgtcgaggcgtccatggcctcgccctcctccctgctgcactggacccggcgcatgatcgagatccgcaagcagaacgtggccttcggcctgggcacctacaccgagctgccgtcgtccaaccctgccgtcctggccttcctgcgcgaacacgaggacgacctggtgctgtgcgtccacaacttctcccggttcgcgcagccgacggagctggacctcagcgccttcgacggacgccatccggtcgagctgttcggcggggtccgcttcccggcggtcggtgacctgccgtacctcgtgaccctgggcggtcacggcttctactggttccgcctgcgcaaggacgccgcctga

SEQ ID NO: 32961 - protein, 566 aa, Streptomyces coelicolor
MIVNEPVPDTFEDTPAKDRDPDWFKRAVFYEVLVRSFQDSNGDGIGDLKGLTAKLDYLQWLGVDCLWLPPFFKSPLRDGGYDVSDYTAVLPEFGDLADFVEFVDAAHQRGMRVIIDFVMNHTSDQHPWFQESRRNPDGPYGDYYVWADDDKQFQDARIIFVDTEASNWTYDPVRKQYYWHRFFSHQPDLNYENPVVQEEMISALKFWLDLGIDGFRLDAVPYLYQEEGTNCENLPRTHDFLKRVRKEIDAQYPDTVVLAEANQWPEDVVDYFGDYAAGGDECHMAFHFPVMPRIFMAVRRESRYPVSEILAKTPAIPSGCQWGIFLRNHDELTLEMVTDEERDYMYAEYAKDPRMRANIGIRRRLAPLLDNDRNQIELFTALLLSLPGSPILYYGDEIGMGDNIWLGDRDAVRTPMQWTPDRNAGFSSSDPGRLFLPTIMDPVHGYQVTNVEASMASPSSLLHWTRRMIEIRKQNVAFGLGTYTELPSSNPAVLAFLREHEDDLVLCVHNFSRFAQPTELDLSAFDGRHPVELFGGVRFPAVGDLPYLVTLGGHGFYWFRLRKDAA

SEQ ID NO: 32962 - DNA, 1668 bp, Bacillus stearothermophilus
  CDS (1)..(1668)
ttgaaaaaaacatggtggaaagaaggcgttgcgtatcaaatttatcctcgcagctttatggatgccaacggcgacggcatcggtgatcttcgcggcatcatcgaaaagctggattatttggtggagcttggagtcgacatcgtttggatttgtccgatttaccggtcgccgaacgctgataatggatatgacatcagcgactattatgccattatggatgagtttggaacgatggatgacttcgatgaattgcttgcccaagcccatcggcgcgggttgaaaatcattttggatttggtcatcaatcatacgagtgatgagcatccgtggtttatcgaatcgcggtcatcgcgagacaatccgaagcgcgactggtacatttggcgcgacggcaaagatgggcgcgaaccgaacaactgggaaagcattttcggcggctcggcatggcagtatgacgagcggacgggtcagtactatttacatcttttcgatgtgaaacagcccgatttgaactgggaaaacagcgaggtgcgccaagcgctgtatgacatgatcaactggtggctggataaaggcatcgacggctttcgcatcgacgcgatttcccacattaagaaaaagccgggtcttcccgatttgccaaatccgaaggggctgaagtacgtgccgtcatttgctgcgcacatgaaccagccagggattatggagtatttgcgagagttgaaagagcaaacgtttgcacgatatgacattatgacggtcggcgaggcgaacggagtaacggttgatgaggccgaacaatgggtcggggaagaaaacggcgtgtttcatatgatttttcagttcgagcatttagggctttggaaaaggaaagcagatggttcgatcgatgtccgccggctgaagcggacgttgacgaaatggcaaaaaggattggaaaatcgtgggtggaacgcgctctttttggaaaaccacgacttgcctcgatcggtgtcgacgtggggcaatgaccgcgagtattgggcggagagcgcgaaggcgcttggcgcgctctactttttcatgcaagggacgccgttcatttaccaagggcaagagatcgggatgacgaacgtgcaattctccgacattcgcgattaccgcgatgtcgctgccttgcgtctgtatgagctcgaacgggcgaacggccggacgcatgaggaagtgatgaagatcatttggaaaaccgggcgcgacaactcgcgcaccccgatgcaatggtctgatgccccgaatgcagggtttacgactggcacgccatggatcaaggtgaacgaaaactatcgtacgatcaatgtcgaggccgagcggcgcgacccgaactcagtatggtcgttttatcgacaaatgattcagcttcggaaagcgaacgagctgtttgtttacggagcgtacgatctgcttttggaaaatcacccatccatttacgcgtacacaagaacgcttggccgcgatcgggcgcttatcattgtcaacgtatccgatcgtccttcactttaccgctatgacggcttccgccttcagtcaagcgatttggcgctttcgaactacccggtccgtccgcataaaaatgcgacgcgttttaagctgaagccgtacgaggcgcgcgtatacatctggaaagaataa

SEQ ID NO: 32963 - protein, 555 aa, Bacillus stearothermophilus
MKKTWWKEGVAYQIYPRSFMDANGDGIGDLRGIIEKLDYLVELGVDIVWICPIYRSPNADNGYDISDYYAIMDEFGTMDDFDELLAQAHRRGLKIILDLVINHTSDEHPWFIESRSSRDNPKRDWYIWRDGKDGREPNNWESIFGGSAWQYDERTGQYYLHLFDVKQPDLNWENSEVRQALYDMINWWLDKGIDGFRIDAISHIKKKPGLPDLPNPKGLKYVPSFAAHMNQPGIMEYLRELKEQTFARYDIMTVGEANGVTVDEAEQWVGEENGVFHMIFQFEHLGLWKRKADGSIDVRRLKRTLTKWQKGLENRGWNALFLENHDLPRSVSTWGNDREYWAESAKALGALYFFMQGTPFIYQGQEIGMTNVQFSDIRDYRDVAALRLYELERANGRTHEEVMKIIWKTGRDNSRTPMQWSDAPNAGFTTGTPWIKVNENYRTINVEAERRDPNSVWSFYRQMIQLRKANELFVYGAYDLLLENHPSIYAYTRTLGRDRALIIVNVSDRPSLYRYDGFRLQSSDLALSNYPVRPHKNATRFKLKPYEARVYIWKE

SEQ ID NO: 32964 - DNA, 1800 bp, Anopheles gambiae
  CDS (1)..(1800)
atggccctctactactggctagctttactactgttgggctggtctactgtgaccgcccagaaggattggtgggaaagtgcgagcttctatcaaatctatccgcgatcgtttcaagatagtaacggcgatggaataggcgatcttaatggcatcaaaagtcggttgccgtatctgaagtcactcggtatgactgcattttggctttccccgatctacccttcgccgatggccgactttgggtatgatatctccaactttatggacattcatccgagctttggaacgttggctgactttaagcagctggtggaagaagcgaaaaaactgcaattacgcatcatcctcgacttcgtgcctaaccattcgagcgacgagcatgagtggttcaagaaaagcgttcagcgagtaagtgggtacgaagactattacgtgtggcaggatcccaaaccgggcacggaacgcgaccctccaaacaactgggttgcagcatggtacggttcggcgtgggaatggaatgacgagagaaagcaattttatctgcaccagtttcacaagaagcagcccgatctgaactaccgcaacccggccgtggtgcaggctatgaaggatgtgttgcgcttctggttggaccagggcgtcgacggcttccgtattgatgcggtcccgtggctgttcgagacggtgggtttcccggacgaacctgttagcggtcattccaccgatccgttaagtcagaactaccttacccacatttatacgctcgatcaaccggaaaccgttgacatgatgtatcaatggcgggaattgatggatcagtacaaacaagagcacaataccaccaccaaagtgctcatgaccgaggcatggtcctcgttggatgttgtaaaaacgtacttcaacgacagtaacaaccggcaaggatcgcaaatgccgttcaacttccagttaatcatgcggctggatcaaaattctaaagcatccgattttcagacggttattaactcgtggctggatatcattcctcctggccacacgcccaactgggtgcttggtaatcacgacaaacgtcgtgtttcgtcacggatgggtggagatcatatggtagacataatggcaatgatcgagctcaccttacccggcataacggtcacttaccagggagaagaaattggaatgcatgacgttgatatctcgtgggcggacactcaagatcctgctgcatgccagctgaccgaagagacgtatcaggaaggtacacgcgacccagccagaacaccgttccagtgggattctactgcaaacgcaggttttacgaacgcttctgtaaaaccgtggcttccgctagctaccgattatccgctggtgaacgtaaaaacacaacaagaatcagcccaaaacagtcatataaaggtgttcaaggagctgatgaacttacgcggcacaaacacgcttatctggggctcgtttaagtcactggtacttggcgaaaatgtgtacgctatactgcgttctttccccaacgacaaacgaacatatgtcgtgctggcaaacattggctccaagagcgaaataattgacgctacaaaactggacaacagtttaccgaacgagcttgtgtttcgcgtggtaagcgtatcgtcaaatcatatcaccggagaatcggtcgcaacaaacaacattcttttacagccttacgaagccgtagttttggctaaccatgcaattcgactggcgcagcagctttatgtattgatcggtgcttttggtatgttggtgggtgtgcaattgtttaaggcgtaa

SEQ ID NO: 32965 - protein, 599 aa, Anopheles gambiae
MALYYWLALLLLGWSTVTAQKDWWESASFYQIYPRSFQDSNGDGIGDLNGIKSRLPYLKSLGMTAFWLSPIYPSPMADFGYDISNFMDIHPSFGTLADFKQLVEEAKKLQLRIILDFVPNHSSDEHEWFKKSVQRVSGYEDYYVWQDPKPGTERDPPNNWVAAWYGSAWEWNDERKQFYLHQFHKKQPDLNYRNPAVVQAMKDVLRFWLDQGVDGFRIDAVPWLFETVGFPDEPVSGHSTDPLSQNYLTHIYTLDQPETVDMMYQWRELMDQYKQEHNTTTKVLMTEAWSSLDVVKTYFNDSNNRQGSQMPFNFQLIMRLDQNSKASDFQTVINSWLDIIPPGHTPNWVLGNHDKRRVSSRMGGDHMVDIMAMIELTLPGITVTYQGEEIGMHDVDISWADTQDPAACQLTEETYQEGTRDPARTPFQWDSTANAGFTNASVKPWLPLATDYPLVNVKTQQESAQNSHIKVFKELMNLRGTNTLIWGSFKSLVLGENVYAILRSFPNDKRTYVVLANIGSKSEIIDATKLDNSLPNELVFRVVSVSSNHITGESVATNNILLQPYEAVVLANHAIRLAQQLYVLIGAFGMLVGVQLFKA

SEQ ID NO: 32966 - DNA, 1764 bp, Bacillus sp
  CDS (1)..(1764)
ttgtccaccgccttgacgcagacctcaacgaactcgcagcaatcgcccattcgccgggcgtggtggaaggaagcggtcgtataccagatttatccgagatccttcatggactcgaatggcgacggtatcggcgatttgcgcggcatcctctcgaagctggactacctcaaactgctcggcgtggatgtgttgtggctgaatcccatctacgactcgccgaatgacgacatgggctatgacatccgcgactactacaagattatggaagagttcgggacgatggaggactttgaggagctgctgcgcgaggtgcacgcccgcggcatgaagctggtcatggacctggtggccaaccatacctcagacgagcacccgtggttcatcgagtcacgctcctcgcgcgacaacccgtaccgcgactggtacatttggcgcgatccgaaagacggccgcgagccgaacaactggttgtcgtatttcagcggatcggcctgggaatacgacgagcgcacggggcagtactacctgcacttgttcagccgcaggcagccggacttgaactgggaaaacccaaaggttcgcgaggccatcttcgagatgatgcggttctggctcgacaaagggatagatggcttccgcatggatgtcatcaacgccatcgccaaggccgagggtctgccggacgcgccggcgcgtcccggagagcgttacgcttggggcggccagtactttctcaatcagccgaaggtccacgagtacctgcgcgagatgtatgataaggtgctctctcattacgacatcatgaccgtcggcgagaccggcggtgtgacgacaaaggatgcactcttgtttgccggtgaagaccggcgcgagctgaacatggtcttccagtttgaacacatggacatcgatgcgaccgacggcgacaagtggcggccgcggccgtggcgattgaccgagttgaaaaccatcatgacgcggtggcaaaatgatttgtacggcaaggcctggaacagcctgtactggaccaaccatgaccagccccgcgcggtgtcgcggtttggcaacgacggtccctaccgcgtggagtcagccaagatgcttgccaccgtcctgcacatgatgcaggggaccccctacatctaccagggcgaggaaatcggcatgacgaactgtccgtttgactctattgacgagtaccgggacgtcgagatccacaacctgtggcggcaccgtgtgatggaaggcggccaggaccctgccgaggtgctgcgcgtcatccagctcaaagggcgggacaacgcgcgcacgcccatgcagtgggacgattcaccgaacgccgggttcaccaccggtacgccgtggatcaaggtgaacccaaactatcgcgagattaacgtcaagcaggccctggcggacccgaactcgattttccattactaccgccgcctgattcagttgcgcaaacagcatcccatcgtggtgtacggcaagtatgacctgattctgccggatcacgaggagatttgggcttacacgcgcacgctgggagacgagcgctggctgattgtggccaacttctttggcggcactccggagttcgagctgccgccggaagtccggtgcgagggcgcagagctggtgattgccaactacccggtggacgattcggaagcgggcggtccagcggccgctggggcacctcaccgcttccgtctgcgcccgtacgaatgccgcgtctaccggctgctcggctggcactga

SEQ ID NO: 32967 - protein, 587 aa, Bacillus sp
MSTALTQTSTNSQQSPIRRAWWKEAVVYQIYPRSFMDSNGDGIGDLRGILSKLDYLKLLGVDVLWLNPIYDSPNDDMGYDIRDYYKIMEEFGTMEDFEELLREVHARGMKLVMDLVANHTSDEHPWFIESRSSRDNPYRDWYIWRDPKDGREPNNWLSYFSGSAWEYDERTGQYYLHLFSRRQPDLNWENPKVREAIFEMMRFWLDKGIDGFRMDVINAIAKAEGLPDAPARPGERYAWGGQYFLNQPKVHEYLREMYDKVLSHYDIMTVGETGGVTTKDALLFAGEDRRELNMVFQFEHMDIDATDGDKWRPRPWRLTELKTIMTRWQNDLYGKAWNSLYWTNHDQPRAVSRFGNDGPYRVESAKMLATVLHMMQGTPYIYQGEEIGMTNCPFDSIDEYRDVEIHNLWRHRVMEGGQDPAEVLRVIQLKGRDNARTPMQWDDSPNAGFTTGTPWIKVNPNYREINVKQALADPNSIFHYYRRLIQLRKQHPIVVYGKYDLILPDHEEIWAYTRTLGDERWLIVANFFGGTPEFELPPEVRCEGAELVIANYPVDDSEAGGPAAAGAPHRFRLRPYECRVYRLLGWH

SEQ ID NO: 32968 - DNA, 1698 bp, Haloarcula marismortui ATCC 43049
  CDS (1)..(1698)
atgaccgcagcgcgcgcctggtggaaggaagcagtcgtctaccagatctatccccggagcttcaacgacagcgacggcgatggcgtcggcgacttgcagggcatcattgagcgcctggattacgtcgccgacctcggcgtcgatgtcatctggctcaacccggtgtatgactctccccagaaggacaacggctacgacatcagcgattatcagaccatctacgacgagttcgggacgatggccgactgggaagcgctggttgaagaggtccacaaccgggatatgcggctcgttatggacctcgtcgtcaatcacacgtcggaccagcacgagtggtttcggaaatcccgccagcgcgacccggagtatgaggactattacatctggcgcgagggcgggacagatgaagacggcgaccccgtgccgccgaacaactgggagtccttcttcgggggctccgcgtgggagtacgacgaggagcgcagcgagtacttcctccacctgtacgacacctcacagccggacctgaactggcgcaacgattcggtccggacggacatcttcgacaccatcgagtggtggctggagaagggcatcgacggcttccggatggatgtcatcaaccttctgtcgaaagtcgaggggctgcccgacggcgacccggacagcgagtgggttggcgccgagcatttcatcgacggcccggagatgctgtcgtacctgacggcgttagatgaggaagtgctatcgaactatgacgtgatgaccgtcggggagatgccacagctcaccgtcgaatcggctctcgagtacgccgacacagacggcccgctggacatggcgtttcacttccagcacacgaaactcgattacgctgacggcgagcggtggtctgtcggtgactggagcctgccggaactgaagcgtatcatcggccgctggcaggacgggctggcggcggacggctggaacacgctgtactgggagaaccacgaccagccgcggagcgtctcccgctacggcgaccccgagaactatcgccgggaatccgcaaagctactcggaacgttcatcctcacgctccgtggcacgccatacgtctatcaggggcaggaactcgggatgacgaacgccgactgggagacgatggacgacctccgcgacgtggacgcgatcaaccacgcgcgagagttactcgaccgagacggggtcgaggagtacgatgacgtgaaagatatcgtcggctaccggacccgcgacaacgctcgaacgccaatgcaatgggacgactcgaaaaacgccgggttcaccgacggcgacccctggattcaggtcaatccgaactacagagagatcaacgctgccgaccagcaagccgatgtggattccgtctacagctactaccagcggctcatccagttgcgcgccgacagggacgtgctggtgtacggggactacaccgacctgctccccgaccacgaaactgtcttcgccttcacacggtcgttgtcggcggactcgggaaccgagcgaatcctcgtcgtcttgcatttcgacgacgcaacggagaccctcgacctcccggtcgagtacgccgatgcgacgctgctcgagggcaactacgactgtgacgacacggacccgggaacggtgacgctcgcgccgtacgaggctcgcgtctacgagctattcgactga

SEQ ID NO: 32969 - protein, 565 aa, Haloarcula marismortui ATCC 43049
MTAARAWWKEAVVYQIYPRSFNDSDGDGVGDLQGIIERLDYVADLGVDVIWLNPVYDSPQKDNGYDISDYQTIYDEFGTMADWEALVEEVHNRDMRLVMDLVVNHTSDQHEWFRKSRQRDPEYEDYYIWREGGTDEDGDPVPPNNWESFFGGSAWEYDEERSEYFLHLYDTSQPDLNWRNDSVRTDIFDTIEWWLEKGIDGFRMDVINLLSKVEGLPDGDPDSEWVGAEHFIDGPEMLSYLTALDEEVLSNYDVMTVGEMPQLTVESALEYADTDGPLDMAFHFQHTKLDYADGERWSVGDWSLPELKRIIGRWQDGLAADGWNTLYWENHDQPRSVSRYGDPENYRRESAKLLGTFILTLRGTPYVYQGQELGMTNADWETMDDLRDVDAINHARELLDRDGVEEYDDVKDIVGYRTRDNARTPMQWDDSKNAGFTDGDPWIQVNPNYREINAADQQADVDSVYSYYQRLIQLRADRDVLVYGDYTDLLPDHETVFAFTRSLSADSGTERILVVLHFDDATETLDLPVEYADATLLEGNYDCDDTDPGTVTLAPYEARVYELFD

SEQ ID NO: 32970 - DNA, 1563 bp, Bacillus sp
  CDS (1)..(1563)
atgaaagggaaaaaatggacagctttagctctaacactgccgctggctgctagcttatcaacaggcgttcacgcggaaaccgtacataaaggtaaatctccagctgcagataaaaacggtgtattttatgaggtgtatgtaaactctttttacgatgcaaataaagatggacatggtgatttaaaaggtcttacacaaaagctggactatttaaatgatggcaattctcatacaaagaatgatcttcaagtaaacgggatttggatgatgccggtcaacccttctcctagctatcataaatatgatgtaacggactattataacattgatcctcagtatggaaatctgcaagattttcgcaaactaatgaaagaagcagataaacgagatgtaaaagttattatggacctcgttgtgaatcatacgagcagtgaacacccttggtttcaagctgcgttaaaagataaaaacagcaagtacagagattactatatttgggctgataaagataccgacttgaatgaaaaaggatcttgggggcagcaagtatggcataaagctccaaacggagagtatttttatggaacgttctgggaaggaatgcctgacttaaattacgataaccctgaagtaagaaaagaaatgattaacgtcggaaagttttggctaaagcaaggcgttgacggcttccgcttagatgctgccctccatatctttaaaggtcaaacacctgaaggcgctaagaaaaatctcctgtggtggaatgagtttagagatgcaatgaaaaaagaaaaccctaacgtatatctaacgggtgaagtatgggatcagccggaagtagtagctccttattatcagtcgcttgattccctatttaactttgatttagcaggaaaaattgtcagctctgtaaaagcaggaaatgatcaaggaatcgctactgcagctgcggcaacagatgaactgttcaaatcatacaatccaaataaaattgacggcattttcttaaccaatcatgaccaaaatcgcgtcatgagtgagttaagcggagatgtcaataaagcaaagtcagctgcctctatcttacttacgcttcctggaaatccgtatatttattacggtgaagaaatcggcatgaccggtgaaaagcctgatgaattaatccgtgaaccgttccgctggtacgaaggaaacggacttggacaaactagttgggaaacacctgtatacaataaaggcggcaacggcgtgtctgtagaagcacaaaccaaacaaaaggactctttgttaaatcattatcgtgaaatgattcgcgtgcgtcagcagcacgaagagttagtaaaaggaacgcttcaatctatttcagtagacagtaaagaagttgttgcttatagccgtacgtataaaggcaactccattagtgtgtatcataatatttcaaatcaacctgtaaaagtatctgtagcagcgaaaggtaaattgatttttgctagtgaaaaaggtgctaagaaagtcaagaatcagcttgtaattccggcgaatacatcggttttgataaaataa

SEQ ID NO: 32971 - protein, 520 aa, Bacillus sp
MKGKKWTALALTLPLAASLSTGVHAETVHKGKSPAADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKDTDLNEKGSWGQQVWHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGNSISVYHNISNQPVKVSVAAKGKLIFASEKGAKKVKNQLVIPANTSVLIK

SEQ ID NO: 32972 - DNA, 1581 bp, Xanthomonas campestris
  CDS (1)..(1581)
atgtcttcgtcctgccgtttccgcccgttgtcgttcctgctcgccgccgcgctcggcgcatccgcggcgttcgcgccgtccgtgcatgccgccgatgccgcgcctgccactccgcggtccgaaggctccggcgtgtggtacgagatcttcgtgcgcgcctggtacgacaccgacggtgacggcatcggcgatctcaacggcgtcaccgccaagctcgactacctgcaatcgctcggcgtcagcggcatctggctgatgccgatcaatccgtcgcccagctaccacggctacgacatcaccgactacgaggggatcaacccgcagtacggcacgatggccgacttcgagaagctggtgagcgaagcgcacaagcgcggcatcgaggtgatcctcgacctggtgatcaaccacaccagcgaccagcatccatggttcaaggcggcgctggatccgaaggacgcgcatcgttcctggtacacctgggcaggcccgggtacgaacctgaaggcggtcagcgcggtgggcggcccggcgtggcatgccaacggcaagcagcactacctgggcgatttcaccggcgccatgccggacctcaactacgacgagccagcggtgcgccgcgagatgatcgcggtcggcaagttctggctggacaagggcgccgatggcttccgcctggatgccgcgcgccacatctatgacgatctggaaagcgacaacggccagcccgccgtgatcgccaggaatgcccagtggtggaacgagttccgccagggtttgcggcaggtccgtccggacgtctatctggtcggcgaggtctcggccaagcagccgggcgagctggcgccgtatctgccggcactgggctcggtgttcgactttccgctggccgagcagctgatcgccagcgccgggcaggaaaaggccggcaagctgccggcgctgctcaccgaaacgtacgcggccttccgtgccgccgcgggcgacgactacgccgacgcgccgttcctttccaaccacgatcaggagcgtgtgctcagccagctcggcggcgatctgcgccacatgcgcacggcggcggcgatgctgctgaccttgcccggccggccgtacctctactacggcgaagagatcggcatgctcggccgcaagccggacgagaacctgcgcgaacccatgcgctggcagcgccaggccggcgcgccgggcgacagccgctggaagccgtacagcgtgaagcagggcggcgaagtgtcggtgcaggccgagcaggatcggcccgattcgctcctgagcttctaccggacgctgatccattggcgcgtggaggtgccggcgctgcgcgacggcgcgctgcgcgtggtcgataccggcgccccggcgctggtggcctacgagcgcgtcacggcggacagccgcgcgctggtggtgcacaacctctcgggcaagccggcgagcatgaagctcggcgccgaccgcgccaaggccttcgccgccatccgcctgcacagtgcgcctggcgcgacgctgacggagggccggctcaccgtgccggcgtacgccaccgtggtgttgcagtga

SEQ ID NO: 32973 - protein, 526 aa, Xanthomonas campestris
MSSSCRFRPLSFLLAAALGASAAFAPSVHAADAAPATPRSEGSGVWYEIFVRAWYDTDGDGIGDLNGVTAKLDYLQSLGVSGIWLMPINPSPSYHGYDITDYEGINPQYGTMADFEKLVSEAHKRGIEVILDLVINHTSDQHPWFKAALDPKDAHRSWYTWAGPGTNLKAVSAVGGPAWHANGKQHYLGDFTGAMPDLNYDEPAVRREMIAVGKFWLDKGADGFRLDAARHIYDDLESDNGQPAVIARNAQWWNEFRQGLRQVRPDVYLVGEVSAKQPGELAPYLPALGSVFDFPLAEQLIASAGQEKAGKLPALLTETYAAFRAAAGDDYADAPFLSNHDQERVLSQLGGDLRHMRTAAAMLLTLPGRPYLYYGEEIGMLGRKPDENLREPMRWQRQAGAPGDSRWKPYSVKQGGEVSVQAEQDRPDSLLSFYRTLIHWRVEVPALRDGALRVVDTGAPALVAYERVTADSRALVVHNLSGKPASMKLGADRAKAFAAIRLHSAPGATLTEGRLTVPAYATVVLQ

SEQ ID NO: 32974 - DNA, 1554 bp, uncultured bacterium
  CDS (1)..(1554)
atgaaaaaatccatcctaactacctccatttttgcacttgtcgctttttcttcctgcgaaaaaaagcctgctccggaagtcaaaaactattggcctcaagcaggagtgacctatgagatttttgttcaatctttttatgattctaacggagacagtattggggattttaatggggtcactcaaaaactggactatgtgaaggagttgggggccaatgccatttggtttatgccgattatgccttcgccaacttaccataagtacgatgtgacggactacaaggcggttcatccagattacggtacgctggatgatttcaaaaagcttttggacgaagctcacaagcgggacatcaagattgtgatcgatttgatcatcaatcacaccagcaacgaacatccgtggtttttggaagcaaaatccggtagggataatccctatcgcgattactacgtgtgggcgcaaaaggacaccattgctgattttttgaacaaaaagaccatcacgtttgatttggataatatccgtcaatggcatgacccgggacagggagaagatttttactacgggtttttctggggtggaatgcctgatctgaactttgacaatcctaaggtaagagaggaaatctatgaaatcggacgattctggttggaagaagtgggtgtggacggatttcggttggacgctgccaagcatatttttcccgatgaccgacctttggataatcatgccttttggaaagaattccgggcaaaaatggaagtcataaagccggatgtttacttggtaggagaggtgtatgacaaaaaagaagtcgtggctccttatcttcctgggttgccagccttgttcaactttgattttcattacactctgcttgagaccatgaataccggggacgggatgcttttggccaagaagcagaaggagattttggacttttatcagggaatcacatcaagctttatcgatgcgaccatttcttctaaccatgatcagccccgtctgctgaatgaattgggatctgatccggccaaatacaagcaggccatcgcagtgatgctcagcatgccgggagcgccatatttgtattatggggaagagatcgggatgctgggtctcaagccggacgagcatatccgggagcctttcctttgggatgaaaaaagcaaggatacaggtcgcaccaagtggatcaaacccaaatacagcaaagactcaacagtaacctcattggaggtccaaaagaaagattccaacagctatttcaatcattacaaaaacttaattgctcttcgtaattcttatcctgctttggctattggttctttggaacttccagctgaggaattacctaaaagtgtaatggcatatttcagaaagtctggagatcaggaaatctttgtggttcacaatgtggacaaggaggaagttgacattcagcttccagagggatttgaagaagttattttctatttgggtgaggggaaaaacagttcaggaaaacttcagctaaaaggcaactcgagtatggtttttttgaaggattaa

SEQ ID NO: 32975 - protein, 517 aa, uncultured bacterium
MKKSILTTSIFALVAFSSCEKKPAPEVKNYWPQAGVTYEIFVQSFYDSNGDSIGDFNGVTQKLDYVKELGANAIWFMPIMPSPTYHKYDVTDYKAVHPDYGTLDDFKKLLDEAHKRDIKIVIDLIINHTSNEHPWFLEAKSGRDNPYRDYYVWAQKDTIADFLNKKTITFDLDNIRQWHDPGQGEDFYYGFFWGGMPDLNFDNPKVREEIYEIGRFWLEEVGVDGFRLDAAKHIFPDDRPLDNHAFWKEFRAKMEVIKPDVYLVGEVYDKKEVVAPYLPGLPALFNFDFHYTLLETMNTGDGMLLAKKQKEILDFYQGITSSFIDATISSNHDQPRLLNELGSDPAKYKQAIAVMLSMPGAPYLYYGEEIGMLGLKPDEHIREPFLWDEKSKDTGRTKWIKPKYSKDSTVTSLEVQKKDSNSYFNHYKNLIALRNSYPALAIGSLELPAEELPKSVMAYFRKSGDQEIFVVHNVDKEEVDIQLPEGFEEVIFYLGEGKNSSGKLQLKGNSSMVFLKD

SEQ ID NO: 32976 - DNA, 1707 bp, Aspergillus parasiticus
  CDS (1)..(1707)
atggccacccagcacaagacacagtcatcgcctgttaatgcggcctggtggaaaaaagcctcggtctatcaaatttatccagcttcgttcaaagactccaatggcgatggaatcggcgatatccccgggattatctcggaacttgactacctgaaagcccttgggatagatctcgtttggctctctccgatccttcagtccccgcaggtggacatgggctacgatgtctctgactattatcaaattcaccccccatacggtacagtcgaagacgtggatgcgctcattcagggtttacatcagcgagggatgagatatgtcatggaccttgttgtaaatcatacttcagaccagcacgagtggttcaaacagtctagatcctcttcagacaatgaataccgagactggtacatatggaaaaagcccaagtacgatgcaaatggtgtccgccagccgccgaataactggagcgcctattttggaggttcggcatggcagtacgacgaaacaactgatgaatattacctgcacctattcgcaccggagcagccagacctcaactgggaaaaccccaaagtccgctctgccgtgcaccagatcatgaggtattggctcgataaaggcgtcagtggattccgcatggatgtgatcaacatgatcagcaaggaccaaagcttcccagatgcgcccatcaccgacccaaaggcccaatggcagcatggggccgatgtactactgctgcggaccacgtcttcacgaatacctgcaagagctggggagggttctgaaggaatacgatgccttttcctgggctttgaccgcggcgaattggccatggcatttcagttcgagatcatggatatcgaccatggccctgggggcaaattctctccgcacaaatatcgaatgtcggacctgaagcatatcgtctccaaatggcaggacttcatgtacgagaatgaaggctggaacgccctctacctcgaaaaccatgaccagggaaggacgatatcacgatttacctcggccggtccggaataccgcgcgacggcggggaagatgctcgccaccttcctgggtcttcaagggggcactcctttcgtataccagggccaggaaataggtctggggaatgttccagagacctggggcattgagcaattcagagacatcgagactttgaattattggaacgagatagaacgagaaatggctgcatatcccaacgacacagagcttcacaaggtgacattagagcaattccgcgtaaagtctcgcgacaatggacgcaccccgatgcaatggaccagtggcaaatttgcagggtttacagctgcgcacaacggtccgtggattgatgttcatgacgactatgaagactggaatgccgcctcccaggtgggaaacccaaatagtgttttccaacactgggcaaaggtgctctcgctgcgcaaagcacataagaggctctttgtatatggctcgtacaaattgattgatgaagcgaataacgatttattcacttatctgcgagtttacggaggccaatcagctttggtgttggccaacttcacaggcaaagaagtgagctgggttgttcctgcggaaaccatttccattctcaaaaatggcgctgttcttttggaaagttatcagcgccacccgtccagtgcgaccggatggtacaatcgctgtaatgccatttga

SEQ ID NO: 32977 - protein, 568 aa, Aspergillus parasiticus
MATQHKTQSSPVNAAWWKKASVYQIYPASFKDSNGDGIGDIPGIISELDYLKALGIDLVWLSPILQSPQVDMGYDVSDYYQIHPPYGTVEDVDALIQGLHQRGMRYVMDLVVNHTSDQHEWFKQSRSSSDNEYRDWYIWKKPKYDANGVRQPPNNWSAYFGGSAWQYDETTDEYYLHLFAPEQPDLNWENPKVRSAVHQIMRYWLDKGVSGFRMDVINMISKDQSFPDAPITDPKAQWQHGADVLLLRTTSSRIPARAGEGSEGIRCLFLGFDRGELAMAFQFEIMDIDHGPGGKFSPHKYRMSDLKHIVSKWQDFMYENEGWNALYLENHDQGRTISRFTSAGPEYRATAGKMLATFLGLQGGTPFVYQGQEIGLGNVPETWGIEQFRDIETLNYWNEIEREMAAYPNDTELHKVTLEQFRVKSRDNGRTPMQWTSGKFAGFTAAHNGPWIDVHDDYEDWNAASQVGNPNSVFQHWAKVLSLRKAHKRLFVYGSYKLIDEANNDLFTYLRVYGGQSALVLANFTGKEVSWVVPAETISILKNGAVLLESYQRHPSSATGWYNRCNAI

SEQ ID NO: 32978 - DNA, 1650 bp, Spiroplasma citri
  CDS (1)..(1650)
atgaataaaataaattttcaagaagcgattgtatatgaaattcatccgcaatcgttttatgacagtaatcatgatggtgttggtgatttacaaggaattattcaaaaattagattatttagcaatgttaggagttaattatctatgattaaatccaatttatgtatcaccacaaaaagataatggttatgatgtttcagattacaaaaatattaatccactttttgggacaatgaatgattttgaaatgttagttacagaagctggaaagcgaaacatttatattatgatggatatgatttttaatcattgttcaacagaacatgaatgatttcaaaaagcacaaacagggaatttagattacttacaacgatttttctttcttcctggtgacaaagcaaagtgcccaaataattggcaaagtaagtttggtggttcggtatgagaatatcacgatgaattaaaaatgttttatttacatttatttgataaaacacaagttgatttaaattgaaagaatgaaagtttacgccaacatatttatcaaattgttaattattgattacaaaaaggggtgcgaggattacgatttgatgttattaatttaattggtaaaccaaatatttttgaaaatgacttaactggtgatggtcggaagtattatactgatacaccacaagttcatacatatttacaagaaatggcacagaatacttatttaaaaacaaatgacattattactgttggtgagttatcatcaacatcaataaaacaagcgattttatatacaaaaccagtgtcacaagaattaaatatggctttcacttttcatcatttaaaaattgattatttaaataatgaaaaatgaaaattagctccctatgatccagcgaaactagtagcaaaaattaaggaatgacaaatcccagtacaagcagcaggtggctggttagctaattttttaaataaccatgatcaaccacgggcattatctcgctttggtgatccagaaaattatcgttttgaatcagctacagctttagcggctgttgtcttgttactacgaggaacaccatatctttatcaaggggaagaatttggtatggaaaataataattatacaaagattgaacagttaaaagatgttgaatcaattaattattatcacattcttcaaaaagaaggagaacaaccaaatgctattttagaagtgttaagtgcacgctcacgtgataatgctcgtactccaatgcaatgaaataatcagcaatttgctggttttagtacgcataaaccttgaattgatgttaatacaaattatttaaaaattaattgagaaaaagattatcatagttcgcaatcaatttttaaagcttatcaaatgttaattcaacttcgtaaaaataatcttgcctttagttatggcgaaattgaatttgttgaaattgatccaacaatattaagtttttatcgttattatgaaaaaaacaaatttttagtattaattaatttatctgatcaaacaattatgattccagataatttattgtctgaaaaaacaatttataacaattattcaacttttgaaaaaaaaattaatccttatcaagttattgtgtttgattatttaatggcaaaatcatttaaataa

SEQ ID NO: 32979 - protein, 549 aa, Spiroplasma citri
MNKINFQEAIVYEIHPQSFYDSNHDGVGDLQGIIQKLDYLAMLGVNYLWLNPIYVSPQKDNGYDVSDYKNINPLFGTMNDFEMLVTEAGKRNIYIMMDMIFNHCSTEHEWFQKAQTGNLDYLQRFFFLPGDKAKCPNNWQSKFGGSVWEYHDELKMFYLHLFDKTQVDLNWKNESLRQHIYQIVNYWLQKGVRGLRFDVINLIGKPNIFENDLTGDGRKYYTDTPQVHTYLQEMAQNTYLKTNDIITVGELSSTSIKQAILYTKPVSQELNMAFTFHHLKIDYLNNEKWKLAPYDPAKLVAKIKEWQIPVQAAGGWLANFLNNHDQPRALSRFGDPENYRFESATALAAVVLLLRGTPYLYQGEEFGMENNNYTKIEQLKDVESINYYHILQKEGEQPNAILEVLSARSRDNARTPMQWNNQQFAGFSTHKPWIDVNTNYLKINWEKDYHSSQSIFKAYQMLIQLRKNNLAFSYGEIEFVEIDPTILSFYRYYEKNKFLVLINLSDQTIMIPDNLLSEKTIYNNYSTFEKKINPYQVIVFDYLMAKSFK

SEQ ID NO: 32980 - DNA, 1797 bp, Klebsiella planticola
  CDS (1)..(1797)
atgtcttttattacgctacgtaccggggtggctgtcgcgctgtcatctttaatgataagccaggcctgcccggctgtcagtgccgcaccatccgtaaatcagaatattcacgttcacaaggaaagtgaatatcctgcatggtggaaagaagctgttttttatcagatctatcctcgctcatttaaagacaccaatgatgatggcattggcgatattcgcggtatcattgaaaagctggactatctgaaatcgctcggtattgacgctatctggataaatccccattatgactctccgaacacagataacggctatgacatcagtaattatcgtcagataatgaaagagtatggcacaatggaggattttgataaccttgttgccgaaatgaaaaaacgaaatatgcgcttaatgatcgacgtggtcattaaccataccagtgatcaacacccgtggtttattcagagtaaaagcgataaaaacaacccttatcgtgactactatttctggcgtgacggaaaagataatcagccacctaataattacccctcatttttcggcggctcggcatggcaaaaagatgcaaagtcaggacagtactatttacactattttgccagacagcaacctgatctcaactgggataacccgaaagtacgtgaggatctttacgcaatgctccgcttctggctggataaaggcgtttcaagcatgcgatttgatacggtggcaacttattccaaaatcccgggatttcccaatctgacacctgaacaacagaaaaattttgctgaacaatacaccatggggcctaatattcatcgatacattcaggaaatgaaccggaaagttctgtcccggtatgatgtggccaccgcgggtgaaatttttggcgtcccgctggatcgttcgtcccagttttttgatccccgccgacatgagctgaatatggcgtttatgtttgacctcattcgtctcgatcgcgacagcaatgaacgctggcgtcacaagtcgtggtcgctctctcagttccgccagatcatcagcaaaatggatgtcacggtcggaaagtatggctggaacacgttcttcttagataaccatgacaacccccgtgcggtatctcacttcggggatgacaggccgcaatggcgggaggcgtcggctaaggcactggcgacgattaccctcactcagcgggcgacgccgtttatttatcagggttcagagctgggaatgactaattatcccttcaggcaactcaacgaatttgacgatatcgaggtcaaaggtttctggcaggattatgtccagagtggaaaagtcacggccacagagtttctcgataatgtgcgcctgacgagccgcgataacagcagaacacctttccagtggaatgacaccctgaatgctggttttactcgcggaaagccgtggtttcacatcaacccaaactatgtggagatcaacgccgaacgcgaagaaacccgcgaagattcagtgctgaattactataaaaaaatgattcagctacgccaccatatccctgctctggtatatggcgcctatcaggatcttaatccacaggacaataccgtttatgcctatacccgaacgctgggtaacgagcgttatctggtcgtggtgaactttaaggagtacccggtccgctatactctcccggctaatgatgccatcgaggaagtggtcattgatactcagcagcaggcgactgcgccgcacagcacatccctgtcattgagcccctggcaggcaggtgtgtataagctgcggtaa

SEQ ID NO: 32981 - protein, 598 aa, Klebsiella planticola
MSFITLRTGVAVALSSLMISQACPAVSAAPSVNQNIHVHKESEYPAWWKEAVFYQIYPRSFKDTNDDGIGDIRGIIEKLDYLKSLGIDAIWINPHYDSPNTDNGYDISNYRQIMKEYGTMEDFDNLVAEMKKRNMRLMIDVVINHTSDQHPWFIQSKSDKNNPYRDYYFWRDGKDNQPPNNYPSFFGGSAWQKDAKSGQYYLHYFARQQPDLNWDNPKVREDLYAMLRFWLDKGVSSMRFDTVATYSKIPGFPNLTPEQQKNFAEQYTMGPNIHRYIQEMNRKVLSRYDVATAGEIFGVPLDRSSQFFDPRRHELNMAFMFDLIRLDRDSNERWRHKSWSLSQFRQIISKMDVTVGKYGWNTFFLDNHDNPRAVSHFGDDRPQWREASAKALATITLTQRATPFIYQGSELGMTNYPFRQLNEFDDIEVKGFWQDYVQSGKVTATEFLDNVRLTSRDNSRTPFQWNDTLNAGFTRGKPWFHINPNYVEINAEREETREDSVLNYYKKMIQLRHHIPALVYGAYQDLNPQDNTVYAYTRTLGNERYLVVVNFKEYPVRYTLPANDAIEEVVIDTQQQATAPHSTSLSLSPWQAGVYKLR

SEQ ID NO: 32982 - DNA, 1827 bp, uncultured bacterium
  CDS (1)..(1827)
atgggctttactacttgtaaagtaaaaagtcatgaagcccattcttataattacgctaatagcctgtggagcctgcgcatgaaatccctgtttatcttgttacttacactggtcttcgtggccggttgttccgattctggaagcgtttcccaatctgccgctaatttaagttcctctaccagttccgactctactacctccgcagattatttgtcgctagcaattgttgaagagccaacgcactggtggcacagcaccattttttatgaaatctggccgcgttcatttcaggattccgatggcgacggcagcggtgattttaatggtatgaccaataaactcgactacctcaaagatctgggggtaaaaggtatttggttgacgccagtatttgaagcaccgtcttatcacggttacgatttccaggatttttataacgtggaaaccgattacggtactatggcagattttgaaaattttattgcgcaagcgcacaaacgcaatattaaagtgattttggatttggtgctcaaccatatctctgacaaacacgagtggtttattaagtccgctaataaaacggcgggttatgaagattattttatctggcgcgatgagcgccccacgagtggttgggggcagccttggtcagcggaatccaatcctgcagccgtgtggcattggaatgaaacacgcaaggctttttactacggcgcctttggtagcagccaaccagatttaaacctcaccaaacaagttgttatcgatgagctcaataaactcgccagtttttggctcgccaaaggtgtcgatggatttcgtttggatgcagtgcgttacgcggtagaagaggggggatatccgttgcaagccgatacgcaaggcactatcgattactggacgattttttcgcagcatgttaagtcagtgaaacccgatgccatgttagttgcagaggcatgggcggatttaaaaacgatcggcaaatatcgaaataatggcaaaggactggattcatcgtttgattttgattttggcactgtggtgattgatatgttaaatcctgcggtaaaacaaactgcagatttcggcaccattagcactaatcacttgcagcaaagccgtgaaagtttatgggcgaatttaaccgcgcgcaaagcggcggcacccatccactatttctcaccctttttaaccaatcacgatcaaacccgtattatgtacacgctggaaaacgatatagccaaagcaaaaatcgctgcgagtttattaatgaccacaccggggattttgtatatttattacggcgaagaaatcggtttgtcgcaatacaaaaccggcgatgaccaatatcgccgtgcgattatgcagtggagcgatgaagatagtgcaggatttaatgcgacaggcgaattttggctcgatcaagccaagtggttcccttggatgcaaaaccatcaaggttggtgggcaaattattggcaatcacttaaaggcacaggtaaatcagttgccgcccaagcgcaagatccacaatcgctatttaatcattacaagcgcatgattaatgtgcgcaataaaaacccggtgctgcaattgccgcaggaggttcgctattatccagtggataataaagaagtgtggttggtggaaaatattgtggtgggtaaaagtgtttgggtattgattaacttgagttcgactgtggatgcggagtttgtagtgccgaaaaatttgcggggtgcgcgcgtcgatcaagttactggcaaggaaataaatttgggtgagcgtgttagtttgccggcggccggggtgatgattttttga

SEQ ID NO: 32983 - protein, 608 aa, uncultured bacterium
MGFTTCKVKSHEAHSYNYANSLWSLRMKSLFILLLTLVFVAGCSDSGSVSQSAANLSSSTSSDSTTSADYLSLAIVEEPTHWWHSTIFYEIWPRSFQDSDGDGSGDFNGMTNKLDYLKDLGVKGIWLTPVFEAPSYHGYDFQDFYNVETDYGTMADFENFIAQAHKRNIKVILDLVLNHISDKHEWFIKSANKTAGYEDYFIWRDERPTSGWGQPWSAESNPAAVWHWNETRKAFYYGAFGSSQPDLNLTKQVVIDELNKLASFWLAKGVDGFRLDAVRYAVEEGGYPLQADTQGTIDYWTIFSQHVKSVKPDAMLVAEAWADLKTIGKYRNNGKGLDSSFDFDFGTVVIDMLNPAVKQTADFGTISTNHLQQSRESLWANLTARKAAAPIHYFSPFLTNHDQTRIMYTLENDIAKAKIAASLLMTTPGILYIYYGEEIGLSQYKTGDDQYRRAIMQWSDEDSAGFNATGEFWLDQAKWFPWMQNHQGWWANYWQSLKGTGKSVAAQAQDPQSLFNHYKRMINVRNKNPVLQLPQEVRYYPVDNKEVWLVENIVVGKSVWVLINLSSTVDAEFVVPKNLRGARVDQVTGKEINLGERVSLPAAGVMIF

SEQ ID NO: 32984 - DNA, 1617 bp, Xanthomonas campestris
  CDS (1)..(1617)
atgtcgcagacaccatggtggcgcggggccgtcatctatcagatttatccgcgtagttttctggattccaatggggatggcgtaggcgatctgccgggcattattgccaagctcgactacatctccgggctgggcgtggatgcgatctggatttcgccttttttcaagtcgccgatggccgatttcggctatgacatctcagactatcgcgcggtggacccgttgttcgggtcgttggccgatttcgatcgcttgctcgagaaggcgcatggactcgggctgaaggtgatgattgatcaggtgctgagtcatacctcgatcgcgcatgcgtggtttcaggagagccggcaggatcggagcaacccgaaggctgattggtacgtgtgggccgatccgcgcgaggatggaacgccgccgaacaactggctgtcgttgtttggcggggtcgcatggcagtgggagccgcggcgtgagcagtactacctgcacaactttctggtggaccagcccgatctcaatttccacaacgccgaggtgcagcaggcaacgctcgataacgtgcggttctggctcgatcgcggtgtggatgggttccgcctggatgcgatcaacttctgctttcacgacgcgcagctgcgcgataacccggccaagccggcagacaagcgggtggggcgcggctttagcgcggacaatccgtatgcctaccagtaccactacttcaacaacacgcagccggaaaatttgccgtttctggagcggctgcgcgggctgttggacagctacccgggtgcggtgagtctgggcgagatttcgtcggaagattcgctggcgaccaccgccgaatacaccgcccagggccgcttgcatatgggctacagcttcgagctgctggtgcaggattacagcgctgcctacatccgcgacaccgtaagccggctcgaggccaccatgttggagggctggccatgctgggccatttccaatcacgacgtagtgcgcgcggtgacgcgctggggtggggcgcaggcgacgccggcgttcgcgcggatggtggtggcgctgctgtgttcgttgcgtggctcgatttgcttgtatcagggcgaagagctcgggctcagtgaggcagaggtggcgttcgaggacctgcaggatccgtatgggattaccttctggccgaccttcaaggggcgggatggctgccgtacgccgatgccgtggaccgacgcgccatctgccggattcactagtggcaagccgtggctgccgttagctgcgtcgcatcgtgccgcagctgtaagcgtgcaacaggacgatgcgcattccgtgttgagagcagtacgggcttttctggcttggcgcaaggagatgccggcgctgcgtgagggatccatcgctttctacgacacggccgaaccggtgctgatgttccgccgcgaacacgccggccaggttgtgctgttggcattcaatctgtccgccgatcctgccgagctggccttgcctgccggcgagtgggagcagatcgatgtacctggtgtcgagcttggggcgatggatggcggacacctacggctggccgggcatgcggtcgttgctgctgtcggtcgtggctga

SEQ ID NO: 32985 - protein, 538 aa, Xanthomonas campestris
MSQTPWWRGAVIYQIYPRSFLDSNGDGVGDLPGIIAKLDYISGLGVDAIWISPFFKSPMADFGYDISDYRAVDPLFGSLADFDRLLEKAHGLGLKVMIDQVLSHTSIAHAWFQESRQDRSNPKADWYVWADPREDGTPPNNWLSLFGGVAWQWEPRREQYYLHNFLVDQPDLNFHNAEVQQATLDNVRFWLDRGVDGFRLDAINFCFHDAQLRDNPAKPADKRVGRGFSADNPYAYQYHYFNNTQPENLPFLERLRGLLDSYPGAVSLGEISSEDSLATTAEYTAQGRLHMGYSFELLVQDYSAAYIRDTVSRLEATMLEGWPCWAISNHDVVRAVTRWGGAQATPAFARMVVALLCSLRGSICLYQGEELGLSEAEVAFEDLQDPYGITFWPTFKGRDGCRTPMPWTDAPSAGFTSGKPWLPLAASHRAAAVSVQQDDAHSVLRAVRAFLAWRKEMPALREGSIAFYDTAEPVLMFRREHAGQVVLLAFNLSADPAELALPAGEWEQIDVPGVELGAMDGGHLRLAGHAVVAAVGRG

SEQ ID NO: 32986 - DNA, 1731 bp, Arthrobacter globiformis
  CDS (1)..(1731)
atgaccatcgaggaaaccgaggaagaagcaacctaccgggccggcagggaatggttcaagagtgccgtcgtgtaccagatctacccccgcagcttcgccgattccgacggtgacggcgtgggcgacctccgcgggatcatcggcaagctggactaccttcagaagctgggcgtcgacgtcgtctggctttccccggtgtaccgctcgccgcaggatgacaacggctacgacatcagcgactaccgggagatcgaccccgtcttcggcgggctggagaccctggacgagctgcttgacggcctgcacgcccgcggcatgaagctggtcatggacctggtggtcaaccacacctccgacgagcacccctggttcgtggagtcccgttccagcaaggacagcccgaagcgggactggtactggtggcggcccgcacgggaaggggcggagcccggcacggctggggcagagcccaacaactgggggtccgcgttctcgggcccggcctgggagtacgacgccgcgaccggggagtactacctccacctcttttcgaggaaacagccggacctcaactgggaaaacccggaggtccgggccgccgtctacgacatgatgaactggtggctggaccgcggcgtggacggcttccggatggacgtcatcaacttcatctccaaggaccagaccctgccggacggcccccgggccgacggcatgctgttcggcgacggaggaccccactacatctgcggcccccgcatccatgaattcctgcaggagatgcaccaggaagtgtttgccgggcgggacaaggacctgctcaccgtgggcgagatgcccggggtgacggtggatgaagccgtcctgtttaccgaccccggacgccgggaggtggacatggtgttccagttcgagcacgtggccctggaccaggagggcggcaacaagtggcgccccaagaagctgctgctgaccgacctgaagaaatccctcggccgatggcaggaagccctgggggagcgcggctggaacagcctctattggggcaaccacgaccaggcccgggccgtctcccgcttcggggacgacggcgaataccgcgagcagtccgccaagatgctggccgccgtccttcacctgcaccgcggcaccccctacgtgtaccaaggcgaagagctgggcatgacgaacatggcgttcggcgccatcagcgactaccgcgacatcgaggttctcaaccaccaccgggaggcgaccacccacctcggccacaccgatgccgaggtcctcgcggccctggctccgctgaaccgggacaacgcccggacgcccgtgcagtgggatgccagccgtcacggcggcttcaccacgggcgcgccgtggatcgcggtcaacccgaacgccaacaccatcaacgccgcagcgcaggtcgacgaccccgactcggtcttcagtttctaccgccgcgtgatcgcgctgcgccacgccgatccggtggtggcctacggtgatttcaccatgctgctgcccgacgacgaacacgtctacgcgttccggcgctccctgcctgacgccgaactgctggtcctgggcaacttttcgggaaccgggcagtcggccggcgttgacggttcctggggcgacgccgagctggtgcttggcaactacccggcggcgcccggcctcgggctgcggccctgggaagtgaaggtgttccgccggaacctgtag

SEQ ID NO: 32987 - protein, 576 aa, Arthrobacter globiformis
MTIEETEEEATYRAGREWFKSAVVYQIYPRSFADSDGDGVGDLRGIIGKLDYLQKLGVDVVWLSPVYRSPQDDNGYDISDYREIDPVFGGLETLDELLDGLHARGMKLVMDLVVNHTSDEHPWFVESRSSKDSPKRDWYWWRPAREGAEPGTAGAEPNNWGSAFSGPAWEYDAATGEYYLHLFSRKQPDLNWENPEVRAAVYDMMNWWLDRGVDGFRMDVINFISKDQTLPDGPRADGMLFGDGGPHYICGPRIHEFLQEMHQEVFAGRDKDLLTVGEMPGVTVDEAVLFTDPGRREVDMVFQFEHVALDQEGGNKWRPKKLLLTDLKKSLGRWQEALGERGWNSLYWGNHDQARAVSRFGDDGEYREQSAKMLAAVLHLHRGTPYVYQGEELGMTNMAFGAISDYRDIEVLNHHREATTHLGHTDAEVLAALAPLNRDNARTPVQWDASRHGGFTTGAPWIAVNPNANTINAAAQVDDPDSVFSFYRRVIALRHADPVVAYGDFTMLLPDDEHVYAFRRSLPDAELLVLGNFSGTGQSAGVDGSWGDAELVLGNYPAAPGLGLRPWEVKVFRRNL

SEQ ID NO: 32988 - DNA, 1758 bp, Actinoplanes missouriensis
  CDS (1)..(1758)
atggagttgacgagcgagcacgatccggtcgaggggagccacaccgaggacggtgtggtcgagcacccgacctccgacgacttcggccacgcccgggcgctccccgccgaccgcacctggttccagcgcgcggtcttctacgaagtgctggtgcgcgcgttctacgactcgggctcggacggcggcggcgacctgcgcggcctgatcgagcggctggactacctgcagtggctcggcgtggactgcctctggctgccgccgttctacgactcgccgctgcgcgacggcgggtacgacatccgtgacttctacaaggtgctgcccgagttcggcacggtcgaggacttcgtggcgctgctggacgcggcgcacaagcgcggcatccgggtgatcaccgacctggtcatgaaccacacctcggactcgcacccgtggttccaggcgtcgcggcacgaccccgacggcccgtacggcgacttctacgtctggaacgacaacagcgacaagtacaaggacgcccggatcatcttcgtcgacaccgaggagtcgaactggacgttcgacccggtccggcggcagttctactggcaccggttcttctcgcaccagccggatctcaactacgagaaccccaaggtgcaggaggccatgatggacgctctgcggttctggctggacctcggcatcgacggtttccggctggacgcggtgccctacctcttcgaggaggagggcactaactgcgagaacctgccggccacccacgcgttcctcaagcactgccgcaaggtgatcgacgacgagttccccggccgggtgctgctggccgaggcgaaccagtggccggccgacgtggtggagtacttcggcgatccgcgcagcggcggcgacgagtgccacatggcgttccacttcccgctgatgccgcgcatcttcatggcggtccggcgcgagtcgcggttcccgatctcggagaccctggcgaacacgccggccatcccggacaactgccagtggggcatcttcctgcgtaaccacggagagctgacgctcgagatggtcaccgacgaagagcgcgactacatgtactcggagtacgccaaggacccgcggatgaaggcgaacgtcggcatccgccgccggctcgccccgctgctggagaacgaccgcaaccagatcgagctgttcaccgccatgctgctgtcgctgcccggctcgccggtgctctactacggcgacgagatcggcatgggcgacaacatctggctgggcgaccgcgacggtgtgcgtaccccgatgcagtggacgccggaccgcaacgccggcttctccaccgccacaccgggccggctctacctgccggtcaaccaggacccggtgtacgggtaccaggcggtcaacgtggaggcccagcgggacagcgccacgtcgttgctgaacgtggacccggaccatgctgcggtccgccgccggcacgaggcgttcgccgtgggcacgttccgcgagctgggcggctccaacccgtcggtcctggcgtacctgcgcgagtacggcgacgacgtcgtgctctgcgtgaacaacctgtcccgcttcccccagccgatcgagctgaacctgcagcactggaacgggtacacaccggtcgagctcaccgggcacgtcaacttcccgcggatcgggcagttgccgtaccttctgacccttccgggacacggcttctactggttccagttgtgcgggtcggaggagaagcaatga

SEQ ID NO: 32989 - protein, 585 aa, Actinoplanes missouriensis
MELTSEHDPVEGSHTEDGVVEHPTSDDFGHARALPADRTWFQRAVFYEVLVRAFYDSGSDGGGDLRGLIERLDYLQWLGVDCLWLPPFYDSPLRDGGYDIRDFYKVLPEFGTVEDFVALLDAAHKRGIRVITDLVMNHTSDSHPWFQASRHDPDGPYGDFYVWNDNSDKYKDARIIFVDTEESNWTFDPVRRQFYWHRFFSHQPDLNYENPKVQEAMMDALRFWLDLGIDGFRLDAVPYLFEEEGTNCENLPATHAFLKHCRKVIDDEFPGRVLLAEANQWPADVVEYFGDPRSGGDECHMAFHFPLMPRIFMAVRRESRFPISETLANTPAIPDNCQWGIFLRNHGELTLEMVTDEERDYMYSEYAKDPRMKANVGIRRRLAPLLENDRNQIELFTAMLLSLPGSPVLYYGDEIGMGDNIWLGDRDGVRTPMQWTPDRNAGFSTATPGRLYLPVNQDPVYGYQAVNVEAQRDSATSLLNVDPDHAAVRRRHEAFAVGTFRELGGSNPSVLAYLREYGDDVVLCVNNLSRFPQPIELNLQHWNGYTPVELTGHVNFPRIGQLPYLLTLPGHGFYWFQLCGSEEKQ

SEQ ID NO: 32990 - DNA, 1692 bp, Pseudomonas fluorescens
  CDS (1)..(1692)
atgaggcctgtgaggccggtacaaaacagactgaaggaaacgcacatgcaagactggcaacgctcggtgatctatcagatctaccccaagagtttctacagccatggcggccaggccaccggtgatttgctgggggtggtggacaagctcgactacctgcactggctgggtgtggattacctgtggctgacaccgttcctgcgttcgccgcaacgggacaacggctacgacatcagcgactactacgccatcgaccccagctacggcaccatggccgattgcgaattattgattaccgaagcgagcaagcgcggtatcaagctgatgctcgacatcgtggtcaatcacacctccatcgagcatccctggttccaggccgcccgcagcagcctcgacaacccgtaccgcgatttctatatctggcgggaccagccgaacaactgggaatccaagttcggcggctcggcctgggagtacgaagcgcagaccggccagtattacctgcacctgttcgaccacacccaggccgacctgaactgggacaacccccaggtgcgcgccgaagtgttcaagatgatgcgtttctggcgggacaagggggtggggggctttcgtctcgatgtgatcaacctgatctccaagccggccgacttccctgacgatcataccgatggccggcgtttttataccgacggtcctaacgtgcatcgctacctgcaggaaatgcatcgggaggtcttcgaggggttcgacctgatcaacgtcggcgagatgtcgtccaccagtctcgaacactgtgttcgttattcgtgtccggcgtcccgtgaactgtcgatgacgttcaatttccatcacttgaaggtggactacccgaacctgcaaaagtgggtgcgggccgacttcgattttcttgaactcaaacgcatcctgtccgactggcaagtcggcatgcaggccggtgacggttggaatgcgctgttctggtgtaaccatgaccagccgcgggtggtgtcgcggttcggtgatgacggcgagtaccgcgagccttcggcgaagatgctcgccacggcgttgcactttctccagggcaccccgttcgtgtaccagggcgaggagttggggatgaccaatccgggcttcgagcacatcgagcagtatcgcgatgtggaaaccctgaacatctatcgtctcaagcgcaacgccggggtgtcggaggccaacgccatggcatcgatcatgcagaaatcccgtgacaacgggcgcacgccgatgcaatggaatgccgggccgaacgcaggtttcagccgggccgaaccctggatcggcgtgcccgccaacgccgcgttcatcaacgtcgagcagcaacagcaagacccgacctcggtgctgcattactaccgtcaattgatcgccctgcgccgcagcgaagccttgatccaggacggcgtctaccgcctgctattgcccgaacatccacatgtgtgggcgtacctgcgcgaagggcagggcgagcgcctgttggtggtcagccatttttatggaggcgactgcgaggtggaactgcccgaaggagtcctcacccatgacacgaaacaacgctgggtgatcggcaactacgaggccggcgaacaccgataccgacggctgcgcttgcggccttacgagtcgtttgtgttgcacctgagcgactga

SEQ ID NO: 32991 - protein, 563 aa, Pseudomonas fluorescens
MRPVRPVQNRLKETHMQDWQRSVIYQIYPKSFYSHGGQATGDLLGVVDKLDYLHWLGVDYLWLTPFLRSPQRDNGYDISDYYAIDPSYGTMADCELLITEASKRGIKLMLDIVVNHTSIEHPWFQAARSSLDNPYRDFYIWRDQPNNWESKFGGSAWEYEAQTGQYYLHLFDHTQADLNWDNPQVRAEVFKMMRFWRDKGVGGFRLDVINLISKPADFPDDHTDGRRFYTDGPNVHRYLQEMHREVFEGFDLINVGEMSSTSLEHCVRYSCPASRELSMTFNFHHLKVDYPNLQKWVRADFDFLELKRILSDWQVGMQAGDGWNALFWCNHDQPRVVSRFGDDGEYREPSAKMLATALHFLQGTPFVYQGEELGMTNPGFEHIEQYRDVETLNIYRLKRNAGVSEANAMASIMQKSRDNGRTPMQWNAGPNAGFSRAEPWIGVPANAAFINVEQQQQDPTSVLHYYRQLIALRRSEALIQDGVYRLLLPEHPHVWAYLREGQGERLLVVSHFYGGDCEVELPEGVLTHDTKQRWVIGNYEAGEHRYRRLRLRPYESFVLHLSD

SEQ ID NO: 32992 - DNA, 1548 bp, Halothermothrix orenii
  CDS (1)..(1548)
gtgaagctaaaacgcttgtctttcttcatgtttgttaccttactggtatttatatctgtttttcctgtttatgcaaacgatttcgaaaaacatggtacatattatgaaatttttgtcaggtctttttatgactctgatggtgacggaataggggatttgaaaggtataatagaaaaactggattatcttaatgatggagaccctgaaaccattgctgatctgggggttaatggtatctggttaatgcctatctttaaatctccctcctatcatggctatgatgtaaccgattattataagattaatcctgactacgggactctggaagacttccataagcttgttgaggctgcccatcaaaggggaatcaaggttataattgatttacccatcaatcataccagtgaaagacatccctggtttctcaaggcttcccgggataagaatagtgaatacagggattattatgtctgggctggccccgataccgataccaaagaaaccaagttagatggaggccgggtctggcattattccccgaccggcatgtattatgggtatttctggagtggcatgcctgatttaaactataataaccctgaagttcaggaaaaggttattgggatagcaaaatactggttaaaacagggggttgatggtttcaggcttgatggagccatgcatatcttcccaccggcccagtatgataaaaactttacctggtgggagaagttccgtcaggaaattgaagaggtaaaacccgtttacctggtgggtgaggtctgggatatttcggaaacggtagctccttacttcaaatatggttttgattctacctttaactttaaactggcagaggcagttatcgctacggctaaagctggatttccctttggttttaataaaaaggcaaaacatatttacggggtatatgacagggaggttggatttgggaattatatcgatgctcccttcctgaccaaccatgatcagaaccggattttggaccagcttgggcaggatcgtaataaggccagggttgctgccagtatttatttgaccttgcctggtaatccctttatttactatggtgaagaaatcggtatgagggggcaggggccccatgaagttatcagggagcccttccagtggtataatggatccggggagggagaaacatactgggagccagccatgtataatgatggctttacttctgttgaacaggaagaaaagaatctcgattccctcttaaatcactacaggaggttaatccatttccggaacgaaaatcctgtcttttataccggtaagattgagattataaatggaggattaaatgtagttgcatttagaagatataatgataagagggatttatatgtctaccataacctggtaaacagaccggttaaaataaaagtggctagtggtaactggaccttattgtttaattcaggtgataaggaaattacccctgttgaagataataataaacttatgtatactatccctgcttatactaccattgttctggaaaaggagtaa

SEQ ID NO: 32993 - protein, 515 aa, Halothermothrix orenii
MKLKRLSFFMFVTLLVFISVFPVYANDFEKHGTYYEIFVRSFYDSDGDGIGDLKGIIEKLDYLNDGDPETIADLGVNGIWLMPIFKSPSYHGYDVTDYYKINPDYGTLEDFHKLVEAAHQRGIKVIIDLPINHTSERHPWFLKASRDKNSEYRDYYVWAGPDTDTKETKLDGGRVWHYSPTGMYYGYFWSGMPDLNYNNPEVQEKVIGIAKYWLKQGVDGFRLDGAMHIFPPAQYDKNFTWWEKFRQEIEEVKPVYLVGEVWDISETVAPYFKYGFDSTFNFKLAEAVIATAKAGFPFGFNKKAKHIYGVYDREVGFGNYIDAPFLTNHDQNRILDQLGQDRNKARVAASIYLTLPGNPFIYYGEEIGMRGQGPHEVIREPFQWYNGSGEGETYWEPAMYNDGFTSVEQEEKNLDSLLNHYRRLIHFRNENPVFYTGKIEIINGGLNVVAFRRYNDKRDLYVYHNLVNRPVKIKVASGNWTLLFNSGDKEITPVEDNNKLMYTIPAYTTIVLEKE

SEQ ID NO: 32994 - DNA, 1797 bp, Klebsiella sp
  CDS (1)..(1797)
atgtcttttgttacgctacgtaccggggtggctgtcgcgctgtcatctttgataataagtctggcctgcccggctgtcagtgctgcaccatccttgaatcaggatattcacgttcaaaaggaaagtgaatatcctgcatggtggaaagaagctgttttttatcagatctatcctcgctcatttaaagacaccaatgatgatggcattggcgatattcgcggtattattgaaaagctggactatctgaaatcgctcggtattgacgctatctggatcaatccccattacgactctccgaacaccgataacggctatgacatcagtaattatcgtcagataatgaaagagtatggcacaatggaggattttgatagccttgttgccgaaatgaaaaaacgaaatatgcgcttaatgatcgacgtggtcattaaccataccagtgatcaacacccgtggtttattcagagtaaaagcgataaaaacaacccttatcgtgactattatttctggcgtgacggaaaagataatcagccacctaataattacccctcatttttcggcggctcggcatggcaaaaagatgcaaagtcaggacagtactatttacactattttgccagacagcaacctgatctcaactgggataacccgaaagtacgtgaggatctttacgcaatgctccgcttctggctggataaaggcgtttcaggcatgcgatttgatacggtggcaacttattccaaaatcccgggatttcccaatctgacacctgaacaacagaaaaattttgctgaacaatacaccatggggcctaatattcatcgatacattcaggaaatgaaccggaaagttctgtcccggtatgatgtggccaccgcgggtgaaatttttggcgtcccgctggatcgttcgtcgcagttttttgatcgccgccgacatgagctgaatatggcgtttatgtttgacctcattcgtctcgatcgcgacagcaatgaacgctggcgtcacaagtcgtggtcgctctctcagttccgccagatcatcagcaaaatggatgtcacggtcggaaagtatggctggaacacgttcttcttagataaccatgacaacccccgtgcggtatctcacttcggggatgacaggccgcaatggcgggaggcgtcggctaaggcactggcgacgattaccctcactcagcgggcgacgccgtttatttatcagggttcagagctgggaatgactaattatcccttcaggcaactcaacgaatttgacgacatcgaggtcaaaggtttctggcaggattatgtccagagtggaaaagtcacggccacagagtttctcgataatgtgcgcctgacgagccgcgataacagcagaacacctttccagtggaatgacaccctgaatgctggttttactcgcggaaagccgtggtttcacatcaacccaaactatgtggagatcaacgccgaacgcgaagaaacccgcgaagattcagtgctgaattactataaaaaaatgattcagctacgccaccatatccctgctctggtatatggcgcctatcaggatcttaatccacaggacaataccgtttatgcctatacccgaacgctgggtaacgagcgttatctggtcgtggtgaactttaaggagtacccggtccgctatactctcccggctaatgatgccatcgaggaagtggtcattgatactcagcagcaggcggctgcgccgcacagcacatccctgtcattgagcccctggcaggcaggtgtgtataagctgcggtaa

SEQ ID NO: 32995 - protein, 598 aa, Klebsiella sp
MSFVTLRTGVAVALSSLIISLACPAVSAAPSLNQDIHVQKESEYPAWWKEAVFYQIYPRSFKDTNDDGIGDIRGIIEKLDYLKSLGIDAIWINPHYDSPNTDNGYDISNYRQIMKEYGTMEDFDSLVAEMKKRNMRLMIDVVINHTSDQHPWFIQSKSDKNNPYRDYYFWRDGKDNQPPNNYPSFFGGSAWQKDAKSGQYYLHYFARQQPDLNWDNPKVREDLYAMLRFWLDKGVSGMRFDTVATYSKIPGFPNLTPEQQKNFAEQYTMGPNIHRYIQEMNRKVLSRYDVATAGEIFGVPLDRSSQFFDRRRHELNMAFMFDLIRLDRDSNERWRHKSWSLSQFRQIISKMDVTVGKYGWNTFFLDNHDNPRAVSHFGDDRPQWREASAKALATITLTQRATPFIYQGSELGMTNYPFRQLNEFDDIEVKGFWQDYVQSGKVTATEFLDNVRLTSRDNSRTPFQWNDTLNAGFTRGKPWFHINPNYVEINAEREETREDSVLNYYKKMIQLRHHIPALVYGAYQDLNPQDNTVYAYTRTLGNERYLVVVNFKEYPVRYTLPANDAIEEVVIDTQQQAAAPHSTSLSLSPWQAGVYKLR

SEQ ID NO: 32996 - DNA, 1533 bp, Paenibacillus sp
  CDS (1)..(1533)
atgctcacgatgttcgcctcaggtgcaatggctgagcaagaaatgaatgggcataagcctccaaattctgttggaagcggcgtgttttacgaaatttatattaattctttttatgattcgaatggggacggacacggtgatttgaaagggattacacaaaagcttgattacttaaacgacggcaacccccgttcgggcaaggatttgcaggttagtggcctctggctcatgcccatgaatccatctccaagctaccataaatatgatgttaccgactattatcaggtggacccccagtatgggaatctgaatgatttccgcaccttgacgaaagaagccaaacggaagggtgtcaaggtgatcatagaccttgttatcaaccattcgagcagtgagcacccttggttcaaggaggccagcaccaatccacaaagcaaataccatgactattacgtatgggcaaatgagaagacaaatctggatgaaaagggatcatggggccagcaggtatggcataagaatccgaatggcgaagggtatttctatggtaccttctggtcggggatgccagatctgaactttgacaatccagaagtccgtaaggaaatgattaaagtcggtaagtattggctgcagcagggtgcagatggtttccggcttgatgcggcgatgcatatctttaaagggcaaacgaaggatggtgccgataaaaacattgcgtggtggaatgagttccgttccgagatggaaaagattaatccaaatgtatatctggcaggagaggtatgggataagccggagaccatagctccttattacgaatcactccactctttgtttaattttgacctgggcggaaagatattgaactctgtgaaaaacggccgggatcagggtatcgcaacattcgctgagaaaacactgaagctgtacaaatcacacaataaagcggcacttgatgccccgttcctaagcaatcatgaccagacccgtgttatgagcgaactgggtggggatgtgcgaaaagccaagctgcctgcatccattcttttgacgctgccaggtcagccgtttctctattacggtgaagagatcggcatgaaaggggagaagcctgatgagtatcttcgagagcctatgcgctggtacaaaggagaaggccgcggtcaaacgacgtgggaagtacccaaatacaaccgaggcgaagtatcggtagaagcgcagatgcgggacaatgattccctgctacaaagctaccgcacgctcatccgtttgagggaagaacatgaagctcttcgtagccataatctagaaccaatccaagcaggttctgccaacgtggcggcataccaacgttcttctggcaaagaaacattgtatgtatatcacaacctgtcagggaagccggttacgctccagatgaaagatgcggataagcagaagaggaaagtggtcttttccagctccaagggtgtaaaaataaagaaaaatgcggtgacgattcccgcatacagctctctaatcaccaaatag

SEQ ID NO: 32997 - protein, 510 aa, Paenibacillus sp
MLTMFASGAMAEQEMNGHKPPNSVGSGVFYEIYINSFYDSNGDGHGDLKGITQKLDYLNDGNPRSGKDLQVSGLWLMPMNPSPSYHKYDVTDYYQVDPQYGNLNDFRTLTKEAKRKGVKVIIDLVINHSSSEHPWFKEASTNPQSKYHDYYVWANEKTNLDEKGSWGQQVWHKNPNGEGYFYGTFWSGMPDLNFDNPEVRKEMIKVGKYWLQQGADGFRLDAAMHIFKGQTKDGADKNIAWWNEFRSEMEKINPNVYLAGEVWDKPETIAPYYESLHSLFNFDLGGKILNSVKNGRDQGIATFAEKTLKLYKSHNKAALDAPFLSNHDQTRVMSELGGDVRKAKLPASILLTLPGQPFLYYGEEIGMKGEKPDEYLREPMRWYKGEGRGQTTWEVPKYNRGEVSVEAQMRDNDSLLQSYRTLIRLREEHEALRSHNLEPIQAGSANVAAYQRSSGKETLYVYHNLSGKPVTLQMKDADKQKRKVVFSSSKGVKIKKNAVTIPAYSSLITK

SEQ ID NO: 32998 - DNA, 1773 bp, Bifidobacterium adolescentis
  CDS (1)..(1773)
atgaaaggggacaacatgaccgaagtcaacgatccgtcgctgtggtggaagcaggccgtggtctaccaggtgtatccacgttccttcaaggattcccgcggcgagggcctcggccagattgccggcgtcaccgagaaaatcggatatctgaaggaactgggcgtcgacgccatctggctgagcccgttctacccgtcccagctggccgacggcggctatgacgtggacgactaccgcaacgtcgatccgaaactcggcaccatggacgatttcgacgcgctcgccaaagccgcgcatgccgacggcatcaaaatcgtcgtggacatcgtgccgaaccacagctccaacctgcacgaatggttcaaggccgcgttggccgcgaaacccggctcgccggaacgcgaccgctacatcttccgcgatggcaagggaccgaacggcgacgagccgccgaccaactggcagaaccacttcggcggccctgcatggacgcgcgtgcccgacggccaatggtatctgcacatgttcaccaaggaacagccggactggaactggaaaaacgaggacgtgcgcgccgatttcatcaaaaccctgcgtttctggcttgaccacggtgccgacggcttccgcgtggacgtggcgcacggcctggccaaggatctcgaccgcgatgatctggacgattatgtggtctggtgcaccaacgatcagcccgaagacggctcccatccggtgatcgaccgcgacgaagtgcacgacatctaccacgagtggcgcaaggtgttcaacgagtacgatccgccggcgttcgccgtggctgaggcgtgggtccgaccaagccgccagcatctgtacgcctccccggacgatctcggccagatcttcaacttcgagttcgccaagaaggattggatccgcgacgacatgcacctcgccatcgaggaaggtctggaaagcgccgaacggtccggttccaccgccacttgggtgatgagcaaccatgacgtggtccgccatgccacccgctacgcgctgccccaggtgccgaccggcgaataccatcgactgccgctcgactggctgctgcgcgacggcaccacataccgggaggaccgcgcgctcggcaccaagcgcgcccgcgccgcgatcatgatggagatggcgctgcccggctccgcctacgtgtatcaaggcgaggaactcggcctgttcgaagtggccgacattccgtgggatgagctggaggatccgtccgcatggcgcacctcccgttccgccagcaccaaaggccgtgacggctgccgtgtgccgctgccgtgggttgcggccgacgctccgcagctggacgatccgaacgatgagttcggccatggcggctccttcggattctcgccggcagacgcgaaggccgagccgcatctgccgcaacccaagtggtacaaggatttcgcggtcgatgtcgaatcggccgacccggattccatgctgaacctgtaccgccgcgtgctggcattgcgacatgagttgcagaccaccgacctgagtctcgaatggcttccggaagaccagcccggcaaggcgcatgacggcgccaacggtttcccgggtggcaccatcgcgtaccgccgtgccaacggctgggcctcgatcaccaacttcggcgaagaaccgatcacgttgccgcaaggcgaagtgctgctgacatcaggaccgcttaccgacgacggcaagctgccgcaagataccagcgcttggctcaaactggccgattga

SEQ ID NO: 32999 - protein, 590 aa, Bifidobacterium adolescentis
MKGDNMTEVNDPSLWWKQAVVYQVYPRSFKDSRGEGLGQIAGVTEKIGYLKELGVDAIWLSPFYPSQLADGGYDVDDYRNVDPKLGTMDDFDALAKAAHADGIKIVVDIVPNHSSNLHEWFKAALAAKPGSPERDRYIFRDGKGPNGDEPPTNWQNHFGGPAWTRVPDGQWYLHMFTKEQPDWNWKNEDVRADFIKTLRFWLDHGADGFRVDVAHGLAKDLDRDDLDDYVVWCTNDQPEDGSHPVIDRDEVHDIYHEWRKVFNEYDPPAFAVAEAWVRPSRQHLYASPDDLGQIFNFEFAKKDWIRDDMHLAIEEGLESAERSGSTATWVMSNHDVVRHATRYALPQVPTGEYHRLPLDWLLRDGTTYREDRALGTKRARAAIMMEMALPGSAYVYQGEELGLFEVADIPWDELEDPSAWRTSRSASTKGRDGCRVPLPWVAADAPQLDDPNDEFGHGGSFGFSPADAKAEPHLPQPKWYKDFAVDVESADPDSMLNLYRRVLALRHELQTTDLSLEWLPEDQPGKAHDGANGFPGGTIAYRRANGWASITNFGEEPITLPQGEVLLTSGPLTDDGKLPQDTSAWLKLAD

SEQ ID NO: 33000 - DNA, 1728 bp, Brevibacterium fuscum var
  CDS (1)..(1728)
atgaccacgctgcaaccggcaacccgccacgcaagcctcaaagcgactgatgaatggtggaaagcctccgtcgtttaccaggtctacccccggagtttcgctgactccaacggcgacgggatcggcgacatccagggcatcatcagccggcttgatcacctccaggaactgggcgtggacgtcctctggctttcacccgtctatgcttcgccgcaggacgataacggctatgacatcagcgactactactccatcgatccgaccttcggaacactggaagacctggacgaactgatcggcgagttgcatacccgaggcatgaaattggtgatggatctggtcgtgaaccacacctcagatgaacacgagtggttccaggaatcacgatcggaccgtacccatcccaaacgggattggtacatctggcgggacccgcaccacggtgccgaacccaacaattgggggtcattcttctcgggatccgcctgggaatgggatgaacaaaccggacagtacttcctccacctcttctccaaaaagcaaccggatctcaactgggagaaccccgaagtacgcgccgcaatctaccggatgatgaactggtggctggatcggggcattgacggcttccgcatggacgtcatcagtttcatctcaaagcaccctgaccttccagacggtgccgtgggcaagggcgggatatggggtgacggcatcccattcttcggttctgggccgcgcgtccacgaatacctgcaggaaatgcaccgtgaggtatttgctcaccgcgacgccgatctactgaccgtgggtgaaatggtcgacgtcacacctgaactggcgcggctctacaccgaccagcggcgcaaagaactcgacatggtgttccacttcgagcacgtaggactcgaccacggcgcggacggcaagttcagccgcaaagccctcgacctggtcgcggtgaagcgctccttcgcccgatggcaggacgcattgtccgacgtcggctggaacagcctctactggaacaaccacgatcaaccacgagttgtgtcacgcttcggcgatgacagtgatcattggtatgaatcggcgacagcctttgccaccatcctccacctgatgcgtggaacgccctacatctaccagggcgaggagctgggcatgacaaatatgcccttcacgagcatcgatgagttccgcgacctcgagagcctcaactattaccggcaggcactggaacgagatggggctgacgcagcaaccgttctcgccggcatcaccgtcggcggacgcgataacgcgcgcaccccggtccagtgggacgcctcagtccacgccggattcaccaccggtgaaccttggataccagtaaaccccaaccacggatggctgaatgccgccactcaacgccaggaccccgagtccgtttacgggtggtacaaacggctcatccaactccgccacgaggaaccggtgattgtggacggaaggttcaacctcatacttgccgacgatccccaaatcttcgcctatacccgcacggatagtgacaccgaactcttcatcgccgccaactgctcagcggacccagctgcgctacctggcgacgttaccgaggaatgggacgacgcagacgtcctgctcgctaaccatccaggcgtccgtgagctcggaagaacgctcctgccctgggaggtgatcgttctacgacgcggcctcgcgtaa

SEQ ID NO: 33001 - protein, 575 aa, Brevibacterium fuscum var
MTTLQPATRHASLKATDEWWKASVVYQVYPRSFADSNGDGIGDIQGIISRLDHLQELGVDVLWLSPVYASPQDDNGYDISDYYSIDPTFGTLEDLDELIGELHTRGMKLVMDLVVNHTSDEHEWFQESRSDRTHPKRDWYIWRDPHHGAEPNNWGSFFSGSAWEWDEQTGQYFLHLFSKKQPDLNWENPEVRAAIYRMMNWWLDRGIDGFRMDVISFISKHPDLPDGAVGKGGIWGDGIPFFGSGPRVHEYLQEMHREVFAHRDADLLTVGEMVDVTPELARLYTDQRRKELDMVFHFEHVGLDHGADGKFSRKALDLVAVKRSFARWQDALSDVGWNSLYWNNHDQPRVVSRFGDDSDHWYESATAFATILHLMRGTPYIYQGEELGMTNMPFTSIDEFRDLESLNYYRQALERDGADAATVLAGITVGGRDNARTPVQWDASVHAGFTTGEPWIPVNPNHGWLNAATQRQDPESVYGWYKRLIQLRHEEPVIVDGRFNLILADDPQIFAYTRTDSDTELFIAANCSADPAALPGDVTEEWDDADVLLANHPGVRELGRTLLPWEVIVLRRGLA

SEQ ID NO: 33002 - DNA, 1725 bp, Aspergillus oryzae
  CDS (1)..(1725)
atgtctccagccccagttggtgaaaaatggtggaaaaactccatcatctaccagatctacccagccagttttaaagactccaacaatgacggcatcggcgatatccccggtattatctcctcccttgactatatcaccagcctgggggtagacgtaatttggatctccccaatgtatgacagtccccagtacgacatggggtatgatgtctccgattatgagagcgtctacccaccatacggcacagtccaggacatggaagttctcatcgacgagtgccaccgtcgtgggctgcgcattattctggacctagtcgtcaatcacacctcgcacgagcacaagtggttcaaggaatcgcgatcatcaaaagcaagccccaagcgggattggtatatctggaagcctgcaaaatacgacgccaatggaaaccggaagccacccaacaactggcgcagtatcttcggcggcagtgcttgggaatgggacgaaggaagcgaagaatattatctccatttgttttgcaaggagcagccagacctcaactgggagaaccaagagacccgtcgtgcgatctacgactcggcgatggagttttggctgcagaagggtgtcgatggattccgtgtggacacggtcaacatgtacagcaagcaccctgagtacccggatgcgcctgttatcgatcccaagtcggagactcaaatgtcgccggcattgttctgtaatggacctcgtattcatgaatacctcagtgagatgaacgaggtgcttgcgaagtatgacgctatgacggtgggagagctgccgaacacgcacactgtcgatggcattctgcggtatgtgtcagcggcgcagaaccagctcaacatggtctttcagttcgatatcgtcgatctcggacaaggaaaggattataaattcttgactacgctgccgggctggaccctgccggaactcaagaccgctgtcaagggtactcaagttatcatgaaggggacagacggttggtccacggtcttcacggagaaccacgaccagggtcggtccgtctctcgctttggttccgagaagaccccagaattgagagtcacctcggcgaagatgcttgcaatgatgcagggcacgttgtcaggcactcaattcatctaccaaggccaggaaattggcatggtcaatgcgccagagagctggaccatcgacgaatataaagacgtcgacagcacaaactactaccaaatggtgcagaagatttccaataacgacccgctggagctggagactgcgatgaagtcactccagcgtttcgcgagagaccatgcccggcttcccatgcagtggagctctgagactcatggtggattctcctcctcagaaaagacatggatgcgtgtccatgataactaccccgagataaacgtaaaagtgcaggagaaggatgactcttccgtcttgtcgttctggaaacaagttattcaactgcgtaaagagtacgccgacctgttcgtctttggggatttcgagatcttggacgaggcaaatgagaaggtgttcacctatatcaagcgagggcagaagcaatcggccttgatcgtattaaacttctcggacgatacactgaaattcaagcaaccagctggggtgcaagatgccaaggtgttgctgcgtaacgttgaaggggatttgaacgagttgcagccatttgagggacgtgtgcttctattttag

SEQ ID NO: 33003 - protein, 574 aa, Aspergillus oryzae
MSPAPVGEKWWKNSIIYQIYPASFKDSNNDGIGDIPGIISSLDYITSLGVDVIWISPMYDSPQYDMGYDVSDYESVYPPYGTVQDMEVLIDECHRRGLRIILDLVVNHTSHEHKWFKESRSSKASPKRDWYIWKPAKYDANGNRKPPNNWRSIFGGSAWEWDEGSEEYYLHLFCKEQPDLNWENQETRRAIYDSAMEFWLQKGVDGFRVDTVNMYSKHPEYPDAPVIDPKSETQMSPALFCNGPRIHEYLSEMNEVLAKYDAMTVGELPNTHTVDGILRYVSAAQNQLNMVFQFDIVDLGQGKDYKFLTTLPGWTLPELKTAVKGTQVIMKGTDGWSTVFTENHDQGRSVSRFGSEKTPELRVTSAKMLAMMQGTLSGTQFIYQGQEIGMVNAPESWTIDEYKDVDSTNYYQMVQKISNNDPLELETAMKSLQRFARDHARLPMQWSSETHGGFSSSEKTWMRVHDNYPEINVKVQEKDDSSVLSFWKQVIQLRKEYADLFVFGDFEILDEANEKVFTYIKRGQKQSALIVLNFSDDTLKFKQPAGVQDAKVLLRNVEGDLNELQPFEGRVLLF

SEQ ID NO: 33004 - DNA, 1659 bp, Erwinia rhapontici
  CDS (1)..(1659)
atggcaaactggtggaaagaggccgtggcgtatcagatatacccgcgcagcttcaacgacagcaataacgatggcattggtgacctgaatggcatcacggaaaaactcgattacctggaagatttgggcatcgatctgatttggatctgccccatgtatcagtcccccaatgatgacaacggctatgacatcagcgattaccagaaaatcatggctgagtttggcacgatggacgattttgaccgtctgcttgaacaggtgcatgcgcgcggtatgcgcctgattattgatttagtggtgaaccatacttctgatgagcatccgtggtttttagcgtccagcgcatcacgggataacccgaaacgcgactggtacatctggcgcgacggtaaagcgggcgctgagccgaacaactgggaaagcatcttcaacggttctgcctggaaatacagcgcggcgaccgggcagtatttcctgcatttgttctccgaaaagcagccagatttgaactgggaaaaccccgaggtgcgttcggcggtgtatgccatgatgcgttggtggcttgacaaaggggtagatggttttcgcattgatgccatctgccatatgaaaaaagagccgactttcagcgatatgcctaatcccctggcgctgccttacgtaccgtcattcgagcgccacctcaactacgacggcctgcttgattacgtcgatgacatgtgtgaacaggtgttcagtcactatgacattgtgaccatcggcgaaatgaacggtgcctccgctgaacagggtgaagagtgggtcggcgagcagcggggcaggctgaatatgatctttcagtttgagcacgtgaagctgtggcaggatgggcaaaaggacaccctggaggccagtctcgatttacccggcttaaaagagattttcacgcgctggcagacactgctggaaaacaaaggctggaacgcgttatacgtagaaaatcatgatcttccccgtgtggtatcgggctggggcgacgataaaaattatcaacgtgaaagcgcgaccgccattgcggcgatgttcttcctgatgaaaggtacgccgtttatttatcaggggcaggaacttggcatgaccaatacgcatttcgccagcctggaggattttgacgacgttgccgcgaagaaactcgccgttgaaatgcgccgacagggcagggaagagcccgagatcctcgccttcctcagccgcaccgggcgcgaaaactcgcgcaccccgatgcagtcggatcagagtgcccacggcggtttcagcaatgctaccccctggtttcctgcgaacagtaattaccctgtaatcaacgtggcggatcaacgtgctgacagcggttccgtgctgaacttctatcgtgcgctcattcgcctgcgccggcagatgccggtattgattgaaggggcttatcaacttctgctgccgacacatccgcagatctatgcctatacccgtcgtctgaatgaacagcaggtgttggtgatcgtcaatttcagtgcccatcagcaggagatagatccgcaacagctgttactggacggctggcaaccgctgctgagcaattatcaggagcaggggaaacggcaaatcttacgggcttatgaggcacaaatttatcagcggtaa

SEQ ID NO: 33005 - protein, 552 aa, Erwinia rhapontici
MANWWKEAVAYQIYPRSFNDSNNDGIGDLNGITEKLDYLEDLGIDLIWICPMYQSPNDDNGYDISDYQKIMAEFGTMDDFDRLLEQVHARGMRLIIDLVVNHTSDEHPWFLASSASRDNPKRDWYIWRDGKAGAEPNNWESIFNGSAWKYSAATGQYFLHLFSEKQPDLNWENPEVRSAVYAMMRWWLDKGVDGFRIDAICHMKKEPTFSDMPNPLALPYVPSFERHLNYDGLLDYVDDMCEQVFSHYDIVTIGEMNGASAEQGEEWVGEQRGRLNMIFQFEHVKLWQDGQKDTLEASLDLPGLKEIFTRWQTLLENKGWNALYVENHDLPRVVSGWGDDKNYQRESATAIAAMFFLMKGTPFIYQGQELGMTNTHFASLEDFDDVAAKKLAVEMRRQGREEPEILAFLSRTGRENSRTPMQSDQSAHGGFSNATPWFPANSNYPVINVADQRADSGSVLNFYRALIRLRRQMPVLIEGAYQLLLPTHPQIYAYTRRLNEQQVLVIVNFSAHQQEIDPQQLLLDGWQPLLSNYQEQGKRQILRAYEAQIYQR

SEQ ID NO: 33006 - DNA, 1656 bp, Erwinia rhapontici
  CDS (1)..(1656)
atgcgcagcacaccgcactggaaagaggccgtggtttatcaggtctatccgcgcagctttatggacagtaacggcgacggtaccggcgatctcaacggtattatcagcaagctcgattacctgcaacagctcggcatcacgctgttgtggctgtcgcccgtataccgttcgccgatggacgataacggctatgacatctctgattacgaagagattgccgacatttttggttcgatgagcgacatggagcgcctgattgcagaagctaaagcgcgtgatatcgggatcctgatggatctggtggtcaaccatacctctgacgaacatccctggtttatcgacgcactgagctcaaaaaacagtgcttaccgtgacttttatatctggcgagcaccggcggcagacggcgggccgcctgatgactctcgttcgaactttggtggcagtgcctggacgcttgatgaggccagcggtgaatactacctgcatcagttttccacgcgccagcccgatctcaactgggaaaacccgcgcgttcgtgaagccatccacgccatgatgaaccgctggctggataagggcatcgggggattccgaatggacgttatcgacctgatcgggaaagaagtggatccacagatcatggcgaatggtcgtcatcctcacctgtatcttcagcagatgaaccgggcgacctttggcccgcgcggcagcgtgacggtaggggagacgtggagcgcaacgccagaagacgccctgctctacagtgccgaagagcggcaagagcggcaagagctgacgatggtctttcagtttgagcacatcaaacttttctgggatgaacagtacgggaagtggtgtaaccagccgtttgatctgttgcgctttaaggccgtgattgacaagtggcagacggcactggctgaccatggctggaactcgttgttctggagcaaccatgatttgcctcgcgcggtctccaaatttggtgacgacggtgagtatcgcgtggtatcagcaaaaatgctcgccaccgcgcttcactgccttaaaggcacaccttacatttatcagggtgaagagattggcatgaccaacgtgaattttgctgatattgacgactatcgggatattgaaagcctgaatctttatcaggagcggatcgccgaagggatgagccacgaagcgatgatgcgcggtatccacgccaacgggcccgataatgcgcgaacgccaatgcagtggacagcagtccacatgccgggtttaccaccggtcagccctggattgaggctaatcctaacttcaggacagtggaatgtcgcggctgcgcttgacgatcctgactctgttttttaccactaccagaagctggtggcattgcgtaagcagctgccgctgctggtgcacggcgacttcaggcagatcgttgtcgaacatccgcaggtgtttgcctggctgcgcacgctgggggagcagacgctggtggtgatcaataacttcacgcgagacgctgtgatgctggcgatccccgacaatctgcagagccagcagggccgttgtctcatcaacaattacgcgccacgggagcagttggagccgattatggaactgcaaccttatgaatcctttgcattacttattgagaggctgtga

SEQ ID NO: 33007 - protein, 551 aa, Erwinia rhapontici
MRSTPHWKEAVVYQVYPRSFMDSNGDGTGDLNGIISKLDYLQQLGITLLWLSPVYRSPMDDNGYDISDYEEIADIFGSMSDMERLIAEAKARDIGILMDLVVNHTSDEHPWFIDALSSKNSAYRDFYIWRAPAADGGPPDDSRSNFGGSAWTLDEASGEYYLHQFSTRQPDLNWENPRVREAIHAMMNRWLDKGIGGFRMDVIDLIGKEVDPQIMANGRHPHLYLQQMNRATFGPRGSVTVGETWSATPEDALLYSAEERQERQELTMVFQFEHIKLFWDEQYGKWCNQPFDLLRFKAVIDKWQTALADHGWNSLFWSNHDLPRAVSKFGDDGEYRVVSAKMLATALHCLKGTPYIYQGEEIGMTNVNFADIDDYRDIESLNLYQERIAEGMSHEAMMRGIHANGPDNARTPMQWTAVHMPGLPPVSPGLRLILTSGQWNVAAALDDPDSVFYHYQKLVALRKQLPLLVHGDFRQIVVEHPQVFAWLRTLGEQTLVVINNFTRDAVMLAIPDNLQSQQGRCLINNYAPREQLEPIMELQPYESFALLIERL

SEQ ID NO: 33008 - DNA, 1590 bp, Bacillus flavocaldarius
  CDS (1)..(1590)
atgagctggtggcaaagggcggtcatctaccaggtctacccccggagcttccaggacacgaacggggacggggtgggggacctcgagggcatccgcaggcggcttccctacctcaagtccttgggggtggatgccctctggctttcccccttctacaaaagccccatgaaggacttcggctacgacgtggccgactactgcgacgtggaccccgtcttcgggacccttcaggactttgaccgcctcctagaggaggcccacgccctggggcttaaggtcctcgtggacctggtgccgaaccacacctccagcgagcacccctggttcctggagtcccgcgcctcccggaatagccccaagcgggactggtacatctggaaagaccctgccccggacggcggcccccccaacaactggcagagcttcttcggcggccccgcctggaccctggacgaggccacgggccagtactacctccacctcttcctccccgagcagcccgacctcaactggcgcaatcccgaggtgcgggaggcgatcaaggaggtcatgcgcttctggctcaggaggggggtggacggcttccgggtggacgtgctctggcttctgggcaaggacccgctcttccgggacgagccgggaagccccctttggcggcccggccttcccgaccgggcccggcacgagcacctctacaccgaggaccagccggagacctacgcctacgtgcgggagatgcgccaggtcctggacgagttctccgagccggggagggagcgggtgatggtgggggagatctacctgcccttgccccgcctggtgcgctactacgccgccgggtgccacctgcccttcaacttcagcctcgtcaccgaggggctttccgactggcggcccgagaacctggcccggatcgtggagacctacgagggcctcctctcccgctgggactggcccaactgggtcctgggcaaccacgaccagccccgcctcgcctcccgcctgggggagccccaggcccgggtcgcggccatgctcctcttcaccttgaggggcacccccacctggtactacggggacgagctcgccctgcccaacggcctcatccccccggagaaggtgcaagaccctgcggccctgaggcagagggaccgggagcccaccgcctaccacaccctgggccgggaccccgagcggacgcccatgccctgggacgcctccccctacggggggttttccacggtggagccctggcttcccctgaaccccgactacaggacgcggaacgtggccgtccaggagcaagacccccgctccatgctccacctggtcaagcgcctcatcgccttgaggaaggaccccgaccttctctatggggcctaccgcacctaccgggcgagggagggggtctacgcctacctccggggggaggggtggcttgtggccctgaacctcacggagaaggagaaggccctggagcttccccgcggggggagggtggtcctttccacccacctggaccgggaggagagggtgggggagaggctcttcttgcggcccgacgagggcgtggcggtgcggctagactag

SEQ ID NO: 33009 - protein, 529 aa, Bacillus flavocaldarius
MSWWQRAVIYQVYPRSFQDTNGDGVGDLEGIRRRLPYLKSLGVDALWLSPFYKSPMKDFGYDVADYCDVDPVFGTLQDFDRLLEEAHALGLKVLVDLVPNHTSSEHPWFLESRASRNSPKRDWYIWKDPAPDGGPPNNWQSFFGGPAWTLDEATGQYYLHLFLPEQPDLNWRNPEVREAIKEVMRFWLRRGVDGFRVDVLWLLGKDPLFRDEPGSPLWRPGLPDRARHEHLYTEDQPETYAYVREMRQVLDEFSEPGRERVMVGEIYLPLPRLVRYYAAGCHLPFNFSLVTEGLSDWRPENLARIVETYEGLLSRWDWPNWVLGNHDQPRLASRLGEPQARVAAMLLFTLRGTPTWYYGDELALPNGLIPPEKVQDPAALRQRDREPTAYHTLGRDPERTPMPWDASPYGGFSTVEPWLPLNPDYRTRNVAVQEQDPRSMLHLVKRLIALRKDPDLLYGAYRTYRAREGVYAYLRGEGWLVALNLTEKEKALELPRGGRVVLSTHLDREERVGERLFLRPDEGVAVRLD
